United States Patent 11,149,256 (ADENO-ASSOCIATED VIRUS COMPOSITIONS FOR TARGETED GENE THERAPY) - sequence listing, part 2

SEQ ID NO: 17963 - DNA, 21 bp, Artificial Sequence
  Description of Artificial Sequence: Synthetic oligonucleotide
gccagcagcagcagccaacaa

SEQ ID NO: 17964 - DNA, 21 bp, Artificial Sequence
  Description of Artificial Sequence: Synthetic oligonucleotide
agcgcccccggcgacaccaaa

SEQ ID NO: 17965 - DNA, 21 bp, Artificial Sequence
  Description of Artificial Sequence: Synthetic oligonucleotide
ggcgacagccaaaaacaaggc

SEQ ID NO: 17966 - DNA, 21 bp, Artificial Sequence
  Description of Artificial Sequence: Synthetic oligonucleotide
accggcagcaccggcatgagc

SEQ ID NO: 17967 - DNA, 21 bp, Artificial Sequence
  Description of Artificial Sequence: Synthetic oligonucleotide
gggacgtcgcagccgtcgact

SEQ ID NO: 17968 - DNA, 21 bp, Artificial Sequence
  Description of Artificial Sequence: Synthetic oligonucleotide
gggacttctccgggtcataat

SEQ ID NO: 17969 - DNA, 21 bp, Artificial Sequence
  Description of Artificial Sequence: Synthetic oligonucleotide
ggggctggggaggataggcat

SEQ ID NO: 17970 - DNA, 21 bp, Artificial Sequence
  Description of Artificial Sequence: Synthetic oligonucleotide
ggttctactaagcagaatgag

SEQ ID NO: 17971 - DNA, 21 bp, Artificial Sequence
  Description of Artificial Sequence: Synthetic oligonucleotide
gatgcttctaatcctggtcgg

SEQ ID NO: 17972 - DNA, 21 bp, Artificial Sequence
  Description of Artificial Sequence: Synthetic oligonucleotide
tcgcatgctagtgctcagggt

SEQ ID NO: 17973 - DNA, 21 bp, Artificial Sequence
  Description of Artificial Sequence: Synthetic oligonucleotide
gagggtgggtctcatgttttg

SEQ ID NO: 17974 - DNA, 21 bp, Artificial Sequence
  Description of Artificial Sequence: Synthetic oligonucleotide
acgcatggtgataagcttatg

SEQ ID NO: 17975 - DNA, 21 bp, Artificial Sequence
  Description of Artificial Sequence: Synthetic oligonucleotide
ggtaatgtgtctggtcatagt

SEQ ID NO: 17976 - DNA, 21 bp, Artificial Sequence
  Description of Artificial Sequence: Synthetic oligonucleotide
tctactactactaagggtatg

SEQ ID NO: 17977 - DNA, 21 bp, Artificial Sequence
  Description of Artificial Sequence: Synthetic oligonucleotide
gaaagcaccagcggcggcaaa

SEQ ID NO: 17978 - DNA, 21 bp, Artificial Sequence
  Description of Artificial Sequence: Synthetic oligonucleotide
ggtgatgttggtaagtcggtt

SEQ ID NO: 17979 - DNA, 21 bp, Artificial Sequence
  Description of Artificial Sequence: Synthetic oligonucleotide
accagccaaacccaccccaaa

SEQ ID NO: 17980 - DNA, 21 bp, Artificial Sequence
  Description of Artificial Sequence: Synthetic oligonucleotide
gagagtagtgctagtccgcgt

SEQ ID NO: 17981 - DNA, 21 bp, Artificial Sequence
  Description of Artificial Sequence: Synthetic oligonucleotide
actcagtctacgtctggtact

SEQ ID NO: 17982 - DNA, 21 bp, Artificial Sequence
  Description of Artificial Sequence: Synthetic oligonucleotide
gccgccaacagcggcagcacc

SEQ ID NO: 17983 - DNA, 21 bp, Artificial Sequence
  Description of Artificial Sequence: Synthetic oligonucleotide
gcttcgggtagtcatgctact

SEQ ID NO: 17984 - DNA, 21 bp, Artificial Sequence
  Description of Artificial Sequence: Synthetic oligonucleotide
gagcctactgctaagggtaat

SEQ ID NO: 17985 - DNA, 21 bp, Artificial Sequence
  Description of Artificial Sequence: Synthetic oligonucleotide
tcgggttcgagtagtagtgtg

SEQ ID NO: 17986 - DNA, 21 bp, Artificial Sequence
  Description of Artificial Sequence: Synthetic oligonucleotide
aacagcggcaacagcagcggc

SEQ ID NO: 17987 - DNA, 21 bp, Artificial Sequence
  Description of Artificial Sequence: Synthetic oligonucleotide
acgggtatggataaggctctg

SEQ ID NO: 17988 - DNA, 21 bp, Artificial Sequence
  Description of Artificial Sequence: Synthetic oligonucleotide
gagggtacgggtaagcttttg

SEQ ID NO: 17989 - DNA, 21 bp, Artificial Sequence
  Description of Artificial Sequence: Synthetic oligonucleotide
gcgtcgtctcgtactcctgag

SEQ ID NO: 17990 - DNA, 21 bp, Artificial Sequence
  Description of Artificial Sequence: Synthetic oligonucleotide
aatccgaagccgtcgaatact

SEQ ID NO: 17991 - DNA, 21 bp, Artificial Sequence
  Description of Artificial Sequence: Synthetic oligonucleotide
actacggagaggtcgggtgtg

SEQ ID NO: 17992 - DNA, 21 bp, Artificial Sequence
  Description of Artificial Sequence: Synthetic oligonucleotide
ggccaaaccgacaccatgaaa

SEQ ID NO: 17993 - DNA, 21 bp, Artificial Sequence
  Description of Artificial Sequence: Synthetic oligonucleotide
caaggcagcgacaccgtcaga

SEQ ID NO: 17994 - DNA, 21 bp, Artificial Sequence
  Description of Artificial Sequence: Synthetic oligonucleotide
caccaaaacgccggcgtccaa

SEQ ID NO: 17995 - DNA, 21 bp, Artificial Sequence
  Description of Artificial Sequence: Synthetic oligonucleotide
aacggcgacagcgtccacaaa

SEQ ID NO: 17996 - DNA, 21 bp, Artificial Sequence
  Description of Artificial Sequence: Synthetic oligonucleotide
tcgtcgggtagtgctaaggag

SEQ ID NO: 17997 - DNA, 21 bp, Artificial Sequence
  Description of Artificial Sequence: Synthetic oligonucleotide
aacaccagcagcagcgccaac

SEQ ID NO: 17998 - DNA, 21 bp, Artificial Sequence
  Description of Artificial Sequence: Synthetic oligonucleotide
attatgcagaataagcagagt

SEQ ID NO: 17999 - DNA, 21 bp, Artificial Sequence
  Description of Artificial Sequence: Synthetic oligonucleotide
agttcggcgagtcctaagggg

SEQ ID NO: 18000 - DNA, 21 bp, Artificial Sequence
  Description of Artificial Sequence: Synthetic oligonucleotide
atgacggggccgagggcttcg

SEQ ID NO: 18001 - DNA, 21 bp, Artificial Sequence
  Description of Artificial Sequence: Synthetic oligonucleotide
cagggggagggtgctgggaag

SEQ ID NO: 18002 - DNA, 21 bp, Artificial Sequence
  Description of Artificial Sequence: Synthetic oligonucleotide
gatcagacgggtgcgccgcat

SEQ ID NO: 18003 - DNA, 21 bp, Artificial Sequence
  Description of Artificial Sequence: Synthetic oligonucleotide
ggtacgaaggtgactaatcag

SEQ ID NO: 18004 - DNA, 21 bp, Artificial Sequence
  Description of Artificial Sequence: Synthetic oligonucleotide
gaaaaactccaacacaccagc

SEQ ID NO: 18005 - DNA, 21 bp, Artificial Sequence
  Description of Artificial Sequence: Synthetic oligonucleotide
gaacaagccagccacaacgcc

SEQ ID NO: 18006 - DNA, 21 bp, Artificial Sequence
  Description of Artificial Sequence: Synthetic oligonucleotide
gtgcagtcgtctagtacggct

SEQ ID NO: 18007 - DNA, 21 bp, Artificial Sequence
  Description of Artificial Sequence: Synthetic oligonucleotide
agttctgcgagtcagaatgtt

SEQ ID NO: 18008 - DNA, 21 bp, Artificial Sequence
  Description of Artificial Sequence: Synthetic oligonucleotide
agcggcgccagcgccgccgcc

SEQ ID NO: 18009 - DNA, 21 bp, Artificial Sequence
  Description of Artificial Sequence: Synthetic oligonucleotide
agcgtcggcggcagcgccaac

SEQ ID NO: 18010 - DNA, 21 bp, Artificial Sequence
  Description of Artificial Sequence: Synthetic oligonucleotide
ctgcagaatagtcaggctcag

SEQ ID NO: 18011 - DNA, 21 bp, Artificial Sequence
  Description of Artificial Sequence: Synthetic oligonucleotide
gacaacgcccacaccaccagc

SEQ ID NO: 18012 - DNA, 21 bp, Artificial Sequence
  Description of Artificial Sequence: Synthetic oligonucleotide
gctcagaatccgactaatatg

SEQ ID NO: 18013 - DNA, 21 bp, Artificial Sequence
  Description of Artificial Sequence: Synthetic oligonucleotide
ggcgtcagcgacaaaaccagc

SEQ ID NO: 18014 - DNA, 21 bp, Artificial Sequence
  Description of Artificial Sequence: Synthetic oligonucleotide
aacggcagcagcagcgccacc

SEQ ID NO: 18015 - DNA, 21 bp, Artificial Sequence
  Description of Artificial Sequence: Synthetic oligonucleotide
tcttcgaatgctactatgaag

SEQ ID NO: 18016 - DNA, 21 bp, Artificial Sequence
  Description of Artificial Sequence: Synthetic oligonucleotide
gtcaccaacaaagccagcgtc

SEQ ID NO: 18017 - DNA, 21 bp, Artificial Sequence
  Description of Artificial Sequence: Synthetic oligonucleotide
agcgacgaaagagccagcacc

SEQ ID NO: 18018 - DNA, 21 bp, Artificial Sequence
  Description of Artificial Sequence: Synthetic oligonucleotide
gtcgccggcgacaaacccaac

SEQ ID NO: 18019 - DNA, 21 bp, Artificial Sequence
  Description of Artificial Sequence: Synthetic oligonucleotide
agcagcaccgaaaaacccctc

SEQ ID NO: 18020 - DNA, 21 bp, Artificial Sequence
  Description of Artificial Sequence: Synthetic oligonucleotide
gtttcgactgggaattcgaat

SEQ ID NO: 18021 - DNA, 21 bp, Artificial Sequence
  Description of Artificial Sequence: Synthetic oligonucleotide
gtcaccggcagcaacgccacc

SEQ ID NO: 18022 - DNA, 21 bp, Artificial Sequence
  Description of Artificial Sequence: Synthetic oligonucleotide
tcgagtactaagggtgagggg

SEQ ID NO: 18023 - DNA, 21 bp, Artificial Sequence
  Description of Artificial Sequence: Synthetic oligonucleotide
tcgggtgggacgtcgtctatt

SEQ ID NO: 18024 - DNA, 21 bp, Artificial Sequence
  Description of Artificial Sequence: Synthetic oligonucleotide
atggtcagcaccggcggcaaa

SEQ ID NO: 18025 - DNA, 21 bp, Artificial Sequence
  Description of Artificial Sequence: Synthetic oligonucleotide
gaaagagccaacaacaacaac

SEQ ID NO: 18026 - DNA, 21 bp, Artificial Sequence
  Description of Artificial Sequence: Synthetic oligonucleotide
gtcgccggcaccagcagcaac

SEQ ID NO: 18027 - DNA, 21 bp, Artificial Sequence
  Description of Artificial Sequence: Synthetic oligonucleotide
gacagcggccccaccagcaga

SEQ ID NO: 18028 - DNA, 21 bp, Artificial Sequence
  Description of Artificial Sequence: Synthetic oligonucleotide
acgaatatggctccgtcgacg

SEQ ID NO: 18029 - DNA, 21 bp, Artificial Sequence
  Description of Artificial Sequence: Synthetic oligonucleotide
gcgagtcagaaggcttctggt

SEQ ID NO: 18030 - DNA, 21 bp, Artificial Sequence
  Description of Artificial Sequence: Synthetic oligonucleotide
tcgagtgcggctaatagtaag

SEQ ID NO: 18031 - DNA, 21 bp, Artificial Sequence
  Description of Artificial Sequence: Synthetic oligonucleotide
accagccaaggcggcaacgcc

SEQ ID NO: 18032 - DNA, 21 bp, Artificial Sequence
  Description of Artificial Sequence: Synthetic oligonucleotide
accggcagcacccacgccgcc

SEQ ID NO: 18033 - DNA, 21 bp, Artificial Sequence
  Description of Artificial Sequence: Synthetic oligonucleotide
agtacggttgatccgaaggct

SEQ ID NO: 18034 - DNA, 21 bp, Artificial Sequence
  Description of Artificial Sequence: Synthetic oligonucleotide
gctgctgggaattcgtctaag

SEQ ID NO: 18035 - DNA, 21 bp, Artificial Sequence
  Description of Artificial Sequence: Synthetic oligonucleotide
ggggttaatggggttaaggct

SEQ ID NO: 18036 - DNA, 21 bp, Artificial Sequence
  Description of Artificial Sequence: Synthetic oligonucleotide
ggtacgaatgctccgcctagt

SEQ ID NO: 18037 - DNA, 21 bp, Artificial Sequence
  Description of Artificial Sequence: Synthetic oligonucleotide
tctgggactcaggtgtctggt

SEQ ID NO: 18038 - DNA, 21 bp, Artificial Sequence
  Description of Artificial Sequence: Synthetic oligonucleotide
agccacggcagccccaccagc

SEQ ID NO: 18039 - DNA, 21 bp, Artificial Sequence
  Description of Artificial Sequence: Synthetic oligonucleotide
gggatgtctaaggaggctagc

SEQ ID NO: 18040 - DNA, 21 bp, Artificial Sequence
  Description of Artificial Sequence: Synthetic oligonucleotide
tcgtcgtctggtgggtctcag

SEQ ID NO: 18041 - DNA, 21 bp, Artificial Sequence
  Description of Artificial Sequence: Synthetic oligonucleotide
caacaagccaccccccacggc

SEQ ID NO: 18042 - DNA, 21 bp, Artificial Sequence
  Description of Artificial Sequence: Synthetic oligonucleotide
ggtgttgggaatcctgttaat

SEQ ID NO: 18043 - DNA, 21 bp, Artificial Sequence
  Description of Artificial Sequence: Synthetic oligonucleotide
gccagcaccggcgaacccaaa

SEQ ID NO: 18044 - DNA, 21 bp, Artificial Sequence
  Description of Artificial Sequence: Synthetic oligonucleotide
ggcagccccaacggcaacgtc

SEQ ID NO: 18045 - DNA, 21 bp, Artificial Sequence
  Description of Artificial Sequence: Synthetic oligonucleotide
aaccaacccaccaccgccggc

SEQ ID NO: 18046 - DNA, 21 bp, Artificial Sequence
  Description of Artificial Sequence: Synthetic oligonucleotide
caaaaaggcgacagaagcaac

SEQ ID NO: 18047 - DNA, 21 bp, Artificial Sequence
  Description of Artificial Sequence: Synthetic oligonucleotide
ctcgccaccggcaaagacggc

SEQ ID NO: 18048 - DNA, 21 bp, Artificial Sequence
  Description of Artificial Sequence: Synthetic oligonucleotide
gaacaaagcaaaatcgccgtc

SEQ ID NO: 18049 - DNA, 21 bp, Artificial Sequence
  Description of Artificial Sequence: Synthetic oligonucleotide
gccaacaccaaacaaacccaa

SEQ ID NO: 18050 - DNA, 21 bp, Artificial Sequence
  Description of Artificial Sequence: Synthetic oligonucleotide
gtttcttcgggtcagcctgct

SEQ ID NO: 18051 - DNA, 21 bp, Artificial Sequence
  Description of Artificial Sequence: Synthetic oligonucleotide
agcagcggcaccagcaccaaa

SEQ ID NO: 18052 - DNA, 21 bp, Artificial Sequence
  Description of Artificial Sequence: Synthetic oligonucleotide
actgatcagaagacgtctgtg

SEQ ID NO: 18053 - DNA, 21 bp, Artificial Sequence
  Description of Artificial Sequence: Synthetic oligonucleotide
gccagcacccaaggcaacagc

SEQ ID NO: 18054 - DNA, 21 bp, Artificial Sequence
  Description of Artificial Sequence: Synthetic oligonucleotide
gatagtgataaggtgcgtaat

SEQ ID NO: 18055 - DNA, 21 bp, Artificial Sequence
  Description of Artificial Sequence: Synthetic oligonucleotide
aaggagggtacggcgaatagg

SEQ ID NO: 18056 - DNA, 21 bp, Artificial Sequence
  Description of Artificial Sequence: Synthetic oligonucleotide
agtacgagttcgcagagtgtt

SEQ ID NO: 18057 - DNA, 21 bp, Artificial Sequence
  Description of Artificial Sequence: Synthetic oligonucleotide
ggggtgtcttcgaagtctaat

SEQ ID NO: 18058 - DNA, 21 bp, Artificial Sequence
  Description of Artificial Sequence: Synthetic oligonucleotide
tatcctgctggtgataagggg

SEQ ID NO: 18059 - DNA, 21 bp, Artificial Sequence
  Description of Artificial Sequence: Synthetic oligonucleotide
gctcatgcgaaggagtcgggt

SEQ ID NO: 18060 - DNA, 21 bp, Artificial Sequence
  Description of Artificial Sequence: Synthetic oligonucleotide
cagaattctacttcggctagt

SEQ ID NO: 18061 - DNA, 21 bp, Artificial Sequence
  Description of Artificial Sequence: Synthetic oligonucleotide
ggggctgatcctactagtcgg

SEQ ID NO: 18062 - DNA, 21 bp, Artificial Sequence
  Description of Artificial Sequence: Synthetic oligonucleotide
agccaagtcaacagcagcaaa

SEQ ID NO: 18063 - DNA, 21 bp, Artificial Sequence
  Description of Artificial Sequence: Synthetic oligonucleotide
gacagcagaaaccccaacgcc

SEQ ID NO: 18064 - DNA, 21 bp, Artificial Sequence
  Description of Artificial Sequence: Synthetic oligonucleotide
gacagcggcagcgccagcgtc

SEQ ID NO: 18065 - DNA, 21 bp, Artificial Sequence
  Description of Artificial Sequence: Synthetic oligonucleotide
gccaacccccccaccagcggc

SEQ ID NO: 18066 - DNA, 21 bp, Artificial Sequence
  Description of Artificial Sequence: Synthetic oligonucleotide
ggccaaggcgacagactcacc

SEQ ID NO: 18067 - DNA, 21 bp, Artificial Sequence
  Description of Artificial Sequence: Synthetic oligonucleotide
agtgggcgtgattcgagtggt

SEQ ID NO: 18068 - DNA, 21 bp, Artificial Sequence
  Description of Artificial Sequence: Synthetic oligonucleotide
gggggtaattctacgagtaat

SEQ ID NO: 18069 - DNA, 21 bp, Artificial Sequence
  Description of Artificial Sequence: Synthetic oligonucleotide
gggttgggggatgggcgtcag

SEQ ID NO: 18070 - DNA, 21 bp, Artificial Sequence
  Description of Artificial Sequence: Synthetic oligonucleotide
tctgctagtggtagtactcag

SEQ ID NO: 18071 - DNA, 21 bp, Artificial Sequence
  Description of Artificial Sequence: Synthetic oligonucleotide
agagccgaaaacagccccacc

SEQ ID NO: 18072 - DNA, 21 bp, Artificial Sequence
  Description of Artificial Sequence: Synthetic oligonucleotide
gttacggattcgaagagtttg

SEQ ID NO: 18073 - DNA, 21 bp, Artificial Sequence
  Description of Artificial Sequence: Synthetic oligonucleotide
aaaaacggcagcagcagcggc

SEQ ID NO: 18074 - DNA, 21 bp, Artificial Sequence
  Description of Artificial Sequence: Synthetic oligonucleotide
gacagcaaaagcaacctcaac

SEQ ID NO: 18075 - DNA, 21 bp, Artificial Sequence
  Description of Artificial Sequence: Synthetic oligonucleotide
agcgccaacgacaaaagagtc

SEQ ID NO: 18076 - DNA, 21 bp, Artificial Sequence
  Description of Artificial Sequence: Synthetic oligonucleotide
gcgacgaaggagcagagtcat

SEQ ID NO: 18077 - DNA, 21 bp, Artificial Sequence
  Description of Artificial Sequence: Synthetic oligonucleotide
agcaacgaccccagcgtcaaa

SEQ ID NO: 18078 - DNA, 21 bp, Artificial Sequence
  Description of Artificial Sequence: Synthetic oligonucleotide
ctcacccaagacaaacccagc

SEQ ID NO: 18079 - DNA, 21 bp, Artificial Sequence
  Description of Artificial Sequence: Synthetic oligonucleotide
catggtggtactagtagtagt

SEQ ID NO: 18080 - DNA, 21 bp, Artificial Sequence
  Description of Artificial Sequence: Synthetic oligonucleotide
ggtgttgataaggctaatttg

SEQ ID NO: 18081 - DNA, 21 bp, Artificial Sequence
  Description of Artificial Sequence: Synthetic oligonucleotide
aatcatgttacgaagcctacg

SEQ ID NO: 18082 - DNA, 21 bp, Artificial Sequence
  Description of Artificial Sequence: Synthetic oligonucleotide
agcagagacaccaaaaacaac

SEQ ID NO: 18083 - DNA, 21 bp, Artificial Sequence
  Description of Artificial Sequence: Synthetic oligonucleotide
gaaggcgccagcaaactcccc

SEQ ID NO: 18084 - DNA, 21 bp, Artificial Sequence
  Description of Artificial Sequence: Synthetic oligonucleotide
tcgacttctcctcagaatgct

SEQ ID NO: 18085 - DNA, 21 bp, Artificial Sequence
  Description of Artificial Sequence: Synthetic oligonucleotide
tacggcgacaaaaccaaaagc

SEQ ID NO: 18086 - DNA, 21 bp, Artificial Sequence
  Description of Artificial Sequence: Synthetic oligonucleotide
accagaaacgccaccagcgtc

SEQ ID NO: 18087 - DNA, 21 bp, Artificial Sequence
  Description of Artificial Sequence: Synthetic oligonucleotide
atgagcaccgaaagaagcggc

SEQ ID NO: 18088 - DNA, 21 bp, Artificial Sequence
  Description of Artificial Sequence: Synthetic oligonucleotide
attcaggctagtggggcgcag

SEQ ID NO: 18089 - DNA, 21 bp, Artificial Sequence
  Description of Artificial Sequence: Synthetic oligonucleotide
cagtcgcagggtgcgagtatg

SEQ ID NO: 18090 - DNA, 21 bp, Artificial Sequence
  Description of Artificial Sequence: Synthetic oligonucleotide
gcggagaagggtgcgtctagt

SEQ ID NO: 18091 - DNA, 21 bp, Artificial Sequence
  Description of Artificial Sequence: Synthetic oligonucleotide
tctgcgggtcagggtttgggt

SEQ ID NO: 18092 - DNA, 21 bp, Artificial Sequence
  Description of Artificial Sequence: Synthetic oligonucleotide
aacgccagcagcaaaggcacc

SEQ ID NO: 18093 - DNA, 21 bp, Artificial Sequence
  Description of Artificial Sequence: Synthetic oligonucleotide
actgctgggagttctaggggt

SEQ ID NO: 18094 - DNA, 21 bp, Artificial Sequence
  Description of Artificial Sequence: Synthetic oligonucleotide
ttgactaagacggggtctgcg

SEQ ID NO: 18095 - DNA, 21 bp, Artificial Sequence
  Description of Artificial Sequence: Synthetic oligonucleotide
ggtagttctcggcctagtgag

SEQ ID NO: 18096 - DNA, 21 bp, Artificial Sequence
  Description of Artificial Sequence: Synthetic oligonucleotide
ggtactgatcagggtcgtagt

SEQ ID NO: 18097 - DNA, 21 bp, Artificial Sequence
  Description of Artificial Sequence: Synthetic oligonucleotide
agcaccggcgccgccaccacc

SEQ ID NO: 18098 - DNA, 21 bp, Artificial Sequence
  Description of Artificial Sequence: Synthetic oligonucleotide
gcttcgactggtcagtctgtt

SEQ ID NO: 18099 - DNA, 21 bp, Artificial Sequence
  Description of Artificial Sequence: Synthetic oligonucleotide
gggattggtaataagccgaat

SEQ ID NO: 18100 - DNA, 21 bp, Artificial Sequence
  Description of Artificial Sequence: Synthetic oligonucleotide
gccaccgccagaccccccggc

SEQ ID NO: 18101 - DNA, 21 bp, Artificial Sequence
  Description of Artificial Sequence: Synthetic oligonucleotide
aatactgcgccggctaagggt

SEQ ID NO: 18102 - DNA, 21 bp, Artificial Sequence
  Description of Artificial Sequence: Synthetic oligonucleotide
ctggggggtaatgggcagggt

SEQ ID NO: 18103 - DNA, 21 bp, Artificial Sequence
  Description of Artificial Sequence: Synthetic oligonucleotide
aacggcgtcgcccccgccggc

SEQ ID NO: 18104 - DNA, 21 bp, Artificial Sequence
  Description of Artificial Sequence: Synthetic oligonucleotide
acgagtgggagttctccgaag

SEQ ID NO: 18105 - DNA, 21 bp, Artificial Sequence
  Description of Artificial Sequence: Synthetic oligonucleotide
ctcaccggccccagcgccggc

SEQ ID NO: 18106 - DNA, 21 bp, Artificial Sequence
  Description of Artificial Sequence: Synthetic oligonucleotide
gaccaaagagaaaaaggcgcc

SEQ ID NO: 18107 - DNA, 21 bp, Artificial Sequence
  Description of Artificial Sequence: Synthetic oligonucleotide
gaccaaggcagaacccccggc

SEQ ID NO: 18108 - DNA, 21 bp, Artificial Sequence
  Description of Artificial Sequence: Synthetic oligonucleotide
gccggcgacaaaagcccctac

SEQ ID NO: 18109 - DNA, 21 bp, Artificial Sequence
  Description of Artificial Sequence: Synthetic oligonucleotide
ggcgccatcaaacccaccggc

SEQ ID NO: 18110 - DNA, 21 bp, Artificial Sequence
  Description of Artificial Sequence: Synthetic oligonucleotide
ggtcatactgatattaagggt

SEQ ID NO: 18111 - DNA, 21 bp, Artificial Sequence
  Description of Artificial Sequence: Synthetic oligonucleotide
gtcgccggcatggaaaaaggc

SEQ ID NO: 18112 - DNA, 21 bp, Artificial Sequence
  Description of Artificial Sequence: Synthetic oligonucleotide
tcgcctacgacgactaatttg

SEQ ID NO: 18113 - DNA, 21 bp, Artificial Sequence
  Description of Artificial Sequence: Synthetic oligonucleotide
ttgcagggtagtaatagtgct

SEQ ID NO: 18114 - DNA, 21 bp, Artificial Sequence
  Description of Artificial Sequence: Synthetic oligonucleotide
aaccaagaaagacccaacgcc

SEQ ID NO: 18115 - DNA, 21 bp, Artificial Sequence
  Description of Artificial Sequence: Synthetic oligonucleotide
aacgccgccaaaaccatgggc

SEQ ID NO: 18116 - DNA, 21 bp, Artificial Sequence
  Description of Artificial Sequence: Synthetic oligonucleotide
accaccggcaacgccggcctc

SEQ ID NO: 18117 - DNA, 21 bp, Artificial Sequence
  Description of Artificial Sequence: Synthetic oligonucleotide
accagagacagcaccagagcc

SEQ ID NO: 18118 - DNA, 21 bp, Artificial Sequence
  Description of Artificial Sequence: Synthetic oligonucleotide
agcagaaccaacgccaacatg

SEQ ID NO: 18119 - DNA, 21 bp, Artificial Sequence
  Description of Artificial Sequence: Synthetic oligonucleotide
caaatcagacccagcgacggc

SEQ ID NO: 18120 - DNA, 21 bp, Artificial Sequence
  Description of Artificial Sequence: Synthetic oligonucleotide
aacagagacagcagcgccagc

SEQ ID NO: 18121 - DNA, 21 bp, Artificial Sequence
  Description of Artificial Sequence: Synthetic oligonucleotide
aagggtggtgggaatagtagt

SEQ ID NO: 18122 - DNA, 21 bp, Artificial Sequence
  Description of Artificial Sequence: Synthetic oligonucleotide
aataatacgccttctactact

SEQ ID NO: 18123 - DNA, 21 bp, Artificial Sequence
  Description of Artificial Sequence: Synthetic oligonucleotide
actagttcgtctgcgcatacg

SEQ ID NO: 18124 - DNA, 21 bp, Artificial Sequence
  Description of Artificial Sequence: Synthetic oligonucleotide
ggcgccagcgaccaacccaga

SEQ ID NO: 18125 - DNA, 21 bp, Artificial Sequence
  Description of Artificial Sequence: Synthetic oligonucleotide
cagtcttctacgactaatact

SEQ ID NO: 18126 - DNA, 21 bp, Artificial Sequence
  Description of Artificial Sequence: Synthetic oligonucleotide
tcgggggagggttcgggtcgt

SEQ ID NO: 18127 - DNA, 21 bp, Artificial Sequence
  Description of Artificial Sequence: Synthetic oligonucleotide
atcgtcggcggcgccggcgcc

SEQ ID NO: 18128 - DNA, 21 bp, Artificial Sequence
  Description of Artificial Sequence: Synthetic oligonucleotide
ggtacggtggatacgaggact

SEQ ID NO: 18129 - DNA, 21 bp, Artificial Sequence
  Description of Artificial Sequence: Synthetic oligonucleotide
tcttctgatagtaatccgagg

SEQ ID NO: 18130 - DNA, 21 bp, Artificial Sequence
  Description of Artificial Sequence: Synthetic oligonucleotide
ggcagcgccaccaccatcaaa

SEQ ID NO: 18131 - DNA, 21 bp, Artificial Sequence
  Description of Artificial Sequence: Synthetic oligonucleotide
catacggggactcctacggtg

SEQ ID NO: 18132 - DNA, 21 bp, Artificial Sequence
  Description of Artificial Sequence: Synthetic oligonucleotide
gacggccccagaagcgacaaa

SEQ ID NO: 18133 - DNA, 21 bp, Artificial Sequence
  Description of Artificial Sequence: Synthetic oligonucleotide
tcgagtactgctgaggtgaag

SEQ ID NO: 18134 - DNA, 21 bp, Artificial Sequence
  Description of Artificial Sequence: Synthetic oligonucleotide
accggcagcggcggcagcgcc

SEQ ID NO: 18135 - DNA, 21 bp, Artificial Sequence
  Description of Artificial Sequence: Synthetic oligonucleotide
aacggcagcagcaccaccaac

SEQ ID NO: 18136 - DNA, 21 bp, Artificial Sequence
  Description of Artificial Sequence: Synthetic oligonucleotide
cttggtcaggcttcgcatggt

SEQ ID NO: 18137 - DNA, 21 bp, Artificial Sequence
  Description of Artificial Sequence: Synthetic oligonucleotide
ctgcaggataagccggcgggg

SEQ ID NO: 18138 - DNA, 21 bp, Artificial Sequence
  Description of Artificial Sequence: Synthetic oligonucleotide
tcgaataataattctgcttct

SEQ ID NO: 18139 - DNA, 21 bp, Artificial Sequence
  Description of Artificial Sequence: Synthetic oligonucleotide
aaccaaagccccgccgtccaa

SEQ ID NO: 18140 - DNA, 21 bp, Artificial Sequence
  Description of Artificial Sequence: Synthetic oligonucleotide
gacagcttcaaaagcggcagc

SEQ ID NO: 18141 - DNA, 21 bp, Artificial Sequence
  Description of Artificial Sequence: Synthetic oligonucleotide
ggcacccaagacggcaccaga

SEQ ID NO: 18142 - DNA, 21 bp, Artificial Sequence
  Description of Artificial Sequence: Synthetic oligonucleotide
gtgacgggggcgaatcctaat

SEQ ID NO: 18143 - DNA, 21 bp, Artificial Sequence
  Description of Artificial Sequence: Synthetic oligonucleotide
tcgactggggcttcttctcat

SEQ ID NO: 18144 - DNA, 21 bp, Artificial Sequence
  Description of Artificial Sequence: Synthetic oligonucleotide
gcccaaagcaaagaaaacacc

SEQ ID NO: 18145 - DNA, 21 bp, Artificial Sequence
  Description of Artificial Sequence: Synthetic oligonucleotide
accaaacaagccacccccctc

SEQ ID NO: 18146 - DNA, 21 bp, Artificial Sequence
  Description of Artificial Sequence: Synthetic oligonucleotide
acgtcggagcaggttgctcgg

SEQ ID NO: 18147 - DNA, 21 bp, Artificial Sequence
  Description of Artificial Sequence: Synthetic oligonucleotide
agtagtggtgagaaggcgctt

SEQ ID NO: 18148 - DNA, 21 bp, Artificial Sequence
  Description of Artificial Sequence: Synthetic oligonucleotide
atcggcggcaccgccgccggc

SEQ ID NO: 18149 - DNA, 21 bp, Artificial Sequence
  Description of Artificial Sequence: Synthetic oligonucleotide
ctcaccaccagcaccaacgcc

SEQ ID NO: 18150 - DNA, 21 bp, Artificial Sequence
  Description of Artificial Sequence: Synthetic oligonucleotide
tatggtagtaagggtagtgct

SEQ ID NO: 18151 - DNA, 21 bp, Artificial Sequence
  Description of Artificial Sequence: Synthetic oligonucleotide
acgtctggtaagaataataat

SEQ ID NO: 18152 - DNA, 21 bp, Artificial Sequence
  Description of Artificial Sequence: Synthetic oligonucleotide
ggcagcaaaagcggcgtcgcc

SEQ ID NO: 18153 - DNA, 21 bp, Artificial Sequence
  Description of Artificial Sequence: Synthetic oligonucleotide
agcggcagcggcgacaaaagc

SEQ ID NO: 18154 - DNA, 21 bp, Artificial Sequence
  Description of Artificial Sequence: Synthetic oligonucleotide
atgaacaacaccagcaacaaa

SEQ ID NO: 18155 - DNA, 21 bp, Artificial Sequence
  Description of Artificial Sequence: Synthetic oligonucleotide
gataatggtaaggctattgct

SEQ ID NO: 18156 - DNA, 21 bp, Artificial Sequence
  Description of Artificial Sequence: Synthetic oligonucleotide
actaatgttgataaggctagt

SEQ ID NO: 18157 - DNA, 21 bp, Artificial Sequence
  Description of Artificial Sequence: Synthetic oligonucleotide
atgcctggtgagactaagggg

SEQ ID NO: 18158 - DNA, 21 bp, Artificial Sequence
  Description of Artificial Sequence: Synthetic oligonucleotide
caagccaaccaaggcggcaac

SEQ ID NO: 18159 - DNA, 21 bp, Artificial Sequence
  Description of Artificial Sequence: Synthetic oligonucleotide
gaaagaagcaccagcagcacc

SEQ ID NO: 18160 - DNA, 21 bp, Artificial Sequence
  Description of Artificial Sequence: Synthetic oligonucleotide
ctcgccagagacaaaagcgtc

SEQ ID NO: 18161 - DNA, 21 bp, Artificial Sequence
  Description of Artificial Sequence: Synthetic oligonucleotide
accggcagcagcagccccgtc

SEQ ID NO: 18162 - DNA, 21 bp, Artificial Sequence
  Description of Artificial Sequence: Synthetic oligonucleotide
gaaagcagcacccccgccaga

SEQ ID NO: 18163 - DNA, 21 bp, Artificial Sequence
  Description of Artificial Sequence: Synthetic oligonucleotide
agcgccagccccagcacccaa

SEQ ID NO: 18164 - DNA, 21 bp, Artificial Sequence
  Description of Artificial Sequence: Synthetic oligonucleotide
aacaacgcccaaggcagcagc

SEQ ID NO: 18165 - DNA, 21 bp, Artificial Sequence
  Description of Artificial Sequence: Synthetic oligonucleotide
gatgcgcagcgtcctactgct

SEQ ID NO: 18166 - DNA, 21 bp, Artificial Sequence
  Description of Artificial Sequence: Synthetic oligonucleotide
gatacgacggctaagcagggg

SEQ ID NO: 18167 - DNA, 21 bp, Artificial Sequence
  Description of Artificial Sequence: Synthetic oligonucleotide
gcgggtggtaataatgctcat

SEQ ID NO: 18168 - DNA, 21 bp, Artificial Sequence
  Description of Artificial Sequence: Synthetic oligonucleotide
gccagcaaaggcaacagcctc

SEQ ID NO: 18169 - DNA, 21 bp, Artificial Sequence
  Description of Artificial Sequence: Synthetic oligonucleotide
ggtgataaggctaatgcgcat

SEQ ID NO: 18170 - DNA, 21 bp, Artificial Sequence
  Description of Artificial Sequence: Synthetic oligonucleotide
gagcctggggcggctattaag

SEQ ID NO: 18171 - DNA, 21 bp, Artificial Sequence
  Description of Artificial Sequence: Synthetic oligonucleotide
attagtgataagacgccgcag

SEQ ID NO: 18172 - DNA, 21 bp, Artificial Sequence
  Description of Artificial Sequence: Synthetic oligonucleotide
tttagtaatgcgaagaatggg

SEQ ID NO: 18173 - DNA, 21 bp, Artificial Sequence
  Description of Artificial Sequence: Synthetic oligonucleotide
accagcgaacacaaaagccaa

SEQ ID NO: 18174 - DNA, 21 bp, Artificial Sequence
  Description of Artificial Sequence: Synthetic oligonucleotide
acgggtgggaatggttttgct

SEQ ID NO: 18175 - DNA, 21 bp, Artificial Sequence
  Description of Artificial Sequence: Synthetic oligonucleotide
agtagtaagccttcggcggct

SEQ ID NO: 18176 - DNA, 21 bp, Artificial Sequence
  Description of Artificial Sequence: Synthetic oligonucleotide
gtcggcaaaagcgaactcacc

SEQ ID NO: 18177 - DNA, 21 bp, Artificial Sequence
  Description of Artificial Sequence: Synthetic oligonucleotide
aacagcagaacccccagcacc

SEQ ID NO: 18178 - DNA, 21 bp, Artificial Sequence
  Description of Artificial Sequence: Synthetic oligonucleotide
acggggcaggagaggtcttct

SEQ ID NO: 18179 - DNA, 21 bp, Artificial Sequence
  Description of Artificial Sequence: Synthetic oligonucleotide
aattctgcggggagtaattct

SEQ ID NO: 18180 - DNA, 21 bp, Artificial Sequence
  Description of Artificial Sequence: Synthetic oligonucleotide
agcggcagcaacaccgtccaa

SEQ ID NO: 18181 - DNA, 21 bp, Artificial Sequence
  Description of Artificial Sequence: Synthetic oligonucleotide
agttctacgaaggtggctcag

SEQ ID NO: 18182 - DNA, 21 bp, Artificial Sequence
  Description of Artificial Sequence: Synthetic oligonucleotide
gcttctgggggttctcgtact

SEQ ID NO: 18183 - DNA, 21 bp, Artificial Sequence
  Description of Artificial Sequence: Synthetic oligonucleotide
cagagttctactagtcaggtg

SEQ ID NO: 18184 - DNA, 21 bp, Artificial Sequence
  Description of Artificial Sequence: Synthetic oligonucleotide
aatgtggggaatcctgtgtcg

SEQ ID NO: 18185 - DNA, 21 bp, Artificial Sequence
  Description of Artificial Sequence: Synthetic oligonucleotide
agcaacaccgccagcgccagc

SEQ ID NO: 18186 - DNA, 21 bp, Artificial Sequence
  Description of Artificial Sequence: Synthetic oligonucleotide
gaaggcacccaccccatcgtc

SEQ ID NO: 18187 - DNA, 21 bp, Artificial Sequence
  Description of Artificial Sequence: Synthetic oligonucleotide
gccgtcgccggcgccaaagcc

SEQ ID NO: 18188 - DNA, 21 bp, Artificial Sequence
  Description of Artificial Sequence: Synthetic oligonucleotide
ggcgaaagcggccccaaaagc

SEQ ID NO: 18189 - DNA, 21 bp, Artificial Sequence
  Description of Artificial Sequence: Synthetic oligonucleotide
actcatggtaagactccggtt

SEQ ID NO: 18190 - DNA, 21 bp, Artificial Sequence
  Description of Artificial Sequence: Synthetic oligonucleotide
gtcgccagccaaacccaagcc

SEQ ID NO: 18191 - DNA, 21 bp, Artificial Sequence
  Description of Artificial Sequence: Synthetic oligonucleotide
agcagcaccaccagcgtccac

SEQ ID NO: 18192 - DNA, 21 bp, Artificial Sequence
  Description of Artificial Sequence: Synthetic oligonucleotide
tcggggacgagttcgttgcag

SEQ ID NO: 18193 - DNA, 21 bp, Artificial Sequence
  Description of Artificial Sequence: Synthetic oligonucleotide
agtagtggggcgagtaattcg

SEQ ID NO: 18194 - DNA, 21 bp, Artificial Sequence
  Description of Artificial Sequence: Synthetic oligonucleotide
cagaataagccgggttctgtt

SEQ ID NO: 18195 - DNA, 21 bp, Artificial Sequence
  Description of Artificial Sequence: Synthetic oligonucleotide
accaccggcagcgccgccctc

SEQ ID NO: 18196 - DNA, 21 bp, Artificial Sequence
  Description of Artificial Sequence: Synthetic oligonucleotide
aacgtcagacaaaccaacgaa

SEQ ID NO: 18197 - DNA, 21 bp, Artificial Sequence
  Description of Artificial Sequence: Synthetic oligonucleotide
gaccaaggcaccagcaccctc

SEQ ID NO: 18198 - DNA, 21 bp, Artificial Sequence
  Description of Artificial Sequence: Synthetic oligonucleotide
gtcagcggccaagtcagcagc

SEQ ID NO: 18199 - DNA, 21 bp, Artificial Sequence
  Description of Artificial Sequence: Synthetic oligonucleotide
aacctcaaaagcagccccagc

SEQ ID NO: 18200 - DNA, 21 bp, Artificial Sequence
  Description of Artificial Sequence: Synthetic oligonucleotide
aacagcggcgacgcccaacac

SEQ ID NO: 18201 - DNA, 21 bp, Artificial Sequence
  Description of Artificial Sequence: Synthetic oligonucleotide
ggtactgcgggggctatgtcg

SEQ ID NO: 18202 - DNA, 21 bp, Artificial Sequence
  Description of Artificial Sequence: Synthetic oligonucleotide
accaaagacaaaggcatgacc

SEQ ID NO: 18203 - DNA, 21 bp, Artificial Sequence
  Description of Artificial Sequence: Synthetic oligonucleotide
gccaacaccaaagacggcaga

SEQ ID NO: 18204 - DNA, 21 bp, Artificial Sequence
  Description of Artificial Sequence: Synthetic oligonucleotide
aacggcaacctcagcaccggc

SEQ ID NO: 18205 - DNA, 21 bp, Artificial Sequence
  Description of Artificial Sequence: Synthetic oligonucleotide
accagcaaaggcaacagcggc

SEQ ID NO: 18206 - DNA, 21 bp, Artificial Sequence
  Description of Artificial Sequence: Synthetic oligonucleotide
agcaccagccccagcggcggc

SEQ ID NO: 18207 - DNA, 21 bp, Artificial Sequence
  Description of Artificial Sequence: Synthetic oligonucleotide
agcggcagccccggcgccggc

SEQ ID NO: 18208 - DNA, 21 bp, Artificial Sequence
  Description of Artificial Sequence: Synthetic oligonucleotide
caacaaagcagcggcaccggc

SEQ ID NO: 18209 - DNA, 21 bp, Artificial Sequence
  Description of Artificial Sequence: Synthetic oligonucleotide
gatgtgacggctaagaatgcg

SEQ ID NO: 18210 - DNA, 21 bp, Artificial Sequence
  Description of Artificial Sequence: Synthetic oligonucleotide
gccagcgacaaaagcgccggc

SEQ ID NO: 18211 - DNA, 21 bp, Artificial Sequence
  Description of Artificial Sequence: Synthetic oligonucleotide
gctccgacggagggtgggcgt

SEQ ID NO: 18212 - DNA, 21 bp, Artificial Sequence
  Description of Artificial Sequence: Synthetic oligonucleotide
ggcagccccaacggccacgcc

SEQ ID NO: 18213 - DNA, 21 bp, Artificial Sequence
  Description of Artificial Sequence: Synthetic oligonucleotide
ggcggcaccgaaaaactcagc

SEQ ID NO: 18214 - DNA, 21 bp, Artificial Sequence
  Description of Artificial Sequence: Synthetic oligonucleotide
gtcagaaacagcgccaccgaa

SEQ ID NO: 18215 - DNA, 21 bp, Artificial Sequence
  Description of Artificial Sequence: Synthetic oligonucleotide
ttggatgggaagtctgtttcg

SEQ ID NO: 18216 - DNA, 21 bp, Artificial Sequence
  Description of Artificial Sequence: Synthetic oligonucleotide
ggcgccgaaaccaacagagtc

SEQ ID NO: 18217 - DNA, 21 bp, Artificial Sequence
  Description of Artificial Sequence: Synthetic oligonucleotide
atgcagactaagcagcctggg

SEQ ID NO: 18218 - DNA, 21 bp, Artificial Sequence
  Description of Artificial Sequence: Synthetic oligonucleotide
cttggtacgcagaatgtgacg

SEQ ID NO: 18219 - DNA, 21 bp, Artificial Sequence
  Description of Artificial Sequence: Synthetic oligonucleotide
gaccaacaaagcaacctcaaa

SEQ ID NO: 18220 - DNA, 21 bp, Artificial Sequence
  Description of Artificial Sequence: Synthetic oligonucleotide
ggtcctgggagtggtagtacg

SEQ ID NO: 18221 - DNA, 21 bp, Artificial Sequence
  Description of Artificial Sequence: Synthetic oligonucleotide
caaggcagcaacccccccacc

SEQ ID NO: 18222 - DNA, 21 bp, Artificial Sequence
  Description of Artificial Sequence: Synthetic oligonucleotide
gacgacgccagccaaaaactc

SEQ ID NO: 18223 - DNA, 21 bp, Artificial Sequence
  Description of Artificial Sequence: Synthetic oligonucleotide
ggcaacgtcagcaaaggcggc

SEQ ID NO: 18224 - DNA, 21 bp, Artificial Sequence
  Description of Artificial Sequence: Synthetic oligonucleotide
ggcgccgacaccaaagcccac

SEQ ID NO: 18225 - DNA, 21 bp, Artificial Sequence
  Description of Artificial Sequence: Synthetic oligonucleotide
atgggtagtaatcctccgaat

SEQ ID NO: 18226 - DNA, 21 bp, Artificial Sequence
  Description of Artificial Sequence: Synthetic oligonucleotide
aagagtggtacgcatccggat

SEQ ID NO: 18227 - DNA, 21 bp, Artificial Sequence
  Description of Artificial Sequence: Synthetic oligonucleotide
gaagtcagccccaaaaccagc

SEQ ID NO: 18228 - DNA, 21 bp, Artificial Sequence
  Description of Artificial Sequence: Synthetic oligonucleotide
gattcgacggcgttgagtaag

SEQ ID NO: 18229 - DNA, 21 bp, Artificial Sequence
  Description of Artificial Sequence: Synthetic oligonucleotide
agagacggcggcaaaggcagc

SEQ ID NO: 18230 - DNA, 21 bp, Artificial Sequence
  Description of Artificial Sequence: Synthetic oligonucleotide
agtaatttgtcgacgccgaag

SEQ ID NO: 18231 - DNA, 21 bp, Artificial Sequence
  Description of Artificial Sequence: Synthetic oligonucleotide
aaaagcacccccagcgccgtc

SEQ ID NO: 18232 - DNA, 21 bp, Artificial Sequence
  Description of Artificial Sequence: Synthetic oligonucleotide
ggcaacgcccaaagccccgtc

SEQ ID NO: 18233 - DNA, 21 bp, Artificial Sequence
  Description of Artificial Sequence: Synthetic oligonucleotide
ggcgtcaccaacagcgccgcc

SEQ ID NO: 18234 - DNA, 21 bp, Artificial Sequence
  Description of Artificial Sequence: Synthetic oligonucleotide
tttactgatagtaaggcttct

SEQ ID NO: 18235 - DNA, 21 bp, Artificial Sequence
  Description of Artificial Sequence: Synthetic oligonucleotide
agcaacaacagcaccatcaaa

SEQ ID NO: 18236 - DNA, 21 bp, Artificial Sequence
  Description of Artificial Sequence: Synthetic oligonucleotide
atgcccctcgaaagcagcaaa

SEQ ID NO: 18237 - DNA, 21 bp, Artificial Sequence
  Description of Artificial Sequence: Synthetic oligonucleotide
accggcaaacaaagcggcagc

SEQ ID NO: 18238 - DNA, 21 bp, Artificial Sequence
  Description of Artificial Sequence: Synthetic oligonucleotide
gtccccaacggcagccccaac

SEQ ID NO: 18239 - DNA, 21 bp, Artificial Sequence
  Description of Artificial Sequence: Synthetic oligonucleotide
aacggcaccgcccaaaacctc

SEQ ID NO: 18240 - DNA, 21 bp, Artificial Sequence
  Description of Artificial Sequence: Synthetic oligonucleotide
agtatgaataagtctgggttg

SEQ ID NO: 18241 - DNA, 21 bp, Artificial Sequence
  Description of Artificial Sequence: Synthetic oligonucleotide
ttggcggataagggtactgct

SEQ ID NO: 18242 - DNA, 21 bp, Artificial Sequence
  Description of Artificial Sequence: Synthetic oligonucleotide
aacgggcctgtgccggttaag

SEQ ID NO: 18243 - DNA, 21 bp, Artificial Sequence
  Description of Artificial Sequence: Synthetic oligonucleotide
agtcgggcgacttcgaatgct

SEQ ID NO: 18244 - DNA, 21 bp, Artificial Sequence
  Description of Artificial Sequence: Synthetic oligonucleotide
agcggcagcgacagccacaga

SEQ ID NO: 18245 - DNA, 21 bp, Artificial Sequence
  Description of Artificial Sequence: Synthetic oligonucleotide
aacggcggcgacaaattcaaa

SEQ ID NO: 18246 - DNA, 21 bp, Artificial Sequence
  Description of Artificial Sequence: Synthetic oligonucleotide
gcccaagccgaccaaagcaaa

SEQ ID NO: 18247 - DNA, 21 bp, Artificial Sequence
  Description of Artificial Sequence: Synthetic oligonucleotide
tctactaagagtgctgagggg

SEQ ID NO: 18248 - DNA, 21 bp, Artificial Sequence
  Description of Artificial Sequence: Synthetic oligonucleotide
aacagcgaaagcaaagccagc

SEQ ID NO: 18249 - DNA, 21 bp, Artificial Sequence
  Description of Artificial Sequence: Synthetic oligonucleotide
cacaccgccaacgccaccagc

SEQ ID NO: 18250 - DNA, 21 bp, Artificial Sequence
  Description of Artificial Sequence: Synthetic oligonucleotide
agcaccagccaaagcagcgcc

SEQ ID NO: 18251 - DNA, 21 bp, Artificial Sequence
  Description of Artificial Sequence: Synthetic oligonucleotide
cagaattcgacgcatccttct

SEQ ID NO: 18252 - DNA, 21 bp, Artificial Sequence
  Description of Artificial Sequence: Synthetic oligonucleotide
gacacccaaaaaagcctcaac

SEQ ID NO: 18253 - DNA, 21 bp, Artificial Sequence
  Description of Artificial Sequence: Synthetic oligonucleotide
agcggcatcggcagcgccacc

SEQ ID NO: 18254 - DNA, 21 bp, Artificial Sequence
  Description of Artificial Sequence: Synthetic oligonucleotide
attggtcgtgagaagagtcag

SEQ ID NO: 18255 - DNA, 21 bp, Artificial Sequence
  Description of Artificial Sequence: Synthetic oligonucleotide
cagaagcagcatgctagtgag

SEQ ID NO: 18256 - DNA, 21 bp, Artificial Sequence
  Description of Artificial Sequence: Synthetic oligonucleotide
gacagcaccaaacaagccttc

SEQ ID NO: 18257 - DNA, 21 bp, Artificial Sequence
  Description of Artificial Sequence: Synthetic oligonucleotide
cttcgtgattctggtaatggg

SEQ ID NO: 18258 - DNA, 21 bp, Artificial Sequence
  Description of Artificial Sequence: Synthetic oligonucleotide
agcgccagcacccccaaagac

SEQ ID NO: 18259 - DNA, 21 bp, Artificial Sequence
  Description of Artificial Sequence: Synthetic oligonucleotide
tcgggggcgcctagttctttg

SEQ ID NO: 18260 - DNA, 21 bp, Artificial Sequence
  Description of Artificial Sequence: Synthetic oligonucleotide
aagacttcttcgactaatgtt

SEQ ID NO: 18261 - DNA, 21 bp, Artificial Sequence
  Description of Artificial Sequence: Synthetic oligonucleotide
ggtggtggtccgagtgcgggt

SEQ ID NO: 18262 - DNA, 21 bp, Artificial Sequence
  Description of Artificial Sequence: Synthetic oligonucleotide
gaaggcgtcaacagcgccaaa

SEQ ID NO: 18263 - DNA, 21 bp, Artificial Sequence
  Description of Artificial Sequence: Synthetic oligonucleotide
agtactggtaagcctgggaat

SEQ ID NO: 18264 - DNA, 21 bp, Artificial Sequence
  Description of Artificial Sequence: Synthetic oligonucleotide
gaggggggggggcaggcgcat

SEQ ID NO: 18265 - DNA, 21 bp, Artificial Sequence
  Description of Artificial Sequence: Synthetic oligonucleotide
agtgggaagggtactagtatt

SEQ ID NO: 18266 - DNA, 21 bp, Artificial Sequence
  Description of Artificial Sequence: Synthetic oligonucleotide
agcagcaccaacggcaccagc

SEQ ID NO: 18267 - DNA, 21 bp, Artificial Sequence
  Description of Artificial Sequence: Synthetic oligonucleotide
gccagcgacaacagccccaga

SEQ ID NO: 18268 - DNA, 21 bp, Artificial Sequence
  Description of Artificial Sequence: Synthetic oligonucleotide
accaaaaacagcggcaacagc

SEQ ID NO: 18269 - DNA, 21 bp, Artificial Sequence
  Description of Artificial Sequence: Synthetic oligonucleotide
agtgctaatggtaagcctatg

SEQ ID NO: 18270 - DNA, 21 bp, Artificial Sequence
  Description of Artificial Sequence: Synthetic oligonucleotide
agtacgggtgatcagaggcag

SEQ ID NO: 18271 - DNA, 21 bp, Artificial Sequence
  Description of Artificial Sequence: Synthetic oligonucleotide
agcggccaaaacgtcaacggc

SEQ ID NO: 18272 - DNA, 21 bp, Artificial Sequence
  Description of Artificial Sequence: Synthetic oligonucleotide
gtcagaagcaccagcaacgtc

SEQ ID NO: 18273 - DNA, 21 bp, Artificial Sequence
  Description of Artificial Sequence: Synthetic oligonucleotide
agcagcgcccaaaaaggcgac

SEQ ID NO: 18274 - DNA, 21 bp, Artificial Sequence
  Description of Artificial Sequence: Synthetic oligonucleotide
gttggtactccgcatagtggg

SEQ ID NO: 18275 - DNA, 21 bp, Artificial Sequence
  Description of Artificial Sequence: Synthetic oligonucleotide
aaggggggtgatagtagttct

SEQ ID NO: 18276 - DNA, 21 bp, Artificial Sequence
  Description of Artificial Sequence: Synthetic oligonucleotide
aaccaagtccaacaaagccac

SEQ ID NO: 18277 - DNA, 21 bp, Artificial Sequence
  Description of Artificial Sequence: Synthetic oligonucleotide
agccccgacaaaagcaccgcc

SEQ ID NO: 18278 - DNA, 21 bp, Artificial Sequence
  Description of Artificial Sequence: Synthetic oligonucleotide
ctcaccaccagcagcagcggc

SEQ ID NO: 18279 - DNA, 21 bp, Artificial Sequence
  Description of Artificial Sequence: Synthetic oligonucleotide
gaaaacaaaagccccagcctc

SEQ ID NO: 18280 - DNA, 21 bp, Artificial Sequence
  Description of Artificial Sequence: Synthetic oligonucleotide
gatatgtcttctaaggctacg

SEQ ID NO: 18281 - DNA, 21 bp, Artificial Sequence
  Description of Artificial Sequence: Synthetic oligonucleotide
ctcggcacccaacccggcacc

SEQ ID NO: 18282 - DNA, 21 bp, Artificial Sequence
  Description of Artificial Sequence: Synthetic oligonucleotide
aatggggcttcgaaggatagt

SEQ ID NO: 18283 - DNA, 21 bp, Artificial Sequence
  Description of Artificial Sequence: Synthetic oligonucleotide
agttctacggctacgcatgtt

SEQ ID NO: 18284 - DNA, 21 bp, Artificial Sequence
  Description of Artificial Sequence: Synthetic oligonucleotide
caccaaggcgccgccagcagc

SEQ ID NO: 18285 - DNA, 21 bp, Artificial Sequence
  Description of Artificial Sequence: Synthetic oligonucleotide
gggaggaatagtacgcctcat

SEQ ID NO: 18286 - DNA, 21 bp, Artificial Sequence
  Description of Artificial Sequence: Synthetic oligonucleotide
caaaccagcaccagcgtcgcc

SEQ ID NO: 18287 - DNA, 21 bp, Artificial Sequence
  Description of Artificial Sequence: Synthetic oligonucleotide
gtgggtactaagcagcctgtt

SEQ ID NO: 18288 - DNA, 21 bp, Artificial Sequence
  Description of Artificial Sequence: Synthetic oligonucleotide
ggtgataataatgcgaagact

SEQ ID NO: 18289 - DNA, 21 bp, Artificial Sequence
  Description of Artificial Sequence: Synthetic oligonucleotide
gtcggcggcggcgccatcaaa

SEQ ID NO: 18290 - DNA, 21 bp, Artificial Sequence
  Description of Artificial Sequence: Synthetic oligonucleotide
ggcaccggcgccgaaaaagcc

SEQ ID NO: 18291 - DNA, 21 bp, Artificial Sequence
  Description of Artificial Sequence: Synthetic oligonucleotide
aacagccccacccaaggcagc

SEQ ID NO: 18292 - DNA, 21 bp, Artificial Sequence
  Description of Artificial Sequence: Synthetic oligonucleotide
gacaccggcagcaaacacagc

SEQ ID NO: 18293 - DNA, 21 bp, Artificial Sequence
  Description of Artificial Sequence: Synthetic oligonucleotide
gggactactcaggtgagtaag

SEQ ID NO: 18294 - DNA, 21 bp, Artificial Sequence
  Description of Artificial Sequence: Synthetic oligonucleotide
tatggtggtaagactggtacg

SEQ ID NO: 18295 - DNA, 21 bp, Artificial Sequence
  Description of Artificial Sequence: Synthetic oligonucleotide
gacagcagcaacaaaagcgtc

SEQ ID NO: 18296 - DNA, 21 bp, Artificial Sequence
  Description of Artificial Sequence: Synthetic oligonucleotide
aacgccggcagcagcagccac

SEQ ID NO: 18297 - DNA, 21 bp, Artificial Sequence
  Description of Artificial Sequence: Synthetic oligonucleotide
aatcaggggaatgggggtatg

SEQ ID NO: 18298 - DNA, 21 bp, Artificial Sequence
  Description of Artificial Sequence: Synthetic oligonucleotide
gcggggtcgtctcagtctggt

SEQ ID NO: 18299 - DNA, 21 bp, Artificial Sequence
  Description of Artificial Sequence: Synthetic oligonucleotide
gcgtctactggtgataaggtg

SEQ ID NO: 18300 - DNA, 21 bp, Artificial Sequence
  Description of Artificial Sequence: Synthetic oligonucleotide
ggcaccaccagcgccaaagaa

SEQ ID NO: 18301 - DNA, 21 bp, Artificial Sequence
  Description of Artificial Sequence: Synthetic oligonucleotide
gggattggtacgggtaatctt

SEQ ID NO: 18302 - DNA, 21 bp, Artificial Sequence
  Description of Artificial Sequence: Synthetic oligonucleotide
tcgccggttcctaatgggttg

SEQ ID NO: 18303 - DNA, 21 bp, Artificial Sequence
  Description of Artificial Sequence: Synthetic oligonucleotide
gaccaaagcagcaaactccaa

SEQ ID NO: 18304 - DNA, 21 bp, Artificial Sequence
  Description of Artificial Sequence: Synthetic oligonucleotide
caaagcgccaacccccccatc

SEQ ID NO: 18305 - DNA, 21 bp, Artificial Sequence
  Description of Artificial Sequence: Synthetic oligonucleotide
ggcagcgaaagcagacccctc

SEQ ID NO: 18306 - DNA, 21 bp, Artificial Sequence
  Description of Artificial Sequence: Synthetic oligonucleotide
tgcaccgccagcaaagccgaa

SEQ ID NO: 18307 - DNA, 21 bp, Artificial Sequence
  Description of Artificial Sequence: Synthetic oligonucleotide
caggctgatgctccgtctagg

SEQ ID NO: 18308 - DNA, 21 bp, Artificial Sequence
  Description of Artificial Sequence: Synthetic oligonucleotide
gaagccatcagcgcccccaaa

SEQ ID NO: 18309 - DNA, 21 bp, Artificial Sequence
  Description of Artificial Sequence: Synthetic oligonucleotide
gattcgggttcggctaatcgg

SEQ ID NO: 18310 - DNA, 21 bp, Artificial Sequence
  Description of Artificial Sequence: Synthetic oligonucleotide
gccaccggccccaccagccac

SEQ ID NO: 18311 - DNA, 21 bp, Artificial Sequence
  Description of Artificial Sequence: Synthetic oligonucleotide
accgccgccgccagcagcaaa

SEQ ID NO: 18312 - DNA, 21 bp, Artificial Sequence
  Description of Artificial Sequence: Synthetic oligonucleotide
agcggcgccgaaagaagcctc

SEQ ID NO: 18313 - DNA, 21 bp, Artificial Sequence
  Description of Artificial Sequence: Synthetic oligonucleotide
gacagcaaaagcggcaccagc

SEQ ID NO: 18314 - DNA, 21 bp, Artificial Sequence
  Description of Artificial Sequence: Synthetic oligonucleotide
agtgttggtcagtcgccgaat

SEQ ID NO: 18315 - DNA, 21 bp, Artificial Sequence
  Description of Artificial Sequence: Synthetic oligonucleotide
ggcgtcgcccaaagagacggc

SEQ ID NO: 18316 - DNA, 21 bp, Artificial Sequence
  Description of Artificial Sequence: Synthetic oligonucleotide
gattcggggcaggcgagtaag

SEQ ID NO: 18317 - DNA, 21 bp, Artificial Sequence
  Description of Artificial Sequence: Synthetic oligonucleotide
gccggcgacaacgccaccaga

SEQ ID NO: 18318 - DNA, 21 bp, Artificial Sequence
  Description of Artificial Sequence: Synthetic oligonucleotide
atggcgaagccgactagtact

SEQ ID NO: 18319 - DNA, 21 bp, Artificial Sequence
  Description of Artificial Sequence: Synthetic oligonucleotide
gatgctacttctaggaatact

SEQ ID NO: 18320 - DNA, 21 bp, Artificial Sequence
  Description of Artificial Sequence: Synthetic oligonucleotide
accaacgaaggcaaccacaga

SEQ ID NO: 18321 - DNA, 21 bp, Artificial Sequence
  Description of Artificial Sequence: Synthetic oligonucleotide
acggggcagagtcctggttcg

SEQ ID NO: 18322 - DNA, 21 bp, Artificial Sequence
  Description of Artificial Sequence: Synthetic oligonucleotide
aacagcagcccccccaccacc

SEQ ID NO: 18323 - DNA, 21 bp, Artificial Sequence
  Description of Artificial Sequence: Synthetic oligonucleotide
attactggtcagggtggtgtt

SEQ ID NO: 18324 - DNA, 21 bp, Artificial Sequence
  Description of Artificial Sequence: Synthetic oligonucleotide
ctcagcggcagcgccagcagc

SEQ ID NO: 18325 - DNA, 21 bp, Artificial Sequence
  Description of Artificial Sequence: Synthetic oligonucleotide
gccaaaggcaacggcatgaac

SEQ ID NO: 18326 - DNA, 21 bp, Artificial Sequence
  Description of Artificial Sequence: Synthetic oligonucleotide
tctcagggtgaggtgggtagg

SEQ ID NO: 18327 - DNA, 21 bp, Artificial Sequence
  Description of Artificial Sequence: Synthetic oligonucleotide
gacggcagcaaaagcgccctc

SEQ ID NO: 18328 - DNA, 21 bp, Artificial Sequence
  Description of Artificial Sequence: Synthetic oligonucleotide
ggccccgacaacgcccaaaaa

SEQ ID NO: 18329 - DNA, 21 bp, Artificial Sequence
  Description of Artificial Sequence: Synthetic oligonucleotide
ggcgtcgacggcaaacccagc

SEQ ID NO: 18330 - DNA, 21 bp, Artificial Sequence
  Description of Artificial Sequence: Synthetic oligonucleotide
aaccaaggcagcaacctcagc

SEQ ID NO: 18331 - DNA, 21 bp, Artificial Sequence
  Description of Artificial Sequence: Synthetic oligonucleotide
agagacagcaacgccaacggc

SEQ ID NO: 18332 - DNA, 21 bp, Artificial Sequence
  Description of Artificial Sequence: Synthetic oligonucleotide
gctggtgagtcttcgatgaag

SEQ ID NO: 18333 - DNA, 21 bp, Artificial Sequence
  Description of Artificial Sequence: Synthetic oligonucleotide
gacagcagcagcaaaaacagc

SEQ ID NO: 18334 - DNA, 21 bp, Artificial Sequence
  Description of Artificial Sequence: Synthetic oligonucleotide
accggcaccaacaccgtccaa

SEQ ID NO: 18335 - DNA, 21 bp, Artificial Sequence
  Description of Artificial Sequence: Synthetic oligonucleotide
attggtgagacgacgaagggg

SEQ ID NO: 18336 - DNA, 21 bp, Artificial Sequence
  Description of Artificial Sequence: Synthetic oligonucleotide
atgagagaagacaaactcctc

SEQ ID NO: 18337 - DNA, 21 bp, Artificial Sequence
  Description of Artificial Sequence: Synthetic oligonucleotide
actagtccgcaggggcaggct

SEQ ID NO: 18338 - DNA, 21 bp, Artificial Sequence
  Description of Artificial Sequence: Synthetic oligonucleotide
ggtatggatcagacgcggtct

SEQ ID NO: 18339 - DNA, 21 bp, Artificial Sequence
  Description of Artificial Sequence: Synthetic oligonucleotide
gtcaacggcggcagcatcaaa

SEQ ID NO: 18340 - DNA, 21 bp, Artificial Sequence
  Description of Artificial Sequence: Synthetic oligonucleotide
agcagccccggcaccgaaaga

SEQ ID NO: 18341 - DNA, 21 bp, Artificial Sequence
  Description of Artificial Sequence: Synthetic oligonucleotide
gtccccgacagcagaagccaa

SEQ ID NO: 18342 - DNA, 21 bp, Artificial Sequence
  Description of Artificial Sequence: Synthetic oligonucleotide
agcagcgaccaaagcagaaaa

SEQ ID NO: 18343 - DNA, 21 bp, Artificial Sequence
  Description of Artificial Sequence: Synthetic oligonucleotide
gagggtagtagtactattgtg

SEQ ID NO: 18344 - DNA, 21 bp, Artificial Sequence
  Description of Artificial Sequence: Synthetic oligonucleotide
gttactaatgcggctacgggg

SEQ ID NO: 18345 - DNA, 21 bp, Artificial Sequence
  Description of Artificial Sequence: Synthetic oligonucleotide
tacagcggcgacaaacccacc

SEQ ID NO: 18346 - DNA, 21 bp, Artificial Sequence
  Description of Artificial Sequence: Synthetic oligonucleotide
agcgccaccaccgccaacacc

SEQ ID NO: 18347 - DNA, 21 bp, Artificial Sequence
  Description of Artificial Sequence: Synthetic oligonucleotide
tctgctgttcaggcgccgtcg

SEQ ID NO: 18348 - DNA, 21 bp, Artificial Sequence
  Description of Artificial Sequence: Synthetic oligonucleotide
tcgtcttctaagacggcgaat

SEQ ID NO: 18349 - DNA, 21 bp, Artificial Sequence
  Description of Artificial Sequence: Synthetic oligonucleotide
aataatagtggtacgttgagt

SEQ ID NO: 18350 - DNA, 21 bp, Artificial Sequence
  Description of Artificial Sequence: Synthetic oligonucleotide
ggcgaccccagccccagacaa

SEQ ID NO: 18351 - DNA, 21 bp, Artificial Sequence
  Description of Artificial Sequence: Synthetic oligonucleotide
atggtgcagagtcctgctacg

SEQ ID NO: 18352 - DNA, 21 bp, Artificial Sequence
  Description of Artificial Sequence: Synthetic oligonucleotide
cgtggtcaggataagccgaat

SEQ ID NO: 18353 - DNA, 21 bp, Artificial Sequence
  Description of Artificial Sequence: Synthetic oligonucleotide
accagcagcagcacccacagc

SEQ ID NO: 18354 - DNA, 21 bp, Artificial Sequence
  Description of Artificial Sequence: Synthetic oligonucleotide
ggcgccggcagcgccaacagc

SEQ ID NO: 18355 - DNA, 21 bp, Artificial Sequence
  Description of Artificial Sequence: Synthetic oligonucleotide
atgcaaagcgccaaaagcggc

SEQ ID NO: 18356 - DNA, 21 bp, Artificial Sequence
  Description of Artificial Sequence: Synthetic oligonucleotide
agtagggatgagaagctgcgt

SEQ ID NO: 18357 - DNA, 21 bp, Artificial Sequence
  Description of Artificial Sequence: Synthetic oligonucleotide
ctcacccaaagccccggcacc

SEQ ID NO: 18358 - DNA, 21 bp, Artificial Sequence
  Description of Artificial Sequence: Synthetic oligonucleotide
gacggcagcaacgtcaaaagc

SEQ ID NO: 18359 - DNA, 21 bp, Artificial Sequence
  Description of Artificial Sequence: Synthetic oligonucleotide
ggtagtttgccggctaatagt

SEQ ID NO: 18360 - DNA, 21 bp, Artificial Sequence
  Description of Artificial Sequence: Synthetic oligonucleotide
gctgctgggggtacgcatggt

SEQ ID NO: 18361 - DNA, 21 bp, Artificial Sequence
  Description of Artificial Sequence: Synthetic oligonucleotide
aacaacagcaaaaacggcggc

SEQ ID NO: 18362 - DNA, 21 bp, Artificial Sequence
  Description of Artificial Sequence: Synthetic oligonucleotide
agcgtcggcatgacccccccc

SEQ ID NO: 18363 - DNA, 21 bp, Artificial Sequence
  Description of Artificial Sequence: Synthetic oligonucleotide
tcgaatacggctactcctcag

SEQ ID NO: 18364 - DNA, 21 bp, Artificial Sequence
  Description of Artificial Sequence: Synthetic oligonucleotide
gccctccacaaaagcagcacc

SEQ ID NO: 18365 - DNA, 21 bp, Artificial Sequence
  Description of Artificial Sequence: Synthetic oligonucleotide
ggtcttgttagggagactggt

SEQ ID NO: 18366 - DNA, 21 bp, Artificial Sequence
  Description of Artificial Sequence: Synthetic oligonucleotide
aagaataattctagttcgcag

SEQ ID NO: 18367 - DNA, 21 bp, Artificial Sequence
  Description of Artificial Sequence: Synthetic oligonucleotide
gccagccccagcaaagacagc

SEQ ID NO: 18368 - DNA, 21 bp, Artificial Sequence
  Description of Artificial Sequence: Synthetic oligonucleotide
cattcgagtgagagggctggg

SEQ ID NO: 18369 - DNA, 21 bp, Artificial Sequence
  Description of Artificial Sequence: Synthetic oligonucleotide
ggtcctagtacgaataattcg

SEQ ID NO: 18370 - DNA, 21 bp, Artificial Sequence
  Description of Artificial Sequence: Synthetic oligonucleotide
gccggcggcgacaccgccaaa

SEQ ID NO: 18371 - DNA, 21 bp, Artificial Sequence
  Description of Artificial Sequence: Synthetic oligonucleotide
ggtactggtcattcgtcttcg

SEQ ID NO: 18372 - DNA, 21 bp, Artificial Sequence
  Description of Artificial Sequence: Synthetic oligonucleotide
gccagcaacgacaaaatgagc

SEQ ID NO: 18373 - DNA, 21 bp, Artificial Sequence
  Description of Artificial Sequence: Synthetic oligonucleotide
actcctagtactagtaatcat

SEQ ID NO: 18374 - DNA, 21 bp, Artificial Sequence
  Description of Artificial Sequence: Synthetic oligonucleotide
gacacccccgcccacaccaaa

SEQ ID NO: 18375 - DNA, 21 bp, Artificial Sequence
  Description of Artificial Sequence: Synthetic oligonucleotide
atttcggcgggtagttcgtct

SEQ ID NO: 18376 - DNA, 21 bp, Artificial Sequence
  Description of Artificial Sequence: Synthetic oligonucleotide
gaccaaaacagaacccacggc

SEQ ID NO: 18377 - DNA, 21 bp, Artificial Sequence
  Description of Artificial Sequence: Synthetic oligonucleotide
gcgaatatgggtgatgttaag

SEQ ID NO: 18378 - DNA, 21 bp, Artificial Sequence
  Description of Artificial Sequence: Synthetic oligonucleotide
ggcaccagccccggcagcatg

SEQ ID NO: 18379 - DNA, 21 bp, Artificial Sequence
  Description of Artificial Sequence: Synthetic oligonucleotide
gaggggcatgagcattctcgg

SEQ ID NO: 18380 - DNA, 21 bp, Artificial Sequence
  Description of Artificial Sequence: Synthetic oligonucleotide
agcaacaacaccagccccaac

SEQ ID NO: 18381 - DNA, 21 bp, Artificial Sequence
  Description of Artificial Sequence: Synthetic oligonucleotide
aatacgactgctccgtctcat

SEQ ID NO: 18382 - DNA, 21 bp, Artificial Sequence
  Description of Artificial Sequence: Synthetic oligonucleotide
ggtagtgattctggtacgcgg

SEQ ID NO: 18383 - DNA, 21 bp, Artificial Sequence
  Description of Artificial Sequence: Synthetic oligonucleotide
atgggcaaccccaccgccagc

SEQ ID NO: 18384 - DNA, 21 bp, Artificial Sequence
  Description of Artificial Sequence: Synthetic oligonucleotide
gaagccagaagcccccccaaa

SEQ ID NO: 18385 - DNA, 21 bp, Artificial Sequence
  Description of Artificial Sequence: Synthetic oligonucleotide
gaccccctcaacgtcaaagtc

SEQ ID NO: 18386 - DNA, 21 bp, Artificial Sequence
  Description of Artificial Sequence: Synthetic oligonucleotide
gacaaacccacccccagcatc

SEQ ID NO: 18387 - DNA, 21 bp, Artificial Sequence
  Description of Artificial Sequence: Synthetic oligonucleotide
aatcattctgataaggctgcg

SEQ ID NO: 18388 - DNA, 21 bp, Artificial Sequence
  Description of Artificial Sequence: Synthetic oligonucleotide
gcggatcagagtcctaagctg

SEQ ID NO: 18389 - DNA, 21 bp, Artificial Sequence
  Description of Artificial Sequence: Synthetic oligonucleotide
ggccaaaaaggcaacgccgtc

SEQ ID NO: 18390 - DNA, 21 bp, Artificial Sequence
  Description of Artificial Sequence: Synthetic oligonucleotide
tcgggtactagtcatcctgct

SEQ ID NO: 18391 - DNA, 21 bp, Artificial Sequence
  Description of Artificial Sequence: Synthetic oligonucleotide
gcgaatacgagttcgaatagt

SEQ ID NO: 18392 - DNA, 21 bp, Artificial Sequence
  Description of Artificial Sequence: Synthetic oligonucleotide
cagggtaagtctggtggggcg

SEQ ID NO: 18393 - DNA, 21 bp, Artificial Sequence
  Description of Artificial Sequence: Synthetic oligonucleotide
aatactaatccgtctggtgct

SEQ ID NO: 18394 - DNA, 21 bp, Artificial Sequence
  Description of Artificial Sequence: Synthetic oligonucleotide
aaagacaaccccgaaagaggc

SEQ ID NO: 18395 - DNA, 21 bp, Artificial Sequence
  Description of Artificial Sequence: Synthetic oligonucleotide
aacggcggcagcaaagtcgcc

SEQ ID NO: 18396 - DNA, 21 bp, Artificial Sequence
  Description of Artificial Sequence: Synthetic oligonucleotide
aacgtcgaccaagccaaaaac

SEQ ID NO: 18397 - DNA, 21 bp, Artificial Sequence
  Description of Artificial Sequence: Synthetic oligonucleotide
accagcgacagcaaagtcagc

SEQ ID NO: 18398 - DNA, 21 bp, Artificial Sequence
  Description of Artificial Sequence: Synthetic oligonucleotide
accggccacaacgccaccacc

SEQ ID NO: 18399 - DNA, 21 bp, Artificial Sequence
  Description of Artificial Sequence: Synthetic oligonucleotide
accggcgaaaaagtcagagtc

SEQ ID NO: 18400 - DNA, 21 bp, Artificial Sequence
  Description of Artificial Sequence: Synthetic oligonucleotide
actaatggtgagcagcgtacg

SEQ ID NO: 18401 - DNA, 21 bp, Artificial Sequence
  Description of Artificial Sequence: Synthetic oligonucleotide
actggtaaggattcgatgtct

SEQ ID NO: 18402 - DNA, 21 bp, Artificial Sequence
  Description of Artificial Sequence: Synthetic oligonucleotide
agcacccacagcgccagcaac

SEQ ID NO: 18403 - DNA, 21 bp, Artificial Sequence
  Description of Artificial Sequence: Synthetic oligonucleotide
agcagagaagaacccagaacc

SEQ ID NO: 18404 - DNA, 21 bp, Artificial Sequence
  Description of Artificial Sequence: Synthetic oligonucleotide
agtacgtcgaagtcggtggct

SEQ ID NO: 18405 - DNA, 21 bp, Artificial Sequence
  Description of Artificial Sequence: Synthetic oligonucleotide
agtgggaatggtaagcttttg

SEQ ID NO: 18406 - DNA, 21 bp, Artificial Sequence
  Description of Artificial Sequence: Synthetic oligonucleotide
attgcttctagtagtgctgcg

SEQ ID NO: 18407 - DNA, 21 bp, Artificial Sequence
  Description of Artificial Sequence: Synthetic oligonucleotide
caaggccaagaaagaaaaagc

SEQ ID NO: 18408 - DNA, 21 bp, Artificial Sequence
  Description of Artificial Sequence: Synthetic oligonucleotide
ctccaaggcagcaacgtcgcc

SEQ ID NO: 18409 - DNA, 21 bp, Artificial Sequence
  Description of Artificial Sequence: Synthetic oligonucleotide
gacagcgtcagccccaaaaaa

SEQ ID NO: 18410 - DNA, 21 bp, Artificial Sequence
  Description of Artificial Sequence: Synthetic oligonucleotide
gacgtccccagcagcaaaggc

SEQ ID NO: 18411 - DNA, 21 bp, Artificial Sequence
  Description of Artificial Sequence: Synthetic oligonucleotide
gagtctgatagtaggtctcat

SEQ ID NO: 18412 - DNA, 21 bp, Artificial Sequence
  Description of Artificial Sequence: Synthetic oligonucleotide
gataatacgaggaatgggggt

SEQ ID NO: 18413 - DNA, 21 bp, Artificial Sequence
  Description of Artificial Sequence: Synthetic oligonucleotide
gccctcagcaacaacagcaaa

SEQ ID NO: 18414 - DNA, 21 bp, Artificial Sequence
  Description of Artificial Sequence: Synthetic oligonucleotide
gcgacgagtcagcatagtaat

SEQ ID NO: 18415 - DNA, 21 bp, Artificial Sequence
  Description of Artificial Sequence: Synthetic oligonucleotide
gctaagcagcctaatgcgaat

SEQ ID NO: 18416 - DNA, 21 bp, Artificial Sequence
  Description of Artificial Sequence: Synthetic oligonucleotide
ggcaccgaagtcaaagccggc

SEQ ID NO: 18417 - DNA, 21 bp, Artificial Sequence
  Description of Artificial Sequence: Synthetic oligonucleotide
ggtactggtagtagtatttcg

SEQ ID NO: 18418 - DNA, 21 bp, Artificial Sequence
  Description of Artificial Sequence: Synthetic oligonucleotide
gttgtgtctgggaatgggggg

SEQ ID NO: 18419 - DNA, 21 bp, Artificial Sequence
  Description of Artificial Sequence: Synthetic oligonucleotide
tctgctactagtaatggtggg

SEQ ID NO: 18420 - DNA, 21 bp, Artificial Sequence
  Description of Artificial Sequence: Synthetic oligonucleotide
gatcgtggtgagaagcatacg

SEQ ID NO: 18421 - DNA, 21 bp, Artificial Sequence
  Description of Artificial Sequence: Synthetic oligonucleotide
ggcaccgccgacagccactac

SEQ ID NO: 18422 - DNA, 21 bp, Artificial Sequence
  Description of Artificial Sequence: Synthetic oligonucleotide
agcggcgcccccaccctcctc

SEQ ID NO: 18423 - DNA, 21 bp, Artificial Sequence
  Description of Artificial Sequence: Synthetic oligonucleotide
gccgccagcgacaaaagcagc

SEQ ID NO: 18424 - DNA, 21 bp, Artificial Sequence
  Description of Artificial Sequence: Synthetic oligonucleotide
agcaccagcgacagacacacc

SEQ ID NO: 18425 - DNA, 21 bp, Artificial Sequence
  Description of Artificial Sequence: Synthetic oligonucleotide
atcgacaaagtcagccccagc

SEQ ID NO: 18426 - DNA, 21 bp, Artificial Sequence
  Description of Artificial Sequence: Synthetic oligonucleotide
gaaggcaaaagcgtcaacgcc

SEQ ID NO: 18427 - DNA, 21 bp, Artificial Sequence
  Description of Artificial Sequence: Synthetic oligonucleotide
ttgaaggataaggcgaattct

SEQ ID NO: 18428 - DNA, 21 bp, Artificial Sequence
  Description of Artificial Sequence: Synthetic oligonucleotide
gccaccggcgccgacatgaga

SEQ ID NO: 18429 - DNA, 21 bp, Artificial Sequence
  Description of Artificial Sequence: Synthetic oligonucleotide
gagaggaatactgcggggagt

SEQ ID NO: 18430 - DNA, 21 bp, Artificial Sequence
  Description of Artificial Sequence: Synthetic oligonucleotide
gacggcatgccccaaaaagtc

SEQ ID NO: 18431 - DNA, 21 bp, Artificial Sequence
  Description of Artificial Sequence: Synthetic oligonucleotide
gcggggcagcggtctgatggt

SEQ ID NO: 18432 - DNA, 21 bp, Artificial Sequence
  Description of Artificial Sequence: Synthetic oligonucleotide
gccggcaaaagcagccaaccc

SEQ ID NO: 18433 - DNA, 21 bp, Artificial Sequence
  Description of Artificial Sequence: Synthetic oligonucleotide
gtcagcaaaagcagcaacagc

SEQ ID NO: 18434 - DNA, 21 bp, Artificial Sequence
  Description of Artificial Sequence: Synthetic oligonucleotide
accagcagcagcacccccacc

SEQ ID NO: 18435 - DNA, 21 bp, Artificial Sequence
  Description of Artificial Sequence: Synthetic oligonucleotide
tcgggtggggcggggtcgcag

SEQ ID NO: 18436 - DNA, 21 bp, Artificial Sequence
  Description of Artificial Sequence: Synthetic oligonucleotide
agccccggcaacgtcgccacc

SEQ ID NO: 18437 - DNA, 21 bp, Artificial Sequence
  Description of Artificial Sequence: Synthetic oligonucleotide
gtccaaaacagcgacgccaaa

SEQ ID NO: 18438 - DNA, 21 bp, Artificial Sequence
  Description of Artificial Sequence: Synthetic oligonucleotide
gctaatgataaggcgccttcg

SEQ ID NO: 18439 - DNA, 21 bp, Artificial Sequence
  Description of Artificial Sequence: Synthetic oligonucleotide
agcgacggcaccagaggcacc

SEQ ID NO: 18440 - DNA, 21 bp, Artificial Sequence
  Description of Artificial Sequence: Synthetic oligonucleotide
gccatcagcaccagcaacagc

SEQ ID NO: 18441 - DNA, 21 bp, Artificial Sequence
  Description of Artificial Sequence: Synthetic oligonucleotide
ggtcagaaggagggtccttct

SEQ ID NO: 18442 - DNA, 21 bp, Artificial Sequence
  Description of Artificial Sequence: Synthetic oligonucleotide
gcccaaggcggcagcagcggc

SEQ ID NO: 18443 - DNA, 21 bp, Artificial Sequence
  Description of Artificial Sequence: Synthetic oligonucleotide
tctacgtctaattctaggggt

SEQ ID NO: 18444 - DNA, 21 bp, Artificial Sequence
  Description of Artificial Sequence: Synthetic oligonucleotide
agcagcggcggcagagacaaa

SEQ ID NO: 18445 - DNA, 21 bp, Artificial Sequence
  Description of Artificial Sequence: Synthetic oligonucleotide
ttgccgtcgcaggggggtggt

SEQ ID NO: 18446 - DNA, 21 bp, Artificial Sequence
  Description of Artificial Sequence: Synthetic oligonucleotide
aatacggggacgaatgctagt

SEQ ID NO: 18447 - DNA, 21 bp, Artificial Sequence
  Description of Artificial Sequence: Synthetic oligonucleotide
actacgggtcagaatagtcag

SEQ ID NO: 18448 - DNA, 21 bp, Artificial Sequence
  Description of Artificial Sequence: Synthetic oligonucleotide
gccgccagcagcagcaccagc

SEQ ID NO: 18449 - DNA, 21 bp, Artificial Sequence
  Description of Artificial Sequence: Synthetic oligonucleotide
accctcggcagcggcggcagc

SEQ ID NO: 18450 - DNA, 21 bp, Artificial Sequence
  Description of Artificial Sequence: Synthetic oligonucleotide
aaaggcagcagcagcggcggc

SEQ ID NO: 18451 - DNA, 21 bp, Artificial Sequence
  Description of Artificial Sequence: Synthetic oligonucleotide
agcagcggcgaccacagaacc

SEQ ID NO: 18452 - DNA, 21 bp, Artificial Sequence
  Description of Artificial Sequence: Synthetic oligonucleotide
gatacgggggggcttgggaag

SEQ ID NO: 18453 - DNA, 21 bp, Artificial Sequence
  Description of Artificial Sequence: Synthetic oligonucleotide
gcgggtcagtcggctacgggg

SEQ ID NO: 18454 - DNA, 21 bp, Artificial Sequence
  Description of Artificial Sequence: Synthetic oligonucleotide
aatgctggtgctaattcgacg

SEQ ID NO: 18455 - DNA, 21 bp, Artificial Sequence
  Description of Artificial Sequence: Synthetic oligonucleotide
gaaagcgtcgccagcgtcaaa

SEQ ID NO: 18456 - DNA, 21 bp, Artificial Sequence
  Description of Artificial Sequence: Synthetic oligonucleotide
gatagtgcttcttcgggtaag

SEQ ID NO: 18457 - DNA, 21 bp, Artificial Sequence
  Description of Artificial Sequence: Synthetic oligonucleotide
agcaccgacaacgccggcaaa

SEQ ID NO: 18458 - DNA, 21 bp, Artificial Sequence
  Description of Artificial Sequence: Synthetic oligonucleotide
cagtcttcgaatgctgctgcg

SEQ ID NO: 18459 - DNA, 21 bp, Artificial Sequence
  Description of Artificial Sequence: Synthetic oligonucleotide
accaccgccagccccgccacc

SEQ ID NO: 18460 - DNA, 21 bp, Artificial Sequence
  Description of Artificial Sequence: Synthetic oligonucleotide
acgacgactcagtctaatatt

SEQ ID NO: 18461 - DNA, 21 bp, Artificial Sequence
  Description of Artificial Sequence: Synthetic oligonucleotide
agcagcggcgacagaagcggc

SEQ ID NO: 18462 - DNA, 21 bp, Artificial Sequence
  Description of Artificial Sequence: Synthetic oligonucleotide
gagaatagtgataaggtgagg

SEQ ID NO: 18463 - DNA, 21 bp, Artificial Sequence
  Description of Artificial Sequence: Synthetic oligonucleotide
gctacgacgaagactagtcag

SEQ ID NO: 18464 - DNA, 21 bp, Artificial Sequence
  Description of Artificial Sequence: Synthetic oligonucleotide
tcgaatggtgctacgccggcg

SEQ ID NO: 18465 - DNA, 21 bp, Artificial Sequence
  Description of Artificial Sequence: Synthetic oligonucleotide
agttcgagggatcaggtgaag

SEQ ID NO: 18466 - DNA, 21 bp, Artificial Sequence
  Description of Artificial Sequence: Synthetic oligonucleotide
gtcagcagcggcaccggcaaa

SEQ ID NO: 18467 - DNA, 21 bp, Artificial Sequence
  Description of Artificial Sequence: Synthetic oligonucleotide
tcgaatgaggggcctagtaag

SEQ ID NO: 18468 - DNA, 21 bp, Artificial Sequence
  Description of Artificial Sequence: Synthetic oligonucleotide
gacctcggcaacaaaacccac

SEQ ID NO: 18469 - DNA, 21 bp, Artificial Sequence
  Description of Artificial Sequence: Synthetic oligonucleotide
gatgcggggaatcttaagact

SEQ ID NO: 18470 - DNA, 21 bp, Artificial Sequence
  Description of Artificial Sequence: Synthetic oligonucleotide
attggggataagagttcgacg

SEQ ID NO: 18471 - DNA, 21 bp, Artificial Sequence
  Description of Artificial Sequence: Synthetic oligonucleotide
ggcaccggccccgaccaaaga

SEQ ID NO: 18472 - DNA, 21 bp, Artificial Sequence
  Description of Artificial Sequence: Synthetic oligonucleotide
aacaccggcgaagccagagcc

SEQ ID NO: 18473 - DNA, 21 bp, Artificial Sequence
  Description of Artificial Sequence: Synthetic oligonucleotide
gccaccaaagccggcagcgcc

SEQ ID NO: 18474 - DNA, 21 bp, Artificial Sequence
  Description of Artificial Sequence: Synthetic oligonucleotide
acgacgggttcgcatagttct

SEQ ID NO: 18475 - DNA, 21 bp, Artificial Sequence
  Description of Artificial Sequence: Synthetic oligonucleotide
gagcctaatgcgcctaagaat

SEQ ID NO: 18476 - DNA, 21 bp, Artificial Sequence
  Description of Artificial Sequence: Synthetic oligonucleotide
ggtgattctaaggagcggctg

SEQ ID NO: 18477 - DNA, 21 bp, Artificial Sequence
  Description of Artificial Sequence: Synthetic oligonucleotide
cagtcgaagggtactgagggt

SEQ ID NO: 18478 - DNA, 21 bp, Artificial Sequence
  Description of Artificial Sequence: Synthetic oligonucleotide
gacggcggcgccaacgccaga

SEQ ID NO: 18479 - DNA, 21 bp, Artificial Sequence
  Description of Artificial Sequence: Synthetic oligonucleotide
aaaagcagcagccaaagcgtc

SEQ ID NO: 18480 - DNA, 21 bp, Artificial Sequence
  Description of Artificial Sequence: Synthetic oligonucleotide
cttggtggtcaggggtcggcg

SEQ ID NO: 18481 - DNA, 21 bp, Artificial Sequence
  Description of Artificial Sequence: Synthetic oligonucleotide
gggcctctgaaggatacgggt

SEQ ID NO: 18482 - DNA, 21 bp, Artificial Sequence
  Description of Artificial Sequence: Synthetic oligonucleotide
aatcaggggacttctactggt

SEQ ID NO: 18483 - DNA, 21 bp, Artificial Sequence
  Description of Artificial Sequence: Synthetic oligonucleotide
accggccaaaaagacctcggc

SEQ ID NO: 18484 - DNA, 21 bp, Artificial Sequence
  Description of Artificial Sequence: Synthetic oligonucleotide
ctcaccgccggcagcggcggc

SEQ ID NO: 18485 - DNA, 21 bp, Artificial Sequence
  Description of Artificial Sequence: Synthetic oligonucleotide
tctgggaataatggtatgcat

SEQ ID NO: 18486 - DNA, 21 bp, Artificial Sequence
  Description of Artificial Sequence: Synthetic oligonucleotide
acttctgggacggcttctacg

SEQ ID NO: 18487 - DNA, 21 bp, Artificial Sequence
  Description of Artificial Sequence: Synthetic oligonucleotide
tctaatagtccgacgacgatg

SEQ ID NO: 18488 - DNA, 21 bp, Artificial Sequence
  Description of Artificial Sequence: Synthetic oligonucleotide
cagaatgcttcttcgcatgcg

SEQ ID NO: 18489 - DNA, 21 bp, Artificial Sequence
  Description of Artificial Sequence: Synthetic oligonucleotide
tcgacttctactgataatcgg

SEQ ID NO: 18490 - DNA, 21 bp, Artificial Sequence
  Description of Artificial Sequence: Synthetic oligonucleotide
gagggtaagagtacgccgatt

SEQ ID NO: 18491 - DNA, 21 bp, Artificial Sequence
  Description of Artificial Sequence: Synthetic oligonucleotide
gattctctggagcctcggaag

SEQ ID NO: 18492 - DNA, 21 bp, Artificial Sequence
  Description of Artificial Sequence: Synthetic oligonucleotide
gccatgaccgaaagcaacaga

SEQ ID NO: 18493 - DNA, 21 bp, Artificial Sequence
  Description of Artificial Sequence: Synthetic oligonucleotide
ggggagacgaataaggggtat

SEQ ID NO: 18494 - DNA, 21 bp, Artificial Sequence
  Description of Artificial Sequence: Synthetic oligonucleotide
ggggctcagagttctgggaag

SEQ ID NO: 18495 - DNA, 21 bp, Artificial Sequence
  Description of Artificial Sequence: Synthetic oligonucleotide
ggtgggcaggataagaagagt

SEQ ID NO: 18496 - DNA, 21 bp, Artificial Sequence
  Description of Artificial Sequence: Synthetic oligonucleotide
cacggccaaagccccggcagc

SEQ ID NO: 18497 - DNA, 21 bp, Artificial Sequence
  Description of Artificial Sequence: Synthetic oligonucleotide
ctcggcggcgcccaacccaaa

SEQ ID NO: 18498 - DNA, 21 bp, Artificial Sequence
  Description of Artificial Sequence: Synthetic oligonucleotide
tcgggtcagtcgccttcgaat

SEQ ID NO: 18499 - DNA, 21 bp, Artificial Sequence
  Description of Artificial Sequence: Synthetic oligonucleotide
ggcaccagcagcaccaaaagc

SEQ ID NO: 18500 - DNA, 21 bp, Artificial Sequence
  Description of Artificial Sequence: Synthetic oligonucleotide
ttgactaatacttcggctgct

SEQ ID NO: 18501 - DNA, 21 bp, Artificial Sequence
  Description of Artificial Sequence: Synthetic oligonucleotide
cagaattcgcctactcctctt

SEQ ID NO: 18502 - DNA, 21 bp, Artificial Sequence
  Description of Artificial Sequence: Synthetic oligonucleotide
agcaccaccggcgccggcacc

SEQ ID NO: 18503 - DNA, 21 bp, Artificial Sequence
  Description of Artificial Sequence: Synthetic oligonucleotide
gtcgtcgacagcagcaacaga

SEQ ID NO: 18504 - DNA, 21 bp, Artificial Sequence
  Description of Artificial Sequence: Synthetic oligonucleotide
ggcgacaccggcagcagaagc

SEQ ID NO: 18505 - DNA, 21 bp, Artificial Sequence
  Description of Artificial Sequence: Synthetic oligonucleotide
actgtgggttcgagttcttct

SEQ ID NO: 18506 - DNA, 21 bp, Artificial Sequence
  Description of Artificial Sequence: Synthetic oligonucleotide
aatactagtgggactaatagt

SEQ ID NO: 18507 - DNA, 21 bp, Artificial Sequence
  Description of Artificial Sequence: Synthetic oligonucleotide
actggttcgcagaatcttgtg

SEQ ID NO: 18508 - DNA, 21 bp, Artificial Sequence
  Description of Artificial Sequence: Synthetic oligonucleotide
agtgcgaatgggcctaatact

SEQ ID NO: 18509 - DNA, 21 bp, Artificial Sequence
  Description of Artificial Sequence: Synthetic oligonucleotide
ctcgccggcgacagaacccaa

SEQ ID NO: 18510 - DNA, 21 bp, Artificial Sequence
  Description of Artificial Sequence: Synthetic oligonucleotide
gacatggccaaccccaaaaga

SEQ ID NO: 18511 - DNA, 21 bp, Artificial Sequence
  Description of Artificial Sequence: Synthetic oligonucleotide
ttggggaatgggaaggtgtcg

SEQ ID NO: 18512 - DNA, 21 bp, Artificial Sequence
  Description of Artificial Sequence: Synthetic oligonucleotide
ggcgccgacagcaaaggcctc

SEQ ID NO: 18513 - DNA, 21 bp, Artificial Sequence
  Description of Artificial Sequence: Synthetic oligonucleotide
ctcggcagcaaagacgcccac

SEQ ID NO: 18514 - DNA, 21 bp, Artificial Sequence
  Description of Artificial Sequence: Synthetic oligonucleotide
actgggagtgcgtctagttct

SEQ ID NO: 18515 - DNA, 21 bp, Artificial Sequence
  Description of Artificial Sequence: Synthetic oligonucleotide
caaagcagccccagcgccaaa

SEQ ID NO: 18516 - DNA, 21 bp, Artificial Sequence
  Description of Artificial Sequence: Synthetic oligonucleotide
gatacggggaagattggtggt

SEQ ID NO: 18517 - DNA, 21 bp, Artificial Sequence
  Description of Artificial Sequence: Synthetic oligonucleotide
ggcaccaccggcgaaagcaga

SEQ ID NO: 18518 - DNA, 21 bp, Artificial Sequence
  Description of Artificial Sequence: Synthetic oligonucleotide
gtccaaggcagcaccagcaac

SEQ ID NO: 18519 - DNA, 21 bp, Artificial Sequence
  Description of Artificial Sequence: Synthetic oligonucleotide
tcggcttctaaggatcatgct

SEQ ID NO: 18520 - DNA, 21 bp, Artificial Sequence
  Description of Artificial Sequence: Synthetic oligonucleotide
atgaaacaagaaagcgccgtc

SEQ ID NO: 18521 - DNA, 21 bp, Artificial Sequence
  Description of Artificial Sequence: Synthetic oligonucleotide
ctcgccagcaccagcagcacc

SEQ ID NO: 18522 - DNA, 21 bp, Artificial Sequence
  Description of Artificial Sequence: Synthetic oligonucleotide
ggtggggtgaagactggtgat

SEQ ID NO: 18523 - DNA, 21 bp, Artificial Sequence
  Description of Artificial Sequence: Synthetic oligonucleotide
caagtccacaaaagcgccgtc

SEQ ID NO: 18524 - DNA, 21 bp, Artificial Sequence
  Description of Artificial Sequence: Synthetic oligonucleotide
ggcggcagcaaaaacaacacc

SEQ ID NO: 18525 - DNA, 21 bp, Artificial Sequence
  Description of Artificial Sequence: Synthetic oligonucleotide
gacggcgccaaccacaccaac

SEQ ID NO: 18526 - DNA, 21 bp, Artificial Sequence
  Description of Artificial Sequence: Synthetic oligonucleotide
cagtctacgagtagttctgct

SEQ ID NO: 18527 - DNA, 21 bp, Artificial Sequence
  Description of Artificial Sequence: Synthetic oligonucleotide
ggtactggtgttgggggtatg

SEQ ID NO: 18528 - DNA, 21 bp, Artificial Sequence
  Description of Artificial Sequence: Synthetic oligonucleotide
aatcagggtgcgtctcctgtg

SEQ ID NO: 18529 - DNA, 21 bp, Artificial Sequence
  Description of Artificial Sequence: Synthetic oligonucleotide
aacaccagcaacaaaaccgac

SEQ ID NO: 18530 - DNA, 21 bp, Artificial Sequence
  Description of Artificial Sequence: Synthetic oligonucleotide
gatagtaagtctagtgctacg

SEQ ID NO: 18531 - DNA, 21 bp, Artificial Sequence
  Description of Artificial Sequence: Synthetic oligonucleotide
ggtacgacgccgagtggtccg

SEQ ID NO: 18532 - DNA, 21 bp, Artificial Sequence
  Description of Artificial Sequence: Synthetic oligonucleotide
acgactgagtcttcgatgcgg

SEQ ID NO: 18533 - DNA, 21 bp, Artificial Sequence
  Description of Artificial Sequence: Synthetic oligonucleotide
aatcgtaatagtacgtcgtct

SEQ ID NO: 18534 - DNA, 21 bp, Artificial Sequence
  Description of Artificial Sequence: Synthetic oligonucleotide
gaacccgtcaacggccacaaa

SEQ ID NO: 18535 - DNA, 21 bp, Artificial Sequence
  Description of Artificial Sequence: Synthetic oligonucleotide
gatcctacggctaatacgaag

SEQ ID NO: 18536 - DNA, 21 bp, Artificial Sequence
  Description of Artificial Sequence: Synthetic oligonucleotide
ggccaagacaaaagcaccgtc

SEQ ID NO: 18537 - DNA, 21 bp, Artificial Sequence
  Description of Artificial Sequence: Synthetic oligonucleotide
tcgaatgctcagcttgctaag

SEQ ID NO: 18538 - DNA, 21 bp, Artificial Sequence
  Description of Artificial Sequence: Synthetic oligonucleotide
gcgactgggacgactcctggt

SEQ ID NO: 18539 - DNA, 21 bp, Artificial Sequence
  Description of Artificial Sequence: Synthetic oligonucleotide
actatgagtaattctccggtt

SEQ ID NO: 18540 - DNA, 21 bp, Artificial Sequence
  Description of Artificial Sequence: Synthetic oligonucleotide
catggtcatgataaggctcag

SEQ ID NO: 18541 - DNA, 21 bp, Artificial Sequence
  Description of Artificial Sequence: Synthetic oligonucleotide
tcttctgggtctcattctgcg

SEQ ID NO: 18542 - DNA, 21 bp, Artificial Sequence
  Description of Artificial Sequence: Synthetic oligonucleotide
gaacaaagaagcaaacccatg

SEQ ID NO: 18543 - DNA, 21 bp, Artificial Sequence
  Description of Artificial Sequence: Synthetic oligonucleotide
ctcaccgacgccaacagaggc

SEQ ID NO: 18544 - DNA, 21 bp, Artificial Sequence
  Description of Artificial Sequence: Synthetic oligonucleotide
gttcagtcgcaggggacgcct

SEQ ID NO: 18545 - DNA, 21 bp, Artificial Sequence
  Description of Artificial Sequence: Synthetic oligonucleotide
atttcgacgggtggttcttct

SEQ ID NO: 18546 - DNA, 21 bp, Artificial Sequence
  Description of Artificial Sequence: Synthetic oligonucleotide
aacagcaacaccagcagcagc

SEQ ID NO: 18547 - DNA, 21 bp, Artificial Sequence
  Description of Artificial Sequence: Synthetic oligonucleotide
accggcaccaaccacctcgcc

SEQ ID NO: 18548 - DNA, 21 bp, Artificial Sequence
  Description of Artificial Sequence: Synthetic oligonucleotide
actcatggtggttctacgcct

SEQ ID NO: 18549 - DNA, 21 bp, Artificial Sequence
  Description of Artificial Sequence: Synthetic oligonucleotide
cagggttcgtcttctgttatg

SEQ ID NO: 18550 - DNA, 21 bp, Artificial Sequence
  Description of Artificial Sequence: Synthetic oligonucleotide
ggcgaagccagccaaagcaga

SEQ ID NO: 18551 - DNA, 21 bp, Artificial Sequence
  Description of Artificial Sequence: Synthetic oligonucleotide
ggtcagagtagtccttctagt

SEQ ID NO: 18552 - DNA, 21 bp, Artificial Sequence
  Description of Artificial Sequence: Synthetic oligonucleotide
gccagccaaacccccaccagc

SEQ ID NO: 18553 - DNA, 21 bp, Artificial Sequence
  Description of Artificial Sequence: Synthetic oligonucleotide
gacggcaccagcaaaaaactc

SEQ ID NO: 18554 - DNA, 21 bp, Artificial Sequence
  Description of Artificial Sequence: Synthetic oligonucleotide
gagggtgtttctcctaagacg

SEQ ID NO: 18555 - DNA, 21 bp, Artificial Sequence
  Description of Artificial Sequence: Synthetic oligonucleotide
cagtctcagtcttctacgatg

SEQ ID NO: 18556 - DNA, 21 bp, Artificial Sequence
  Description of Artificial Sequence: Synthetic oligonucleotide
gaaaccagcaacaccggcaaa

SEQ ID NO: 18557 - DNA, 21 bp, Artificial Sequence
  Description of Artificial Sequence: Synthetic oligonucleotide
tcgccgaatcagtctagtggt

SEQ ID NO: 18558 - DNA, 21 bp, Artificial Sequence
  Description of Artificial Sequence: Synthetic oligonucleotide
acccccaccgacaacaaaggc

SEQ ID NO: 18559 - DNA, 21 bp, Artificial Sequence
  Description of Artificial Sequence: Synthetic oligonucleotide
agaggcgaccaaaccctcgcc

SEQ ID NO: 18560 - DNA, 21 bp, Artificial Sequence
  Description of Artificial Sequence: Synthetic oligonucleotide
gaaagcggccaaagcaaaggc

SEQ ID NO: 18561 - DNA, 21 bp, Artificial Sequence
  Description of Artificial Sequence: Synthetic oligonucleotide
ggtgtggcgactccttcgaag

SEQ ID NO: 18562 - DNA, 21 bp, Artificial Sequence
  Description of Artificial Sequence: Synthetic oligonucleotide
tcgtcggttagtacggcgtct

SEQ ID NO: 18563 - DNA, 21 bp, Artificial Sequence
  Description of Artificial Sequence: Synthetic oligonucleotide
gcccaagaaagagacgccaaa

SEQ ID NO: 18564 - DNA, 21 bp, Artificial Sequence
  Description of Artificial Sequence: Synthetic oligonucleotide
ggtccgagtaatcagaagatg

SEQ ID NO: 18565 - DNA, 21 bp, Artificial Sequence
  Description of Artificial Sequence: Synthetic oligonucleotide
aacaacggcaacgccaccacc

SEQ ID NO: 18566 - DNA, 21 bp, Artificial Sequence
  Description of Artificial Sequence: Synthetic oligonucleotide
accagcggcggcaccatgagc

SEQ ID NO: 18567 - DNA, 21 bp, Artificial Sequence
  Description of Artificial Sequence: Synthetic oligonucleotide
acgggtaagactagtacgtct

SEQ ID NO: 18568 - DNA, 21 bp, Artificial Sequence
  Description of Artificial Sequence: Synthetic oligonucleotide
aacggcaacgacaccgccaaa

SEQ ID NO: 18569 - DNA, 21 bp, Artificial Sequence
  Description of Artificial Sequence: Synthetic oligonucleotide
gctgattctaagcagaatgct

SEQ ID NO: 18570 - DNA, 21 bp, Artificial Sequence
  Description of Artificial Sequence: Synthetic oligonucleotide
tcgccggggccggctacgaag

SEQ ID NO: 18571 - DNA, 21 bp, Artificial Sequence
  Description of Artificial Sequence: Synthetic oligonucleotide
tcggggcagaaggttaattcg

SEQ ID NO: 18572 - DNA, 21 bp, Artificial Sequence
  Description of Artificial Sequence: Synthetic oligonucleotide
gggtcgaatgctcagtctcgt

SEQ ID NO: 18573 - DNA, 21 bp, Artificial Sequence
  Description of Artificial Sequence: Synthetic oligonucleotide
cagccgtctagtacgcctacg

SEQ ID NO: 18574 - DNA, 21 bp, Artificial Sequence
  Description of Artificial Sequence: Synthetic oligonucleotide
ggggttacttcgaagcctgat

SEQ ID NO: 18575 - DNA, 21 bp, Artificial Sequence
  Description of Artificial Sequence: Synthetic oligonucleotide
accaacctcggcagccccagc

SEQ ID NO: 18576 - DNA, 21 bp, Artificial Sequence
  Description of Artificial Sequence: Synthetic oligonucleotide
cagaatagtgagaagggtcag

SEQ ID NO: 18577 - DNA, 21 bp, Artificial Sequence
  Description of Artificial Sequence: Synthetic oligonucleotide
gaaagaaccggcagcagcggc

SEQ ID NO: 18578 - DNA, 21 bp, Artificial Sequence
  Description of Artificial Sequence: Synthetic oligonucleotide
aatgggacgcagaatgcgcag

SEQ ID NO: 18579 - DNA, 21 bp, Artificial Sequence
  Description of Artificial Sequence: Synthetic oligonucleotide
ctcagagacaaaagcagcggc

SEQ ID NO: 18580 - DNA, 21 bp, Artificial Sequence
  Description of Artificial Sequence: Synthetic oligonucleotide
acgccttcgaagactagtgcg

SEQ ID NO: 18581 - DNA, 21 bp, Artificial Sequence
  Description of Artificial Sequence: Synthetic oligonucleotide
agccaagtcagccaaggcgcc

SEQ ID NO: 18582 - DNA, 21 bp, Artificial Sequence
  Description of Artificial Sequence: Synthetic oligonucleotide
tcgacgcataaggatcagtcg

SEQ ID NO: 18583 - DNA, 21 bp, Artificial Sequence
  Description of Artificial Sequence: Synthetic oligonucleotide
accagcgcccaagccaccagc

SEQ ID NO: 18584 - DNA, 21 bp, Artificial Sequence
  Description of Artificial Sequence: Synthetic oligonucleotide
acgcctacttcttcgtctatg

SEQ ID NO: 18585 - DNA, 21 bp, Artificial Sequence
  Description of Artificial Sequence: Synthetic oligonucleotide
agcagcaccaacgcccccacc

SEQ ID NO: 18586 - DNA, 21 bp, Artificial Sequence
  Description of Artificial Sequence: Synthetic oligonucleotide
gctagtccggctggttctggt

SEQ ID NO: 18587 - DNA, 21 bp, Artificial Sequence
  Description of Artificial Sequence: Synthetic oligonucleotide
aatggtgcggctcctgtgtct

SEQ ID NO: 18588 - DNA, 21 bp, Artificial Sequence
  Description of Artificial Sequence: Synthetic oligonucleotide
gacatgggccacaaaggccaa

SEQ ID NO: 18589 - DNA, 21 bp, Artificial Sequence
  Description of Artificial Sequence: Synthetic oligonucleotide
ggtggggagacgcggactagt

SEQ ID NO: 18590 - DNA, 21 bp, Artificial Sequence
  Description of Artificial Sequence: Synthetic oligonucleotide
cacacccaaaacaccagcgcc

SEQ ID NO: 18591 - DNA, 21 bp, Artificial Sequence
  Description of Artificial Sequence: Synthetic oligonucleotide
cagaatgcgcctacttcgggt

SEQ ID NO: 18592 - DNA, 21 bp, Artificial Sequence
  Description of Artificial Sequence: Synthetic oligonucleotide
accgtcagcagcaacggcgcc

SEQ ID NO: 18593 - DNA, 21 bp, Artificial Sequence
  Description of Artificial Sequence: Synthetic oligonucleotide
tcggttagtaagtcttctgtt

SEQ ID NO: 18594 - DNA, 21 bp, Artificial Sequence
  Description of Artificial Sequence: Synthetic oligonucleotide
tgcagcgacagcaaaagccaa

SEQ ID NO: 18595 - DNA, 21 bp, Artificial Sequence
  Description of Artificial Sequence: Synthetic oligonucleotide
caggttgcggatgctaatagg

SEQ ID NO: 18596 - DNA, 21 bp, Artificial Sequence
  Description of Artificial Sequence: Synthetic oligonucleotide
ggggagccgaggaataatagt

SEQ ID NO: 18597 - DNA, 21 bp, Artificial Sequence
  Description of Artificial Sequence: Synthetic oligonucleotide
gagtcgtctggtacgtcgagg

SEQ ID NO: 18598 - DNA, 21 bp, Artificial Sequence
  Description of Artificial Sequence: Synthetic oligonucleotide
ggcagagacggcgccagcggc

SEQ ID NO: 18599 - DNA, 21 bp, Artificial Sequence
  Description of Artificial Sequence: Synthetic oligonucleotide
aacaccagcaaaggcaacagc

SEQ ID NO: 18600 - DNA, 21 bp, Artificial Sequence
  Description of Artificial Sequence: Synthetic oligonucleotide
atccccagcagcagcagcagc

SEQ ID NO: 18601 - DNA, 21 bp, Artificial Sequence
  Description of Artificial Sequence: Synthetic oligonucleotide
atgcccggcaccgccgccccc

SEQ ID NO: 18602 - DNA, 21 bp, Artificial Sequence
  Description of Artificial Sequence: Synthetic oligonucleotide
aacagagccaccgccaccgcc

SEQ ID NO: 18603 - DNA, 21 bp, Artificial Sequence
  Description of Artificial Sequence: Synthetic oligonucleotide
ggggttgcgcagccgcatggt

SEQ ID NO: 18604 - DNA, 21 bp, Artificial Sequence
  Description of Artificial Sequence: Synthetic oligonucleotide
agcagcaccggcaaagtcagc

SEQ ID NO: 18605 - DNA, 21 bp, Artificial Sequence
  Description of Artificial Sequence: Synthetic oligonucleotide
cgtattgatgggaggaaggat

SEQ ID NO: 18606 - DNA, 21 bp, Artificial Sequence
  Description of Artificial Sequence: Synthetic oligonucleotide
agtacgaatgctggtggtagt

SEQ ID NO: 18607 - DNA, 21 bp, Artificial Sequence
  Description of Artificial Sequence: Synthetic oligonucleotide
catagtggggagcgtcagggt

SEQ ID NO: 18608 - DNA, 21 bp, Artificial Sequence
  Description of Artificial Sequence: Synthetic oligonucleotide
ggccccaacaccagccccagc

SEQ ID NO: 18609 - DNA, 21 bp, Artificial Sequence
  Description of Artificial Sequence: Synthetic oligonucleotide
tctgatgataagattcgtggt

SEQ ID NO: 18610 - DNA, 21 bp, Artificial Sequence
  Description of Artificial Sequence: Synthetic oligonucleotide
aacagaagcgaaagccccagc

SEQ ID NO: 18611 - DNA, 21 bp, Artificial Sequence
  Description of Artificial Sequence: Synthetic oligonucleotide
gacggcaaacccagcagcgtc

SEQ ID NO: 18612 - DNA, 21 bp, Artificial Sequence
  Description of Artificial Sequence: Synthetic oligonucleotide
caaggcagcagcaccaacagc

SEQ ID NO: 18613 - DNA, 21 bp, Artificial Sequence
  Description of Artificial Sequence: Synthetic oligonucleotide
ggcaaaggcacccccgacagc

SEQ ID NO: 18614 - DNA, 21 bp, Artificial Sequence
  Description of Artificial Sequence: Synthetic oligonucleotide
cttgggactaagccgaatatg

SEQ ID NO: 18615 - DNA, 21 bp, Artificial Sequence
  Description of Artificial Sequence: Synthetic oligonucleotide
cacagcgaccccaaaggcctc

SEQ ID NO: 18616 - DNA, 21 bp, Artificial Sequence
  Description of Artificial Sequence: Synthetic oligonucleotide
atggagaagccgagtcttgct

SEQ ID NO: 18617 - DNA, 21 bp, Artificial Sequence
  Description of Artificial Sequence: Synthetic oligonucleotide
aacagcaccaacagcagcaaa

SEQ ID NO: 18618 - DNA, 21 bp, Artificial Sequence
  Description of Artificial Sequence: Synthetic oligonucleotide
atgggccaaggccccaaagac

SEQ ID NO: 18619 - DNA, 21 bp, Artificial Sequence
  Description of Artificial Sequence: Synthetic oligonucleotide
ctcagcagcaaagaaaccacc

SEQ ID NO: 18620 - DNA, 21 bp, Artificial Sequence
  Description of Artificial Sequence: Synthetic oligonucleotide
gccctcggcagcaaccccggc

SEQ ID NO: 18621 - DNA, 21 bp, Artificial Sequence
  Description of Artificial Sequence: Synthetic oligonucleotide
gccggcacccaaagcaccatg

SEQ ID NO: 18622 - DNA, 21 bp, Artificial Sequence
  Description of Artificial Sequence: Synthetic oligonucleotide
gccggcaccggcagcagcaaa

SEQ ID NO: 18623 - DNA, 21 bp, Artificial Sequence
  Description of Artificial Sequence: Synthetic oligonucleotide
ggcaccggcagagacaacctc

SEQ ID NO: 18624 - DNA, 21 bp, Artificial Sequence
  Description of Artificial Sequence: Synthetic oligonucleotide
gggactagtaatagtggttcg

SEQ ID NO: 18625 - DNA, 21 bp, Artificial Sequence
  Description of Artificial Sequence: Synthetic oligonucleotide
ggggagaagacgaatatgtct

SEQ ID NO: 18626 - DNA, 21 bp, Artificial Sequence
  Description of Artificial Sequence: Synthetic oligonucleotide
gtccaaaacaccgccgccggc

SEQ ID NO: 18627 - DNA, 21 bp, Artificial Sequence
  Description of Artificial Sequence: Synthetic oligonucleotide
accgacagcagagacaaagtc

SEQ ID NO: 18628 - DNA, 21 bp, Artificial Sequence
  Description of Artificial Sequence: Synthetic oligonucleotide
gacacccacagcaccagcaga

SEQ ID NO: 18629 - DNA, 21 bp, Artificial Sequence
  Description of Artificial Sequence: Synthetic oligonucleotide
tctccttcgactaaggagtct

SEQ ID NO: 18630 - DNA, 21 bp, Artificial Sequence
  Description of Artificial Sequence: Synthetic oligonucleotide
accgccggcaacgccaacagc

SEQ ID NO: 18631 - DNA, 21 bp, Artificial Sequence
  Description of Artificial Sequence: Synthetic oligonucleotide
agtactctgtctgcgaagggg

SEQ ID NO: 18632 - DNA, 21 bp, Artificial Sequence
  Description of Artificial Sequence: Synthetic oligonucleotide
accggcggccaaagcaacgtc

SEQ ID NO: 18633 - DNA, 21 bp, Artificial Sequence
  Description of Artificial Sequence: Synthetic oligonucleotide
agccaaagcagccccacccaa

SEQ ID NO: 18634 - DNA, 21 bp, Artificial Sequence
  Description of Artificial Sequence: Synthetic oligonucleotide
aatggggagtcgaagccgatg

SEQ ID NO: 18635 - DNA, 21 bp, Artificial Sequence
  Description of Artificial Sequence: Synthetic oligonucleotide
accaacgccaccaaccacgtc

SEQ ID NO: 18636 - DNA, 21 bp, Artificial Sequence
  Description of Artificial Sequence: Synthetic oligonucleotide
agcaacggcggccccagcagc

SEQ ID NO: 18637 - DNA, 21 bp, Artificial Sequence
  Description of Artificial Sequence: Synthetic oligonucleotide
gatggtgtgagggagaaggtg

SEQ ID NO: 18638 - DNA, 21 bp, Artificial Sequence
  Description of Artificial Sequence: Synthetic oligonucleotide
gggaatagtccgacgctgcag

SEQ ID NO: 18639 - DNA, 21 bp, Artificial Sequence
  Description of Artificial Sequence: Synthetic oligonucleotide
gtcaccggcgtccccaccacc

SEQ ID NO: 18640 - DNA, 21 bp, Artificial Sequence
  Description of Artificial Sequence: Synthetic oligonucleotide
agcgaaatcaaccccaaactc

SEQ ID NO: 18641 - DNA, 21 bp, Artificial Sequence
  Description of Artificial Sequence: Synthetic oligonucleotide
gctactggttctggtagttct

SEQ ID NO: 18642 - DNA, 21 bp, Artificial Sequence
  Description of Artificial Sequence: Synthetic oligonucleotide
gaacacggcaaaagcagcgtc

SEQ ID NO: 18643 - DNA, 21 bp, Artificial Sequence
  Description of Artificial Sequence: Synthetic oligonucleotide
ggcgtcggccaaagcaacggc

SEQ ID NO: 18644 - DNA, 21 bp, Artificial Sequence
  Description of Artificial Sequence: Synthetic oligonucleotide
ggcagcgccaccgccaacgcc

SEQ ID NO: 18645 - DNA, 21 bp, Artificial Sequence
  Description of Artificial Sequence: Synthetic oligonucleotide
agcgccgaaatcaaaggcgcc

SEQ ID NO: 18646 - DNA, 21 bp, Artificial Sequence
  Description of Artificial Sequence: Synthetic oligonucleotide
ctgaatagtcctacgacgggt

SEQ ID NO: 18647 - DNA, 21 bp, Artificial Sequence
  Description of Artificial Sequence: Synthetic oligonucleotide
aaccacgacggcgccggcaaa

SEQ ID NO: 18648 - DNA, 21 bp, Artificial Sequence
  Description of Artificial Sequence: Synthetic oligonucleotide
gacagagccagccccaccacc

SEQ ID NO: 18649 - DNA, 21 bp, Artificial Sequence
  Description of Artificial Sequence: Synthetic oligonucleotide
attggtacgtcgtcgcagggt

SEQ ID NO: 18650 - DNA, 21 bp, Artificial Sequence
  Description of Artificial Sequence: Synthetic oligonucleotide
accggcgccgaccccctcaaa

SEQ ID NO: 18651 - DNA, 21 bp, Artificial Sequence
  Description of Artificial Sequence: Synthetic oligonucleotide
acgttggctagtacgaatcag

SEQ ID NO: 18652 - DNA, 21 bp, Artificial Sequence
  Description of Artificial Sequence: Synthetic oligonucleotide
gctctggagactcctacgcgg

SEQ ID NO: 18653 - DNA, 21 bp, Artificial Sequence
  Description of Artificial Sequence: Synthetic oligonucleotide
gaaggcagaagcagcgtcgtc

SEQ ID NO: 18654 - DNA, 21 bp, Artificial Sequence
  Description of Artificial Sequence: Synthetic oligonucleotide
caaggcacccacaaacaagac

SEQ ID NO: 18655 - DNA, 21 bp, Artificial Sequence
  Description of Artificial Sequence: Synthetic oligonucleotide
accagcggcgaccacatgaaa

SEQ ID NO: 18656 - DNA, 21 bp, Artificial Sequence
  Description of Artificial Sequence: Synthetic oligonucleotide
gacagcaacgtcaccaaaccc

SEQ ID NO: 18657 - DNA, 21 bp, Artificial Sequence
  Description of Artificial Sequence: Synthetic oligonucleotide
aacggcggcgcccacgtcacc

SEQ ID NO: 18658 - DNA, 21 bp, Artificial Sequence
  Description of Artificial Sequence: Synthetic oligonucleotide
aatgcgggggggaatgctatt

SEQ ID NO: 18659 - DNA, 21 bp, Artificial Sequence
  Description of Artificial Sequence: Synthetic oligonucleotide
acgggggcgggtagtagtgtc

SEQ ID NO: 18660 - DNA, 21 bp, Artificial Sequence
  Description of Artificial Sequence: Synthetic oligonucleotide
tctagtcctggtgctagttcg

SEQ ID NO: 18661 - DNA, 21 bp, Artificial Sequence
  Description of Artificial Sequence: Synthetic oligonucleotide
aacaccaaaggcaccacccaa

SEQ ID NO: 18662 - DNA, 21 bp, Artificial Sequence
  Description of Artificial Sequence: Synthetic oligonucleotide
ggcagcgccaccgccagcacc

SEQ ID NO: 18663 - DNA, 21 bp, Artificial Sequence
  Description of Artificial Sequence: Synthetic oligonucleotide
agcctcggcagccaaagcaaa

SEQ ID NO: 18664 - DNA, 21 bp, Artificial Sequence
  Description of Artificial Sequence: Synthetic oligonucleotide
agcggcaaagacaccatgcaa

SEQ ID NO: 18665 - DNA, 21 bp, Artificial Sequence
  Description of Artificial Sequence: Synthetic oligonucleotide
gggaatgttgataaggttgtg

SEQ ID NO: 18666 - DNA, 21 bp, Artificial Sequence
  Description of Artificial Sequence: Synthetic oligonucleotide
agcgtcagcaaagaaaccatg

SEQ ID NO: 18667 - DNA, 21 bp, Artificial Sequence
  Description of Artificial Sequence: Synthetic oligonucleotide
gcttcggatggtaagacggct

SEQ ID NO: 18668 - DNA, 21 bp, Artificial Sequence
  Description of Artificial Sequence: Synthetic oligonucleotide
gggaagaatggtcatgcgggt

SEQ ID NO: 18669 - DNA, 21 bp, Artificial Sequence
  Description of Artificial Sequence: Synthetic oligonucleotide
gggggttctgataataagaat

SEQ ID NO: 18670 - DNA, 21 bp, Artificial Sequence
  Description of Artificial Sequence: Synthetic oligonucleotide
agcagagaaggcacccccctc

SEQ ID NO: 18671 - DNA, 21 bp, Artificial Sequence
  Description of Artificial Sequence: Synthetic oligonucleotide
ttggtggggaagtctactagt

SEQ ID NO: 18672 - DNA, 21 bp, Artificial Sequence
  Description of Artificial Sequence: Synthetic oligonucleotide
agcaacgacagcagaaaaggc

SEQ ID NO: 18673 - DNA, 21 bp, Artificial Sequence
  Description of Artificial Sequence: Synthetic oligonucleotide
aacgccgaccaacccggcaaa

SEQ ID NO: 18674 - DNA, 21 bp, Artificial Sequence
  Description of Artificial Sequence: Synthetic oligonucleotide
atggcgacgaatgcgacggct

SEQ ID NO: 18675 - DNA, 21 bp, Artificial Sequence
  Description of Artificial Sequence: Synthetic oligonucleotide
gaagtcagccccaccagcaaa

SEQ ID NO: 18676 - DNA, 21 bp, Artificial Sequence
  Description of Artificial Sequence: Synthetic oligonucleotide
ggccccaacacccccgccgtc

SEQ ID NO: 18677 - DNA, 21 bp, Artificial Sequence
  Description of Artificial Sequence: Synthetic oligonucleotide
cagcaggggtcgaatgcgaat

SEQ ID NO: 18678 - DNA, 21 bp, Artificial Sequence
  Description of Artificial Sequence: Synthetic oligonucleotide
gtgtctggttcggctgcggct

SEQ ID NO: 18679 - DNA, 21 bp, Artificial Sequence
  Description of Artificial Sequence: Synthetic oligonucleotide
gctgagacttcgggttcgaag

SEQ ID NO: 18680 - DNA, 21 bp, Artificial Sequence
  Description of Artificial Sequence: Synthetic oligonucleotide
caaggcacccccaaacccgac

SEQ ID NO: 18681 - DNA, 21 bp, Artificial Sequence
  Description of Artificial Sequence: Synthetic oligonucleotide
gagcaggcgactaagtctccg

SEQ ID NO: 18682 - DNA, 21 bp, Artificial Sequence
  Description of Artificial Sequence: Synthetic oligonucleotide
agccccgtcaacaccaaagtc

SEQ ID NO: 18683 - DNA, 21 bp, Artificial Sequence
  Description of Artificial Sequence: Synthetic oligonucleotide
actcagaggggggcttctcag

SEQ ID NO: 18684 - DNA, 21 bp, Artificial Sequence
  Description of Artificial Sequence: Synthetic oligonucleotide
attaggagtgattctacggcg

SEQ ID NO: 18685 - DNA, 21 bp, Artificial Sequence
  Description of Artificial Sequence: Synthetic oligonucleotide
cgggaggggtcgggttcggct

SEQ ID NO: 18686 - DNA, 21 bp, Artificial Sequence
  Description of Artificial Sequence: Synthetic oligonucleotide
gacagaagcagcgcccaagcc

SEQ ID NO: 18687 - DNA, 21 bp, Artificial Sequence
  Description of Artificial Sequence: Synthetic oligonucleotide
gatcaggcgggggagaggagt

SEQ ID NO: 18688 - DNA, 21 bp, Artificial Sequence
  Description of Artificial Sequence: Synthetic oligonucleotide
gccagcagcgaaaaagacaga

SEQ ID NO: 18689 - DNA, 21 bp, Artificial Sequence
  Description of Artificial Sequence: Synthetic oligonucleotide
gggattagtgcgagtacgggt

SEQ ID NO: 18690 - DNA, 21 bp, Artificial Sequence
  Description of Artificial Sequence: Synthetic oligonucleotide
gtttctcaggggacgtcggtg

SEQ ID NO: 18691 - DNA, 21 bp, Artificial Sequence
  Description of Artificial Sequence: Synthetic oligonucleotide
tctgatgtggggaatgggaag

SEQ ID NO: 18692 - DNA, 21 bp, Artificial Sequence
  Description of Artificial Sequence: Synthetic oligonucleotide
ggcagccccggcaccagcagc

SEQ ID NO: 18693 - DNA, 21 bp, Artificial Sequence
  Description of Artificial Sequence: Synthetic oligonucleotide
gcgagggggaagacgtctgag

SEQ ID NO: 18694 - DNA, 21 bp, Artificial Sequence
  Description of Artificial Sequence: Synthetic oligonucleotide
caaaccgtcaccagcagccaa

SEQ ID NO: 18695 - DNA, 21 bp, Artificial Sequence
  Description of Artificial Sequence: Synthetic oligonucleotide
agaagcaacagcgccaccagc

SEQ ID NO: 18696 - DNA, 21 bp, Artificial Sequence
  Description of Artificial Sequence: Synthetic oligonucleotide
agcaacaacagcgcccaaggc

SEQ ID NO: 18697 - DNA, 21 bp, Artificial Sequence
  Description of Artificial Sequence: Synthetic oligonucleotide
aacaccaccgacaaaggcagc

SEQ ID NO: 18698 - DNA, 21 bp, Artificial Sequence
  Description of Artificial Sequence: Synthetic oligonucleotide
agcagcgacacccaaaaaaac

SEQ ID NO: 18699 - DNA, 21 bp, Artificial Sequence
  Description of Artificial Sequence: Synthetic oligonucleotide
ctcagcagcagcggcggcggc

SEQ ID NO: 18700 - DNA, 21 bp, Artificial Sequence
  Description of Artificial Sequence: Synthetic oligonucleotide
ctcgccaacagcaacaccagc

SEQ ID NO: 18701 - DNA, 21 bp, Artificial Sequence
  Description of Artificial Sequence: Synthetic oligonucleotide
gggtctcattctcagagtggt

SEQ ID NO: 18702 - DNA, 21 bp, Artificial Sequence
  Description of Artificial Sequence: Synthetic oligonucleotide
agcgcccccgacagaggcggc

SEQ ID NO: 18703 - DNA, 21 bp, Artificial Sequence
  Description of Artificial Sequence: Synthetic oligonucleotide
gacaccagcaaaagcgccctc

SEQ ID NO: 18704 - DNA, 21 bp, Artificial Sequence
  Description of Artificial Sequence: Synthetic oligonucleotide
ggcgaaaacggcaaaagcgtc

SEQ ID NO: 18705 - DNA, 21 bp, Artificial Sequence
  Description of Artificial Sequence: Synthetic oligonucleotide
ctgggggagacgaaggctggg

SEQ ID NO: 18706 - DNA, 21 bp, Artificial Sequence
  Description of Artificial Sequence: Synthetic oligonucleotide
ctcggcgacaacacccaaaaa

SEQ ID NO: 18707 - DNA, 21 bp, Artificial Sequence
  Description of Artificial Sequence: Synthetic oligonucleotide
caaagcaccggcaccctcagc

SEQ ID NO: 18708 - DNA, 21 bp, Artificial Sequence
  Description of Artificial Sequence: Synthetic oligonucleotide
gacagcgccagcaaacacggc

SEQ ID NO: 18709 - DNA, 21 bp, Artificial Sequence
  Description of Artificial Sequence: Synthetic oligonucleotide
tcgggtgttgaggcgcggagt

SEQ ID NO: 18710 - DNA, 21 bp, Artificial Sequence
  Description of Artificial Sequence: Synthetic oligonucleotide
aacaacagcgacaccaacaaa

SEQ ID NO: 18711 - DNA, 21 bp, Artificial Sequence
  Description of Artificial Sequence: Synthetic oligonucleotide
catgttagtgggacgcctgct

SEQ ID NO: 18712 - DNA, 21 bp, Artificial Sequence
  Description of Artificial Sequence: Synthetic oligonucleotide
agcaacggcggcaccaaaacc

SEQ ID NO: 18713 - DNA, 21 bp, Artificial Sequence
  Description of Artificial Sequence: Synthetic oligonucleotide
aatggtggtaagacgaatgtg

SEQ ID NO: 18714 - DNA, 21 bp, Artificial Sequence
  Description of Artificial Sequence: Synthetic oligonucleotide
aatggtagtactagtcttaag

SEQ ID NO: 18715 - DNA, 21 bp, Artificial Sequence
  Description of Artificial Sequence: Synthetic oligonucleotide
aatagtaatgagaagtctggt

SEQ ID NO: 18716 - DNA, 21 bp, Artificial Sequence
  Description of Artificial Sequence: Synthetic oligonucleotide
aggacttctggtccgaatacg

SEQ ID NO: 18717 - DNA, 21 bp, Artificial Sequence
  Description of Artificial Sequence: Synthetic oligonucleotide
gagtctccgtctcataataag

SEQ ID NO: 18718 - DNA, 21 bp, Artificial Sequence
  Description of Artificial Sequence: Synthetic oligonucleotide
gctgggggtgagctgcagaag

SEQ ID NO: 18719 - DNA, 21 bp, Artificial Sequence
  Description of Artificial Sequence: Synthetic oligonucleotide
ctcaccagcggcaaaggcagc

SEQ ID NO: 18720 - DNA, 21 bp, Artificial Sequence
  Description of Artificial Sequence: Synthetic oligonucleotide
aaagccaccagcaccagcagc

SEQ ID NO: 18721 - DNA, 21 bp, Artificial Sequence
  Description of Artificial Sequence: Synthetic oligonucleotide
gatgggagtaatgggaagatg

SEQ ID NO: 18722 - DNA, 21 bp, Artificial Sequence
  Description of Artificial Sequence: Synthetic oligonucleotide
tcggtggataagacggcgggg

SEQ ID NO: 18723 - DNA, 21 bp, Artificial Sequence
  Description of Artificial Sequence: Synthetic oligonucleotide
caaggcatcaccaacagcaac

SEQ ID NO: 18724 - DNA, 21 bp, Artificial Sequence
  Description of Artificial Sequence: Synthetic oligonucleotide
catcagtcggggagtcctact

SEQ ID NO: 18725 - DNA, 21 bp, Artificial Sequence
  Description of Artificial Sequence: Synthetic oligonucleotide
gagacggttaagagtagtcag

SEQ ID NO: 18726 - DNA, 21 bp, Artificial Sequence
  Description of Artificial Sequence: Synthetic oligonucleotide
gagtctggggatcgtgggaag

SEQ ID NO: 18727 - DNA, 21 bp, Artificial Sequence
  Description of Artificial Sequence: Synthetic oligonucleotide
accagcaaacccagcagcgaa

SEQ ID NO: 18728 - DNA, 21 bp, Artificial Sequence
  Description of Artificial Sequence: Synthetic oligonucleotide
ggcgccaccagccccacccaa

SEQ ID NO: 18729 - DNA, 21 bp, Artificial Sequence
  Description of Artificial Sequence: Synthetic oligonucleotide
caggcgaatgatcggtctgct

SEQ ID NO: 18730 - DNA, 21 bp, Artificial Sequence
  Description of Artificial Sequence: Synthetic oligonucleotide
aacaacaacgcccacgccagc

SEQ ID NO: 18731 - DNA, 21 bp, Artificial Sequence
  Description of Artificial Sequence: Synthetic oligonucleotide
caggcgcagagtgctagtaag

SEQ ID NO: 18732 - DNA, 21 bp, Artificial Sequence
  Description of Artificial Sequence: Synthetic oligonucleotide
agcagctacgaacccaacaaa

SEQ ID NO: 18733 - DNA, 21 bp, Artificial Sequence
  Description of Artificial Sequence: Synthetic oligonucleotide
agcaaaaccggcggcaccagc

SEQ ID NO: 18734 - DNA, 21 bp, Artificial Sequence
  Description of Artificial Sequence: Synthetic oligonucleotide
agcagcagcgacaaacacggc

SEQ ID NO: 18735 - DNA, 21 bp, Artificial Sequence
  Description of Artificial Sequence: Synthetic oligonucleotide
agcatgcccggcgaaaaaaga

SEQ ID NO: 18736 - DNA, 21 bp, Artificial Sequence
  Description of Artificial Sequence: Synthetic oligonucleotide
atcgaaggcagcggccacagc

SEQ ID NO: 18737 - DNA, 21 bp, Artificial Sequence
  Description of Artificial Sequence: Synthetic oligonucleotide
ggcagcaccgccgcccccggc

SEQ ID NO: 18738 - DNA, 21 bp, Artificial Sequence
  Description of Artificial Sequence: Synthetic oligonucleotide
gggacgactgctactgttggt

SEQ ID NO: 18739 - DNA, 21 bp, Artificial Sequence
  Description of Artificial Sequence: Synthetic oligonucleotide
ggccaaaccaccggcacccac

SEQ ID NO: 18740 - DNA, 21 bp, Artificial Sequence
  Description of Artificial Sequence: Synthetic oligonucleotide
accaacagcagccccaccctc

SEQ ID NO: 18741 - DNA, 21 bp, Artificial Sequence
  Description of Artificial Sequence: Synthetic oligonucleotide
agcaccagcagacaagaaggc

SEQ ID NO: 18742 - DNA, 21 bp, Artificial Sequence
  Description of Artificial Sequence: Synthetic oligonucleotide
acgactgttggtccgaatcat

SEQ ID NO: 18743 - DNA, 21 bp, Artificial Sequence
  Description of Artificial Sequence: Synthetic oligonucleotide
gaaaacagcagcgccatcaaa

SEQ ID NO: 18744 - DNA, 21 bp, Artificial Sequence
  Description of Artificial Sequence: Synthetic oligonucleotide
gtggctacgacgtctagtagt

SEQ ID NO: 18745 - DNA, 21 bp, Artificial Sequence
  Description of Artificial Sequence: Synthetic oligonucleotide
agagaccacacccccaccacc

SEQ ID NO: 18746 - DNA, 21 bp, Artificial Sequence
  Description of Artificial Sequence: Synthetic oligonucleotide
atcagcagcagaggcagcgaa

SEQ ID NO: 18747 - DNA, 21 bp, Artificial Sequence
  Description of Artificial Sequence: Synthetic oligonucleotide
gggggtggtactccggttacg

SEQ ID NO: 18748 - DNA, 21 bp, Artificial Sequence
  Description of Artificial Sequence: Synthetic oligonucleotide
accagcaccacccaaccccac

SEQ ID NO: 18749 - DNA, 21 bp, Artificial Sequence
  Description of Artificial Sequence: Synthetic oligonucleotide
gccagaacccaaagcagcagc

SEQ ID NO: 18750 - DNA, 21 bp, Artificial Sequence
  Description of Artificial Sequence: Synthetic oligonucleotide
ggcaaagtcaacaccaccacc

SEQ ID NO: 18751 - DNA, 21 bp, Artificial Sequence
  Description of Artificial Sequence: Synthetic oligonucleotide
actgggggggagaagaagagt

SEQ ID NO: 18752 - DNA, 21 bp, Artificial Sequence
  Description of Artificial Sequence: Synthetic oligonucleotide
ggttcggggtcgtcgagtgtg

SEQ ID NO: 18753 - DNA, 21 bp, Artificial Sequence
  Description of Artificial Sequence: Synthetic oligonucleotide
caggtgactggtaatcctcct

SEQ ID NO: 18754 - DNA, 21 bp, Artificial Sequence
  Description of Artificial Sequence: Synthetic oligonucleotide
gttactggtggtgcttctcag

SEQ ID NO: 18755 - DNA, 21 bp, Artificial Sequence
  Description of Artificial Sequence: Synthetic oligonucleotide
aatgcgtctcctagtgcgggt

SEQ ID NO: 18756 - DNA, 21 bp, Artificial Sequence
  Description of Artificial Sequence: Synthetic oligonucleotide
gggcatggggatgggcctcgt

SEQ ID NO: 18757 - DNA, 21 bp, Artificial Sequence
  Description of Artificial Sequence: Synthetic oligonucleotide
tctactacgggtgatactaag

SEQ ID NO: 18758 - DNA, 21 bp, Artificial Sequence
  Description of Artificial Sequence: Synthetic oligonucleotide
actggtactaagtcggataat

SEQ ID NO: 18759 - DNA, 21 bp, Artificial Sequence
  Description of Artificial Sequence: Synthetic oligonucleotide
agcggcatcaacgcccccacc

SEQ ID NO: 18760 - DNA, 21 bp, Artificial Sequence
  Description of Artificial Sequence: Synthetic oligonucleotide
ggcctcggcagcagcagcacc

SEQ ID NO: 18761 - DNA, 21 bp, Artificial Sequence
  Description of Artificial Sequence: Synthetic oligonucleotide
agcgccggcaacacccccctc

SEQ ID NO: 18762 - DNA, 21 bp, Artificial Sequence
  Description of Artificial Sequence: Synthetic oligonucleotide
accaaagaccacacccccagc

SEQ ID NO: 18763 - DNA, 21 bp, Artificial Sequence
  Description of Artificial Sequence: Synthetic oligonucleotide
agaggcagcgacaccgccaac

SEQ ID NO: 18764 - DNA, 21 bp, Artificial Sequence
  Description of Artificial Sequence: Synthetic oligonucleotide
gattctactgcgaaggatagt

SEQ ID NO: 18765 - DNA, 21 bp, Artificial Sequence
  Description of Artificial Sequence: Synthetic oligonucleotide
ggtaagagtaatgctactttt

SEQ ID NO: 18766 - DNA, 21 bp, Artificial Sequence
  Description of Artificial Sequence: Synthetic oligonucleotide
tcggtgggtagggatcctagt

SEQ ID NO: 18767 - DNA, 21 bp, Artificial Sequence
  Description of Artificial Sequence: Synthetic oligonucleotide
ttgacgggtcatcaggggggt

SEQ ID NO: 18768 - DNA, 21 bp, Artificial Sequence
  Description of Artificial Sequence: Synthetic oligonucleotide
caaagaggcaaccaaaacgtc

SEQ ID NO: 18769 - DNA, 21 bp, Artificial Sequence
  Description of Artificial Sequence: Synthetic oligonucleotide
agtacgaattcgggtggttcg

SEQ ID NO: 18770 - DNA, 21 bp, Artificial Sequence
  Description of Artificial Sequence: Synthetic oligonucleotide
cacggcggcggcagcgtcacc

SEQ ID NO: 18771 - DNA, 21 bp, Artificial Sequence
  Description of Artificial Sequence: Synthetic oligonucleotide
atgagtgggcagacgtcggtt

SEQ ID NO: 18772 - DNA, 21 bp, Artificial Sequence
  Description of Artificial Sequence: Synthetic oligonucleotide
gacaacgtcagccccaaaagc

SEQ ID NO: 18773 - DNA, 21 bp, Artificial Sequence
  Description of Artificial Sequence: Synthetic oligonucleotide
agcggcaacgccggccccagc

SEQ ID NO: 18774 - DNA, 21 bp, Artificial Sequence
  Description of Artificial Sequence: Synthetic oligonucleotide
gagcggggtagtgggactaat

SEQ ID NO: 18775 - DNA, 21 bp, Artificial Sequence
  Description of Artificial Sequence: Synthetic oligonucleotide
gggaatgatcatcagaagact

SEQ ID NO: 18776 - DNA, 21 bp, Artificial Sequence
  Description of Artificial Sequence: Synthetic oligonucleotide
aaacccctcgacaaacacgaa

SEQ ID NO: 18777 - DNA, 21 bp, Artificial Sequence
  Description of Artificial Sequence: Synthetic oligonucleotide
catcagacttctagttcgacc

SEQ ID NO: 18778 - DNA, 21 bp, Artificial Sequence
  Description of Artificial Sequence: Synthetic oligonucleotide
tctcagccgacgggtcagact

SEQ ID NO: 18779 - DNA, 21 bp, Artificial Sequence
  Description of Artificial Sequence: Synthetic oligonucleotide
aacgccgccagcgacctcaaa

SEQ ID NO: 18780 - DNA, 21 bp, Artificial Sequence
  Description of Artificial Sequence: Synthetic oligonucleotide
ctggttggtacgactcctgct

SEQ ID NO: 18781 - DNA, 21 bp, Artificial Sequence
  Description of Artificial Sequence: Synthetic oligonucleotide
gtcgccaccggcagcaccacc

SEQ ID NO: 18782 - DNA, 21 bp, Artificial Sequence
  Description of Artificial Sequence: Synthetic oligonucleotide
gatgttgctaaggggaaggat

SEQ ID NO: 18783 - DNA, 21 bp, Artificial Sequence
  Description of Artificial Sequence: Synthetic oligonucleotide
gcggaggtacagaagtctggg

SEQ ID NO: 18784 - DNA, 21 bp, Artificial Sequence
  Description of Artificial Sequence: Synthetic oligonucleotide
ggcctcggcgtccacgccgcc

SEQ ID NO: 18785 - DNA, 21 bp, Artificial Sequence
  Description of Artificial Sequence: Synthetic oligonucleotide
ggtcctcagacgagttcgggt

SEQ ID NO: 18786 - DNA, 21 bp, Artificial Sequence
  Description of Artificial Sequence: Synthetic oligonucleotide
aaaaacgccagcggcgccacc

SEQ ID NO: 18787 - DNA, 21 bp, Artificial Sequence
  Description of Artificial Sequence: Synthetic oligonucleotide
accggcaacggcgccggccaa

SEQ ID NO: 18788 - DNA, 21 bp, Artificial Sequence
  Description of Artificial Sequence: Synthetic oligonucleotide
atgaacagcggccaaagcagc

SEQ ID NO: 18789 - DNA, 21 bp, Artificial Sequence
  Description of Artificial Sequence: Synthetic oligonucleotide
atttcgacggataaggcgaat

SEQ ID NO: 18790 - DNA, 21 bp, Artificial Sequence
  Description of Artificial Sequence: Synthetic oligonucleotide
gagcctagtaataatcgtgtg

SEQ ID NO: 18791 - DNA, 21 bp, Artificial Sequence
  Description of Artificial Sequence: Synthetic oligonucleotide
ggccaaggcaccggccccatc

SEQ ID NO: 18792 - DNA, 21 bp, Artificial Sequence
  Description of Artificial Sequence: Synthetic oligonucleotide
gacagcagacccagcagcaac

SEQ ID NO: 18793 - DNA, 21 bp, Artificial Sequence
  Description of Artificial Sequence: Synthetic oligonucleotide
gaacaaagaaccaaagacagc

SEQ ID NO: 18794 - DNA, 21 bp, Artificial Sequence
  Description of Artificial Sequence: Synthetic oligonucleotide
gaactcagcagcaaagccagc

SEQ ID NO: 18795 - DNA, 21 bp, Artificial Sequence
  Description of Artificial Sequence: Synthetic oligonucleotide
agcgccgacagaaacaacgcc

SEQ ID NO: 18796 - DNA, 21 bp, Artificial Sequence
  Description of Artificial Sequence: Synthetic oligonucleotide
cagaagcctgggaatcttggt

SEQ ID NO: 18797 - DNA, 21 bp, Artificial Sequence
  Description of Artificial Sequence: Synthetic oligonucleotide
catactactgataagattcag

SEQ ID NO: 18798 - DNA, 21 bp, Artificial Sequence
  Description of Artificial Sequence: Synthetic oligonucleotide
aacagcaacagcagaaacgaa

SEQ ID NO: 18799 - DNA, 21 bp, Artificial Sequence
  Description of Artificial Sequence: Synthetic oligonucleotide
gatagtcttgcggtgactaag

SEQ ID NO: 18800 - DNA, 21 bp, Artificial Sequence
  Description of Artificial Sequence: Synthetic oligonucleotide
gatgggcagaatactgcgtct

SEQ ID NO: 18801 - DNA, 21 bp, Artificial Sequence
  Description of Artificial Sequence: Synthetic oligonucleotide
gtccaaaacacccacagcagc

SEQ ID NO: 18802 - DNA, 21 bp, Artificial Sequence
  Description of Artificial Sequence: Synthetic oligonucleotide
agtacggttggttcgccgagt

SEQ ID NO: 18803 - DNA, 21 bp, Artificial Sequence
  Description of Artificial Sequence: Synthetic oligonucleotide
aacaacaccaccagcagcgcc

SEQ ID NO: 18804 - DNA, 21 bp, Artificial Sequence
  Description of Artificial Sequence: Synthetic oligonucleotide
accggcagcacccccgccctc

SEQ ID NO: 18805 - DNA, 21 bp, Artificial Sequence
  Description of Artificial Sequence: Synthetic oligonucleotide
gtgtctagttcttcttctggt

SEQ ID NO: 18806 - DNA, 21 bp, Artificial Sequence
  Description of Artificial Sequence: Synthetic oligonucleotide
cacaacaccgaaaaacccagc

SEQ ID NO: 18807 - DNA, 21 bp, Artificial Sequence
  Description of Artificial Sequence: Synthetic oligonucleotide
cagacgggtggtactgcgggt

SEQ ID NO: 18808 - DNA, 21 bp, Artificial Sequence
  Description of Artificial Sequence: Synthetic oligonucleotide
tctacgactcagtctcaggcg

SEQ ID NO: 18809 - DNA, 21 bp, Artificial Sequence
  Description of Artificial Sequence: Synthetic oligonucleotide
accaccggcagcggcaaccaa

SEQ ID NO: 18810 - DNA, 21 bp, Artificial Sequence
  Description of Artificial Sequence: Synthetic oligonucleotide
cacggcgtcaacagccccagc

SEQ ID NO: 18811 - DNA, 21 bp, Artificial Sequence
  Description of Artificial Sequence: Synthetic oligonucleotide
gccagaagcaccagcaacagc

SEQ ID NO: 18812 - DNA, 21 bp, Artificial Sequence
  Description of Artificial Sequence: Synthetic oligonucleotide
gaaagcaccggcagcctcaaa

SEQ ID NO: 18813 - DNA, 21 bp, Artificial Sequence
  Description of Artificial Sequence: Synthetic oligonucleotide
acccccgacgccaaaagcgtc

SEQ ID NO: 18814 - DNA, 21 bp, Artificial Sequence
  Description of Artificial Sequence: Synthetic oligonucleotide
ggttctagtacgtctccggtt

SEQ ID NO: 18815 - DNA, 21 bp, Artificial Sequence
  Description of Artificial Sequence: Synthetic oligonucleotide
tctggtcagcaggttaatgtt

SEQ ID NO: 18816 - DNA, 21 bp, Artificial Sequence
  Description of Artificial Sequence: Synthetic oligonucleotide
gacaacaccggcaaaggcagc

SEQ ID NO: 18817 - DNA, 21 bp, Artificial Sequence
  Description of Artificial Sequence: Synthetic oligonucleotide
actgatgatcgttctaagagt

SEQ ID NO: 18818 - DNA, 21 bp, Artificial Sequence
  Description of Artificial Sequence: Synthetic oligonucleotide
ggcaacgacggcagaagcgcc

SEQ ID NO: 18819 - DNA, 21 bp, Artificial Sequence
  Description of Artificial Sequence: Synthetic oligonucleotide
accacccaaacccccagcctc

SEQ ID NO: 18820 - DNA, 21 bp, Artificial Sequence
  Description of Artificial Sequence: Synthetic oligonucleotide
agaaacggcaaagaaatcgtc

SEQ ID NO: 18821 - DNA, 21 bp, Artificial Sequence
  Description of Artificial Sequence: Synthetic oligonucleotide
ggggatagtcgtcagtcggtg

SEQ ID NO: 18822 - DNA, 21 bp, Artificial Sequence
  Description of Artificial Sequence: Synthetic oligonucleotide
cagactcagaagggtaatggg

SEQ ID NO: 18823 - DNA, 21 bp, Artificial Sequence
  Description of Artificial Sequence: Synthetic oligonucleotide
ggcaacatcagcggcagcaaa

SEQ ID NO: 18824 - DNA, 21 bp, Artificial Sequence
  Description of Artificial Sequence: Synthetic oligonucleotide
agcaaagccaccagcaacggc

SEQ ID NO: 18825 - DNA, 21 bp, Artificial Sequence
  Description of Artificial Sequence: Synthetic oligonucleotide
cacaaaggccaacacaccgaa

SEQ ID NO: 18826 - DNA, 21 bp, Artificial Sequence
  Description of Artificial Sequence: Synthetic oligonucleotide
cacaacagcgaaatcgccaaa

SEQ ID NO: 18827 - DNA, 21 bp, Artificial Sequence
  Description of Artificial Sequence: Synthetic oligonucleotide
cagaatccgcctcctgctaag

SEQ ID NO: 18828 - DNA, 21 bp, Artificial Sequence
  Description of Artificial Sequence: Synthetic oligonucleotide
cgtagtggtgaggatactaag

SEQ ID NO: 18829 - DNA, 21 bp, Artificial Sequence
  Description of Artificial Sequence: Synthetic oligonucleotide
gcgcaggggtcgagtgctacg

SEQ ID NO: 18830 - DNA, 21 bp, Artificial Sequence
  Description of Artificial Sequence: Synthetic oligonucleotide
ggcaccatgaccgacagaagc

SEQ ID NO: 18831 - DNA, 21 bp, Artificial Sequence
  Description of Artificial Sequence: Synthetic oligonucleotide
ggcctcgccgccaacagcctc

SEQ ID NO: 18832 - DNA, 21 bp, Artificial Sequence
  Description of Artificial Sequence: Synthetic oligonucleotide
tcgactactaagggtggttcg

SEQ ID NO: 18833 - DNA, 21 bp, Artificial Sequence
  Description of Artificial Sequence: Synthetic oligonucleotide
ctcagcagcaacgccggcaaa

SEQ ID NO: 18834 - DNA, 21 bp, Artificial Sequence
  Description of Artificial Sequence: Synthetic oligonucleotide
gatacggggtcgaggacgtct

SEQ ID NO: 18835 - DNA, 21 bp, Artificial Sequence
  Description of Artificial Sequence: Synthetic oligonucleotide
ggcaaaagcaccaacaacatg

SEQ ID NO: 18836 - DNA, 21 bp, Artificial Sequence
  Description of Artificial Sequence: Synthetic oligonucleotide
agacaagacgccgccggcagc

SEQ ID NO: 18837 - DNA, 21 bp, Artificial Sequence
  Description of Artificial Sequence: Synthetic oligonucleotide
agcggccaacccgtccccagc

SEQ ID NO: 18838 - DNA, 21 bp, Artificial Sequence
  Description of Artificial Sequence: Synthetic oligonucleotide
attccggaggcgaagcttggt

SEQ ID NO: 18839 - DNA, 21 bp, Artificial Sequence
  Description of Artificial Sequence: Synthetic oligonucleotide
agcaccggcggcaacctcaaa

SEQ ID NO: 18840 - DNA, 21 bp, Artificial Sequence
  Description of Artificial Sequence: Synthetic oligonucleotide
accagcatggacaaaaccagc

SEQ ID NO: 18841 - DNA, 21 bp, Artificial Sequence
  Description of Artificial Sequence: Synthetic oligonucleotide
atcaccggcaccaccagccaa

SEQ ID NO: 18842 - DNA, 21 bp, Artificial Sequence
  Description of Artificial Sequence: Synthetic oligonucleotide
gctgtggggccttcgagtcag

SEQ ID NO: 18843 - DNA, 21 bp, Artificial Sequence
  Description of Artificial Sequence: Synthetic oligonucleotide
ggcaacatgccccccaacaaa

SEQ ID NO: 18844 - DNA, 21 bp, Artificial Sequence
  Description of Artificial Sequence: Synthetic oligonucleotide
aacgccagcggcaccgacaga

SEQ ID NO: 18845 - DNA, 21 bp, Artificial Sequence
  Description of Artificial Sequence: Synthetic oligonucleotide
gacaccaccgccacccccaga

SEQ ID NO: 18846 - DNA, 21 bp, Artificial Sequence
  Description of Artificial Sequence: Synthetic oligonucleotide
ggcctcgacatgaaaagcacc

SEQ ID NO: 18847 - DNA, 21 bp, Artificial Sequence
  Description of Artificial Sequence: Synthetic oligonucleotide
gtcgccaccgccgccaccaaa

SEQ ID NO: 18848 - DNA, 21 bp, Artificial Sequence
  Description of Artificial Sequence: Synthetic oligonucleotide
gggtcgattcctagtcctaag

SEQ ID NO: 18849 - DNA, 21 bp, Artificial Sequence
  Description of Artificial Sequence: Synthetic oligonucleotide
aacaaagtcagcgccgacggc

SEQ ID NO: 18850 - DNA, 21 bp, Artificial Sequence
  Description of Artificial Sequence: Synthetic oligonucleotide
agcaccagcaacgtcaacaga

SEQ ID NO: 18851 - DNA, 21 bp, Artificial Sequence
  Description of Artificial Sequence: Synthetic oligonucleotide
agcagcacccaaagcagcaac

SEQ ID NO: 18852 - DNA, 21 bp, Artificial Sequence
  Description of Artificial Sequence: Synthetic oligonucleotide
agtactaagtcggcttcttct

SEQ ID NO: 18853 - DNA, 21 bp, Artificial Sequence
  Description of Artificial Sequence: Synthetic oligonucleotide
gctagtacgaatcatgctact

SEQ ID NO: 18854 - DNA, 21 bp, Artificial Sequence
  Description of Artificial Sequence: Synthetic oligonucleotide
gaaagcgccaacagaaacagc

SEQ ID NO: 18855 - DNA, 21 bp, Artificial Sequence
  Description of Artificial Sequence: Synthetic oligonucleotide
accatcggcaaaagcagcagc

SEQ ID NO: 18856 - DNA, 21 bp, Artificial Sequence
  Description of Artificial Sequence: Synthetic oligonucleotide
actccggtggagcataagggg

SEQ ID NO: 18857 - DNA, 21 bp, Artificial Sequence
  Description of Artificial Sequence: Synthetic oligonucleotide
caagacagcagcagcgtcaaa

SEQ ID NO: 18858 - DNA, 21 bp, Artificial Sequence
  Description of Artificial Sequence: Synthetic oligonucleotide
gagtcggggtcttctcgggag

SEQ ID NO: 18859 - DNA, 21 bp, Artificial Sequence
  Description of Artificial Sequence: Synthetic oligonucleotide
ggcaccagcaaagccgtcggc

SEQ ID NO: 18860 - DNA, 21 bp, Artificial Sequence
  Description of Artificial Sequence: Synthetic oligonucleotide
ggccaaagcaacaaagtcggc

SEQ ID NO: 18861 - DNA, 21 bp, Artificial Sequence
  Description of Artificial Sequence: Synthetic oligonucleotide
tctgctcctacgggtaatgtt

SEQ ID NO: 18862 - DNA, 21 bp, Artificial Sequence
  Description of Artificial Sequence: Synthetic oligonucleotide
ggtcataatagtccttctgtt

SEQ ID NO: 18863 - DNA, 21 bp, Artificial Sequence
  Description of Artificial Sequence: Synthetic oligonucleotide
gttgggtcgcctgcgtctact

SEQ ID NO: 18864 - DNA, 21 bp, Artificial Sequence
  Description of Artificial Sequence: Synthetic oligonucleotide
cagtcgaaggctgcgatggtt

SEQ ID NO: 18865 - DNA, 21 bp, Artificial Sequence
  Description of Artificial Sequence: Synthetic oligonucleotide
gccggcagcaccgcccccaga

SEQ ID NO: 18866 - DNA, 21 bp, Artificial Sequence
  Description of Artificial Sequence: Synthetic oligonucleotide
aatgctactaaggatcaggtt

SEQ ID NO: 18867 - DNA, 21 bp, Artificial Sequence
  Description of Artificial Sequence: Synthetic oligonucleotide
gacgccgaaagaaccaaaagc

SEQ ID NO: 18868 - DNA, 21 bp, Artificial Sequence
  Description of Artificial Sequence: Synthetic oligonucleotide
catcctagtcctacgacggcg

SEQ ID NO: 18869 - DNA, 21 bp, Artificial Sequence
  Description of Artificial Sequence: Synthetic oligonucleotide
ggcaaacaaaccgtcagccaa

SEQ ID NO: 18870 - DNA, 21 bp, Artificial Sequence
  Description of Artificial Sequence: Synthetic oligonucleotide
ggcggcaaagacagcgtcaac

SEQ ID NO: 18871 - DNA, 21 bp, Artificial Sequence
  Description of Artificial Sequence: Synthetic oligonucleotide
gggaaggagtcgcatcctgtg

SEQ ID NO: 18872 - DNA, 21 bp, Artificial Sequence
  Description of Artificial Sequence: Synthetic oligonucleotide
tctcttcatgctccgacttcg

SEQ ID NO: 18873 - DNA, 21 bp, Artificial Sequence
  Description of Artificial Sequence: Synthetic oligonucleotide
aattctgataagaatgctaag

SEQ ID NO: 18874 - DNA, 21 bp, Artificial Sequence
  Description of Artificial Sequence: Synthetic oligonucleotide
actacgaatgctcagagtaag

SEQ ID NO: 18875 - DNA, 21 bp, Artificial Sequence
  Description of Artificial Sequence: Synthetic oligonucleotide
gagacgaagaattctcttggt

SEQ ID NO: 18876 - DNA, 21 bp, Artificial Sequence
  Description of Artificial Sequence: Synthetic oligonucleotide
agaggcagcgacaccaccagc

SEQ ID NO: 18877 - DNA, 21 bp, Artificial Sequence
  Description of Artificial Sequence: Synthetic oligonucleotide
ggtagtcagaagattgcgacg

SEQ ID NO: 18878 - DNA, 21 bp, Artificial Sequence
  Description of Artificial Sequence: Synthetic oligonucleotide
gtccaagacaaaaccaacacc

SEQ ID NO: 18879 - DNA, 21 bp, Artificial Sequence
  Description of Artificial Sequence: Synthetic oligonucleotide
atgcatgataagccggcgtct

SEQ ID NO: 18880 - DNA, 21 bp, Artificial Sequence
  Description of Artificial Sequence: Synthetic oligonucleotide
gacaaccccgccggcatcaga

SEQ ID NO: 18881 - DNA, 21 bp, Artificial Sequence
  Description of Artificial Sequence: Synthetic oligonucleotide
accaccgtcagcgccgccagc

SEQ ID NO: 18882 - DNA, 21 bp, Artificial Sequence
  Description of Artificial Sequence: Synthetic oligonucleotide
aggtctaatggtcagcttagt

SEQ ID NO: 18883 - DNA, 21 bp, Artificial Sequence
  Description of Artificial Sequence: Synthetic oligonucleotide
catgggactcaggagcctcgt

SEQ ID NO: 18884 - DNA, 21 bp, Artificial Sequence
  Description of Artificial Sequence: Synthetic oligonucleotide
gacaccagcaaagaaaccaga

SEQ ID NO: 18885 - DNA, 21 bp, Artificial Sequence
  Description of Artificial Sequence: Synthetic oligonucleotide
gccgacggcgccggcagagcc

SEQ ID NO: 18886 - DNA, 21 bp, Artificial Sequence
  Description of Artificial Sequence: Synthetic oligonucleotide
gacggcaacaacagccacaga

SEQ ID NO: 18887 - DNA, 21 bp, Artificial Sequence
  Description of Artificial Sequence: Synthetic oligonucleotide
atggcgcagtctactaatacg

SEQ ID NO: 18888 - DNA, 21 bp, Artificial Sequence
  Description of Artificial Sequence: Synthetic oligonucleotide
gattcgcaggcgtctccgcat

SEQ ID NO: 18889 - DNA, 21 bp, Artificial Sequence
  Description of Artificial Sequence: Synthetic oligonucleotide
accggcggcagcaaaatcagc

SEQ ID NO: 18890 - DNA, 21 bp, Artificial Sequence
  Description of Artificial Sequence: Synthetic oligonucleotide
aacggcctcgacaaaatcaga

SEQ ID NO: 18891 - DNA, 21 bp, Artificial Sequence
  Description of Artificial Sequence: Synthetic oligonucleotide
agcgaaagcaccggcaccaga

SEQ ID NO: 18892 - DNA, 21 bp, Artificial Sequence
  Description of Artificial Sequence: Synthetic oligonucleotide
agcaaaggcagccccagcagc

SEQ ID NO: 18893 - DNA, 21 bp, Artificial Sequence
  Description of Artificial Sequence: Synthetic oligonucleotide
gggctttctggtgcttcgggg

SEQ ID NO: 18894 - DNA, 21 bp, Artificial Sequence
  Description of Artificial Sequence: Synthetic oligonucleotide
agcatgggcaaagacagccac

SEQ ID NO: 18895 - DNA, 21 bp, Artificial Sequence
  Description of Artificial Sequence: Synthetic oligonucleotide
cagggttctccttcggcgcat

SEQ ID NO: 18896 - DNA, 21 bp, Artificial Sequence
  Description of Artificial Sequence: Synthetic oligonucleotide
tctccgagtaagtctgcggag

SEQ ID NO: 18897 - DNA, 21 bp, Artificial Sequence
  Description of Artificial Sequence: Synthetic oligonucleotide
agtaagggtgatggtgcttcg

SEQ ID NO: 18898 - DNA, 21 bp, Artificial Sequence
  Description of Artificial Sequence: Synthetic oligonucleotide
atggggaattcttcgcagggt

SEQ ID NO: 18899 - DNA, 21 bp, Artificial Sequence
  Description of Artificial Sequence: Synthetic oligonucleotide
ggtgagagtaattcggctcat

SEQ ID NO: 18900 - DNA, 21 bp, Artificial Sequence
  Description of Artificial Sequence: Synthetic oligonucleotide
gtcaccggcaccaccgtcggc

SEQ ID NO: 18901 - DNA, 21 bp, Artificial Sequence
  Description of Artificial Sequence: Synthetic oligonucleotide
aagatgacggctagtcagggt

SEQ ID NO: 18902 - DNA, 21 bp, Artificial Sequence
  Description of Artificial Sequence: Synthetic oligonucleotide
atgccgtctagtccggcgtct

SEQ ID NO: 18903 - DNA, 21 bp, Artificial Sequence
  Description of Artificial Sequence: Synthetic oligonucleotide
gagacgagtgatcctcgtact

SEQ ID NO: 18904 - DNA, 21 bp, Artificial Sequence
  Description of Artificial Sequence: Synthetic oligonucleotide
aacagcaccaacagcggcgcc

SEQ ID NO: 18905 - DNA, 21 bp, Artificial Sequence
  Description of Artificial Sequence: Synthetic oligonucleotide
agccccaaaggcaacggcaac

SEQ ID NO: 18906 - DNA, 21 bp, Artificial Sequence
  Description of Artificial Sequence: Synthetic oligonucleotide
agcggcgccagccccagcgcc

SEQ ID NO: 18907 - DNA, 21 bp, Artificial Sequence
  Description of Artificial Sequence: Synthetic oligonucleotide
ggcaccgacaaaagcaaaccc

SEQ ID NO: 18908 - DNA, 21 bp, Artificial Sequence
  Description of Artificial Sequence: Synthetic oligonucleotide
gttaatgggggtgctgctgcg

SEQ ID NO: 18909 - DNA, 21 bp, Artificial Sequence
  Description of Artificial Sequence: Synthetic oligonucleotide
gccagagacgtcggcagcggc

SEQ ID NO: 18910 - DNA, 21 bp, Artificial Sequence
  Description of Artificial Sequence: Synthetic oligonucleotide
cagatgggggcgacggggacg

SEQ ID NO: 18911 - DNA, 21 bp, Artificial Sequence
  Description of Artificial Sequence: Synthetic oligonucleotide
gctggtcagggtaagactctt

SEQ ID NO: 18912 - DNA, 21 bp, Artificial Sequence
  Description of Artificial Sequence: Synthetic oligonucleotide
acccccagcaacaccaccctc

SEQ ID NO: 18913 - DNA, 21 bp, Artificial Sequence
  Description of Artificial Sequence: Synthetic oligonucleotide
ggcagcgaagcccccagcaga

SEQ ID NO: 18914 - DNA, 21 bp, Artificial Sequence
  Description of Artificial Sequence: Synthetic oligonucleotide
agaagcggcgacagcatcagc

SEQ ID NO: 18915 - DNA, 21 bp, Artificial Sequence
  Description of Artificial Sequence: Synthetic oligonucleotide
ctcggcaccaacagcagccac

SEQ ID NO: 18916 - DNA, 21 bp, Artificial Sequence
  Description of Artificial Sequence: Synthetic oligonucleotide
gaaagcaaaaccggcagcggc

SEQ ID NO: 18917 - DNA, 21 bp, Artificial Sequence
  Description of Artificial Sequence: Synthetic oligonucleotide
gaaagcgccaaacaaaacttc

SEQ ID NO: 18918 - DNA, 21 bp, Artificial Sequence
  Description of Artificial Sequence: Synthetic oligonucleotide
ggccccgaaagccccagaagc

SEQ ID NO: 18919 - DNA, 21 bp, Artificial Sequence
  Description of Artificial Sequence: Synthetic oligonucleotide
gttaatggtcagtctactgcg

SEQ ID NO: 18920 - DNA, 21 bp, Artificial Sequence
  Description of Artificial Sequence: Synthetic oligonucleotide
ctccccagcagcgaccaaaga

SEQ ID NO: 18921 - DNA, 21 bp, Artificial Sequence
  Description of Artificial Sequence: Synthetic oligonucleotide
agcaccggcagcgccaccagc

SEQ ID NO: 18922 - DNA, 21 bp, Artificial Sequence
  Description of Artificial Sequence: Synthetic oligonucleotide
aatcgtaatactacggcgagt

SEQ ID NO: 18923 - DNA, 21 bp, Artificial Sequence
  Description of Artificial Sequence: Synthetic oligonucleotide
gggtcgtcgagtgatcatcgg

SEQ ID NO: 18924 - DNA, 21 bp, Artificial Sequence
  Description of Artificial Sequence: Synthetic oligonucleotide
gagcagggggcgagttcgcgg

SEQ ID NO: 18925 - DNA, 21 bp, Artificial Sequence
  Description of Artificial Sequence: Synthetic oligonucleotide
aaaagcaccggcagccaaggc

SEQ ID NO: 18926 - DNA, 21 bp, Artificial Sequence
  Description of Artificial Sequence: Synthetic oligonucleotide
tcgggttcggagcggtcactt

SEQ ID NO: 18927 - DNA, 21 bp, Artificial Sequence
  Description of Artificial Sequence: Synthetic oligonucleotide
ggtggtgcttctacgacgcat

SEQ ID NO: 18928 - DNA, 21 bp, Artificial Sequence
  Description of Artificial Sequence: Synthetic oligonucleotide
aaggggagtcctgcgtcgagt

SEQ ID NO: 18929 - DNA, 21 bp, Artificial Sequence
  Description of Artificial Sequence: Synthetic oligonucleotide
gaggttagtgggcagcgtcag

SEQ ID NO: 18930 - DNA, 21 bp, Artificial Sequence
  Description of Artificial Sequence: Synthetic oligonucleotide
gcccacgtcggcgacaaaagc

SEQ ID NO: 18931 - DNA, 21 bp, Artificial Sequence
  Description of Artificial Sequence: Synthetic oligonucleotide
acccccagcgacaaaggcgcc

SEQ ID NO: 18932 - DNA, 21 bp, Artificial Sequence
  Description of Artificial Sequence: Synthetic oligonucleotide
actcagagtagtaatccttct

SEQ ID NO: 18933 - DNA, 21 bp, Artificial Sequence
  Description of Artificial Sequence: Synthetic oligonucleotide
gggtctacggagcggcattct

SEQ ID NO: 18934 - DNA, 21 bp, Artificial Sequence
  Description of Artificial Sequence: Synthetic oligonucleotide
ggcaccgccgcccccgcccac

SEQ ID NO: 18935 - DNA, 21 bp, Artificial Sequence
  Description of Artificial Sequence: Synthetic oligonucleotide
accatggccggcaccaaccaa

SEQ ID NO: 18936 - DNA, 21 bp, Artificial Sequence
  Description of Artificial Sequence: Synthetic oligonucleotide
agcacccaaaaccccaaagac

SEQ ID NO: 18937 - DNA, 21 bp, Artificial Sequence
  Description of Artificial Sequence: Synthetic oligonucleotide
gagggtcagacgactagtttg

SEQ ID NO: 18938 - DNA, 21 bp, Artificial Sequence
  Description of Artificial Sequence: Synthetic oligonucleotide
gatcgtgcgaaggagtcttcg

SEQ ID NO: 18939 - DNA, 21 bp, Artificial Sequence
  Description of Artificial Sequence: Synthetic oligonucleotide
gtcaccaccaccaacagcaaa

SEQ ID NO: 18940 - DNA, 21 bp, Artificial Sequence
  Description of Artificial Sequence: Synthetic oligonucleotide
tcgagtcagacgaataatgtt

SEQ ID NO: 18941 - DNA, 21 bp, Artificial Sequence
  Description of Artificial Sequence: Synthetic oligonucleotide
tcgtcgactaagagttctcct

SEQ ID NO: 18942 - DNA, 21 bp, Artificial Sequence
  Description of Artificial Sequence: Synthetic oligonucleotide
agcagcggcccccaacccagc

SEQ ID NO: 18943 - DNA, 21 bp, Artificial Sequence
  Description of Artificial Sequence: Synthetic oligonucleotide
caaaccgacgccaaaagcctc

SEQ ID NO: 18944 - DNA, 21 bp, Artificial Sequence
  Description of Artificial Sequence: Synthetic oligonucleotide
gtccccgccggcagcggcggc

SEQ ID NO: 18945 - DNA, 21 bp, Artificial Sequence
  Description of Artificial Sequence: Synthetic oligonucleotide
atgcaagcccaaaaagaaagc

SEQ ID NO: 18946 - DNA, 21 bp, Artificial Sequence
  Description of Artificial Sequence: Synthetic oligonucleotide
cacgtcaacatgaaagaaggc

SEQ ID NO: 18947 - DNA, 21 bp, Artificial Sequence
  Description of Artificial Sequence: Synthetic oligonucleotide
gacaccgtcagcaaaagcaac

SEQ ID NO: 18948 - DNA, 21 bp, Artificial Sequence
  Description of Artificial Sequence: Synthetic oligonucleotide
gacagcaacaaaagcccccac

SEQ ID NO: 18949 - DNA, 21 bp, Artificial Sequence
  Description of Artificial Sequence: Synthetic oligonucleotide
aacggcgtcccccaacccaaa

SEQ ID NO: 18950 - DNA, 21 bp, Artificial Sequence
  Description of Artificial Sequence: Synthetic oligonucleotide
aatagttctgggtctggtggt

SEQ ID NO: 18951 - DNA, 21 bp, Artificial Sequence
  Description of Artificial Sequence: Synthetic oligonucleotide
acttcggctcagactcctcat

SEQ ID NO: 18952 - DNA, 21 bp, Artificial Sequence
  Description of Artificial Sequence: Synthetic oligonucleotide
agcagcggcgacggctaccaa

SEQ ID NO: 18953 - DNA, 21 bp, Artificial Sequence
  Description of Artificial Sequence: Synthetic oligonucleotide
gacgccagaggcagcgtcagc

SEQ ID NO: 18954 - DNA, 21 bp, Artificial Sequence
  Description of Artificial Sequence: Synthetic oligonucleotide
tcggctggggatcggaatctt

SEQ ID NO: 18955 - DNA, 21 bp, Artificial Sequence
  Description of Artificial Sequence: Synthetic oligonucleotide
accgacgccagccaaagaagc

SEQ ID NO: 18956 - DNA, 21 bp, Artificial Sequence
  Description of Artificial Sequence: Synthetic oligonucleotide
agtagtggtgataagagtttg

SEQ ID NO: 18957 - DNA, 21 bp, Artificial Sequence
  Description of Artificial Sequence: Synthetic oligonucleotide
tctcatgctaagtcttctgag

SEQ ID NO: 18958 - DNA, 21 bp, Artificial Sequence
  Description of Artificial Sequence: Synthetic oligonucleotide
gtcagaagcgaaagcaccgcc

SEQ ID NO: 18959 - DNA, 21 bp, Artificial Sequence
  Description of Artificial Sequence: Synthetic oligonucleotide
tctgcgggtagtactccgact

SEQ ID NO: 18960 - DNA, 21 bp, Artificial Sequence
  Description of Artificial Sequence: Synthetic oligonucleotide
agcaaaagcaccacccccagc

SEQ ID NO: 18961 - DNA, 21 bp, Artificial Sequence
  Description of Artificial Sequence: Synthetic oligonucleotide
agcagcgccggcgtcggcgcc

SEQ ID NO: 18962 - DNA, 21 bp, Artificial Sequence
  Description of Artificial Sequence: Synthetic oligonucleotide
caccccctcaaagacggcggc

SEQ ID NO: 18963 - DNA, 21 bp, Artificial Sequence
  Description of Artificial Sequence: Synthetic oligonucleotide
accgacagcagccccagcaaa

SEQ ID NO: 18964 - DNA, 21 bp, Artificial Sequence
  Description of Artificial Sequence: Synthetic oligonucleotide
aatggggatgttggtaggggg

SEQ ID NO: 18965 - DNA, 21 bp, Artificial Sequence
  Description of Artificial Sequence: Synthetic oligonucleotide
aacggttctggacagaaggaa

SEQ ID NO: 18966 - DNA, 21 bp, Artificial Sequence
  Description of Artificial Sequence: Synthetic oligonucleotide
ggcgaacccagcgtcaacaaa

SEQ ID NO: 18967 - DNA, 21 bp, Artificial Sequence
  Description of Artificial Sequence: Synthetic oligonucleotide
aacaccaaagaaggcagcggc

SEQ ID NO: 18968 - DNA, 21 bp, Artificial Sequence
  Description of Artificial Sequence: Synthetic oligonucleotide
aaccccgacgccagcggcaaa

SEQ ID NO: 18969 - DNA, 21 bp, Artificial Sequence
  Description of Artificial Sequence: Synthetic oligonucleotide
agcagcatggccaaaacccaa

SEQ ID NO: 18970 - DNA, 21 bp, Artificial Sequence
  Description of Artificial Sequence: Synthetic oligonucleotide
atgcctggtacgaaggttatt

SEQ ID NO: 18971 - DNA, 21 bp, Artificial Sequence
  Description of Artificial Sequence: Synthetic oligonucleotide
caggctagttcttcgtcggtt

SEQ ID NO: 18972 - DNA, 21 bp, Artificial Sequence
  Description of Artificial Sequence: Synthetic oligonucleotide
gaaggcagacaaggcggcagc

SEQ ID NO: 18973 - DNA, 21 bp, Artificial Sequence
  Description of Artificial Sequence: Synthetic oligonucleotide
tctactgcgggggcgaatgcg

SEQ ID NO: 18974 - DNA, 21 bp, Artificial Sequence
  Description of Artificial Sequence: Synthetic oligonucleotide
tctggtaatcctggtggggct

SEQ ID NO: 18975 - DNA, 21 bp, Artificial Sequence
  Description of Artificial Sequence: Synthetic oligonucleotide
accatcgaaaccggcaaaggc

SEQ ID NO: 18976 - DNA, 21 bp, Artificial Sequence
  Description of Artificial Sequence: Synthetic oligonucleotide
agccaaggcgacgccagcaga

SEQ ID NO: 18977 - DNA, 21 bp, Artificial Sequence
  Description of Artificial Sequence: Synthetic oligonucleotide
ggcgaaagaggcgaaaaaagc

SEQ ID NO: 18978 - DNA, 21 bp, Artificial Sequence
  Description of Artificial Sequence: Synthetic oligonucleotide
aacggcagcagcaccgccagc

SEQ ID NO: 18979 - DNA, 21 bp, Artificial Sequence
  Description of Artificial Sequence: Synthetic oligonucleotide
accggcaacagcggcagcacc

SEQ ID NO: 18980 - DNA, 21 bp, Artificial Sequence
  Description of Artificial Sequence: Synthetic oligonucleotide
agtcgggggtcggatgctagt

SEQ ID NO: 18981 - DNA, 21 bp, Artificial Sequence
  Description of Artificial Sequence: Synthetic oligonucleotide
cataattcttcggggattcat

SEQ ID NO: 18982 - DNA, 21 bp, Artificial Sequence
  Description of Artificial Sequence: Synthetic oligonucleotide
actcctgatgcgaatcggcgt

SEQ ID NO: 18983 - DNA, 21 bp, Artificial Sequence
  Description of Artificial Sequence: Synthetic oligonucleotide
gtcaacggcgccagcgtcagc

SEQ ID NO: 18984 - DNA, 21 bp, Artificial Sequence
  Description of Artificial Sequence: Synthetic oligonucleotide
ctcaacagcagcaaaagcggc

SEQ ID NO: 18985 - DNA, 21 bp, Artificial Sequence
  Description of Artificial Sequence: Synthetic oligonucleotide
ctggctagtggtaatgggcag

SEQ ID NO: 18986 - DNA, 21 bp, Artificial Sequence
  Description of Artificial Sequence: Synthetic oligonucleotide
gccaccagcgacaaaaacccc

SEQ ID NO: 18987 - DNA, 21 bp, Artificial Sequence
  Description of Artificial Sequence: Synthetic oligonucleotide
gaggcgagtcgttcgtcgtct

SEQ ID NO: 18988 - DNA, 21 bp, Artificial Sequence
  Description of Artificial Sequence: Synthetic oligonucleotide
gttgggtctggtagtcctagg

SEQ ID NO: 18989 - DNA, 21 bp, Artificial Sequence
  Description of Artificial Sequence: Synthetic oligonucleotide
caaggccaaggcaccgccacc

SEQ ID NO: 18990 - DNA, 21 bp, Artificial Sequence
  Description of Artificial Sequence: Synthetic oligonucleotide
aaagccaacgaccccaaagcc

SEQ ID NO: 18991 - DNA, 21 bp, Artificial Sequence
  Description of Artificial Sequence: Synthetic oligonucleotide
gacaccagcagaaaaagcgaa

SEQ ID NO: 18992 - DNA, 21 bp, Artificial Sequence
  Description of Artificial Sequence: Synthetic oligonucleotide
ggtaaggtttcttcggagaag

SEQ ID NO: 18993 - DNA, 21 bp, Artificial Sequence
  Description of Artificial Sequence: Synthetic oligonucleotide
actcgggagagggagactgtt

SEQ ID NO: 18994 - DNA, 21 bp, Artificial Sequence
  Description of Artificial Sequence: Synthetic oligonucleotide
agttcttctgttcctaaggtg

SEQ ID NO: 18995 - DNA, 21 bp, Artificial Sequence
  Description of Artificial Sequence: Synthetic oligonucleotide
caagccaccggcaaactccaa

SEQ ID NO: 18996 - DNA, 21 bp, Artificial Sequence
  Description of Artificial Sequence: Synthetic oligonucleotide
gaaaacaccggcagcaacagc

SEQ ID NO: 18997 - DNA, 21 bp, Artificial Sequence
  Description of Artificial Sequence: Synthetic oligonucleotide
gcgagttctcctgcggtggct

SEQ ID NO: 18998 - DNA, 21 bp, Artificial Sequence
  Description of Artificial Sequence: Synthetic oligonucleotide
gcgcggcaggaggctactcat

SEQ ID NO: 18999 - DNA, 21 bp, Artificial Sequence
  Description of Artificial Sequence: Synthetic oligonucleotide
agcggcaccgtcagcaaaccc

SEQ ID NO: 19000 - DNA, 21 bp, Artificial Sequence
  Description of Artificial Sequence: Synthetic oligonucleotide
cagattagtaatccggcgcat

SEQ ID NO: 19001 - DNA, 21 bp, Artificial Sequence
  Description of Artificial Sequence: Synthetic oligonucleotide
gatactgctgctgttaagtct

SEQ ID NO: 19002 - DNA, 21 bp, Artificial Sequence
  Description of Artificial Sequence: Synthetic oligonucleotide
gatgggagtaattcgcctaat

SEQ ID NO: 19003 - DNA, 21 bp, Artificial Sequence
  Description of Artificial Sequence: Synthetic oligonucleotide
ggtactgggcataatagtacg

SEQ ID NO: 19004 - DNA, 21 bp, Artificial Sequence
  Description of Artificial Sequence: Synthetic oligonucleotide
tcggcgggtaatcaggggtct

SEQ ID NO: 19005 - DNA, 21 bp, Artificial Sequence
  Description of Artificial Sequence: Synthetic oligonucleotide
actaaggatggtaggaatact

SEQ ID NO: 19006 - DNA, 21 bp, Artificial Sequence
  Description of Artificial Sequence: Synthetic oligonucleotide
agcggccccaccaaacccgtc

SEQ ID NO: 19007 - DNA, 21 bp, Artificial Sequence
  Description of Artificial Sequence: Synthetic oligonucleotide
gacaaaagcggcagcatcgcc

SEQ ID NO: 19008 - DNA, 21 bp, Artificial Sequence
  Description of Artificial Sequence: Synthetic oligonucleotide
gcccaaggccaaaacaacctc

SEQ ID NO: 19009 - DNA, 21 bp, Artificial Sequence
  Description of Artificial Sequence: Synthetic oligonucleotide
gacagcgcccccagcctcaaa

SEQ ID NO: 19010 - DNA, 21 bp, Artificial Sequence
  Description of Artificial Sequence: Synthetic oligonucleotide
atggctggtgctgcttctact

SEQ ID NO: 19011 - DNA, 21 bp, Artificial Sequence
  Description of Artificial Sequence: Synthetic oligonucleotide
gacagcagcaaaaccagcgcc

SEQ ID NO: 19012 - DNA, 21 bp, Artificial Sequence
  Description of Artificial Sequence: Synthetic oligonucleotide
actgcgcagggtagtcatagt

SEQ ID NO: 19013 - DNA, 21 bp, Artificial Sequence
  Description of Artificial Sequence: Synthetic oligonucleotide
agcggcgtcaccagcggcggc

SEQ ID NO: 19014 - DNA, 21 bp, Artificial Sequence
  Description of Artificial Sequence: Synthetic oligonucleotide
acggcttctccgactccgttg

SEQ ID NO: 19015 - DNA, 21 bp, Artificial Sequence
  Description of Artificial Sequence: Synthetic oligonucleotide
cttactgggaaggctcctgct

SEQ ID NO: 19016 - DNA, 21 bp, Artificial Sequence
  Description of Artificial Sequence: Synthetic oligonucleotide
agcgacagccacagcgccaaa

SEQ ID NO: 19017 - DNA, 21 bp, Artificial Sequence
  Description of Artificial Sequence: Synthetic oligonucleotide
agcaccggcagcaaccccgcc

SEQ ID NO: 19018 - DNA, 21 bp, Artificial Sequence
  Description of Artificial Sequence: Synthetic oligonucleotide
gccacccacggcgccagcacc

SEQ ID NO: 19019 - DNA, 21 bp, Artificial Sequence
  Description of Artificial Sequence: Synthetic oligonucleotide
gggtctgatactaagcctctt

SEQ ID NO: 19020 - DNA, 21 bp, Artificial Sequence
  Description of Artificial Sequence: Synthetic oligonucleotide
gccaacaacaaaggcaacgtc

SEQ ID NO: 19021 - DNA, 21 bp, Artificial Sequence
  Description of Artificial Sequence: Synthetic oligonucleotide
actggtgcttcggctaagacg

SEQ ID NO: 19022 - DNA, 21 bp, Artificial Sequence
  Description of Artificial Sequence: Synthetic oligonucleotide
ctcagcaacagcaaaagcctc

SEQ ID NO: 19023 - DNA, 21 bp, Artificial Sequence
  Description of Artificial Sequence: Synthetic oligonucleotide
cttcaggcgtcggggtcgctg

SEQ ID NO: 19024 - DNA, 21 bp, Artificial Sequence
  Description of Artificial Sequence: Synthetic oligonucleotide
tcgtcttcgagtgataagagt

SEQ ID NO: 19025 - DNA, 21 bp, Artificial Sequence
  Description of Artificial Sequence: Synthetic oligonucleotide
ggtggtggggatgctcgttcg

SEQ ID NO: 19026 - DNA, 21 bp, Artificial Sequence
  Description of Artificial Sequence: Synthetic oligonucleotide
gtccccagcagcaccgccaaa

SEQ ID NO: 19027 - DNA, 21 bp, Artificial Sequence
  Description of Artificial Sequence: Synthetic oligonucleotide
accaccagcaccggcagcgcc

SEQ ID NO: 19028 - DNA, 21 bp, Artificial Sequence
  Description of Artificial Sequence: Synthetic oligonucleotide
caaagcagcggcaacagcgtc

SEQ ID NO: 19029 - DNA, 21 bp, Artificial Sequence
  Description of Artificial Sequence: Synthetic oligonucleotide
gatactacgcctaagcctggt

SEQ ID NO: 19030 - DNA, 21 bp, Artificial Sequence
  Description of Artificial Sequence: Synthetic oligonucleotide
acgggtgagagttcgaagtct

SEQ ID NO: 19031 - DNA, 21 bp, Artificial Sequence
  Description of Artificial Sequence: Synthetic oligonucleotide
gggtctgatcagcctgttcgt

SEQ ID NO: 19032 - DNA, 21 bp, Artificial Sequence
  Description of Artificial Sequence: Synthetic oligonucleotide
gatggggttaagcagacgcct

SEQ ID NO: 19033 - DNA, 21 bp, Artificial Sequence
  Description of Artificial Sequence: Synthetic oligonucleotide
ggcagcgacaaactcaaactc

SEQ ID NO: 19034 - DNA, 21 bp, Artificial Sequence
  Description of Artificial Sequence: Synthetic oligonucleotide
gattcggtgagtagtattaag

SEQ ID NO: 19035 - DNA, 21 bp, Artificial Sequence
  Description of Artificial Sequence: Synthetic oligonucleotide
cagacggggccgagtccgact

SEQ ID NO: 19036 - DNA, 21 bp, Artificial Sequence
  Description of Artificial Sequence: Synthetic oligonucleotide
caaggcagagacgcccaaccc

SEQ ID NO: 19037 - DNA, 21 bp, Artificial Sequence
  Description of Artificial Sequence: Synthetic oligonucleotide
aacagcagcaccaccagcaga

SEQ ID NO: 19038 - DNA, 21 bp, Artificial Sequence
  Description of Artificial Sequence: Synthetic oligonucleotide
aaccaactcgtcggcgccggc

SEQ ID NO: 19039 - DNA, 21 bp, Artificial Sequence
  Description of Artificial Sequence: Synthetic oligonucleotide
aacgaaaaaaccagcagcagc

SEQ ID NO: 19040 - DNA, 21 bp, Artificial Sequence
  Description of Artificial Sequence: Synthetic oligonucleotide
aatccggattcgcaggctagg

SEQ ID NO: 19041 - DNA, 21 bp, Artificial Sequence
  Description of Artificial Sequence: Synthetic oligonucleotide
accaccaacagccccaacaaa

SEQ ID NO: 19042 - DNA, 21 bp, Artificial Sequence
  Description of Artificial Sequence: Synthetic oligonucleotide
accagcagccaaggccccggc

SEQ ID NO: 19043 - DNA, 21 bp, Artificial Sequence
  Description of Artificial Sequence: Synthetic oligonucleotide
accgccgacaacaaagtcaga

SEQ ID NO: 19044 - DNA, 21 bp, Artificial Sequence
  Description of Artificial Sequence: Synthetic oligonucleotide
acgaatagtcaggggtcttct

SEQ ID NO: 19045 - DNA, 21 bp, Artificial Sequence
  Description of Artificial Sequence: Synthetic oligonucleotide
acgactgataataatcggatt

SEQ ID NO: 19046 - DNA, 21 bp, Artificial Sequence
  Description of Artificial Sequence: Synthetic oligonucleotide
acgagtggtccttcttcgggg

SEQ ID NO: 19047 - DNA, 21 bp, Artificial Sequence
  Description of Artificial Sequence: Synthetic oligonucleotide
agaggcggcggcagcgccgcc

SEQ ID NO: 19048 - DNA, 21 bp, Artificial Sequence
  Description of Artificial Sequence: Synthetic oligonucleotide
agcagcaaccccagcctcggc

SEQ ID NO: 19049 - DNA, 21 bp, Artificial Sequence
  Description of Artificial Sequence: Synthetic oligonucleotide
agcgtcggcagcgacagaatc

SEQ ID NO: 19050 - DNA, 21 bp, Artificial Sequence
  Description of Artificial Sequence: Synthetic oligonucleotide
atgggtagtaagaaggatagt

SEQ ID NO: 19051 - DNA, 21 bp, Artificial Sequence
  Description of Artificial Sequence: Synthetic oligonucleotide
atgggtggtacgggttcgtct

SEQ ID NO: 19052 - DNA, 21 bp, Artificial Sequence
  Description of Artificial Sequence: Synthetic oligonucleotide
caaaacaacaccggccacaac

SEQ ID NO: 19053 - DNA, 21 bp, Artificial Sequence
  Description of Artificial Sequence: Synthetic oligonucleotide
caggttgcttcgagtaataat

SEQ ID NO: 19054 - DNA, 21 bp, Artificial Sequence
  Description of Artificial Sequence: Synthetic oligonucleotide
catggtcagtctgcgtcttct

SEQ ID NO: 19055 - DNA, 21 bp, Artificial Sequence
  Description of Artificial Sequence: Synthetic oligonucleotide
catggttcgtctaaggcgggg

SEQ ID NO: 19056 - DNA, 21 bp, Artificial Sequence
  Description of Artificial Sequence: Synthetic oligonucleotide
ctcagcgcccccaccagcgcc

SEQ ID NO: 19057 - DNA, 21 bp, Artificial Sequence
  Description of Artificial Sequence: Synthetic oligonucleotide
ctcggcgccaacgccgccggc

SEQ ID NO: 19058 - DNA, 21 bp, Artificial Sequence
  Description of Artificial Sequence: Synthetic oligonucleotide
gaacaaagaagcaccaccggc

SEQ ID NO: 19059 - DNA, 21 bp, Artificial Sequence
  Description of Artificial Sequence: Synthetic oligonucleotide
gataataggactgttaataag

SEQ ID NO: 19060 - DNA, 21 bp, Artificial Sequence
  Description of Artificial Sequence: Synthetic oligonucleotide
gatcagaatattaagccgaat

SEQ ID NO: 19061 - DNA, 21 bp, Artificial Sequence
  Description of Artificial Sequence: Synthetic oligonucleotide
gattcggcttcgaagctgagt

SEQ ID NO: 19062 - DNA, 21 bp, Artificial Sequence
  Description of Artificial Sequence: Synthetic oligonucleotide
gccagcgacagcaaaaacgtc

SEQ ID NO: 19063 - DNA, 21 bp, Artificial Sequence
  Description of Artificial Sequence: Synthetic oligonucleotide
gccatgaacgacagcaaactc

SEQ ID NO: 19064 - DNA, 21 bp, Artificial Sequence
  Description of Artificial Sequence: Synthetic oligonucleotide
gccctcaccgaccaaagaggc

SEQ ID NO: 19065 - DNA, 21 bp, Artificial Sequence
  Description of Artificial Sequence: Synthetic oligonucleotide
gccgccaccctccccgccggc

SEQ ID NO: 19066 - DNA, 21 bp, Artificial Sequence
  Description of Artificial Sequence: Synthetic oligonucleotide
gccgccagcagcaacaacaaa

SEQ ID NO: 19067 - DNA, 21 bp, Artificial Sequence
  Description of Artificial Sequence: Synthetic oligonucleotide
gctgaatcgagggagaagggg

SEQ ID NO: 19068 - DNA, 21 bp, Artificial Sequence
  Description of Artificial Sequence: Synthetic oligonucleotide
ggcatcgccgaaaaccacaaa

SEQ ID NO: 19069 - DNA, 21 bp, Artificial Sequence
  Description of Artificial Sequence: Synthetic oligonucleotide
ggcggcaaaagcagcgtcagc

SEQ ID NO: 19070 - DNA, 21 bp, Artificial Sequence
  Description of Artificial Sequence: Synthetic oligonucleotide
ggcgtcaacggcgtcagcaac

SEQ ID NO: 19071 - DNA, 21 bp, Artificial Sequence
  Description of Artificial Sequence: Synthetic oligonucleotide
gggaatagtacgtctaatggg

SEQ ID NO: 19072 - DNA, 21 bp, Artificial Sequence
  Description of Artificial Sequence: Synthetic oligonucleotide
gggtcgggtggggggattgcg

SEQ ID NO: 19073 - DNA, 21 bp, Artificial Sequence
  Description of Artificial Sequence: Synthetic oligonucleotide
ggtaagaatagtgatgttcat

SEQ ID NO: 19074 - DNA, 21 bp, Artificial Sequence
  Description of Artificial Sequence: Synthetic oligonucleotide
ggttctgcagattctagtaag

SEQ ID NO: 19075 - DNA, 21 bp, Artificial Sequence
  Description of Artificial Sequence: Synthetic oligonucleotide
gtcaacagcaccggcgtccac

SEQ ID NO: 19076 - DNA, 21 bp, Artificial Sequence
  Description of Artificial Sequence: Synthetic oligonucleotide
gtcgccaccagcggccccaaa

SEQ ID NO: 19077 - DNA, 21 bp, Artificial Sequence
  Description of Artificial Sequence: Synthetic oligonucleotide
gtgtctaatggtacgagtggt

SEQ ID NO: 19078 - DNA, 21 bp, Artificial Sequence
  Description of Artificial Sequence: Synthetic oligonucleotide
gttgggaatagttcgttgcgg

SEQ ID NO: 19079 - DNA, 21 bp, Artificial Sequence
  Description of Artificial Sequence: Synthetic oligonucleotide
tcgcaggagcggtctctggct

SEQ ID NO: 19080 - DNA, 21 bp, Artificial Sequence
  Description of Artificial Sequence: Synthetic oligonucleotide
tcggtgtctggtgagcggtct

SEQ ID NO: 19081 - DNA, 21 bp, Artificial Sequence
  Description of Artificial Sequence: Synthetic oligonucleotide
tctaattcgtcgtctgctagt

SEQ ID NO: 19082 - DNA, 21 bp, Artificial Sequence
  Description of Artificial Sequence: Synthetic oligonucleotide
ttgcctactggttctaagtcg

SEQ ID NO: 19083 - DNA, 21 bp, Artificial Sequence
  Description of Artificial Sequence: Synthetic oligonucleotide
tctaatgggaagtctcctcag

SEQ ID NO: 19084 - DNA, 21 bp, Artificial Sequence
  Description of Artificial Sequence: Synthetic oligonucleotide
gctggtgagggttcttctcgg

SEQ ID NO: 19085 - DNA, 21 bp, Artificial Sequence
  Description of Artificial Sequence: Synthetic oligonucleotide
aaggatgcgggtactagttcg

SEQ ID NO: 19086 - DNA, 21 bp, Artificial Sequence
  Description of Artificial Sequence: Synthetic oligonucleotide
agtggggatcagaaaggtgct

SEQ ID NO: 19087 - DNA, 21 bp, Artificial Sequence
  Description of Artificial Sequence: Synthetic oligonucleotide
atgtctgggaatactggtaat

SEQ ID NO: 19088 - DNA, 21 bp, Artificial Sequence
  Description of Artificial Sequence: Synthetic oligonucleotide
cttcaggagaagccgagtgct

SEQ ID NO: 19089 - DNA, 21 bp, Artificial Sequence
  Description of Artificial Sequence: Synthetic oligonucleotide
gctcagaataataatgcgggg

SEQ ID NO: 19090 - DNA, 21 bp, Artificial Sequence
  Description of Artificial Sequence: Synthetic oligonucleotide
gggactggtgagcgtcatctt

SEQ ID NO: 19091 - DNA, 21 bp, Artificial Sequence
  Description of Artificial Sequence: Synthetic oligonucleotide
gggagtcagtcgtctactcgg

SEQ ID NO: 19092 - DNA, 21 bp, Artificial Sequence
  Description of Artificial Sequence: Synthetic oligonucleotide
gggctgaatacggcgtctggg

SEQ ID NO: 19093 - DNA, 21 bp, Artificial Sequence
  Description of Artificial Sequence: Synthetic oligonucleotide
tctcgggagagtgctaatcat

SEQ ID NO: 19094 - DNA, 21 bp, Artificial Sequence
  Description of Artificial Sequence: Synthetic oligonucleotide
aggactactgcgaatagtggt

SEQ ID NO: 19095 - DNA, 21 bp, Artificial Sequence
  Description of Artificial Sequence: Synthetic oligonucleotide
gtcaccgacaaacccaacatg

SEQ ID NO: 19096 - DNA, 21 bp, Artificial Sequence
  Description of Artificial Sequence: Synthetic oligonucleotide
agcctcaccaacagcaacagc

SEQ ID NO: 19097 - DNA, 21 bp, Artificial Sequence
  Description of Artificial Sequence: Synthetic oligonucleotide
acgggggctggtcatacgtcg

SEQ ID NO: 19098 - DNA, 21 bp, Artificial Sequence
  Description of Artificial Sequence: Synthetic oligonucleotide
accctcgccagcaccaacgcc

SEQ ID NO: 19099 - DNA, 21 bp, Artificial Sequence
  Description of Artificial Sequence: Synthetic oligonucleotide
ggcgacgtcaacgtcaaacaa

SEQ ID NO: 19100 - DNA, 21 bp, Artificial Sequence
  Description of Artificial Sequence: Synthetic oligonucleotide
gcttctcatgataagtcgtct

SEQ ID NO: 19101 - DNA, 21 bp, Artificial Sequence
  Description of Artificial Sequence: Synthetic oligonucleotide
gttggttcgagtaaggatggt

SEQ ID NO: 19102 - DNA, 21 bp, Artificial Sequence
  Description of Artificial Sequence: Synthetic oligonucleotide
catgatggttcgaagtctatg

SEQ ID NO: 19103 - DNA, 21 bp, Artificial Sequence
  Description of Artificial Sequence: Synthetic oligonucleotide
gacagcacccacggcaacacc

SEQ ID NO: 19104 - DNA, 21 bp, Artificial Sequence
  Description of Artificial Sequence: Synthetic oligonucleotide
ggcctcaaacaagcccccacc

SEQ ID NO: 19105 - DNA, 21 bp, Artificial Sequence
  Description of Artificial Sequence: Synthetic oligonucleotide
ggtgattctaagaagcctccg

SEQ ID NO: 19106 - DNA, 21 bp, Artificial Sequence
  Description of Artificial Sequence: Synthetic oligonucleotide
acgccgggtgggtcggcgcct

SEQ ID NO: 19107 - DNA, 21 bp, Artificial Sequence
  Description of Artificial Sequence: Synthetic oligonucleotide
cgtggtgggtctgatagtgct

SEQ ID NO: 19108 - DNA, 21 bp, Artificial Sequence
  Description of Artificial Sequence: Synthetic oligonucleotide
ggcaccagcggcggcggcacc

SEQ ID NO: 19109 - DNA, 21 bp, Artificial Sequence
  Description of Artificial Sequence: Synthetic oligonucleotide
agcgtcggcacccccagcgcc

SEQ ID NO: 19110 - DNA, 21 bp, Artificial Sequence
  Description of Artificial Sequence: Synthetic oligonucleotide
gaaaccggcgccagcagcctc

SEQ ID NO: 19111 - DNA, 21 bp, Artificial Sequence
  Description of Artificial Sequence: Synthetic oligonucleotide
acgggtccgacggagaagtct

SEQ ID NO: 19112 - DNA, 21 bp, Artificial Sequence
  Description of Artificial Sequence: Synthetic oligonucleotide
agccccaaacccggcagcatc

SEQ ID NO: 19113 - DNA, 21 bp, Artificial Sequence
  Description of Artificial Sequence: Synthetic oligonucleotide
tctgattcgacgcggtctcag

SEQ ID NO: 19114 - DNA, 21 bp, Artificial Sequence
  Description of Artificial Sequence: Synthetic oligonucleotide
acgggtaattcgagtgcgcct

SEQ ID NO: 19115 - DNA, 21 bp, Artificial Sequence
  Description of Artificial Sequence: Synthetic oligonucleotide
gatgcgcgggagaggaatcag

SEQ ID NO: 19116 - DNA, 21 bp, Artificial Sequence
  Description of Artificial Sequence: Synthetic oligonucleotide
accaacaccaccagcgccacc

SEQ ID NO: 19117 - DNA, 21 bp, Artificial Sequence
  Description of Artificial Sequence: Synthetic oligonucleotide
cttgggactagttcttctgtg

SEQ ID NO: 19118 - DNA, 21 bp, Artificial Sequence
  Description of Artificial Sequence: Synthetic oligonucleotide
caggggcagaatcatcctaat

SEQ ID NO: 19119 - DNA, 21 bp, Artificial Sequence
  Description of Artificial Sequence: Synthetic oligonucleotide
ggtggtactgggacgcttggg

SEQ ID NO: 19120 - DNA, 21 bp, Artificial Sequence
  Description of Artificial Sequence: Synthetic oligonucleotide
ttggggacgggtacgtcgact

SEQ ID NO: 19121 - DNA, 21 bp, Artificial Sequence
  Description of Artificial Sequence: Synthetic oligonucleotide
gaaggcagccaacccctccaa

SEQ ID NO: 19122 - DNA, 21 bp, Artificial Sequence
  Description of Artificial Sequence: Synthetic oligonucleotide
gaaagcggcatgcaaaacagc

SEQ ID NO: 19123 - DNA, 21 bp, Artificial Sequence
  Description of Artificial Sequence: Synthetic oligonucleotide
ggggttgatcacgcgaagacg

SEQ ID NO: 19124 - DNA, 21 bp, Artificial Sequence
  Description of Artificial Sequence: Synthetic oligonucleotide
agccccatcaccaacggccac

SEQ ID NO: 19125 - DNA, 21 bp, Artificial Sequence
  Description of Artificial Sequence: Synthetic oligonucleotide
atgagcggcagcgccaaagac

SEQ ID NO: 19126 - DNA, 21 bp, Artificial Sequence
  Description of Artificial Sequence: Synthetic oligonucleotide
caaagcggcgaagcccccaga

SEQ ID NO: 19127 - DNA, 21 bp, Artificial Sequence
  Description of Artificial Sequence: Synthetic oligonucleotide
ggcgaaaccagcagaaccagc

SEQ ID NO: 19128 - DNA, 21 bp, Artificial Sequence
  Description of Artificial Sequence: Synthetic oligonucleotide
ggtgattcgcggcctctgaat

SEQ ID NO: 19129 - DNA, 21 bp, Artificial Sequence
  Description of Artificial Sequence: Synthetic oligonucleotide
aataatggttctcagcttaag

SEQ ID NO: 19130 - DNA, 21 bp, Artificial Sequence
  Description of Artificial Sequence: Synthetic oligonucleotide
agtactgctaatgcgtcgtcg

SEQ ID NO: 19131 - DNA, 21 bp, Artificial Sequence
  Description of Artificial Sequence: Synthetic oligonucleotide
ggccccaacagcaacaaaagc

SEQ ID NO: 19132 - DNA, 21 bp, Artificial Sequence
  Description of Artificial Sequence: Synthetic oligonucleotide
tctggggataatctgcggggg

SEQ ID NO: 19133 - DNA, 21 bp, Artificial Sequence
  Description of Artificial Sequence: Synthetic oligonucleotide
ggcggcagcaaacccaacctc

SEQ ID NO: 19134 - DNA, 21 bp, Artificial Sequence
  Description of Artificial Sequence: Synthetic oligonucleotide
ggcagcagcggcagccacagc

SEQ ID NO: 19135 - DNA, 21 bp, Artificial Sequence
  Description of Artificial Sequence: Synthetic oligonucleotide
agcggcatgaacggccaaaac

SEQ ID NO: 19136 - DNA, 21 bp, Artificial Sequence
  Description of Artificial Sequence: Synthetic oligonucleotide
cagactaattcgggttcgact

SEQ ID NO: 19137 - DNA, 21 bp, Artificial Sequence
  Description of Artificial Sequence: Synthetic oligonucleotide
gccagcggcagccacagcagc

SEQ ID NO: 19138 - DNA, 21 bp, Artificial Sequence
  Description of Artificial Sequence: Synthetic oligonucleotide
gccctcagcgaaaaaaccctc

SEQ ID NO: 19139 - DNA, 21 bp, Artificial Sequence
  Description of Artificial Sequence: Synthetic oligonucleotide
gagtcgtcgaagccttctttg

SEQ ID NO: 19140 - DNA, 21 bp, Artificial Sequence
  Description of Artificial Sequence: Synthetic oligonucleotide
ggtgggggtactactcaggct

SEQ ID NO: 19141 - DNA, 21 bp, Artificial Sequence
  Description of Artificial Sequence: Synthetic oligonucleotide
tctaaggcgaatactccgaat

SEQ ID NO: 19142 - DNA, 21 bp, Artificial Sequence
  Description of Artificial Sequence: Synthetic oligonucleotide
agcacccaacccagcagcggc

SEQ ID NO: 19143 - DNA, 21 bp, Artificial Sequence
  Description of Artificial Sequence: Synthetic oligonucleotide
gtcgccgaccaaaaacaaggc

SEQ ID NO: 19144 - DNA, 21 bp, Artificial Sequence
  Description of Artificial Sequence: Synthetic oligonucleotide
cacggcagcaacggcagcagc

SEQ ID NO: 19145 - DNA, 21 bp, Artificial Sequence
  Description of Artificial Sequence: Synthetic oligonucleotide
gatactgggaagagtcctgtg

SEQ ID NO: 19146 - DNA, 21 bp, Artificial Sequence
  Description of Artificial Sequence: Synthetic oligonucleotide
aatatgacgtctgcgaaggat

SEQ ID NO: 19147 - DNA, 21 bp, Artificial Sequence
  Description of Artificial Sequence: Synthetic oligonucleotide
agcaccaccggcgaagccaaa

SEQ ID NO: 19148 - DNA, 21 bp, Artificial Sequence
  Description of Artificial Sequence: Synthetic oligonucleotide
gaaaacagcaccagccacagc

SEQ ID NO: 19149 - DNA, 21 bp, Artificial Sequence
  Description of Artificial Sequence: Synthetic oligonucleotide
gtcagcaacagccccaccaaa

SEQ ID NO: 19150 - DNA, 21 bp, Artificial Sequence
  Description of Artificial Sequence: Synthetic oligonucleotide
aacgccggcgccagcaccctc

SEQ ID NO: 19151 - DNA, 21 bp, Artificial Sequence
  Description of Artificial Sequence: Synthetic oligonucleotide
agttctgcgactaataatacg

SEQ ID NO: 19152 - DNA, 21 bp, Artificial Sequence
  Description of Artificial Sequence: Synthetic oligonucleotide
accaccggcgtcggcggcacc

SEQ ID NO: 19153 - DNA, 21 bp, Artificial Sequence
  Description of Artificial Sequence: Synthetic oligonucleotide
gcgaatacgacgggtcttagt

SEQ ID NO: 19154 - DNA, 21 bp, Artificial Sequence
  Description of Artificial Sequence: Synthetic oligonucleotide
tcgaatggtacggctaagagt

SEQ ID NO: 19155 - DNA, 21 bp, Artificial Sequence
  Description of Artificial Sequence: Synthetic oligonucleotide
gcccacaaagacaaagacggc

SEQ ID NO: 19156 - DNA, 21 bp, Artificial Sequence
  Description of Artificial Sequence: Synthetic oligonucleotide
tcgagtggtacttctacggct

SEQ ID NO: 19157 - DNA, 21 bp, Artificial Sequence
  Description of Artificial Sequence: Synthetic oligonucleotide
actaatgagaatagtaatcgg

SEQ ID NO: 19158 - DNA, 21 bp, Artificial Sequence
  Description of Artificial Sequence: Synthetic oligonucleotide
caaatcgccaaagacagcagc

SEQ ID NO: 19159 - DNA, 21 bp, Artificial Sequence
  Description of Artificial Sequence: Synthetic oligonucleotide
ctcagcaccagccaagtcagc

SEQ ID NO: 19160 - DNA, 21 bp, Artificial Sequence
  Description of Artificial Sequence: Synthetic oligonucleotide
cagagtgaggcgaagggggcg

SEQ ID NO: 19161 - DNA, 21 bp, Artificial Sequence
  Description of Artificial Sequence: Synthetic oligonucleotide
gttggtgttaaggcgtctcag

SEQ ID NO: 19162 - DNA, 21 bp, Artificial Sequence
  Description of Artificial Sequence: Synthetic oligonucleotide
gaccccagcaaagccagcgtc

SEQ ID NO: 19163 - DNA, 21 bp, Artificial Sequence
  Description of Artificial Sequence: Synthetic oligonucleotide
aaccccagcagcggcgacaaa

SEQ ID NO: 19164 - DNA, 21 bp, Artificial Sequence
  Description of Artificial Sequence: Synthetic oligonucleotide
atgggcagcaccgccaacggc

SEQ ID NO: 19165 - DNA, 21 bp, Artificial Sequence
  Description of Artificial Sequence: Synthetic oligonucleotide
ggcgccagcggcgacaaccac

SEQ ID NO: 19166 - DNA, 21 bp, Artificial Sequence
  Description of Artificial Sequence: Synthetic oligonucleotide
tggagggagtcggagacgaag

SEQ ID NO: 19167 - DNA, 21 bp, Artificial Sequence
  Description of Artificial Sequence: Synthetic oligonucleotide
aacaccggcgcccccgccagc

SEQ ID NO: 19168 - DNA, 21 bp, Artificial Sequence
  Description of Artificial Sequence: Synthetic oligonucleotide
gacgccaacagcggcaaaatg

SEQ ID NO: 19169 - DNA, 21 bp, Artificial Sequence
  Description of Artificial Sequence: Synthetic oligonucleotide
gcgagtaagagtggtgctgct

SEQ ID NO: 19170 - DNA, 21 bp, Artificial Sequence
  Description of Artificial Sequence: Synthetic oligonucleotide
ggtcttggttcgtctacgtcg

SEQ ID NO: 19171 - DNA, 21 bp, Artificial Sequence
  Description of Artificial Sequence: Synthetic oligonucleotide
gacagcagcaaaagcgcctac

SEQ ID NO: 19172 - DNA, 21 bp, Artificial Sequence
  Description of Artificial Sequence: Synthetic oligonucleotide
agcggcaaacaaagccccgcc

SEQ ID NO: 19173 - DNA, 21 bp, Artificial Sequence
  Description of Artificial Sequence: Synthetic oligonucleotide
actgttacgaatacgtctggg

SEQ ID NO: 19174 - DNA, 21 bp, Artificial Sequence
  Description of Artificial Sequence: Synthetic oligonucleotide
atcgccggccccggcacccaa

SEQ ID NO: 19175 - DNA, 21 bp, Artificial Sequence
  Description of Artificial Sequence: Synthetic oligonucleotide
gggttggataaggctggtaag

SEQ ID NO: 19176 - DNA, 21 bp, Artificial Sequence
  Description of Artificial Sequence: Synthetic oligonucleotide
gtggatggtaagacttcgaat

SEQ ID NO: 19177 - DNA, 21 bp, Artificial Sequence
  Description of Artificial Sequence: Synthetic oligonucleotide
accgccggcggcagccacctc

SEQ ID NO: 19178 - DNA, 21 bp, Artificial Sequence
  Description of Artificial Sequence: Synthetic oligonucleotide
gccagccaaagccccagcctc

SEQ ID NO: 19179 - DNA, 21 bp, Artificial Sequence
  Description of Artificial Sequence: Synthetic oligonucleotide
tctgttggttcttcttcgaat

SEQ ID NO: 19180 - DNA, 21 bp, Artificial Sequence
  Description of Artificial Sequence: Synthetic oligonucleotide
aatacggcggctccgactgct

SEQ ID NO: 19181 - DNA, 21 bp, Artificial Sequence
  Description of Artificial Sequence: Synthetic oligonucleotide
aatactcatacgaagtcgacg

SEQ ID NO: 19182 - DNA, 21 bp, Artificial Sequence
  Description of Artificial Sequence: Synthetic oligonucleotide
ggcaacagccaacccaacgcc

SEQ ID NO: 19183 - DNA, 21 bp, Artificial Sequence
  Description of Artificial Sequence: Synthetic oligonucleotide
tctctttcggataagcagggt

SEQ ID NO: 19184 - DNA, 21 bp, Artificial Sequence
  Description of Artificial Sequence: Synthetic oligonucleotide
accaccggcagcagcatgatg

SEQ ID NO: 19185 - DNA, 21 bp, Artificial Sequence
  Description of Artificial Sequence: Synthetic oligonucleotide
actactgtttctagtccgcat

SEQ ID NO: 19186 - DNA, 21 bp, Artificial Sequence
  Description of Artificial Sequence: Synthetic oligonucleotide
agccaaaccggccaaaaccaa

SEQ ID NO: 19187 - DNA, 21 bp, Artificial Sequence
  Description of Artificial Sequence: Synthetic oligonucleotide
atggggagttctaaggtgggt

SEQ ID NO: 19188 - DNA, 21 bp, Artificial Sequence
  Description of Artificial Sequence: Synthetic oligonucleotide
gtcggcgcccccaccaacaga

SEQ ID NO: 19189 - DNA, 21 bp, Artificial Sequence
  Description of Artificial Sequence: Synthetic oligonucleotide
tctgggatgcctgcgggtact

SEQ ID NO: 19190 - DNA, 21 bp, Artificial Sequence
  Description of Artificial Sequence: Synthetic oligonucleotide
ggcagcaccaaagaagccaac

SEQ ID NO: 19191 - DNA, 21 bp, Artificial Sequence
  Description of Artificial Sequence: Synthetic oligonucleotide
caaaccaacgccaccctcggc

SEQ ID NO: 19192 - DNA, 21 bp, Artificial Sequence
  Description of Artificial Sequence: Synthetic oligonucleotide
gacagcggcggcagccccaga

SEQ ID NO: 19193 - DNA, 21 bp, Artificial Sequence
  Description of Artificial Sequence: Synthetic oligonucleotide
ggcagcgtcaaacccggcctc

SEQ ID NO: 19194 - DNA, 21 bp, Artificial Sequence
  Description of Artificial Sequence: Synthetic oligonucleotide
gggtcgagttcgaagagtact

SEQ ID NO: 19195 - DNA, 21 bp, Artificial Sequence
  Description of Artificial Sequence: Synthetic oligonucleotide
gtcaaaagccaagccaacaac

SEQ ID NO: 19196 - DNA, 21 bp, Artificial Sequence
  Description of Artificial Sequence: Synthetic oligonucleotide
tcgcagacgactcagtcgggt

SEQ ID NO: 19197 - DNA, 21 bp, Artificial Sequence
  Description of Artificial Sequence: Synthetic oligonucleotide
gggacgccttcgtctagtact

SEQ ID NO: 19198 - DNA, 21 bp, Artificial Sequence
  Description of Artificial Sequence: Synthetic oligonucleotide
cggtctagtgataagagtggt

SEQ ID NO: 19199 - DNA, 21 bp, Artificial Sequence
  Description of Artificial Sequence: Synthetic oligonucleotide
aattcgagtcggtcgaatgag

SEQ ID NO: 19200 - DNA, 21 bp, Artificial Sequence
  Description of Artificial Sequence: Synthetic oligonucleotide
accggccccaccccccaagtc

SEQ ID NO: 19201 - DNA, 21 bp, Artificial Sequence
  Description of Artificial Sequence: Synthetic oligonucleotide
actacgggtacgactccttcg

SEQ ID NO: 19202 - DNA, 21 bp, Artificial Sequence
  Description of Artificial Sequence: Synthetic oligonucleotide
agcgacggcagcgccgccgcc

SEQ ID NO: 19203 - DNA, 21 bp, Artificial Sequence
  Description of Artificial Sequence: Synthetic oligonucleotide
attgggactacttctcagagt

SEQ ID NO: 19204 - DNA, 21 bp, Artificial Sequence
  Description of Artificial Sequence: Synthetic oligonucleotide
agcaccggcgcccccaacgcc

SEQ ID NO: 19205 - DNA, 21 bp, Artificial Sequence
  Description of Artificial Sequence: Synthetic oligonucleotide
gaaagcaaaaaacccgccctc

SEQ ID NO: 19206 - DNA, 21 bp, Artificial Sequence
  Description of Artificial Sequence: Synthetic oligonucleotide
ggccaccaaaccacccccacc

SEQ ID NO: 19207 - DNA, 21 bp, Artificial Sequence
  Description of Artificial Sequence: Synthetic oligonucleotide
gggaatctggcgaaggctgag

SEQ ID NO: 19208 - DNA, 21 bp, Artificial Sequence
  Description of Artificial Sequence: Synthetic oligonucleotide
gaacccaccagcagaaacgcc

SEQ ID NO: 19209 - DNA, 21 bp, Artificial Sequence
  Description of Artificial Sequence: Synthetic oligonucleotide
agtgctactaatgctgctact

SEQ ID NO: 19210 - DNA, 21 bp, Artificial Sequence
  Description of Artificial Sequence: Synthetic oligonucleotide
ggtaattcgcagtctatgact

SEQ ID NO: 19211 - DNA, 21 bp, Artificial Sequence
  Description of Artificial Sequence: Synthetic oligonucleotide
gtcggcggcagcggcccccaa

SEQ ID NO: 19212 - DNA, 21 bp, Artificial Sequence
  Description of Artificial Sequence: Synthetic oligonucleotide
actccgactaagcctaatacg

SEQ ID NO: 19213 - DNA, 21 bp, Artificial Sequence
  Description of Artificial Sequence: Synthetic oligonucleotide
ggtacggccaggaataatggt

SEQ ID NO: 19214 - DNA, 21 bp, Artificial Sequence
  Description of Artificial Sequence: Synthetic oligonucleotide
aacgtcagcaccaacaacggc

SEQ ID NO: 19215 - DNA, 21 bp, Artificial Sequence
  Description of Artificial Sequence: Synthetic oligonucleotide
aacaccaccagcggcctcgcc

SEQ ID NO: 19216 - DNA, 21 bp, Artificial Sequence
  Description of Artificial Sequence: Synthetic oligonucleotide
aatcaggcggctcagggtgtt

SEQ ID NO: 19217 - DNA, 21 bp, Artificial Sequence
  Description of Artificial Sequence: Synthetic oligonucleotide
accaacgccagccccagcagc

SEQ ID NO: 19218 - DNA, 21 bp, Artificial Sequence
  Description of Artificial Sequence: Synthetic oligonucleotide
actgggaaggatcagtcttcg

SEQ ID NO: 19219 - DNA, 21 bp, Artificial Sequence
  Description of Artificial Sequence: Synthetic oligonucleotide
acttcttcgccgacgggtgtt

SEQ ID NO: 19220 - DNA, 21 bp, Artificial Sequence
  Description of Artificial Sequence: Synthetic oligonucleotide
agtgggggtaagccttctaat

SEQ ID NO: 19221 - DNA, 21 bp, Artificial Sequence
  Description of Artificial Sequence: Synthetic oligonucleotide
gaaagcagcagcagaagcatc

SEQ ID NO: 19222 - DNA, 21 bp, Artificial Sequence
  Description of Artificial Sequence: Synthetic oligonucleotide
gccagcgacaaacccgccctc

SEQ ID NO: 19223 - DNA, 21 bp, Artificial Sequence
  Description of Artificial Sequence: Synthetic oligonucleotide
gtcaaaacccaagccaccatc

SEQ ID NO: 19224 - DNA, 21 bp, Artificial Sequence
  Description of Artificial Sequence: Synthetic oligonucleotide
acccacagccccaacggcaac

SEQ ID NO: 19225 - DNA, 21 bp, Artificial Sequence
  Description of Artificial Sequence: Synthetic oligonucleotide
cagacgagtcaggctcctgtt

SEQ ID NO: 19226 - DNA, 21 bp, Artificial Sequence
  Description of Artificial Sequence: Synthetic oligonucleotide
acggatgggactaaggttaat

SEQ ID NO: 19227 - DNA, 21 bp, Artificial Sequence
  Description of Artificial Sequence: Synthetic oligonucleotide
atcatggaaagcaaaagcatg

SEQ ID NO: 19228 - DNA, 21 bp, Artificial Sequence
  Description of Artificial Sequence: Synthetic oligonucleotide
agcagcgaaagaagcagcaac

SEQ ID NO: 19229 - DNA, 21 bp, Artificial Sequence
  Description of Artificial Sequence: Synthetic oligonucleotide
cagactaagagtaatccttcg

SEQ ID NO: 19230 - DNA, 21 bp, Artificial Sequence
  Description of Artificial Sequence: Synthetic oligonucleotide
gacggcgtcgacaaaagaggc

SEQ ID NO: 19231 - DNA, 21 bp, Artificial Sequence
  Description of Artificial Sequence: Synthetic oligonucleotide
ggtgctgcggttaagagtact

SEQ ID NO: 19232 - DNA, 21 bp, Artificial Sequence
  Description of Artificial Sequence: Synthetic oligonucleotide
ggggatgggaattctcatgtg

SEQ ID NO: 19233 - DNA, 21 bp, Artificial Sequence
  Description of Artificial Sequence: Synthetic oligonucleotide
tctgggtctgagcagattaag

SEQ ID NO: 19234 - DNA, 21 bp, Artificial Sequence
  Description of Artificial Sequence: Synthetic oligonucleotide
aacaccacccccgccagcgcc

SEQ ID NO: 19235 - DNA, 21 bp, Artificial Sequence
  Description of Artificial Sequence: Synthetic oligonucleotide
gacaacaccggcagcaccaac

SEQ ID NO: 19236 - DNA, 21 bp, Artificial Sequence
  Description of Artificial Sequence: Synthetic oligonucleotide
gatgggcctagtcctgctagg

SEQ ID NO: 19237 - DNA, 21 bp, Artificial Sequence
  Description of Artificial Sequence: Synthetic oligonucleotide
ggtggtactgcgacgcctctt

SEQ ID NO: 19238 - DNA, 21 bp, Artificial Sequence
  Description of Artificial Sequence: Synthetic oligonucleotide
accagcggcgacagaatcagc

SEQ ID NO: 19239 - DNA, 21 bp, Artificial Sequence
  Description of Artificial Sequence: Synthetic oligonucleotide
ggtccgagtgagggtcagcgt

SEQ ID NO: 19240 - DNA, 21 bp, Artificial Sequence
  Description of Artificial Sequence: Synthetic oligonucleotide
acgactgatcataagagtgtt

SEQ ID NO: 19241 - DNA, 21 bp, Artificial Sequence
  Description of Artificial Sequence: Synthetic oligonucleotide
aacggcgaaaaaatcggcaac

SEQ ID NO: 19242 - DNA, 21 bp, Artificial Sequence
  Description of Artificial Sequence: Synthetic oligonucleotide
tctaagtcggttcagccgtcg

SEQ ID NO: 19243 - DNA, 21 bp, Artificial Sequence
  Description of Artificial Sequence: Synthetic oligonucleotide
cgtgctgatcagaatcgtggg

SEQ ID NO: 19244 - DNA, 21 bp, Artificial Sequence
  Description of Artificial Sequence: Synthetic oligonucleotide
aaccaacacaaacccagcgcc

SEQ ID NO: 19245 - DNA, 21 bp, Artificial Sequence
  Description of Artificial Sequence: Synthetic oligonucleotide
agcaaagccaccagcgccgcc

SEQ ID NO: 19246 - DNA, 21 bp, Artificial Sequence
  Description of Artificial Sequence: Synthetic oligonucleotide
agcgtcagcagcgccaaagac

SEQ ID NO: 19247 - DNA, 21 bp, Artificial Sequence
  Description of Artificial Sequence: Synthetic oligonucleotide
tctacggggattagtaatgtt

SEQ ID NO: 19248 - DNA, 21 bp, Artificial Sequence
  Description of Artificial Sequence: Synthetic oligonucleotide
gacccccccgacaacaaagtc

SEQ ID NO: 19249 - DNA, 21 bp, Artificial Sequence
  Description of Artificial Sequence: Synthetic oligonucleotide
aacagcgccagcgcccaaagc

SEQ ID NO: 19250 - DNA, 21 bp, Artificial Sequence
  Description of Artificial Sequence: Synthetic oligonucleotide
aaccccagcggcagaaacgaa

SEQ ID NO: 19251 - DNA, 21 bp, Artificial Sequence
  Description of Artificial Sequence: Synthetic oligonucleotide
accgccggcgacagcagagcc

SEQ ID NO: 19252 - DNA, 21 bp, Artificial Sequence
  Description of Artificial Sequence: Synthetic oligonucleotide
cgggttagtgctgataggggg

SEQ ID NO: 19253 - DNA, 21 bp, Artificial Sequence
  Description of Artificial Sequence: Synthetic oligonucleotide
tctagggataaggaggtggcg

SEQ ID NO: 19254 - DNA, 21 bp, Artificial Sequence
  Description of Artificial Sequence: Synthetic oligonucleotide
aatactcctaatcagtctacg

SEQ ID NO: 19255 - DNA, 21 bp, Artificial Sequence
  Description of Artificial Sequence: Synthetic oligonucleotide
agcaacggcggcagcaacagc

SEQ ID NO: 19256 - DNA, 21 bp, Artificial Sequence
  Description of Artificial Sequence: Synthetic oligonucleotide
caaaccaaccacaccaacagc

SEQ ID NO: 19257 - DNA, 21 bp, Artificial Sequence
  Description of Artificial Sequence: Synthetic oligonucleotide
ggtgctgctgcgaatttggct

SEQ ID NO: 19258 - DNA, 21 bp, Artificial Sequence
  Description of Artificial Sequence: Synthetic oligonucleotide
accggcagcagcagcgccacc

SEQ ID NO: 19259 - DNA, 21 bp, Artificial Sequence
  Description of Artificial Sequence: Synthetic oligonucleotide
aacggccacagcggcatcagc

SEQ ID NO: 19260 - DNA, 21 bp, Artificial Sequence
  Description of Artificial Sequence: Synthetic oligonucleotide
accaccaccgccggcctcacc

SEQ ID NO: 19261 - DNA, 21 bp, Artificial Sequence
  Description of Artificial Sequence: Synthetic oligonucleotide
agcagcggcaccgtcggcaaa

SEQ ID NO: 19262 - DNA, 21 bp, Artificial Sequence
  Description of Artificial Sequence: Synthetic oligonucleotide
agcgtcggccacgaccacaga

SEQ ID NO: 19263 - DNA, 21 bp, Artificial Sequence
  Description of Artificial Sequence: Synthetic oligonucleotide
agtgggaagagtgagcagacg

SEQ ID NO: 19264 - DNA, 21 bp, Artificial Sequence
  Description of Artificial Sequence: Synthetic oligonucleotide
ggcggcaacagcgccgccacc

SEQ ID NO: 19265 - DNA, 21 bp, Artificial Sequence
  Description of Artificial Sequence: Synthetic oligonucleotide
ttgggttcgggggctagggag

SEQ ID NO: 19266 - DNA, 21 bp, Artificial Sequence
  Description of Artificial Sequence: Synthetic oligonucleotide
ttggttccggaggctaagggg

SEQ ID NO: 19267 - DNA, 21 bp, Artificial Sequence
  Description of Artificial Sequence: Synthetic oligonucleotide
attcagtcgccgtcttcgggg

SEQ ID NO: 19268 - DNA, 21 bp, Artificial Sequence
  Description of Artificial Sequence: Synthetic oligonucleotide
aacctcggcagcgacagcaaa

SEQ ID NO: 19269 - DNA, 21 bp, Artificial Sequence
  Description of Artificial Sequence: Synthetic oligonucleotide
gagcctgctcctggtactaag

SEQ ID NO: 19270 - DNA, 21 bp, Artificial Sequence
  Description of Artificial Sequence: Synthetic oligonucleotide
agccccaccgccggcggcggc

SEQ ID NO: 19271 - DNA, 21 bp, Artificial Sequence
  Description of Artificial Sequence: Synthetic oligonucleotide
ctggcgagtaaggttgggcag

SEQ ID NO: 19272 - DNA, 21 bp, Artificial Sequence
  Description of Artificial Sequence: Synthetic oligonucleotide
gaaagcctcggcggcaacaaa

SEQ ID NO: 19273 - DNA, 21 bp, Artificial Sequence
  Description of Artificial Sequence: Synthetic oligonucleotide
gttactggtgcgtctatgaat

SEQ ID NO: 19274 - DNA, 21 bp, Artificial Sequence
  Description of Artificial Sequence: Synthetic oligonucleotide
acgtctagtcaggctacggtt

SEQ ID NO: 19275 - DNA, 21 bp, Artificial Sequence
  Description of Artificial Sequence: Synthetic oligonucleotide
catcatgctgataagggtagt

SEQ ID NO: 19276 - DNA, 21 bp, Artificial Sequence
  Description of Artificial Sequence: Synthetic oligonucleotide
cggcctgattctaagagtact

SEQ ID NO: 19277 - DNA, 21 bp, Artificial Sequence
  Description of Artificial Sequence: Synthetic oligonucleotide
ggtgtgcctgagagtaagcag

SEQ ID NO: 19278 - DNA, 21 bp, Artificial Sequence
  Description of Artificial Sequence: Synthetic oligonucleotide
gacagcagcagcagagccagc

SEQ ID NO: 19279 - DNA, 21 bp, Artificial Sequence
  Description of Artificial Sequence: Synthetic oligonucleotide
agcaaaagccccagccaagcc

SEQ ID NO: 19280 - DNA, 21 bp, Artificial Sequence
  Description of Artificial Sequence: Synthetic oligonucleotide
gaccccggcaaactcacccac

SEQ ID NO: 19281 - DNA, 21 bp, Artificial Sequence
  Description of Artificial Sequence: Synthetic oligonucleotide
agtcttgataatcagcgtcag

SEQ ID NO: 19282 - DNA, 21 bp, Artificial Sequence
  Description of Artificial Sequence: Synthetic oligonucleotide
ggtgcgagtaatggttctgcg

SEQ ID NO: 19283 - DNA, 21 bp, Artificial Sequence
  Description of Artificial Sequence: Synthetic oligonucleotide
cacagaaacagcaccagcagc

SEQ ID NO: 19284 - DNA, 21 bp, Artificial Sequence
  Description of Artificial Sequence: Synthetic oligonucleotide
cacaccagcaccaaagacagc

SEQ ID NO: 19285 - DNA, 21 bp, Artificial Sequence
  Description of Artificial Sequence: Synthetic oligonucleotide
gttcagcatgggtcttcgact

SEQ ID NO: 19286 - DNA, 21 bp, Artificial Sequence
  Description of Artificial Sequence: Synthetic oligonucleotide
gacggcgccggcgccaacgtc

SEQ ID NO: 19287 - DNA, 21 bp, Artificial Sequence
  Description of Artificial Sequence: Synthetic oligonucleotide
ggtggtcctccttcgaatacg

SEQ ID NO: 19288 - DNA, 21 bp, Artificial Sequence
  Description of Artificial Sequence: Synthetic oligonucleotide
gcgtctaattcgggggctgtt

SEQ ID NO: 19289 - DNA, 21 bp, Artificial Sequence
  Description of Artificial Sequence: Synthetic oligonucleotide
aacagagacagcagcctccac

SEQ ID NO: 19290 - DNA, 21 bp, Artificial Sequence
  Description of Artificial Sequence: Synthetic oligonucleotide
aacgacaccagaaccaccagc

SEQ ID NO: 19291 - DNA, 21 bp, Artificial Sequence
  Description of Artificial Sequence: Synthetic oligonucleotide
accggcagcgccaccatggtc

SEQ ID NO: 19292 - DNA, 21 bp, Artificial Sequence
  Description of Artificial Sequence: Synthetic oligonucleotide
acggggatgacgtctactagt

SEQ ID NO: 19293 - DNA, 21 bp, Artificial Sequence
  Description of Artificial Sequence: Synthetic oligonucleotide
agacaagccggccaactcgcc

SEQ ID NO: 19294 - DNA, 21 bp, Artificial Sequence
  Description of Artificial Sequence: Synthetic oligonucleotide
cagacggtgtctagttctggt

SEQ ID NO: 19295 - DNA, 21 bp, Artificial Sequence
  Description of Artificial Sequence: Synthetic oligonucleotide
ggtacgactccgggtaagaat

SEQ ID NO: 19296 - DNA, 21 bp, Artificial Sequence
  Description of Artificial Sequence: Synthetic oligonucleotide
agcagcaccgccaccggcctc

SEQ ID NO: 19297 - DNA, 21 bp, Artificial Sequence
  Description of Artificial Sequence: Synthetic oligonucleotide
agaaacgccagcagcagccaa

SEQ ID NO: 19298 - DNA, 21 bp, Artificial Sequence
  Description of Artificial Sequence: Synthetic oligonucleotide
catgttggtaagtcttcgacg

SEQ ID NO: 19299 - DNA, 21 bp, Artificial Sequence
  Description of Artificial Sequence: Synthetic oligonucleotide
tcgtctgagcgggctgggcat

SEQ ID NO: 19300 - DNA, 21 bp, Artificial Sequence
  Description of Artificial Sequence: Synthetic oligonucleotide
gacagaaccggcgccaaaaac

SEQ ID NO: 19301 - DNA, 21 bp, Artificial Sequence
  Description of Artificial Sequence: Synthetic oligonucleotide
gaccacagccacaaaaacgcc

SEQ ID NO: 19302 - DNA, 21 bp, Artificial Sequence
  Description of Artificial Sequence: Synthetic oligonucleotide
cacgtcgaaagaagccacggc

SEQ ID NO: 19303 - DNA, 21 bp, Artificial Sequence
  Description of Artificial Sequence: Synthetic oligonucleotide
agtaatccggggagggatggt

SEQ ID NO: 19304 - DNA, 21 bp, Artificial Sequence
  Description of Artificial Sequence: Synthetic oligonucleotide
ggtgattctggtcgtcaggct

SEQ ID NO: 19305 - DNA, 21 bp, Artificial Sequence
  Description of Artificial Sequence: Synthetic oligonucleotide
atgcaggatagtcgtgctcag

SEQ ID NO: 19306 - DNA, 21 bp, Artificial Sequence
  Description of Artificial Sequence: Synthetic oligonucleotide
cttggggggccgtcgaattcg

SEQ ID NO: 19307 - DNA, 21 bp, Artificial Sequence
  Description of Artificial Sequence: Synthetic oligonucleotide
gacagcaaagccgccccccaa

SEQ ID NO: 19308 - DNA, 21 bp, Artificial Sequence
  Description of Artificial Sequence: Synthetic oligonucleotide
gtggatgctaaggagaggagt

SEQ ID NO: 19309 - DNA, 21 bp, Artificial Sequence
  Description of Artificial Sequence: Synthetic oligonucleotide
accaccagcagcgccagcgcc

SEQ ID NO: 19310 - DNA, 21 bp, Artificial Sequence
  Description of Artificial Sequence: Synthetic oligonucleotide
agcagcgacagagacagcaaa

SEQ ID NO: 19311 - DNA, 21 bp, Artificial Sequence
  Description of Artificial Sequence: Synthetic oligonucleotide
agcggcaccggcagaagcgac

SEQ ID NO: 19312 - DNA, 21 bp, Artificial Sequence
  Description of Artificial Sequence: Synthetic oligonucleotide
ggcaacggcgccagcgccagc

SEQ ID NO: 19313 - DNA, 21 bp, Artificial Sequence
  Description of Artificial Sequence: Synthetic oligonucleotide
ggtacgcatggttcgagtaat

SEQ ID NO: 19314 - DNA, 21 bp, Artificial Sequence
  Description of Artificial Sequence: Synthetic oligonucleotide
aacagagccgaaggcagcggc

SEQ ID NO: 19315 - DNA, 21 bp, Artificial Sequence
  Description of Artificial Sequence: Synthetic oligonucleotide
accggcaaccccgccagccac

SEQ ID NO: 19316 - DNA, 21 bp, Artificial Sequence
  Description of Artificial Sequence: Synthetic oligonucleotide
agtggtgtgaattctgttggt

SEQ ID NO: 19317 - DNA, 21 bp, Artificial Sequence
  Description of Artificial Sequence: Synthetic oligonucleotide
agaaacaccagcagcgtccaa

SEQ ID NO: 19318 - DNA, 21 bp, Artificial Sequence
  Description of Artificial Sequence: Synthetic oligonucleotide
gtcaaaagcaacggcgccagc

SEQ ID NO: 19319 - DNA, 21 bp, Artificial Sequence
  Description of Artificial Sequence: Synthetic oligonucleotide
agcaacaacaaacccaccaac

SEQ ID NO: 19320 - DNA, 21 bp, Artificial Sequence
  Description of Artificial Sequence: Synthetic oligonucleotide
accggccaagacgtcatgaga

SEQ ID NO: 19321 - DNA, 21 bp, Artificial Sequence
  Description of Artificial Sequence: Synthetic oligonucleotide
tcggtgggtaagccgacgagt

SEQ ID NO: 19322 - DNA, 21 bp, Artificial Sequence
  Description of Artificial Sequence: Synthetic oligonucleotide
actactggtaattctgtgcct

SEQ ID NO: 19323 - DNA, 21 bp, Artificial Sequence
  Description of Artificial Sequence: Synthetic oligonucleotide
caggcgaagcagaattcgatt

SEQ ID NO: 19324 - DNA, 21 bp, Artificial Sequence
  Description of Artificial Sequence: Synthetic oligonucleotide
agcagagaagacaaaatccac

SEQ ID NO: 19325 - DNA, 21 bp, Artificial Sequence
  Description of Artificial Sequence: Synthetic oligonucleotide
gggtctactcagcctagtagt

SEQ ID NO: 19326 - DNA, 21 bp, Artificial Sequence
  Description of Artificial Sequence: Synthetic oligonucleotide
accagagacgccaccgtcaga

SEQ ID NO: 19327 - DNA, 21 bp, Artificial Sequence
  Description of Artificial Sequence: Synthetic oligonucleotide
cattctggtactcctacgggg

SEQ ID NO: 19328 - DNA, 21 bp, Artificial Sequence
  Description of Artificial Sequence: Synthetic oligonucleotide
gacaaacccggcggcatgagc

SEQ ID NO: 19329 - DNA, 21 bp, Artificial Sequence
  Description of Artificial Sequence: Synthetic oligonucleotide
agccacaccagcggcagcgcc

SEQ ID NO: 19330 - DNA, 21 bp, Artificial Sequence
  Description of Artificial Sequence: Synthetic oligonucleotide
attggggctggtacttcgtct

SEQ ID NO: 19331 - DNA, 21 bp, Artificial Sequence
  Description of Artificial Sequence: Synthetic oligonucleotide
attggttcgaatacgactact

SEQ ID NO: 19332 - DNA, 21 bp, Artificial Sequence
  Description of Artificial Sequence: Synthetic oligonucleotide
actcaggatcataataggtct

SEQ ID NO: 19333 - DNA, 21 bp, Artificial Sequence
  Description of Artificial Sequence: Synthetic oligonucleotide
aaccccggcgcccacgccagc

SEQ ID NO: 19334 - DNA, 21 bp, Artificial Sequence
  Description of Artificial Sequence: Synthetic oligonucleotide
aacgcccaaacccacgccagc

SEQ ID NO: 19335 - DNA, 21 bp, Artificial Sequence
  Description of Artificial Sequence: Synthetic oligonucleotide
accagcaccagcggcctcgcc

SEQ ID NO: 19336 - DNA, 21 bp, Artificial Sequence
  Description of Artificial Sequence: Synthetic oligonucleotide
gatttgaattctacgagtaag

SEQ ID NO: 19337 - DNA, 21 bp, Artificial Sequence
  Description of Artificial Sequence: Synthetic oligonucleotide
actaatgcgagtagtccgatg

SEQ ID NO: 19338 - DNA, 21 bp, Artificial Sequence
  Description of Artificial Sequence: Synthetic oligonucleotide
aacaccaaccaagccgccggc

SEQ ID NO: 19339 - DNA, 21 bp, Artificial Sequence
  Description of Artificial Sequence: Synthetic oligonucleotide
agccaaagcagccccagcatg

SEQ ID NO: 19340 - DNA, 21 bp, Artificial Sequence
  Description of Artificial Sequence: Synthetic oligonucleotide
gaaaaaggccaacacaaccaa

SEQ ID NO: 19341 - DNA, 21 bp, Artificial Sequence
  Description of Artificial Sequence: Synthetic oligonucleotide
gatagtaagcctagtacgtcg

SEQ ID NO: 19342 - DNA, 21 bp, Artificial Sequence
  Description of Artificial Sequence: Synthetic oligonucleotide
gatcctagtagtgcgtctaag

SEQ ID NO: 19343 - DNA, 21 bp, Artificial Sequence
  Description of Artificial Sequence: Synthetic oligonucleotide
ggcaccgaacccaccagaggc

SEQ ID NO: 19344 - DNA, 21 bp, Artificial Sequence
  Description of Artificial Sequence: Synthetic oligonucleotide
ggcgacaccaccagaaacaac

SEQ ID NO: 19345 - DNA, 21 bp, Artificial Sequence
  Description of Artificial Sequence: Synthetic oligonucleotide
gtcggcgtcggcagcgccgcc

SEQ ID NO: 19346 - DNA, 21 bp, Artificial Sequence
  Description of Artificial Sequence: Synthetic oligonucleotide
tcggttacggataagggtaag

SEQ ID NO: 19347 - DNA, 21 bp, Artificial Sequence
  Description of Artificial Sequence: Synthetic oligonucleotide
tctagtacgatgaaggagggg

SEQ ID NO: 19348 - DNA, 21 bp, Artificial Sequence
  Description of Artificial Sequence: Synthetic oligonucleotide
ttggatcaggcgaagcctaat

SEQ ID NO: 19349 - DNA, 21 bp, Artificial Sequence
  Description of Artificial Sequence: Synthetic oligonucleotide
gcgactgctaatacgggtggg

SEQ ID NO: 19350 - DNA, 21 bp, Artificial Sequence
  Description of Artificial Sequence: Synthetic oligonucleotide
agcaccggcaaaagcctcggc

SEQ ID NO: 19351 - DNA, 21 bp, Artificial Sequence
  Description of Artificial Sequence: Synthetic oligonucleotide
cacggcgtcagcacccccacc

SEQ ID NO: 19352 - DNA, 21 bp, Artificial Sequence
  Description of Artificial Sequence: Synthetic oligonucleotide
tctaagggtgctagtcctcag

SEQ ID NO: 19353 - DNA, 21 bp, Artificial Sequence
  Description of Artificial Sequence: Synthetic oligonucleotide
gaccccaccgaaagagccaga

SEQ ID NO: 19354 - DNA, 21 bp, Artificial Sequence
  Description of Artificial Sequence: Synthetic oligonucleotide
acgcctaattcttctggtggt

SEQ ID NO: 19355 - DNA, 21 bp, Artificial Sequence
  Description of Artificial Sequence: Synthetic oligonucleotide
accagcaacagcaaagtcaac

SEQ ID NO: 19356 - DNA, 21 bp, Artificial Sequence
  Description of Artificial Sequence: Synthetic oligonucleotide
agccccggcgccagcaccgcc

SEQ ID NO: 19357 - DNA, 21 bp, Artificial Sequence
  Description of Artificial Sequence: Synthetic oligonucleotide
gacaaagcccaaggcgtcaac

SEQ ID NO: 19358 - DNA, 21 bp, Artificial Sequence
  Description of Artificial Sequence: Synthetic oligonucleotide
tctcgtactaaggaggggatg

SEQ ID NO: 19359 - DNA, 21 bp, Artificial Sequence
  Description of Artificial Sequence: Synthetic oligonucleotide
agtccgtctaatggtgggcag

SEQ ID NO: 19360 - DNA, 21 bp, Artificial Sequence
  Description of Artificial Sequence: Synthetic oligonucleotide
gcggtttctggggctagtggt

SEQ ID NO: 19361 - DNA, 21 bp, Artificial Sequence
  Description of Artificial Sequence: Synthetic oligonucleotide
gggaaggagagtgataagtcg

SEQ ID NO: 19362 - DNA, 21 bp, Artificial Sequence
  Description of Artificial Sequence: Synthetic oligonucleotide
tcgtcgaataagacgagtcag

SEQ ID NO: 19363 - DNA, 21 bp, Artificial Sequence
  Description of Artificial Sequence: Synthetic oligonucleotide
ggcaaacaagaagccagagtc

SEQ ID NO: 19364 - DNA, 21 bp, Artificial Sequence
  Description of Artificial Sequence: Synthetic oligonucleotide
accggcgaccccaaactcggc

SEQ ID NO: 19365 - DNA, 21 bp, Artificial Sequence
  Description of Artificial Sequence: Synthetic oligonucleotide
agcagagtcagcagcgacaaa

SEQ ID NO: 19366 - DNA, 21 bp, Artificial Sequence
  Description of Artificial Sequence: Synthetic oligonucleotide
tcgctgaatacgtcttcggct

SEQ ID NO: 19367 - DNA, 21 bp, Artificial Sequence
  Description of Artificial Sequence: Synthetic oligonucleotide
aagactacgtctgggtcgcag

SEQ ID NO: 19368 - DNA, 21 bp, Artificial Sequence
  Description of Artificial Sequence: Synthetic oligonucleotide
agtaatggtgcgcctactggt

SEQ ID NO: 19369 - DNA, 21 bp, Artificial Sequence
  Description of Artificial Sequence: Synthetic oligonucleotide
ggtcttgatcagcagcgtagt

SEQ ID NO: 19370 - DNA, 21 bp, Artificial Sequence
  Description of Artificial Sequence: Synthetic oligonucleotide
tctttgacgagtgttaataag

SEQ ID NO: 19371 - DNA, 21 bp, Artificial Sequence
  Description of Artificial Sequence: Synthetic oligonucleotide
agcaccgccaccaacaacaac

SEQ ID NO: 19372 - DNA, 21 bp, Artificial Sequence
  Description of Artificial Sequence: Synthetic oligonucleotide
tcggggcagactgctacgacg

SEQ ID NO: 19373 - DNA, 21 bp, Artificial Sequence
  Description of Artificial Sequence: Synthetic oligonucleotide
agcgccgcccaaagcagagaa

SEQ ID NO: 19374 - DNA, 21 bp, Artificial Sequence
  Description of Artificial Sequence: Synthetic oligonucleotide
tcgtctggtcctcctgtggct

SEQ ID NO: 19375 - DNA, 21 bp, Artificial Sequence
  Description of Artificial Sequence: Synthetic oligonucleotide
agtgaggggaatccttctagg

SEQ ID NO: 19376 - DNA, 21 bp, Artificial Sequence
  Description of Artificial Sequence: Synthetic oligonucleotide
agtggggcttcgggttctatg

SEQ ID NO: 19377 - DNA, 21 bp, Artificial Sequence
  Description of Artificial Sequence: Synthetic oligonucleotide
gaaagcgccggcaaagccctc

SEQ ID NO: 19378 - DNA, 21 bp, Artificial Sequence
  Description of Artificial Sequence: Synthetic oligonucleotide
gccggcgacggccacgtcaaa

SEQ ID NO: 19379 - DNA, 21 bp, Artificial Sequence
  Description of Artificial Sequence: Synthetic oligonucleotide
ggcagcaaagaaggcaacggc

SEQ ID NO: 19380 - DNA, 21 bp, Artificial Sequence
  Description of Artificial Sequence: Synthetic oligonucleotide
gtcagcgaaagcggcaccacc

SEQ ID NO: 19381 - DNA, 21 bp, Artificial Sequence
  Description of Artificial Sequence: Synthetic oligonucleotide
gcttctgataaggtttctgct

SEQ ID NO: 19382 - DNA, 21 bp, Artificial Sequence
  Description of Artificial Sequence: Synthetic oligonucleotide
atgagcggcaccggcggcagc

SEQ ID NO: 19383 - DNA, 21 bp, Artificial Sequence
  Description of Artificial Sequence: Synthetic oligonucleotide
aacagcgtcccccacaccagc

SEQ ID NO: 19384 - DNA, 21 bp, Artificial Sequence
  Description of Artificial Sequence: Synthetic oligonucleotide
agcatcagcaaacccggcacc

SEQ ID NO: 19385 - DNA, 21 bp, Artificial Sequence
  Description of Artificial Sequence: Synthetic oligonucleotide
gacaccctcaacagcaaaaac

SEQ ID NO: 19386 - DNA, 21 bp, Artificial Sequence
  Description of Artificial Sequence: Synthetic oligonucleotide
gccgccgccggccccaacggc

SEQ ID NO: 19387 - DNA, 21 bp, Artificial Sequence
  Description of Artificial Sequence: Synthetic oligonucleotide
actggttcgcctgctcctagt

SEQ ID NO: 19388 - DNA, 21 bp, Artificial Sequence
  Description of Artificial Sequence: Synthetic oligonucleotide
accagaaaccccaccagcacc

SEQ ID NO: 19389 - DNA, 21 bp, Artificial Sequence
  Description of Artificial Sequence: Synthetic oligonucleotide
accagcggcaccgccgccatg

SEQ ID NO: 19390 - DNA, 21 bp, Artificial Sequence
  Description of Artificial Sequence: Synthetic oligonucleotide
agcaccagcagcagcagcaaa

SEQ ID NO: 19391 - DNA, 21 bp, Artificial Sequence
  Description of Artificial Sequence: Synthetic oligonucleotide
agcagcggcacccccagaacc

SEQ ID NO: 19392 - DNA, 21 bp, Artificial Sequence
  Description of Artificial Sequence: Synthetic oligonucleotide
gaaatgcaaaccagcaacaaa

SEQ ID NO: 19393 - DNA, 21 bp, Artificial Sequence
  Description of Artificial Sequence: Synthetic oligonucleotide
tctgctgggcatgcgtcgtct

SEQ ID NO: 19394 - DNA, 21 bp, Artificial Sequence
  Description of Artificial Sequence: Synthetic oligonucleotide
caagccggcgtcagcaacgtc

SEQ ID NO: 19395 - DNA, 21 bp, Artificial Sequence
  Description of Artificial Sequence: Synthetic oligonucleotide
cacggcagcggccaagccacc

SEQ ID NO: 19396 - DNA, 21 bp, Artificial Sequence
  Description of Artificial Sequence: Synthetic oligonucleotide
cagcagtctaatagtggtact

SEQ ID NO: 19397 - DNA, 21 bp, Artificial Sequence
  Description of Artificial Sequence: Synthetic oligonucleotide
ggcgtcgtcagcaaaagcgtc

SEQ ID NO: 19398 - DNA, 21 bp, Artificial Sequence
  Description of Artificial Sequence: Synthetic oligonucleotide
gttccttctggtagtccgcat

SEQ ID NO: 19399 - DNA, 21 bp, Artificial Sequence
  Description of Artificial Sequence: Synthetic oligonucleotide
gagactgttaataagggtacg

SEQ ID NO: 19400 - DNA, 21 bp, Artificial Sequence
  Description of Artificial Sequence: Synthetic oligonucleotide
acccccagcggcagcggccaa

SEQ ID NO: 19401 - DNA, 21 bp, Artificial Sequence
  Description of Artificial Sequence: Synthetic oligonucleotide
agcggcggcgacagcttcaaa

SEQ ID NO: 19402 - DNA, 21 bp, Artificial Sequence
  Description of Artificial Sequence: Synthetic oligonucleotide
aatggtgtttcgaaggttgtt

SEQ ID NO: 19403 - DNA, 21 bp, Artificial Sequence
  Description of Artificial Sequence: Synthetic oligonucleotide
catggggattctcagaggact

SEQ ID NO: 19404 - DNA, 21 bp, Artificial Sequence
  Description of Artificial Sequence: Synthetic oligonucleotide
agcagcagcaaaagcaccctc

SEQ ID NO: 19405 - DNA, 21 bp, Artificial Sequence
  Description of Artificial Sequence: Synthetic oligonucleotide
actcgtaatgggagtgtgggg

SEQ ID NO: 19406 - DNA, 21 bp, Artificial Sequence
  Description of Artificial Sequence: Synthetic oligonucleotide
ggcagcgccgtccccgccgcc

SEQ ID NO: 19407 - DNA, 21 bp, Artificial Sequence
  Description of Artificial Sequence: Synthetic oligonucleotide
agtgctaattcgaagtctacg

SEQ ID NO: 19408 - DNA, 21 bp, Artificial Sequence
  Description of Artificial Sequence: Synthetic oligonucleotide
gaacaaaacgccggccccaaa

SEQ ID NO: 19409 - DNA, 21 bp, Artificial Sequence
  Description of Artificial Sequence: Synthetic oligonucleotide
acttctacggctagtactggg

SEQ ID NO: 19410 - DNA, 21 bp, Artificial Sequence
  Description of Artificial Sequence: Synthetic oligonucleotide
acttctgggagtcatggtgct

SEQ ID NO: 19411 - DNA, 21 bp, Artificial Sequence
  Description of Artificial Sequence: Synthetic oligonucleotide
ctcgccgccggcaaagccggc

SEQ ID NO: 19412 - DNA, 21 bp, Artificial Sequence
  Description of Artificial Sequence: Synthetic oligonucleotide
gatgggtctggtagtgttcag

SEQ ID NO: 19413 - DNA, 21 bp, Artificial Sequence
  Description of Artificial Sequence: Synthetic oligonucleotide
gccgccaaagacggcaaagcc

SEQ ID NO: 19414 - DNA, 21 bp, Artificial Sequence
  Description of Artificial Sequence: Synthetic oligonucleotide
gccggcaccagcaacgaaaaa

SEQ ID NO: 19415 - DNA, 21 bp, Artificial Sequence
  Description of Artificial Sequence: Synthetic oligonucleotide
gcgggtaattctggtcttagt

SEQ ID NO: 19416 - DNA, 21 bp, Artificial Sequence
  Description of Artificial Sequence: Synthetic oligonucleotide
ggcaacgccgaaaaacccagc

SEQ ID NO: 19417 - DNA, 21 bp, Artificial Sequence
  Description of Artificial Sequence: Synthetic oligonucleotide
ggtaggcagggttctacgaat

SEQ ID NO: 19418 - DNA, 21 bp, Artificial Sequence
  Description of Artificial Sequence: Synthetic oligonucleotide
ttcaccagcggcacccccacc

SEQ ID NO: 19419 - DNA, 21 bp, Artificial Sequence
  Description of Artificial Sequence: Synthetic oligonucleotide
atgcagcctagtcagaagggg

SEQ ID NO: 19420 - DNA, 21 bp, Artificial Sequence
  Description of Artificial Sequence: Synthetic oligonucleotide
tctggtactaagactcagaat

SEQ ID NO: 19421 - DNA, 21 bp, Artificial Sequence
  Description of Artificial Sequence: Synthetic oligonucleotide
gaggttcatcagggtaagggt

SEQ ID NO: 19422 - DNA, 21 bp, Artificial Sequence
  Description of Artificial Sequence: Synthetic oligonucleotide
gccaacgccagccacagcacc

SEQ ID NO: 19423 - DNA, 21 bp, Artificial Sequence
  Description of Artificial Sequence: Synthetic oligonucleotide
ggcaaaagcgacaccagaagc

SEQ ID NO: 19424 - DNA, 21 bp, Artificial Sequence
  Description of Artificial Sequence: Synthetic oligonucleotide
ttgagtgcgagttctactggt

SEQ ID NO: 19425 - DNA, 21 bp, Artificial Sequence
  Description of Artificial Sequence: Synthetic oligonucleotide
acggggagttcgcatcttgtg

SEQ ID NO: 19426 - DNA, 21 bp, Artificial Sequence
  Description of Artificial Sequence: Synthetic oligonucleotide
agtcctaatgggaatcatcag

SEQ ID NO: 19427 - DNA, 21 bp, Artificial Sequence
  Description of Artificial Sequence: Synthetic oligonucleotide
gaacaaatcaacagcaaagcc

SEQ ID NO: 19428 - DNA, 21 bp, Artificial Sequence
  Description of Artificial Sequence: Synthetic oligonucleotide
caaggcacccccaccaacggc

SEQ ID NO: 19429 - DNA, 21 bp, Artificial Sequence
  Description of Artificial Sequence: Synthetic oligonucleotide
cagggggtttcgagtcataat

SEQ ID NO: 19430 - DNA, 21 bp, Artificial Sequence
  Description of Artificial Sequence: Synthetic oligonucleotide
ctcagcggcgaaagagccgcc

SEQ ID NO: 19431 - DNA, 21 bp, Artificial Sequence
  Description of Artificial Sequence: Synthetic oligonucleotide
ggtgctgtggataggagtggg

SEQ ID NO: 19432 - DNA, 21 bp, Artificial Sequence
  Description of Artificial Sequence: Synthetic oligonucleotide
tctcgggatcctgctggtggt

SEQ ID NO: 19433 - DNA, 21 bp, Artificial Sequence
  Description of Artificial Sequence: Synthetic oligonucleotide
agccaaagcaacaccagcgtc

SEQ ID NO: 19434 - DNA, 21 bp, Artificial Sequence
  Description of Artificial Sequence: Synthetic oligonucleotide
agcggcagagacaaactcaac

SEQ ID NO: 19435 - DNA, 21 bp, Artificial Sequence
  Description of Artificial Sequence: Synthetic oligonucleotide
catgttgataagtcgggtatg

SEQ ID NO: 19436 - DNA, 21 bp, Artificial Sequence
  Description of Artificial Sequence: Synthetic oligonucleotide
gagggtagtacgtcgaagcat

SEQ ID NO: 19437 - DNA, 21 bp, Artificial Sequence
  Description of Artificial Sequence: Synthetic oligonucleotide
aatccgagtccttctgtgaag

SEQ ID NO: 19438 - DNA, 21 bp, Artificial Sequence
  Description of Artificial Sequence: Synthetic oligonucleotide
caacccagcaacgccgccagc

SEQ ID NO: 19439 - DNA, 21 bp, Artificial Sequence
  Description of Artificial Sequence: Synthetic oligonucleotide
atgagcaacagccccagcagc

SEQ ID NO: 19440 - DNA, 21 bp, Artificial Sequence
  Description of Artificial Sequence: Synthetic oligonucleotide
ctgggcggtaatgaggcgagg

SEQ ID NO: 19441 - DNA, 21 bp, Artificial Sequence
  Description of Artificial Sequence: Synthetic oligonucleotide
gagcagtcgaagcatgcgagt

SEQ ID NO: 19442 - DNA, 21 bp, Artificial Sequence
  Description of Artificial Sequence: Synthetic oligonucleotide
accagcagcgccaccagcatc

SEQ ID NO: 19443 - DNA, 21 bp, Artificial Sequence
  Description of Artificial Sequence: Synthetic oligonucleotide
gatgagggtcggagtcatacg

SEQ ID NO: 19444 - DNA, 21 bp, Artificial Sequence
  Description of Artificial Sequence: Synthetic oligonucleotide
gatggtacgcggactagtggg

SEQ ID NO: 19445 - DNA, 21 bp, Artificial Sequence
  Description of Artificial Sequence: Synthetic oligonucleotide
gccgccgacagaagcagcagc

SEQ ID NO: 19446 - DNA, 21 bp, Artificial Sequence
  Description of Artificial Sequence: Synthetic oligonucleotide
agccaacccagcggcggcggc

SEQ ID NO: 19447 - DNA, 21 bp, Artificial Sequence
  Description of Artificial Sequence: Synthetic oligonucleotide
ctcagaagcagcgaaaaaggc

SEQ ID NO: 19448 - DNA, 21 bp, Artificial Sequence
  Description of Artificial Sequence: Synthetic oligonucleotide
gagggtggtgctaatagtcgt

SEQ ID NO: 19449 - DNA, 21 bp, Artificial Sequence
  Description of Artificial Sequence: Synthetic oligonucleotide
tcttctgcgcagggttcgggt

SEQ ID NO: 19450 - DNA, 21 bp, Artificial Sequence
  Description of Artificial Sequence: Synthetic oligonucleotide
acggaggttagtaaggttcag

SEQ ID NO: 19451 - DNA, 21 bp, Artificial Sequence
  Description of Artificial Sequence: Synthetic oligonucleotide
aacaccggcaaagacaacccc

SEQ ID NO: 19452 - DNA, 21 bp, Artificial Sequence
  Description of Artificial Sequence: Synthetic oligonucleotide
aaggctcagaatgctccgcag

SEQ ID NO: 19453 - DNA, 21 bp, Artificial Sequence
  Description of Artificial Sequence: Synthetic oligonucleotide
atgggtccggagaggcctcag

SEQ ID NO: 19454 - DNA, 21 bp, Artificial Sequence
  Description of Artificial Sequence: Synthetic oligonucleotide
gagagtggtaagacttcttct

SEQ ID NO: 19455 - DNA, 21 bp, Artificial Sequence
  Description of Artificial Sequence: Synthetic oligonucleotide
cagcctactaaggagcatcat

SEQ ID NO: 19456 - DNA, 21 bp, Artificial Sequence
  Description of Artificial Sequence: Synthetic oligonucleotide
tctcctcctaatggtggggtg

SEQ ID NO: 19457 - DNA, 21 bp, Artificial Sequence
  Description of Artificial Sequence: Synthetic oligonucleotide
gattctgcgactcgttctggg

SEQ ID NO: 19458 - DNA, 21 bp, Artificial Sequence
  Description of Artificial Sequence: Synthetic oligonucleotide
acggatggtcctaggtctaat

SEQ ID NO: 19459 - DNA, 21 bp, Artificial Sequence
  Description of Artificial Sequence: Synthetic oligonucleotide
aatcgtttggagaaggagtcg

SEQ ID NO: 19460 - DNA, 21 bp, Artificial Sequence
  Description of Artificial Sequence: Synthetic oligonucleotide
gaagccaccagcagcggcacc

SEQ ID NO: 19461 - DNA, 21 bp, Artificial Sequence
  Description of Artificial Sequence: Synthetic oligonucleotide
ggcaaagaccccaacagcgcc

SEQ ID NO: 19462 - DNA, 21 bp, Artificial Sequence
  Description of Artificial Sequence: Synthetic oligonucleotide
aacagagacaaaagcatggcc

SEQ ID NO: 19463 - DNA, 21 bp, Artificial Sequence
  Description of Artificial Sequence: Synthetic oligonucleotide
acgccttcgaattctactagt

SEQ ID NO: 19464 - DNA, 21 bp, Artificial Sequence
  Description of Artificial Sequence: Synthetic oligonucleotide
ggcagagtcgccgaagaaaaa

SEQ ID NO: 19465 - DNA, 21 bp, Artificial Sequence
  Description of Artificial Sequence: Synthetic oligonucleotide
ggcagcaccgacgccaaagtc

SEQ ID NO: 19466 - DNA, 21 bp, Artificial Sequence
  Description of Artificial Sequence: Synthetic oligonucleotide
tgcggcagcagcagctgcagc

SEQ ID NO: 19467 - DNA, 21 bp, Artificial Sequence
  Description of Artificial Sequence: Synthetic oligonucleotide
ttcaaacaagcccaaaccgcc

SEQ ID NO: 19468 - DNA, 21 bp, Artificial Sequence
  Description of Artificial Sequence: Synthetic oligonucleotide
gataggcctccgtctaaggat

SEQ ID NO: 19469 - DNA, 21 bp, Artificial Sequence
  Description of Artificial Sequence: Synthetic oligonucleotide
gtgggggggactactacggcg

SEQ ID NO: 19470 - DNA, 21 bp, Artificial Sequence
  Description of Artificial Sequence: Synthetic oligonucleotide
agtggtgagtcgcggcctaag

SEQ ID NO: 19471 - DNA, 21 bp, Artificial Sequence
  Description of Artificial Sequence: Synthetic oligonucleotide
agcagcggccccagcagcagc

SEQ ID NO: 19472 - DNA, 21 bp, Artificial Sequence
  Description of Artificial Sequence: Synthetic oligonucleotide
tctcatacgaatagtccgtcg

SEQ ID NO: 19473 - DNA, 21 bp, Artificial Sequence
  Description of Artificial Sequence: Synthetic oligonucleotide
acggttgggcattcgaatcag

SEQ ID NO: 19474 - DNA, 21 bp, Artificial Sequence
  Description of Artificial Sequence: Synthetic oligonucleotide
aaaggcaccagcaccagcctc

SEQ ID NO: 19475 - DNA, 21 bp, Artificial Sequence
  Description of Artificial Sequence: Synthetic oligonucleotide
acccacaccagcgcccccgtc

SEQ ID NO: 19476 - DNA, 21 bp, Artificial Sequence
  Description of Artificial Sequence: Synthetic oligonucleotide
agtaaggataatgcgactttg

SEQ ID NO: 19477 - DNA, 21 bp, Artificial Sequence
  Description of Artificial Sequence: Synthetic oligonucleotide
atcagcgaaagccccaacaga

SEQ ID NO: 19478 - DNA, 21 bp, Artificial Sequence
  Description of Artificial Sequence: Synthetic oligonucleotide
caaagagccaccaacagcatc

SEQ ID NO: 19479 - DNA, 21 bp, Artificial Sequence
  Description of Artificial Sequence: Synthetic oligonucleotide
ctcaaaagcagccccaccgtc

SEQ ID NO: 19480 - DNA, 21 bp, Artificial Sequence
  Description of Artificial Sequence: Synthetic oligonucleotide
gacggccacggcgccgtcagc

SEQ ID NO: 19481 - DNA, 21 bp, Artificial Sequence
  Description of Artificial Sequence: Synthetic oligonucleotide
ggcggcacccaaagcgccaaa

SEQ ID NO: 19482 - DNA, 21 bp, Artificial Sequence
  Description of Artificial Sequence: Synthetic oligonucleotide
gtgcggacggctaataataat

SEQ ID NO: 19483 - DNA, 21 bp, Artificial Sequence
  Description of Artificial Sequence: Synthetic oligonucleotide
actcctacggtgtctccgggt

SEQ ID NO: 19484 - DNA, 21 bp, Artificial Sequence
  Description of Artificial Sequence: Synthetic oligonucleotide
agtattgggacgtcgtctggt

SEQ ID NO: 19485 - DNA, 21 bp, Artificial Sequence
  Description of Artificial Sequence: Synthetic oligonucleotide
catgggacgacgacgactacg

SEQ ID NO: 19486 - DNA, 21 bp, Artificial Sequence
  Description of Artificial Sequence: Synthetic oligonucleotide
gctccgactgagtcttctaag

SEQ ID NO: 19487 - DNA, 21 bp, Artificial Sequence
  Description of Artificial Sequence: Synthetic oligonucleotide
aagcttagtgataagtcgctg

SEQ ID NO: 19488 - DNA, 21 bp, Artificial Sequence
  Description of Artificial Sequence: Synthetic oligonucleotide
gccaacggcgaagccaacaga

SEQ ID NO: 19489 - DNA, 21 bp, Artificial Sequence
  Description of Artificial Sequence: Synthetic oligonucleotide
gacaacgtcaaccccgccaga

SEQ ID NO: 19490 - DNA, 21 bp, Artificial Sequence
  Description of Artificial Sequence: Synthetic oligonucleotide
gggagggagcggcctagtgag

SEQ ID NO: 19491 - DNA, 21 bp, Artificial Sequence
  Description of Artificial Sequence: Synthetic oligonucleotide
ggtaatagtgataagtcgagt

SEQ ID NO: 19492 - DNA, 21 bp, Artificial Sequence
  Description of Artificial Sequence: Synthetic oligonucleotide
gtcaccaccggcggcaccagc

SEQ ID NO: 19493 - DNA, 21 bp, Artificial Sequence
  Description of Artificial Sequence: Synthetic oligonucleotide
gagtctacgggtagtcgtgct

SEQ ID NO: 19494 - DNA, 21 bp, Artificial Sequence
  Description of Artificial Sequence: Synthetic oligonucleotide
ggtccttcgactaatgagaag

SEQ ID NO: 19495 - DNA, 21 bp, Artificial Sequence
  Description of Artificial Sequence: Synthetic oligonucleotide
caagacaccaaaaccgccaac

SEQ ID NO: 19496 - DNA, 21 bp, Artificial Sequence
  Description of Artificial Sequence: Synthetic oligonucleotide
cgggagaatgggaagtcgatt

SEQ ID NO: 19497 - DNA, 21 bp, Artificial Sequence
  Description of Artificial Sequence: Synthetic oligonucleotide
gacggcaacagacccaacggc

SEQ ID NO: 19498 - DNA, 21 bp, Artificial Sequence
  Description of Artificial Sequence: Synthetic oligonucleotide
gctggtgataatactcgggct

SEQ ID NO: 19499 - DNA, 21 bp, Artificial Sequence
  Description of Artificial Sequence: Synthetic oligonucleotide
tcgacttcggcgactagtagt

SEQ ID NO: 19500 - DNA, 21 bp, Artificial Sequence
  Description of Artificial Sequence: Synthetic oligonucleotide
caacaagccagcagcaccagc

SEQ ID NO: 19501 - DNA, 21 bp, Artificial Sequence
  Description of Artificial Sequence: Synthetic oligonucleotide
agtggtaatcagagtctgaat

SEQ ID NO: 19502 - DNA, 21 bp, Artificial Sequence
  Description of Artificial Sequence: Synthetic oligonucleotide
actgttcatgataaggggaat

SEQ ID NO: 19503 - DNA, 21 bp, Artificial Sequence
  Description of Artificial Sequence: Synthetic oligonucleotide
agcgacggcagaggcagcggc

SEQ ID NO: 19504 - DNA, 21 bp, Artificial Sequence
  Description of Artificial Sequence: Synthetic oligonucleotide
agcggcagcaccacccccatg

SEQ ID NO: 19505 - DNA, 21 bp, Artificial Sequence
  Description of Artificial Sequence: Synthetic oligonucleotide
gacacccaaggcagaaaagac

SEQ ID NO: 19506 - DNA, 21 bp, Artificial Sequence
  Description of Artificial Sequence: Synthetic oligonucleotide
ggcagcgacaaaggcagagac

SEQ ID NO: 19507 - DNA, 21 bp, Artificial Sequence
  Description of Artificial Sequence: Synthetic oligonucleotide
caggggtctactcctcagctt

SEQ ID NO: 19508 - DNA, 21 bp, Artificial Sequence
  Description of Artificial Sequence: Synthetic oligonucleotide
agtagtgataagactgggagg

SEQ ID NO: 19509 - DNA, 21 bp, Artificial Sequence
  Description of Artificial Sequence: Synthetic oligonucleotide
aacaccagcagcaccagcggc

SEQ ID NO: 19510 - DNA, 21 bp, Artificial Sequence
  Description of Artificial Sequence: Synthetic oligonucleotide
cacgccaaaggcgccggcgac

SEQ ID NO: 19511 - DNA, 21 bp, Artificial Sequence
  Description of Artificial Sequence: Synthetic oligonucleotide
ggcagagacgacaaagtcggc

SEQ ID NO: 19512 - DNA, 21 bp, Artificial Sequence
  Description of Artificial Sequence: Synthetic oligonucleotide
tcgctgggtgcggggagtggt

SEQ ID NO: 19513 - DNA, 21 bp, Artificial Sequence
  Description of Artificial Sequence: Synthetic oligonucleotide
actcgtcagggggcgcctgtt

SEQ ID NO: 19514 - DNA, 21 bp, Artificial Sequence
  Description of Artificial Sequence: Synthetic oligonucleotide
gacagaaaccccagcagccac

SEQ ID NO: 19515 - DNA, 21 bp, Artificial Sequence
  Description of Artificial Sequence: Synthetic oligonucleotide
catacggataagaatgctggg

SEQ ID NO: 19516 - DNA, 21 bp, Artificial Sequence
  Description of Artificial Sequence: Synthetic oligonucleotide
agtggtactaatactatgacg

SEQ ID NO: 19517 - DNA, 21 bp, Artificial Sequence
  Description of Artificial Sequence: Synthetic oligonucleotide
catcagacgggggcggggtcg

SEQ ID NO: 19518 - DNA, 21 bp, Artificial Sequence
  Description of Artificial Sequence: Synthetic oligonucleotide
agcggcagcgccaacaccaga

SEQ ID NO: 19519 - DNA, 21 bp, Artificial Sequence
  Description of Artificial Sequence: Synthetic oligonucleotide
ggcgacagaagcaaagccaac

SEQ ID NO: 19520 - DNA, 21 bp, Artificial Sequence
  Description of Artificial Sequence: Synthetic oligonucleotide
gggaagggtaatgcgtctgcg

SEQ ID NO: 19521 - DNA, 21 bp, Artificial Sequence
  Description of Artificial Sequence: Synthetic oligonucleotide
agtggttcttcttcggttgtg

SEQ ID NO: 19522 - DNA, 21 bp, Artificial Sequence
  Description of Artificial Sequence: Synthetic oligonucleotide
gaacccagcagaagcagcgtc

SEQ ID NO: 19523 - DNA, 21 bp, Artificial Sequence
  Description of Artificial Sequence: Synthetic oligonucleotide
cgtgataagggtcagtcttcg

SEQ ID NO: 19524 - DNA, 21 bp, Artificial Sequence
  Description of Artificial Sequence: Synthetic oligonucleotide
gttggtggtagttctcctact

SEQ ID NO: 19525 - DNA, 21 bp, Artificial Sequence
  Description of Artificial Sequence: Synthetic oligonucleotide
aacggcaccggcagcgcccaa

SEQ ID NO: 19526 - DNA, 21 bp, Artificial Sequence
  Description of Artificial Sequence: Synthetic oligonucleotide
ggtacggggccgtcgcatgtt

SEQ ID NO: 19527 - DNA, 21 bp, Artificial Sequence
  Description of Artificial Sequence: Synthetic oligonucleotide
gccggcagccccagccccaga

SEQ ID NO: 19528 - DNA, 21 bp, Artificial Sequence
  Description of Artificial Sequence: Synthetic oligonucleotide
aatggggctgctaagcaggtg

SEQ ID NO: 19529 - DNA, 21 bp, Artificial Sequence
  Description of Artificial Sequence: Synthetic oligonucleotide
acccccaacgccacccccaac

SEQ ID NO: 19530 - DNA, 21 bp, Artificial Sequence
  Description of Artificial Sequence: Synthetic oligonucleotide
accgccaccagaagcgccggc

SEQ ID NO: 19531 - DNA, 21 bp, Artificial Sequence
  Description of Artificial Sequence: Synthetic oligonucleotide
accgccggccaaaccagcctc

SEQ ID NO: 19532 - DNA, 21 bp, Artificial Sequence
  Description of Artificial Sequence: Synthetic oligonucleotide
actactaatccttcttcgagt

SEQ ID NO: 19533 - DNA, 21 bp, Artificial Sequence
  Description of Artificial Sequence: Synthetic oligonucleotide
agtatgaataatccgggtaag

SEQ ID NO: 19534 - DNA, 21 bp, Artificial Sequence
  Description of Artificial Sequence: Synthetic oligonucleotide
atggtttcgaatccttctagt

SEQ ID NO: 19535 - DNA, 21 bp, Artificial Sequence
  Description of Artificial Sequence: Synthetic oligonucleotide
cagcagggtggtgctattgct

SEQ ID NO: 19536 - DNA, 21 bp, Artificial Sequence
  Description of Artificial Sequence: Synthetic oligonucleotide
cagtcggatggtacgcatagg

SEQ ID NO: 19537 - DNA, 21 bp, Artificial Sequence
  Description of Artificial Sequence: Synthetic oligonucleotide
ctccaaggcgaaaacagcaaa

SEQ ID NO: 19538 - DNA, 21 bp, Artificial Sequence
  Description of Artificial Sequence: Synthetic oligonucleotide
ctcggcgaaagaagcagcggc

SEQ ID NO: 19539 - DNA, 21 bp, Artificial Sequence
  Description of Artificial Sequence: Synthetic oligonucleotide
gagggtagtggtgagaggcgt

SEQ ID NO: 19540 - DNA, 21 bp, Artificial Sequence
  Description of Artificial Sequence: Synthetic oligonucleotide
ggcaccagcaacgccagcgcc

SEQ ID NO: 19541 - DNA, 21 bp, Artificial Sequence
  Description of Artificial Sequence: Synthetic oligonucleotide
ggccacaccaaaatcagcggc

SEQ ID NO: 19542 - DNA, 21 bp, Artificial Sequence
  Description of Artificial Sequence: Synthetic oligonucleotide
ggcgccctcggcaccgccggc

SEQ ID NO: 19543 - DNA, 21 bp, Artificial Sequence
  Description of Artificial Sequence: Synthetic oligonucleotide
gttgcttctaaggggcctacg

SEQ ID NO: 19544 - DNA, 21 bp, Artificial Sequence
  Description of Artificial Sequence: Synthetic oligonucleotide
accggcgcccaaaccgtcgcc

SEQ ID NO: 19545 - DNA, 21 bp, Artificial Sequence
  Description of Artificial Sequence: Synthetic oligonucleotide
tgggggactacttcgccgtct

SEQ ID NO: 19546 - DNA, 21 bp, Artificial Sequence
  Description of Artificial Sequence: Synthetic oligonucleotide
agcatcgccggcagcaccgcc

SEQ ID NO: 19547 - DNA, 21 bp, Artificial Sequence
  Description of Artificial Sequence: Synthetic oligonucleotide
gacgtcaccgaaaaaagcaga

SEQ ID NO: 19548 - DNA, 21 bp, Artificial Sequence
  Description of Artificial Sequence: Synthetic oligonucleotide
actattcatcagaagagtgat

SEQ ID NO: 19549 - DNA, 21 bp, Artificial Sequence
  Description of Artificial Sequence: Synthetic oligonucleotide
agcaccgacggcagaaacacc

SEQ ID NO: 19550 - DNA, 21 bp, Artificial Sequence
  Description of Artificial Sequence: Synthetic oligonucleotide
gggactgagcgtccgaatggt

SEQ ID NO: 19551 - DNA, 21 bp, Artificial Sequence
  Description of Artificial Sequence: Synthetic oligonucleotide
accaacggcaacgtccccgtc

SEQ ID NO: 19552 - DNA, 21 bp, Artificial Sequence
  Description of Artificial Sequence: Synthetic oligonucleotide
ggcggcggcagcagccaagcc

SEQ ID NO: 19553 - DNA, 21 bp, Artificial Sequence
  Description of Artificial Sequence: Synthetic oligonucleotide
accggcagcggcgtcaacgtc

SEQ ID NO: 19554 - DNA, 21 bp, Artificial Sequence
  Description of Artificial Sequence: Synthetic oligonucleotide
gccctcagcaaaggcagcggc

SEQ ID NO: 19555 - DNA, 21 bp, Artificial Sequence
  Description of Artificial Sequence: Synthetic oligonucleotide
ggcaaaaccgacagcatgaga

SEQ ID NO: 19556 - DNA, 21 bp, Artificial Sequence
  Description of Artificial Sequence: Synthetic oligonucleotide
ggcgtcgaaggcaccagaatc

SEQ ID NO: 19557 - DNA, 21 bp, Artificial Sequence
  Description of Artificial Sequence: Synthetic oligonucleotide
tcgggttctgataaggctagg

SEQ ID NO: 19558 - DNA, 21 bp, Artificial Sequence
  Description of Artificial Sequence: Synthetic oligonucleotide
aatgtttcgtcgtcgaatgtg

SEQ ID NO: 19559 - DNA, 21 bp, Artificial Sequence
  Description of Artificial Sequence: Synthetic oligonucleotide
gggctgtctagtagtactggt

SEQ ID NO: 19560 - DNA, 21 bp, Artificial Sequence
  Description of Artificial Sequence: Synthetic oligonucleotide
aaagaaagcaaagaaagcatg

SEQ ID NO: 19561 - DNA, 21 bp, Artificial Sequence
  Description of Artificial Sequence: Synthetic oligonucleotide
agcggcggcagcgtcaacggc

SEQ ID NO: 19562 - DNA, 21 bp, Artificial Sequence
  Description of Artificial Sequence: Synthetic oligonucleotide
cacgccagcagcagcaacacc

SEQ ID NO: 19563 - DNA, 21 bp, Artificial Sequence
  Description of Artificial Sequence: Synthetic oligonucleotide
gaaggcggcagcaccgccacc

SEQ ID NO: 19564 - DNA, 21 bp, Artificial Sequence
  Description of Artificial Sequence: Synthetic oligonucleotide
gctacgagtaataatagtgtg

SEQ ID NO: 19565 - DNA, 21 bp, Artificial Sequence
  Description of Artificial Sequence: Synthetic oligonucleotide
aacggcaaacccaacgccagc

SEQ ID NO: 19566 - DNA, 21 bp, Artificial Sequence
  Description of Artificial Sequence: Synthetic oligonucleotide
gtcagcggcaccaacagcgcc

SEQ ID NO: 19567 - DNA, 21 bp, Artificial Sequence
  Description of Artificial Sequence: Synthetic oligonucleotide
gctggtacggcgaagggtgtt

SEQ ID NO: 19568 - DNA, 21 bp, Artificial Sequence
  Description of Artificial Sequence: Synthetic oligonucleotide
cttgcttcgcagtctcagggt

SEQ ID NO: 19569 - DNA, 21 bp, Artificial Sequence
  Description of Artificial Sequence: Synthetic oligonucleotide
gcttcgactggtaaggtgagt

SEQ ID NO: 19570 - DNA, 21 bp, Artificial Sequence
  Description of Artificial Sequence: Synthetic oligonucleotide
gggcagggtggttctgggcct

SEQ ID NO: 19571 - DNA, 21 bp, Artificial Sequence
  Description of Artificial Sequence: Synthetic oligonucleotide
accaaaaacaccaacgtcatg

SEQ ID NO: 19572 - DNA, 21 bp, Artificial Sequence
  Description of Artificial Sequence: Synthetic oligonucleotide
accagcgccagcgccgtcacc

SEQ ID NO: 19573 - DNA, 21 bp, Artificial Sequence
  Description of Artificial Sequence: Synthetic oligonucleotide
ggcaccaccgcccaaagcagc

SEQ ID NO: 19574 - DNA, 21 bp, Artificial Sequence
  Description of Artificial Sequence: Synthetic oligonucleotide
actggggatgggaagttgcat

SEQ ID NO: 19575 - DNA, 21 bp, Artificial Sequence
  Description of Artificial Sequence: Synthetic oligonucleotide
aatttgaatgatactaagggt

SEQ ID NO: 19576 - DNA, 21 bp, Artificial Sequence
  Description of Artificial Sequence: Synthetic oligonucleotide
gataggaataatgaggctcgt

SEQ ID NO: 19577 - DNA, 21 bp, Artificial Sequence
  Description of Artificial Sequence: Synthetic oligonucleotide
cacggcaacagcagcagccac

SEQ ID NO: 19578 - DNA, 21 bp, Artificial Sequence
  Description of Artificial Sequence: Synthetic oligonucleotide
ggcagcctcaaagccgaaagc

SEQ ID NO: 19579 - DNA, 21 bp, Artificial Sequence
  Description of Artificial Sequence: Synthetic oligonucleotide
ggcgccaccgacaaagtcaac

SEQ ID NO: 19580 - DNA, 21 bp, Artificial Sequence
  Description of Artificial Sequence: Synthetic oligonucleotide
gtgaagagtactgcgagtcag

SEQ ID NO: 19581 - DNA, 21 bp, Artificial Sequence
  Description of Artificial Sequence: Synthetic oligonucleotide
tctaatcagaatagtccgacg

SEQ ID NO: 19582 - DNA, 21 bp, Artificial Sequence
  Description of Artificial Sequence: Synthetic oligonucleotide
agtactaagggttcgaattat

SEQ ID NO: 19583 - DNA, 21 bp, Artificial Sequence
  Description of Artificial Sequence: Synthetic oligonucleotide
accaccgtcagcaccagcagc

SEQ ID NO: 19584 - DNA, 21 bp, Artificial Sequence
  Description of Artificial Sequence: Synthetic oligonucleotide
accagcgccaccagccccgtc

SEQ ID NO: 19585 - DNA, 21 bp, Artificial Sequence
  Description of Artificial Sequence: Synthetic oligonucleotide
cagcaggagcgggaggttaag

SEQ ID NO: 19586 - DNA, 21 bp, Artificial Sequence
  Description of Artificial Sequence: Synthetic oligonucleotide
gcggttgcgaagcagtctatt

SEQ ID NO: 19587 - DNA, 21 bp, Artificial Sequence
  Description of Artificial Sequence: Synthetic oligonucleotide
ggcgacagcagactcaacagc

SEQ ID NO: 19588 - DNA, 21 bp, Artificial Sequence
  Description of Artificial Sequence: Synthetic oligonucleotide
actgatggttctaaggtttcg

SEQ ID NO: 19589 - DNA, 21 bp, Artificial Sequence
  Description of Artificial Sequence: Synthetic oligonucleotide
gacagagtcggcaccagccaa

SEQ ID NO: 19590 - DNA, 21 bp, Artificial Sequence
  Description of Artificial Sequence: Synthetic oligonucleotide
ggtgcggatactaagttgacg

SEQ ID NO: 19591 - DNA, 21 bp, Artificial Sequence
  Description of Artificial Sequence: Synthetic oligonucleotide
gtccaaagaaccgaacaacaa

SEQ ID NO: 19592 - DNA, 21 bp, Artificial Sequence
  Description of Artificial Sequence: Synthetic oligonucleotide
aacgccaacagcagccccaac

SEQ ID NO: 19593 - DNA, 21 bp, Artificial Sequence
  Description of Artificial Sequence: Synthetic oligonucleotide
tcttctgggtcgtcgtcgctt

SEQ ID NO: 19594 - DNA, 21 bp, Artificial Sequence
  Description of Artificial Sequence: Synthetic oligonucleotide
acgggttcgactagtaatgtg

SEQ ID NO: 19595 - DNA, 21 bp, Artificial Sequence
  Description of Artificial Sequence: Synthetic oligonucleotide
ggcctcggcgaaaaaagcaaa

SEQ ID NO: 19596 - DNA, 21 bp, Artificial Sequence
  Description of Artificial Sequence: Synthetic oligonucleotide
catgcgggtaagcagaatgcg

SEQ ID NO: 19597 - DNA, 21 bp, Artificial Sequence
  Description of Artificial Sequence: Synthetic oligonucleotide
gatagggttagtgctccgact

SEQ ID NO: 19598 - DNA, 21 bp, Artificial Sequence
  Description of Artificial Sequence: Synthetic oligonucleotide
ggtggtaatggtgggtcttct

SEQ ID NO: 19599 - DNA, 21 bp, Artificial Sequence
  Description of Artificial Sequence: Synthetic oligonucleotide
tcggataatagggggacgcag

SEQ ID NO: 19600 - DNA, 21 bp, Artificial Sequence
  Description of Artificial Sequence: Synthetic oligonucleotide
aacagcggcagccccagccaa

SEQ ID NO: 19601 - DNA, 21 bp, Artificial Sequence
  Description of Artificial Sequence: Synthetic oligonucleotide
aatagtaatgagcgtacgcag

SEQ ID NO: 19602 - DNA, 21 bp, Artificial Sequence
  Description of Artificial Sequence: Synthetic oligonucleotide
accggcggcagcaccggcctc

SEQ ID NO: 19603 - DNA, 21 bp, Artificial Sequence
  Description of Artificial Sequence: Synthetic oligonucleotide
ttcagcggcaacaccgccaaa

SEQ ID NO: 19604 - DNA, 21 bp, Artificial Sequence
  Description of Artificial Sequence: Synthetic oligonucleotide
agcggcgacaccgccagaagc

SEQ ID NO: 19605 - DNA, 21 bp, Artificial Sequence
  Description of Artificial Sequence: Synthetic oligonucleotide
gaaaacggcgtcagcaccaga

SEQ ID NO: 19606 - DNA, 21 bp, Artificial Sequence
  Description of Artificial Sequence: Synthetic oligonucleotide
tcttcgtcggattctagggcg

SEQ ID NO: 19607 - DNA, 21 bp, Artificial Sequence
  Description of Artificial Sequence: Synthetic oligonucleotide
aatggtgggaatgctccgggg

SEQ ID NO: 19608 - DNA, 21 bp, Artificial Sequence
  Description of Artificial Sequence: Synthetic oligonucleotide
accaacggcggcaccagcaga

SEQ ID NO: 19609 - DNA, 21 bp, Artificial Sequence
  Description of Artificial Sequence: Synthetic oligonucleotide
gagaatggtcagcctaagacg

SEQ ID NO: 19610 - DNA, 21 bp, Artificial Sequence
  Description of Artificial Sequence: Synthetic oligonucleotide
gcccccgacctcaaaggcggc

SEQ ID NO: 19611 - DNA, 21 bp, Artificial Sequence
  Description of Artificial Sequence: Synthetic oligonucleotide
gtcgtcgccagcgccaacagc

SEQ ID NO: 19612 - DNA, 21 bp, Artificial Sequence
  Description of Artificial Sequence: Synthetic oligonucleotide
ggggcgaataagtctattggt

SEQ ID NO: 19613 - DNA, 21 bp, Artificial Sequence
  Description of Artificial Sequence: Synthetic oligonucleotide
accagcggcggcggcgccccc

SEQ ID NO: 19614 - DNA, 21 bp, Artificial Sequence
  Description of Artificial Sequence: Synthetic oligonucleotide
gtcagcagccccgccagcgtc

SEQ ID NO: 19615 - DNA, 21 bp, Artificial Sequence
  Description of Artificial Sequence: Synthetic oligonucleotide
gaaggcaccaacaaagtcggc

SEQ ID NO: 19616 - DNA, 21 bp, Artificial Sequence
  Description of Artificial Sequence: Synthetic oligonucleotide
gtcgccagcgacaaagcccac

SEQ ID NO: 19617 - DNA, 21 bp, Artificial Sequence
  Description of Artificial Sequence: Synthetic oligonucleotide
tcgcctagtgctaatgggatt

SEQ ID NO: 19618 - DNA, 21 bp, Artificial Sequence
  Description of Artificial Sequence: Synthetic oligonucleotide
acttcggggacgactcctagg

SEQ ID NO: 19619 - DNA, 21 bp, Artificial Sequence
  Description of Artificial Sequence: Synthetic oligonucleotide
gacgcccccgccagaagcgtc

SEQ ID NO: 19620 - DNA, 21 bp, Artificial Sequence
  Description of Artificial Sequence: Synthetic oligonucleotide
tctggttctacttcgttttcg

SEQ ID NO: 19621 - DNA, 21 bp, Artificial Sequence
  Description of Artificial Sequence: Synthetic oligonucleotide
caaaccgaaaccaaaggcacc

SEQ ID NO: 19622 - DNA, 21 bp, Artificial Sequence
  Description of Artificial Sequence: Synthetic oligonucleotide
caacaaaccaacggcaaaccc

SEQ ID NO: 19623 - DNA, 21 bp, Artificial Sequence
  Description of Artificial Sequence: Synthetic oligonucleotide
gcccaaagcaacagccacgcc

SEQ ID NO: 19624 - DNA, 21 bp, Artificial Sequence
  Description of Artificial Sequence: Synthetic oligonucleotide
ggcgccggcagcgccgccgcc

SEQ ID NO: 19625 - DNA, 21 bp, Artificial Sequence
  Description of Artificial Sequence: Synthetic oligonucleotide
ttgcagaagagtactcctgtg

SEQ ID NO: 19626 - DNA, 21 bp, Artificial Sequence
  Description of Artificial Sequence: Synthetic oligonucleotide
agcaccaacagcaaagacaga

SEQ ID NO: 19627 - DNA, 21 bp, Artificial Sequence
  Description of Artificial Sequence: Synthetic oligonucleotide
agcaacggcccccccaacacc

SEQ ID NO: 19628 - DNA, 21 bp, Artificial Sequence
  Description of Artificial Sequence: Synthetic oligonucleotide
gggactcagactgatatccgt

SEQ ID NO: 19629 - DNA, 21 bp, Artificial Sequence
  Description of Artificial Sequence: Synthetic oligonucleotide
gggcctactcagtctgcgact

SEQ ID NO: 19630 - DNA, 21 bp, Artificial Sequence
  Description of Artificial Sequence: Synthetic oligonucleotide
gagagctcttcgcgggttgcg

SEQ ID NO: 19631 - DNA, 21 bp, Artificial Sequence
  Description of Artificial Sequence: Synthetic oligonucleotide
gcccccgccgaaagcaaaagc

SEQ ID NO: 19632 - DNA, 21 bp, Artificial Sequence
  Description of Artificial Sequence: Synthetic oligonucleotide
tcgggttctactcattctgtt

SEQ ID NO: 19633 - DNA, 21 bp, Artificial Sequence
  Description of Artificial Sequence: Synthetic oligonucleotide
gccaccggcagcagcgccaac

SEQ ID NO: 19634 - DNA, 21 bp, Artificial Sequence
  Description of Artificial Sequence: Synthetic oligonucleotide
agcaccggcaaagacaacagc

SEQ ID NO: 19635 - DNA, 21 bp, Artificial Sequence
  Description of Artificial Sequence: Synthetic oligonucleotide
cagcgtaatgagagtactgtt

SEQ ID NO: 19636 - DNA, 21 bp, Artificial Sequence
  Description of Artificial Sequence: Synthetic oligonucleotide
gagcctcaggcgaatcggggt

SEQ ID NO: 19637 - DNA, 21 bp, Artificial Sequence
  Description of Artificial Sequence: Synthetic oligonucleotide
actgttgcgactcctgggacg

SEQ ID NO: 19638 - DNA, 21 bp, Artificial Sequence
  Description of Artificial Sequence: Synthetic oligonucleotide
actggtgggtcgggtaatagt

SEQ ID NO: 19639 - DNA, 21 bp, Artificial Sequence
  Description of Artificial Sequence: Synthetic oligonucleotide
atgtcgggtcagaatccgtcg

SEQ ID NO: 19640 - DNA, 21 bp, Artificial Sequence
  Description of Artificial Sequence: Synthetic oligonucleotide
caaaaccaacccaacagaggc

SEQ ID NO: 19641 - DNA, 21 bp, Artificial Sequence
  Description of Artificial Sequence: Synthetic oligonucleotide
cacggcagcagcaccatgctc

SEQ ID NO: 19642 - DNA, 21 bp, Artificial Sequence
  Description of Artificial Sequence: Synthetic oligonucleotide
gagagtgtgagtcgtaataat

SEQ ID NO: 19643 - DNA, 21 bp, Artificial Sequence
  Description of Artificial Sequence: Synthetic oligonucleotide
aattcgtcttcgaaggctgag

SEQ ID NO: 19644 - DNA, 21 bp, Artificial Sequence
  Description of Artificial Sequence: Synthetic oligonucleotide
ctgacgactaatacttcggcg

SEQ ID NO: 19645 - DNA, 21 bp, Artificial Sequence
  Description of Artificial Sequence: Synthetic oligonucleotide
ggtcatttgccgacttcggcg

SEQ ID NO: 19646 - DNA, 21 bp, Artificial Sequence
  Description of Artificial Sequence: Synthetic oligonucleotide
ctggggaatcagggtgttaat

SEQ ID NO: 19647 - DNA, 21 bp, Artificial Sequence
  Description of Artificial Sequence: Synthetic oligonucleotide
gcttctaagaatactccgact

SEQ ID NO: 19648 - DNA, 21 bp, Artificial Sequence
  Description of Artificial Sequence: Synthetic oligonucleotide
agtacggctaataagagtcag

SEQ ID NO: 19649 - DNA, 21 bp, Artificial Sequence
  Description of Artificial Sequence: Synthetic oligonucleotide
ggcgccaccaaaggccaagcc

SEQ ID NO: 19650 - DNA, 21 bp, Artificial Sequence
  Description of Artificial Sequence: Synthetic oligonucleotide
accgccaaccaaagcaacctc

SEQ ID NO: 19651 - DNA, 21 bp, Artificial Sequence
  Description of Artificial Sequence: Synthetic oligonucleotide
gccaacctcgaccccaaaacc

SEQ ID NO: 19652 - DNA, 21 bp, Artificial Sequence
  Description of Artificial Sequence: Synthetic oligonucleotide
catcctgctagtaagcctcct

SEQ ID NO: 19653 - DNA, 21 bp, Artificial Sequence
  Description of Artificial Sequence: Synthetic oligonucleotide
atccccagcgacggcagcaaa

SEQ ID NO: 19654 - DNA, 21 bp, Artificial Sequence
  Description of Artificial Sequence: Synthetic oligonucleotide
gacggcggcagcagagacagc

SEQ ID NO: 19655 - DNA, 21 bp, Artificial Sequence
  Description of Artificial Sequence: Synthetic oligonucleotide
gccgccaccaacaaaaaccaa

SEQ ID NO: 19656 - DNA, 21 bp, Artificial Sequence
  Description of Artificial Sequence: Synthetic oligonucleotide
gggaatgctgcgtcgcatgcg

SEQ ID NO: 19657 - DNA, 21 bp, Artificial Sequence
  Description of Artificial Sequence: Synthetic oligonucleotide
gggctttcgggtcctggtaag

SEQ ID NO: 19658 - DNA, 21 bp, Artificial Sequence
  Description of Artificial Sequence: Synthetic oligonucleotide
gatactggtactagtaatcgg

SEQ ID NO: 19659 - DNA, 21 bp, Artificial Sequence
  Description of Artificial Sequence: Synthetic oligonucleotide
gattctggtagtcagtcgcgt

SEQ ID NO: 19660 - DNA, 21 bp, Artificial Sequence
  Description of Artificial Sequence: Synthetic oligonucleotide
ggcgaacccagagccaacagc

SEQ ID NO: 19661 - DNA, 21 bp, Artificial Sequence
  Description of Artificial Sequence: Synthetic oligonucleotide
ctcaccaaaagcaacagcagc

SEQ ID NO: 19662 - DNA, 21 bp, Artificial Sequence
  Description of Artificial Sequence: Synthetic oligonucleotide
acgcgtaataaggaggttaat

SEQ ID NO: 19663 - DNA, 21 bp, Artificial Sequence
  Description of Artificial Sequence: Synthetic oligonucleotide
tggggcaacagcgacaaaagc

SEQ ID NO: 19664 - DNA, 21 bp, Artificial Sequence
  Description of Artificial Sequence: Synthetic oligonucleotide
ttcggcagcaacagcggcagc

SEQ ID NO: 19665 - DNA, 21 bp, Artificial Sequence
  Description of Artificial Sequence: Synthetic oligonucleotide
aacggcagcgacacccaaaga

SEQ ID NO: 19666 - DNA, 21 bp, Artificial Sequence
  Description of Artificial Sequence: Synthetic oligonucleotide
agcaccgccaccgtcccccaa

SEQ ID NO: 19667 - DNA, 21 bp, Artificial Sequence
  Description of Artificial Sequence: Synthetic oligonucleotide
agcctcggcagaagcgaaggc

SEQ ID NO: 19668 - DNA, 21 bp, Artificial Sequence
  Description of Artificial Sequence: Synthetic oligonucleotide
gagaatcataagccgatgatt

SEQ ID NO: 19669 - DNA, 21 bp, Artificial Sequence
  Description of Artificial Sequence: Synthetic oligonucleotide
gccatcgacagacaaaacggc

SEQ ID NO: 19670 - DNA, 21 bp, Artificial Sequence
  Description of Artificial Sequence: Synthetic oligonucleotide
ggtccggaggttgcgttgaag

SEQ ID NO: 19671 - DNA, 21 bp, Artificial Sequence
  Description of Artificial Sequence: Synthetic oligonucleotide
ttgggtacgactactactttg

SEQ ID NO: 19672 - DNA, 21 bp, Artificial Sequence
  Description of Artificial Sequence: Synthetic oligonucleotide
agcagagccgccgccaccgtc

SEQ ID NO: 19673 - DNA, 21 bp, Artificial Sequence
  Description of Artificial Sequence: Synthetic oligonucleotide
tctctgggtagtcatggttcg

SEQ ID NO: 19674 - DNA, 21 bp, Artificial Sequence
  Description of Artificial Sequence: Synthetic oligonucleotide
cacagcaccggcagccacggc

SEQ ID NO: 19675 - DNA, 21 bp, Artificial Sequence
  Description of Artificial Sequence: Synthetic oligonucleotide
ctgcttaagggggcttctcag

SEQ ID NO: 19676 - DNA, 21 bp, Artificial Sequence
  Description of Artificial Sequence: Synthetic oligonucleotide
gaaagaggcaacgccgccagc

SEQ ID NO: 19677 - DNA, 21 bp, Artificial Sequence
  Description of Artificial Sequence: Synthetic oligonucleotide
gagccggctactaaggggact

SEQ ID NO: 19678 - DNA, 21 bp, Artificial Sequence
  Description of Artificial Sequence: Synthetic oligonucleotide
gatgatgggagggcgactgtt

SEQ ID NO: 19679 - DNA, 21 bp, Artificial Sequence
  Description of Artificial Sequence: Synthetic oligonucleotide
agagtcaccgacaaacccagc

SEQ ID NO: 19680 - DNA, 21 bp, Artificial Sequence
  Description of Artificial Sequence: Synthetic oligonucleotide
acgcggaatagtcctacgcag

SEQ ID NO: 19681 - DNA, 21 bp, Artificial Sequence
  Description of Artificial Sequence: Synthetic oligonucleotide
agtacgggtggtagtggtact

SEQ ID NO: 19682 - DNA, 21 bp, Artificial Sequence
  Description of Artificial Sequence: Synthetic oligonucleotide
agcatcgccagcagcggcggc

SEQ ID NO: 19683 - DNA, 21 bp, Artificial Sequence
  Description of Artificial Sequence: Synthetic oligonucleotide
tctcataatacggcgaattcg

SEQ ID NO: 19684 - DNA, 21 bp, Artificial Sequence
  Description of Artificial Sequence: Synthetic oligonucleotide
cagatttcggatcctaagcat

SEQ ID NO: 19685 - DNA, 21 bp, Artificial Sequence
  Description of Artificial Sequence: Synthetic oligonucleotide
cataatactagttctcctact

SEQ ID NO: 19686 - DNA, 21 bp, Artificial Sequence
  Description of Artificial Sequence: Synthetic oligonucleotide
agtaaggagaatgtgccggtt

SEQ ID NO: 19687 - DNA, 21 bp, Artificial Sequence
  Description of Artificial Sequence: Synthetic oligonucleotide
catgtggatagtggggggggg

SEQ ID NO: 19688 - DNA, 21 bp, Artificial Sequence
  Description of Artificial Sequence: Synthetic oligonucleotide
gccatgagcaacgaaagcaaa

SEQ ID NO: 19689 - DNA, 21 bp, Artificial Sequence
  Description of Artificial Sequence: Synthetic oligonucleotide
ggggagaaggcgcagaaggtg

SEQ ID NO: 19690 - DNA, 21 bp, Artificial Sequence
  Description of Artificial Sequence: Synthetic oligonucleotide
ttgagttcggggtcttcgggg

SEQ ID NO: 19691 - DNA, 21 bp, Artificial Sequence
  Description of Artificial Sequence: Synthetic oligonucleotide
ggcgtcagcaacagcagcatc

SEQ ID NO: 19692 - DNA, 21 bp, Artificial Sequence
  Description of Artificial Sequence: Synthetic oligonucleotide
tcttcggggacggctattagt

SEQ ID NO: 19693 - DNA, 21 bp, Artificial Sequence
  Description of Artificial Sequence: Synthetic oligonucleotide
gacaaaagcagcggcggcaaa

SEQ ID NO: 19694 - DNA, 21 bp, Artificial Sequence
  Description of Artificial Sequence: Synthetic oligonucleotide
ggcagcaccggcagcggcagc

SEQ ID NO: 19695 - DNA, 21 bp, Artificial Sequence
  Description of Artificial Sequence: Synthetic oligonucleotide
ggtgctgataggcctgcgggt

SEQ ID NO: 19696 - DNA, 21 bp, Artificial Sequence
  Description of Artificial Sequence: Synthetic oligonucleotide
atgagccacggcagcaacagc

SEQ ID NO: 19697 - DNA, 21 bp, Artificial Sequence
  Description of Artificial Sequence: Synthetic oligonucleotide
atcaaacaaagcccccaaagc

SEQ ID NO: 19698 - DNA, 21 bp, Artificial Sequence
  Description of Artificial Sequence: Synthetic oligonucleotide
agcgccaacggcaacaacaaa

SEQ ID NO: 19699 - DNA, 21 bp, Artificial Sequence
  Description of Artificial Sequence: Synthetic oligonucleotide
ggggcgggggcttctaggagt

SEQ ID NO: 19700 - DNA, 21 bp, Artificial Sequence
  Description of Artificial Sequence: Synthetic oligonucleotide
agtcctcagcagactgtttct

SEQ ID NO: 19701 - DNA, 21 bp, Artificial Sequence
  Description of Artificial Sequence: Synthetic oligonucleotide
aatgggaatggtgctaagctg

SEQ ID NO: 19702 - DNA, 21 bp, Artificial Sequence
  Description of Artificial Sequence: Synthetic oligonucleotide
gggcctaaggagtctaatgct

SEQ ID NO: 19703 - DNA, 21 bp, Artificial Sequence
  Description of Artificial Sequence: Synthetic oligonucleotide
agcaaccaaagcagccccagc

SEQ ID NO: 19704 - DNA, 21 bp, Artificial Sequence
  Description of Artificial Sequence: Synthetic oligonucleotide
aattctgcgcagggtggtggg

SEQ ID NO: 19705 - DNA, 21 bp, Artificial Sequence
  Description of Artificial Sequence: Synthetic oligonucleotide
acgggggatcgggatagggct

SEQ ID NO: 19706 - DNA, 21 bp, Artificial Sequence
  Description of Artificial Sequence: Synthetic oligonucleotide
accaacgacagcagacccgaa

SEQ ID NO: 19707 - DNA, 21 bp, Artificial Sequence
  Description of Artificial Sequence: Synthetic oligonucleotide
gacagcgccggccccagaagc

SEQ ID NO: 19708 - DNA, 21 bp, Artificial Sequence
  Description of Artificial Sequence: Synthetic oligonucleotide
gccaccggcaaacccggcgtc

SEQ ID NO: 19709 - DNA, 21 bp, Artificial Sequence
  Description of Artificial Sequence: Synthetic oligonucleotide
agcggcatcaaagacagcccc

SEQ ID NO: 19710 - DNA, 21 bp, Artificial Sequence
  Description of Artificial Sequence: Synthetic oligonucleotide
agtactcatactccgagtagt

SEQ ID NO: 19711 - DNA, 21 bp, Artificial Sequence
  Description of Artificial Sequence: Synthetic oligonucleotide
aacagcagcggcaacaccccc

SEQ ID NO: 19712 - DNA, 21 bp, Artificial Sequence
  Description of Artificial Sequence: Synthetic oligonucleotide
cagatggctaagtcgaatgag

SEQ ID NO: 19713 - DNA, 21 bp, Artificial Sequence
  Description of Artificial Sequence: Synthetic oligonucleotide
gattcgaatcgggtgaatgtg

SEQ ID NO: 19714 - DNA, 21 bp, Artificial Sequence
  Description of Artificial Sequence: Synthetic oligonucleotide
tctggggttgggagtacgttg

SEQ ID NO: 19715 - DNA, 21 bp, Artificial Sequence
  Description of Artificial Sequence: Synthetic oligonucleotide
acccaaaaacaagccagcacc

SEQ ID NO: 19716 - DNA, 21 bp, Artificial Sequence
  Description of Artificial Sequence: Synthetic oligonucleotide
agcgccgccagcaccgccagc

SEQ ID NO: 19717 - DNA, 21 bp, Artificial Sequence
  Description of Artificial Sequence: Synthetic oligonucleotide
ggtgtggcgagtacgtcttct

SEQ ID NO: 19718 - DNA, 21 bp, Artificial Sequence
  Description of Artificial Sequence: Synthetic oligonucleotide
gatggtgcgaagtcttctggt

SEQ ID NO: 19719 - DNA, 21 bp, Artificial Sequence
  Description of Artificial Sequence: Synthetic oligonucleotide
catgctacggctggtggtagt

SEQ ID NO: 19720 - DNA, 21 bp, Artificial Sequence
  Description of Artificial Sequence: Synthetic oligonucleotide
agcggcagcggcagcagcgtc

SEQ ID NO: 19721 - DNA, 21 bp, Artificial Sequence
  Description of Artificial Sequence: Synthetic oligonucleotide
ggccacggcggcacccaaaac

SEQ ID NO: 19722 - DNA, 21 bp, Artificial Sequence
  Description of Artificial Sequence: Synthetic oligonucleotide
agtggtactgataagaggtcg

SEQ ID NO: 19723 - DNA, 21 bp, Artificial Sequence
  Description of Artificial Sequence: Synthetic oligonucleotide
gataaggagcagaagagtatg

SEQ ID NO: 19724 - DNA, 21 bp, Artificial Sequence
  Description of Artificial Sequence: Synthetic oligonucleotide
aacaccggccaaagaagcacc

SEQ ID NO: 19725 - DNA, 21 bp, Artificial Sequence
  Description of Artificial Sequence: Synthetic oligonucleotide
aacctcggcgccgccgccggc

SEQ ID NO: 19726 - DNA, 21 bp, Artificial Sequence
  Description of Artificial Sequence: Synthetic oligonucleotide
aagggtagtactacggttatt

SEQ ID NO: 19727 - DNA, 21 bp, Artificial Sequence
  Description of Artificial Sequence: Synthetic oligonucleotide
aatgcgacgggtactccggtt

SEQ ID NO: 19728 - DNA, 21 bp, Artificial Sequence
  Description of Artificial Sequence: Synthetic oligonucleotide
accgccagcgccagcagcggc

SEQ ID NO: 19729 - DNA, 21 bp, Artificial Sequence
  Description of Artificial Sequence: Synthetic oligonucleotide
accggcacccaaacccccggc

SEQ ID NO: 19730 - DNA, 21 bp, Artificial Sequence
  Description of Artificial Sequence: Synthetic oligonucleotide
agcaccggcgccggcgccagc

SEQ ID NO: 19731 - DNA, 21 bp, Artificial Sequence
  Description of Artificial Sequence: Synthetic oligonucleotide
agcctcgccagcaaaagcggc

SEQ ID NO: 19732 - DNA, 21 bp, Artificial Sequence
  Description of Artificial Sequence: Synthetic oligonucleotide
agcgccatggacagcaaaaga

SEQ ID NO: 19733 - DNA, 21 bp, Artificial Sequence
  Description of Artificial Sequence: Synthetic oligonucleotide
aggagtactgataagactacg

SEQ ID NO: 19734 - DNA, 21 bp, Artificial Sequence
  Description of Artificial Sequence: Synthetic oligonucleotide
atcagcagccaacaaagccac

SEQ ID NO: 19735 - DNA, 21 bp, Artificial Sequence
  Description of Artificial Sequence: Synthetic oligonucleotide
caaggcggcgccagcctccaa

SEQ ID NO: 19736 - DNA, 21 bp, Artificial Sequence
  Description of Artificial Sequence: Synthetic oligonucleotide
cacgaagaaaaaagccccaga

SEQ ID NO: 19737 - DNA, 21 bp, Artificial Sequence
  Description of Artificial Sequence: Synthetic oligonucleotide
ctcaaccacaccaacgccggc

SEQ ID NO: 19738 - DNA, 21 bp, Artificial Sequence
  Description of Artificial Sequence: Synthetic oligonucleotide
ctcaccaccggcgaaagagcc

SEQ ID NO: 19739 - DNA, 21 bp, Artificial Sequence
  Description of Artificial Sequence: Synthetic oligonucleotide
ctcagcggcaccaacgcccaa

SEQ ID NO: 19740 - DNA, 21 bp, Artificial Sequence
  Description of Artificial Sequence: Synthetic oligonucleotide
gacaccggcggcagcagacac

SEQ ID NO: 19741 - DNA, 21 bp, Artificial Sequence
  Description of Artificial Sequence: Synthetic oligonucleotide
gagtcgcggcagagtgttcag

SEQ ID NO: 19742 - DNA, 21 bp, Artificial Sequence
  Description of Artificial Sequence: Synthetic oligonucleotide
gccggcaacaccagcagagaa

SEQ ID NO: 19743 - DNA, 21 bp, Artificial Sequence
  Description of Artificial Sequence: Synthetic oligonucleotide
gggccgggtgcttcttcttct

SEQ ID NO: 19744 - DNA, 21 bp, Artificial Sequence
  Description of Artificial Sequence: Synthetic oligonucleotide
tctggttcttcggcgttggtc

SEQ ID NO: 19745 - DNA, 21 bp, Artificial Sequence
  Description of Artificial Sequence: Synthetic oligonucleotide
tggcgtgagtcgaaggatatt

SEQ ID NO: 19746 - DNA, 21 bp, Artificial Sequence
  Description of Artificial Sequence: Synthetic oligonucleotide
ggcagcggccacaaagtcctc

SEQ ID NO: 19747 - DNA, 21 bp, Artificial Sequence
  Description of Artificial Sequence: Synthetic oligonucleotide
gagacgactaagcagcttggg

SEQ ID NO: 19748 - DNA, 21 bp, Artificial Sequence
  Description of Artificial Sequence: Synthetic oligonucleotide
cacggcacccccagcagcgtc

SEQ ID NO: 19749 - DNA, 21 bp, Artificial Sequence
  Description of Artificial Sequence: Synthetic oligonucleotide
gagtcgtctggtgagcgtagg

SEQ ID NO: 19750 - DNA, 21 bp, Artificial Sequence
  Description of Artificial Sequence: Synthetic oligonucleotide
gataagcatggtcagcctgtg

SEQ ID NO: 19751 - DNA, 21 bp, Artificial Sequence
  Description of Artificial Sequence: Synthetic oligonucleotide
acgcagggtgggtcttcgtcg

SEQ ID NO: 19752 - DNA, 21 bp, Artificial Sequence
  Description of Artificial Sequence: Synthetic oligonucleotide
agcagaaccgccagcaacgtc

SEQ ID NO: 19753 - DNA, 21 bp, Artificial Sequence
  Description of Artificial Sequence: Synthetic oligonucleotide
gtgcagaagccgacgatggct

SEQ ID NO: 19754 - DNA, 21 bp, Artificial Sequence
  Description of Artificial Sequence: Synthetic oligonucleotide
accggcaaccccagcctcacc

SEQ ID NO: 19755 - DNA, 21 bp, Artificial Sequence
  Description of Artificial Sequence: Synthetic oligonucleotide
ggttctcatacgccggttacg

SEQ ID NO: 19756 - DNA, 21 bp, Artificial Sequence
  Description of Artificial Sequence: Synthetic oligonucleotide
actcagcagcagtcggctact

SEQ ID NO: 19757 - DNA, 21 bp, Artificial Sequence
  Description of Artificial Sequence: Synthetic oligonucleotide
actggggttcagactgttggt

SEQ ID NO: 19758 - DNA, 21 bp, Artificial Sequence
  Description of Artificial Sequence: Synthetic oligonucleotide
agcagcacccaaacccccagc

SEQ ID NO: 19759 - DNA, 21 bp, Artificial Sequence
  Description of Artificial Sequence: Synthetic oligonucleotide
gctaggggggagcatccgatt

SEQ ID NO: 19760 - DNA, 21 bp, Artificial Sequence
  Description of Artificial Sequence: Synthetic oligonucleotide
aatggtaagactggtactgcg

SEQ ID NO: 19761 - DNA, 21 bp, Artificial Sequence
  Description of Artificial Sequence: Synthetic oligonucleotide
gagaatactaagagtctggct

SEQ ID NO: 19762 - DNA, 21 bp, Artificial Sequence
  Description of Artificial Sequence: Synthetic oligonucleotide
gggcagggtaaggagcagggt

SEQ ID NO: 19763 - DNA, 21 bp, Artificial Sequence
  Description of Artificial Sequence: Synthetic oligonucleotide
accagcagcggcaccagaaac

SEQ ID NO: 19764 - DNA, 21 bp, Artificial Sequence
  Description of Artificial Sequence: Synthetic oligonucleotide
gtgggtgttagtaatacgcag

SEQ ID NO: 19765 - DNA, 21 bp, Artificial Sequence
  Description of Artificial Sequence: Synthetic oligonucleotide
tgcctcgaacccagcaacaga

SEQ ID NO: 19766 - DNA, 21 bp, Artificial Sequence
  Description of Artificial Sequence: Synthetic oligonucleotide
gcccccgaaaaagaccacaga

SEQ ID NO: 19767 - DNA, 21 bp, Artificial Sequence
  Description of Artificial Sequence: Synthetic oligonucleotide
tctggtgatgctgttaagcag

SEQ ID NO: 19768 - DNA, 21 bp, Artificial Sequence
  Description of Artificial Sequence: Synthetic oligonucleotide
agcagcagcagcaccatcgcc

SEQ ID NO: 19769 - DNA, 21 bp, Artificial Sequence
  Description of Artificial Sequence: Synthetic oligonucleotide
actgctacggctgcgcctatg

SEQ ID NO: 19770 - DNA, 21 bp, Artificial Sequence
  Description of Artificial Sequence: Synthetic oligonucleotide
gccagcagccccggcaccacc

SEQ ID NO: 19771 - DNA, 21 bp, Artificial Sequence
  Description of Artificial Sequence: Synthetic oligonucleotide
agcaacagcaacaaaaacggc

SEQ ID NO: 19772 - DNA, 21 bp, Artificial Sequence
  Description of Artificial Sequence: Synthetic oligonucleotide
gcccaccaaggcagcaacacc

SEQ ID NO: 19773 - DNA, 21 bp, Artificial Sequence
  Description of Artificial Sequence: Synthetic oligonucleotide
gggcggagttcgcagagtggg

SEQ ID NO: 19774 - DNA, 21 bp, Artificial Sequence
  Description of Artificial Sequence: Synthetic oligonucleotide
tcggcggctgagaagtctgcg

SEQ ID NO: 19775 - DNA, 21 bp, Artificial Sequence
  Description of Artificial Sequence: Synthetic oligonucleotide
gtgcctgatcggacgcctgtg

SEQ ID NO: 19776 - DNA, 21 bp, Artificial Sequence
  Description of Artificial Sequence: Synthetic oligonucleotide
aacagagacagcagcagcagc

SEQ ID NO: 19777 - DNA, 21 bp, Artificial Sequence
  Description of Artificial Sequence: Synthetic oligonucleotide
agcggcgaccaaaaaggcagc

SEQ ID NO: 19778 - DNA, 21 bp, Artificial Sequence
  Description of Artificial Sequence: Synthetic oligonucleotide
gccacccaagccagcagccac

SEQ ID NO: 19779 - DNA, 21 bp, Artificial Sequence
  Description of Artificial Sequence: Synthetic oligonucleotide
cagacgtctccgaatgggtcg

SEQ ID NO: 19780 - DNA, 21 bp, Artificial Sequence
  Description of Artificial Sequence: Synthetic oligonucleotide
agcggcacccccagcctcagc

SEQ ID NO: 19781 - DNA, 21 bp, Artificial Sequence
  Description of Artificial Sequence: Synthetic oligonucleotide
agtatggctggggcgagtagg

SEQ ID NO: 19782 - DNA, 21 bp, Artificial Sequence
  Description of Artificial Sequence: Synthetic oligonucleotide
atgagaaccgaacaaagcatg

SEQ ID NO: 19783 - DNA, 21 bp, Artificial Sequence
  Description of Artificial Sequence: Synthetic oligonucleotide
ggcaccggcacccacctccaa

SEQ ID NO: 19784 - DNA, 21 bp, Artificial Sequence
  Description of Artificial Sequence: Synthetic oligonucleotide
ggccaagaagaaagaaaatac

SEQ ID NO: 19785 - DNA, 21 bp, Artificial Sequence
  Description of Artificial Sequence: Synthetic oligonucleotide
tctgggagtccgactgggttg

SEQ ID NO: 19786 - DNA, 21 bp, Artificial Sequence
  Description of Artificial Sequence: Synthetic oligonucleotide
ggcagcaccagcagccccaac

SEQ ID NO: 19787 - DNA, 21 bp, Artificial Sequence
  Description of Artificial Sequence: Synthetic oligonucleotide
gggtctaatactcctgcgctg

SEQ ID NO: 19788 - DNA, 21 bp, Artificial Sequence
  Description of Artificial Sequence: Synthetic oligonucleotide
agaagcggcgaacacagcgtc

SEQ ID NO: 19789 - DNA, 21 bp, Artificial Sequence
  Description of Artificial Sequence: Synthetic oligonucleotide
agcgccaccaaaatcagcagc

SEQ ID NO: 19790 - DNA, 21 bp, Artificial Sequence
  Description of Artificial Sequence: Synthetic oligonucleotide
agtagtggtcagggtaatggt

SEQ ID NO: 19791 - DNA, 21 bp, Artificial Sequence
  Description of Artificial Sequence: Synthetic oligonucleotide
caggttcatgatggtccgaag

SEQ ID NO: 19792 - DNA, 21 bp, Artificial Sequence
  Description of Artificial Sequence: Synthetic oligonucleotide
aacagcgaagtcagaaccagc

SEQ ID NO: 19793 - DNA, 21 bp, Artificial Sequence
  Description of Artificial Sequence: Synthetic oligonucleotide
agagtcggcagcgcccaaggc

SEQ ID NO: 19794 - DNA, 21 bp, Artificial Sequence
  Description of Artificial Sequence: Synthetic oligonucleotide
ctccccaccgacggcgccaaa

SEQ ID NO: 19795 - DNA, 21 bp, Artificial Sequence
  Description of Artificial Sequence: Synthetic oligonucleotide
gagtcttctccttcgaagggg

SEQ ID NO: 19796 - DNA, 21 bp, Artificial Sequence
  Description of Artificial Sequence: Synthetic oligonucleotide
gccgccggcaccaccggcacc

SEQ ID NO: 19797 - DNA, 21 bp, Artificial Sequence
  Description of Artificial Sequence: Synthetic oligonucleotide
gctggggatagtacgaagctg

SEQ ID NO: 19798 - DNA, 21 bp, Artificial Sequence
  Description of Artificial Sequence: Synthetic oligonucleotide
ggtagtactacgtctgctggg

SEQ ID NO: 19799 - DNA, 21 bp, Artificial Sequence
  Description of Artificial Sequence: Synthetic oligonucleotide
gtcagcagcagccaaaccagc

SEQ ID NO: 19800 - DNA, 21 bp, Artificial Sequence
  Description of Artificial Sequence: Synthetic oligonucleotide
accaacggcgcccccagccaa

SEQ ID NO: 19801 - DNA, 21 bp, Artificial Sequence
  Description of Artificial Sequence: Synthetic oligonucleotide
atgggtggtcagtctggtact

SEQ ID NO: 19802 - DNA, 21 bp, Artificial Sequence
  Description of Artificial Sequence: Synthetic oligonucleotide
ggcagcagcacccccagccaa

SEQ ID NO: 19803 - DNA, 21 bp, Artificial Sequence
  Description of Artificial Sequence: Synthetic oligonucleotide
tctcaggggcatagtccgact

SEQ ID NO: 19804 - DNA, 21 bp, Artificial Sequence
  Description of Artificial Sequence: Synthetic oligonucleotide
atgactggtgggtctgtggct

SEQ ID NO: 19805 - DNA, 21 bp, Artificial Sequence
  Description of Artificial Sequence: Synthetic oligonucleotide
gaggtgaagactcctgcggtt

SEQ ID NO: 19806 - DNA, 21 bp, Artificial Sequence
  Description of Artificial Sequence: Synthetic oligonucleotide
agcgtcagcgcccccagcaga

SEQ ID NO: 19807 - DNA, 21 bp, Artificial Sequence
  Description of Artificial Sequence: Synthetic oligonucleotide
ggcaaagtcggcgccaacaac

SEQ ID NO: 19808 - DNA, 21 bp, Artificial Sequence
  Description of Artificial Sequence: Synthetic oligonucleotide
agagacggcaacagcaccacc

SEQ ID NO: 19809 - DNA, 21 bp, Artificial Sequence
  Description of Artificial Sequence: Synthetic oligonucleotide
gagaatctggctcctagtaag

SEQ ID NO: 19810 - DNA, 21 bp, Artificial Sequence
  Description of Artificial Sequence: Synthetic oligonucleotide
ggcatcagcgacaaacccacc

SEQ ID NO: 19811 - DNA, 21 bp, Artificial Sequence
  Description of Artificial Sequence: Synthetic oligonucleotide
accagcagcaaagtcagcagc

SEQ ID NO: 19812 - DNA, 21 bp, Artificial Sequence
  Description of Artificial Sequence: Synthetic oligonucleotide
ctgagtgcggggggggctggg

SEQ ID NO: 19813 - DNA, 21 bp, Artificial Sequence
  Description of Artificial Sequence: Synthetic oligonucleotide
caacaacaaggcaaaggcccc

SEQ ID NO: 19814 - DNA, 21 bp, Artificial Sequence
  Description of Artificial Sequence: Synthetic oligonucleotide
ctcccccaacaaaacagcaaa

SEQ ID NO: 19815 - DNA, 21 bp, Artificial Sequence
  Description of Artificial Sequence: Synthetic oligonucleotide
ggcagcagcagccccagagaa

SEQ ID NO: 19816 - DNA, 21 bp, Artificial Sequence
  Description of Artificial Sequence: Synthetic oligonucleotide
accgacagccccaccaccaaa

SEQ ID NO: 19817 - DNA, 21 bp, Artificial Sequence
  Description of Artificial Sequence: Synthetic oligonucleotide
acgggtagtgagaatcgggtt

SEQ ID NO: 19818 - DNA, 21 bp, Artificial Sequence
  Description of Artificial Sequence: Synthetic oligonucleotide
cacaaagccaccaccgccgtc

SEQ ID NO: 19819 - DNA, 21 bp, Artificial Sequence
  Description of Artificial Sequence: Synthetic oligonucleotide
ctcgacaacggcaaacccccc

SEQ ID NO: 19820 - DNA, 21 bp, Artificial Sequence
  Description of Artificial Sequence: Synthetic oligonucleotide
agcgaaagcagaagcagcatc

SEQ ID NO: 19821 - DNA, 21 bp, Artificial Sequence
  Description of Artificial Sequence: Synthetic oligonucleotide
gaaagcggccaacccgccaaa

SEQ ID NO: 19822 - DNA, 21 bp, Artificial Sequence
  Description of Artificial Sequence: Synthetic oligonucleotide
aacgccgccagcgccggcgcc

SEQ ID NO: 19823 - DNA, 21 bp, Artificial Sequence
  Description of Artificial Sequence: Synthetic oligonucleotide
catagtgagagtaagttggct

SEQ ID NO: 19824 - DNA, 21 bp, Artificial Sequence
  Description of Artificial Sequence: Synthetic oligonucleotide
actcctggggataagacgatg

SEQ ID NO: 19825 - DNA, 21 bp, Artificial Sequence
  Description of Artificial Sequence: Synthetic oligonucleotide
ggcatcgccgacagcagaacc

SEQ ID NO: 19826 - DNA, 21 bp, Artificial Sequence
  Description of Artificial Sequence: Synthetic oligonucleotide
ggcgtcgacggcaaagccacc

SEQ ID NO: 19827 - DNA, 21 bp, Artificial Sequence
  Description of Artificial Sequence: Synthetic oligonucleotide
gataatcataagccggctcag

SEQ ID NO: 19828 - DNA, 21 bp, Artificial Sequence
  Description of Artificial Sequence: Synthetic oligonucleotide
ccgccgggtcagcctcagacg

SEQ ID NO: 19829 - DNA, 21 bp, Artificial Sequence
  Description of Artificial Sequence: Synthetic oligonucleotide
aacaacaccagccaccccgcc

SEQ ID NO: 19830 - DNA, 21 bp, Artificial Sequence
  Description of Artificial Sequence: Synthetic oligonucleotide
accggcaccagccccagcaga

SEQ ID NO: 19831 - DNA, 21 bp, Artificial Sequence
  Description of Artificial Sequence: Synthetic oligonucleotide
accggcagccccccccccagc

SEQ ID NO: 19832 - DNA, 21 bp, Artificial Sequence
  Description of Artificial Sequence: Synthetic oligonucleotide
accggcctcaaagaaaacccc

SEQ ID NO: 19833 - DNA, 21 bp, Artificial Sequence
  Description of Artificial Sequence: Synthetic oligonucleotide
agcagaaaccccagcaacagc

SEQ ID NO: 19834 - DNA, 21 bp, Artificial Sequence
  Description of Artificial Sequence: Synthetic oligonucleotide
cttcggacggctactagtaat

SEQ ID NO: 19835 - DNA, 21 bp, Artificial Sequence
  Description of Artificial Sequence: Synthetic oligonucleotide
ggggatactcagcggtctgcg

SEQ ID NO: 19836 - DNA, 21 bp, Artificial Sequence
  Description of Artificial Sequence: Synthetic oligonucleotide
acccaaggcaaaaccaacacc

SEQ ID NO: 19837 - DNA, 21 bp, Artificial Sequence
  Description of Artificial Sequence: Synthetic oligonucleotide
ggtactagggcgactcctcag

SEQ ID NO: 19838 - DNA, 21 bp, Artificial Sequence
  Description of Artificial Sequence: Synthetic oligonucleotide
cagagtactaaggctgttgag

SEQ ID NO: 19839 - DNA, 21 bp, Artificial Sequence
  Description of Artificial Sequence: Synthetic oligonucleotide
agcagcaacagccccaccgcc

SEQ ID NO: 19840 - DNA, 21 bp, Artificial Sequence
  Description of Artificial Sequence: Synthetic oligonucleotide
agccaaggcagcagcctcacc

SEQ ID NO: 19841 - DNA, 21 bp, Artificial Sequence
  Description of Artificial Sequence: Synthetic oligonucleotide
agccacaacagccaaggcggc

SEQ ID NO: 19842 - DNA, 21 bp, Artificial Sequence
  Description of Artificial Sequence: Synthetic oligonucleotide
caaggcagcagcaccagcacc

SEQ ID NO: 19843 - DNA, 21 bp, Artificial Sequence
  Description of Artificial Sequence: Synthetic oligonucleotide
caggggaaggatgcttctatg

SEQ ID NO: 19844 - DNA, 21 bp, Artificial Sequence
  Description of Artificial Sequence: Synthetic oligonucleotide
cgtatgggtgctccgacgggg

SEQ ID NO: 19845 - DNA, 21 bp, Artificial Sequence
  Description of Artificial Sequence: Synthetic oligonucleotide
ctcgacggcacccccagccac

SEQ ID NO: 19846 - DNA, 21 bp, Artificial Sequence
  Description of Artificial Sequence: Synthetic oligonucleotide
accaccgacaccggcaaccac

SEQ ID NO: 19847 - DNA, 21 bp, Artificial Sequence
  Description of Artificial Sequence: Synthetic oligonucleotide
atgtctggtcagtcgtctcgt

SEQ ID NO: 19848 - DNA, 21 bp, Artificial Sequence
  Description of Artificial Sequence: Synthetic oligonucleotide
agaaccggcagcaaaagcgac

SEQ ID NO: 19849 - DNA, 21 bp, Artificial Sequence
  Description of Artificial Sequence: Synthetic oligonucleotide
aatgtggttagggattctaag

SEQ ID NO: 19850 - DNA, 21 bp, Artificial Sequence
  Description of Artificial Sequence: Synthetic oligonucleotide
catactggttcggcgtcggct

SEQ ID NO: 19851 - DNA, 21 bp, Artificial Sequence
  Description of Artificial Sequence: Synthetic oligonucleotide
gattttagtcagaaggggatg

SEQ ID NO: 19852 - DNA, 21 bp, Artificial Sequence
  Description of Artificial Sequence: Synthetic oligonucleotide
ggcgtcagcagcagccccgcc

SEQ ID NO: 19853 - DNA, 21 bp, Artificial Sequence
  Description of Artificial Sequence: Synthetic oligonucleotide
tcggggcagaataaggagtcg

SEQ ID NO: 19854 - DNA, 21 bp, Artificial Sequence
  Description of Artificial Sequence: Synthetic oligonucleotide
gatgggtctcgtagtgggtct

SEQ ID NO: 19855 - DNA, 21 bp, Artificial Sequence
  Description of Artificial Sequence: Synthetic oligonucleotide
aatagtcagtcgccgtctgcg

SEQ ID NO: 19856 - DNA, 21 bp, Artificial Sequence
  Description of Artificial Sequence: Synthetic oligonucleotide
ctcacccaaggcggcaacagc

SEQ ID NO: 19857 - DNA, 21 bp, Artificial Sequence
  Description of Artificial Sequence: Synthetic oligonucleotide
gctcggacggcgcagcctgtt

SEQ ID NO: 19858 - DNA, 21 bp, Artificial Sequence
  Description of Artificial Sequence: Synthetic oligonucleotide
tcggcggatagggtggctacg

SEQ ID NO: 19859 - DNA, 21 bp, Artificial Sequence
  Description of Artificial Sequence: Synthetic oligonucleotide
ggcggccccagcgccaaccaa

SEQ ID NO: 19860 - DNA, 21 bp, Artificial Sequence
  Description of Artificial Sequence: Synthetic oligonucleotide
actggtacggcgacttctttg

SEQ ID NO: 19861 - DNA, 21 bp, Artificial Sequence
  Description of Artificial Sequence: Synthetic oligonucleotide
gaaaaaggcaacggcagcacc

SEQ ID NO: 19862 - DNA, 21 bp, Artificial Sequence
  Description of Artificial Sequence: Synthetic oligonucleotide
gttgcgaatgcttctggtggg

SEQ ID NO: 19863 - DNA, 21 bp, Artificial Sequence
  Description of Artificial Sequence: Synthetic oligonucleotide
agcaacgacagcaaaagagtc

SEQ ID NO: 19864 - DNA, 21 bp, Artificial Sequence
  Description of Artificial Sequence: Synthetic oligonucleotide
agcggcgaagccaaaaccaaa

SEQ ID NO: 19865 - DNA, 21 bp, Artificial Sequence
  Description of Artificial Sequence: Synthetic oligonucleotide
caggctggtacgtcggttaat

SEQ ID NO: 19866 - DNA, 21 bp, Artificial Sequence
  Description of Artificial Sequence: Synthetic oligonucleotide
gaactccccggcggcaccaaa

SEQ ID NO: 19867 - DNA, 21 bp, Artificial Sequence
  Description of Artificial Sequence: Synthetic oligonucleotide
ggtttgggtggggagcgtaat

SEQ ID NO: 19868 - DNA, 21 bp, Artificial Sequence
  Description of Artificial Sequence: Synthetic oligonucleotide
gttccgagtcaggttgggggt

SEQ ID NO: 19869 - DNA, 21 bp, Artificial Sequence
  Description of Artificial Sequence: Synthetic oligonucleotide
tatagggatgataagactatt

SEQ ID NO: 19870 - DNA, 21 bp, Artificial Sequence
  Description of Artificial Sequence: Synthetic oligonucleotide
aacagcctcgacaccagcaaa

SEQ ID NO: 19871 - DNA, 21 bp, Artificial Sequence
  Description of Artificial Sequence: Synthetic oligonucleotide
gctggtacgcagagtactgct

SEQ ID NO: 19872 - DNA, 21 bp, Artificial Sequence
  Description of Artificial Sequence: Synthetic oligonucleotide
agcaccgtcaaaggcagccaa

SEQ ID NO: 19873 - DNA, 21 bp, Artificial Sequence
  Description of Artificial Sequence: Synthetic oligonucleotide
caactcaaaagccccagcagc

SEQ ID NO: 19874 - DNA, 21 bp, Artificial Sequence
  Description of Artificial Sequence: Synthetic oligonucleotide
gccagccaagaaagagtcgcc

SEQ ID NO: 19875 - DNA, 21 bp, Artificial Sequence
  Description of Artificial Sequence: Synthetic oligonucleotide
gctcgtagtcagacttcgagt

SEQ ID NO: 19876 - DNA, 21 bp, Artificial Sequence
  Description of Artificial Sequence: Synthetic oligonucleotide
ggcagcagccaaggcctcacc

SEQ ID NO: 19877 - DNA, 21 bp, Artificial Sequence
  Description of Artificial Sequence: Synthetic oligonucleotide
gccagccacctcaaacccccc

SEQ ID NO: 19878 - DNA, 21 bp, Artificial Sequence
  Description of Artificial Sequence: Synthetic oligonucleotide
gcttcgacttcgcctgttgtt

SEQ ID NO: 19879 - DNA, 21 bp, Artificial Sequence
  Description of Artificial Sequence: Synthetic oligonucleotide
ctcaacagcgccaaaaacagc

SEQ ID NO: 19880 - DNA, 21 bp, Artificial Sequence
  Description of Artificial Sequence: Synthetic oligonucleotide
ggccccgaaggcggcaacaga

SEQ ID NO: 19881 - DNA, 21 bp, Artificial Sequence
  Description of Artificial Sequence: Synthetic oligonucleotide
agtaaggggtcggggactctg

SEQ ID NO: 19882 - DNA, 21 bp, Artificial Sequence
  Description of Artificial Sequence: Synthetic oligonucleotide
gattctaagacgcctgcgcgg

SEQ ID NO: 19883 - DNA, 21 bp, Artificial Sequence
  Description of Artificial Sequence: Synthetic oligonucleotide
agtaagtctactggttctgtt

SEQ ID NO: 19884 - DNA, 21 bp, Artificial Sequence
  Description of Artificial Sequence: Synthetic oligonucleotide
ctcagcggcgacgccgccaga

SEQ ID NO: 19885 - DNA, 21 bp, Artificial Sequence
  Description of Artificial Sequence: Synthetic oligonucleotide
ctgggttctcctgttagtacg

SEQ ID NO: 19886 - DNA, 21 bp, Artificial Sequence
  Description of Artificial Sequence: Synthetic oligonucleotide
caagccaccagcagcagcacc

SEQ ID NO: 19887 - DNA, 21 bp, Artificial Sequence
  Description of Artificial Sequence: Synthetic oligonucleotide
accggcagcaacaaaagccac

SEQ ID NO: 19888 - DNA, 21 bp, Artificial Sequence
  Description of Artificial Sequence: Synthetic oligonucleotide
gagacgaagacggctaataag

SEQ ID NO: 19889 - DNA, 21 bp, Artificial Sequence
  Description of Artificial Sequence: Synthetic oligonucleotide
ggtatgacgacggcggcgggg

SEQ ID NO: 19890 - DNA, 21 bp, Artificial Sequence
  Description of Artificial Sequence: Synthetic oligonucleotide
accagcgtcgccagcacccaa

SEQ ID NO: 19891 - DNA, 21 bp, Artificial Sequence
  Description of Artificial Sequence: Synthetic oligonucleotide
acggttgctgagaagttgggt

SEQ ID NO: 19892 - DNA, 21 bp, Artificial Sequence
  Description of Artificial Sequence: Synthetic oligonucleotide
atcaccggcagcacccccccc

SEQ ID NO: 19893 - DNA, 21 bp, Artificial Sequence
  Description of Artificial Sequence: Synthetic oligonucleotide
gacatcggcgccagccacgcc

SEQ ID NO: 19894 - DNA, 21 bp, Artificial Sequence
  Description of Artificial Sequence: Synthetic oligonucleotide
tcgagtacgtcgagtacgcat

SEQ ID NO: 19895 - DNA, 21 bp, Artificial Sequence
  Description of Artificial Sequence: Synthetic oligonucleotide
aacaacacccccaccctcagc

SEQ ID NO: 19896 - DNA, 21 bp, Artificial Sequence
  Description of Artificial Sequence: Synthetic oligonucleotide
agtagtagttctacttctaag

SEQ ID NO: 19897 - DNA, 21 bp, Artificial Sequence
  Description of Artificial Sequence: Synthetic oligonucleotide
tcgacgggtcattctcctcat

SEQ ID NO: 19898 - DNA, 21 bp, Artificial Sequence
  Description of Artificial Sequence: Synthetic oligonucleotide
aacagcagcggcgcccacacc

SEQ ID NO: 19899 - DNA, 21 bp, Artificial Sequence
  Description of Artificial Sequence: Synthetic oligonucleotide
accaccggcaccagcaccccc

SEQ ID NO: 19900 - DNA, 21 bp, Artificial Sequence
  Description of Artificial Sequence: Synthetic oligonucleotide
caagtcggcagcaaccacagc

SEQ ID NO: 19901 - DNA, 21 bp, Artificial Sequence
  Description of Artificial Sequence: Synthetic oligonucleotide
gacagcagaggccccagcagc

SEQ ID NO: 19902 - DNA, 21 bp, Artificial Sequence
  Description of Artificial Sequence: Synthetic oligonucleotide
cacggcgccggcaacgccgcc

SEQ ID NO: 19903 - DNA, 21 bp, Artificial Sequence
  Description of Artificial Sequence: Synthetic oligonucleotide
gtcggcagcagcaccgtcatg

SEQ ID NO: 19904 - DNA, 21 bp, Artificial Sequence
  Description of Artificial Sequence: Synthetic oligonucleotide
gaggcgcgttcggcgcatggg

SEQ ID NO: 19905 - DNA, 21 bp, Artificial Sequence
  Description of Artificial Sequence: Synthetic oligonucleotide
gctacgggtactggtaatggt

SEQ ID NO: 19906 - DNA, 21 bp, Artificial Sequence
  Description of Artificial Sequence: Synthetic oligonucleotide
ggttctaaggctaatactttg

SEQ ID NO: 19907 - DNA, 21 bp, Artificial Sequence
  Description of Artificial Sequence: Synthetic oligonucleotide
accagcggcaccggcaaccaa

SEQ ID NO: 19908 - DNA, 21 bp, Artificial Sequence
  Description of Artificial Sequence: Synthetic oligonucleotide
gacagaaacggcagccaaggc

SEQ ID NO: 19909 - DNA, 21 bp, Artificial Sequence
  Description of Artificial Sequence: Synthetic oligonucleotide
caacaagtcaaccccaaactc

SEQ ID NO: 19910 - DNA, 21 bp, Artificial Sequence
  Description of Artificial Sequence: Synthetic oligonucleotide
aacggcagcctcaaacccacc

SEQ ID NO: 19911 - DNA, 21 bp, Artificial Sequence
  Description of Artificial Sequence: Synthetic oligonucleotide
agaaacggcagccccaacgtc

SEQ ID NO: 19912 - DNA, 21 bp, Artificial Sequence
  Description of Artificial Sequence: Synthetic oligonucleotide
gaaagcaacaaaggcatcggc

SEQ ID NO: 19913 - DNA, 21 bp, Artificial Sequence
  Description of Artificial Sequence: Synthetic oligonucleotide
gacaccagccccagaaacaac

SEQ ID NO: 19914 - DNA, 21 bp, Artificial Sequence
  Description of Artificial Sequence: Synthetic oligonucleotide
gcgggtgattcgtcgaggggg

SEQ ID NO: 19915 - DNA, 21 bp, Artificial Sequence
  Description of Artificial Sequence: Synthetic oligonucleotide
gtcggcagcagagaaaaaggc

SEQ ID NO: 19916 - DNA, 21 bp, Artificial Sequence
  Description of Artificial Sequence: Synthetic oligonucleotide
tcgccttcgagtaagaatagt

SEQ ID NO: 19917 - DNA, 21 bp, Artificial Sequence
  Description of Artificial Sequence: Synthetic oligonucleotide
agaagccaaggcgccagcatg

SEQ ID NO: 19918 - DNA, 21 bp, Artificial Sequence
  Description of Artificial Sequence: Synthetic oligonucleotide
ggtacgacgcctacgagtcgt

SEQ ID NO: 19919 - DNA, 21 bp, Artificial Sequence
  Description of Artificial Sequence: Synthetic oligonucleotide
gatggtcgggtgaagaatggg

SEQ ID NO: 19920 - DNA, 21 bp, Artificial Sequence
  Description of Artificial Sequence: Synthetic oligonucleotide
actcaggctgttaatggtggt

SEQ ID NO: 19921 - DNA, 21 bp, Artificial Sequence
  Description of Artificial Sequence: Synthetic oligonucleotide
gaacaaagagccaccgcccaa

SEQ ID NO: 19922 - DNA, 21 bp, Artificial Sequence
  Description of Artificial Sequence: Synthetic oligonucleotide
gatctttcgggtaagtctctt

SEQ ID NO: 19923 - DNA, 21 bp, Artificial Sequence
  Description of Artificial Sequence: Synthetic oligonucleotide
aacaccagaagcagcaccgtc

SEQ ID NO: 19924 - DNA, 21 bp, Artificial Sequence
  Description of Artificial Sequence: Synthetic oligonucleotide
gcccccagcgccagccccaac

SEQ ID NO: 19925 - DNA, 21 bp, Artificial Sequence
  Description of Artificial Sequence: Synthetic oligonucleotide
ggcagcagcaaaagccccgaa

SEQ ID NO: 19926 - DNA, 21 bp, Artificial Sequence
  Description of Artificial Sequence: Synthetic oligonucleotide
aacggcagcgacgccaaaacc

SEQ ID NO: 19927 - DNA, 21 bp, Artificial Sequence
  Description of Artificial Sequence: Synthetic oligonucleotide
aattctgctaatcagaatcat

SEQ ID NO: 19928 - DNA, 21 bp, Artificial Sequence
  Description of Artificial Sequence: Synthetic oligonucleotide
agcggcggcgcccccgccgtc

SEQ ID NO: 19929 - DNA, 21 bp, Artificial Sequence
  Description of Artificial Sequence: Synthetic oligonucleotide
ctcaccagccccgccggcgcc

SEQ ID NO: 19930 - DNA, 21 bp, Artificial Sequence
  Description of Artificial Sequence: Synthetic oligonucleotide
gaccacagcaaagaccacagc

SEQ ID NO: 19931 - DNA, 21 bp, Artificial Sequence
  Description of Artificial Sequence: Synthetic oligonucleotide
gagagtgggaagccgggtttg

SEQ ID NO: 19932 - DNA, 21 bp, Artificial Sequence
  Description of Artificial Sequence: Synthetic oligonucleotide
gttagggataatagtagtcag

SEQ ID NO: 19933 - DNA, 21 bp, Artificial Sequence
  Description of Artificial Sequence: Synthetic oligonucleotide
acgcagcagtctcctagtatg

SEQ ID NO: 19934 - DNA, 21 bp, Artificial Sequence
  Description of Artificial Sequence: Synthetic oligonucleotide
aacggcggcagcaaaagcctc

SEQ ID NO: 19935 - DNA, 21 bp, Artificial Sequence
  Description of Artificial Sequence: Synthetic oligonucleotide
agtcctgtgagtggtggtcat

SEQ ID NO: 19936 - DNA, 21 bp, Artificial Sequence
  Description of Artificial Sequence: Synthetic oligonucleotide
gggcgggatgatactagggtt

SEQ ID NO: 19937 - DNA, 21 bp, Artificial Sequence
  Description of Artificial Sequence: Synthetic oligonucleotide
ggtatgaatagtaagcttacg

SEQ ID NO: 19938 - DNA, 21 bp, Artificial Sequence
  Description of Artificial Sequence: Synthetic oligonucleotide
agcggcgccagcgccaccagc

SEQ ID NO: 19939 - DNA, 21 bp, Artificial Sequence
  Description of Artificial Sequence: Synthetic oligonucleotide
caaggcaccatgagcaacggc

SEQ ID NO: 19940 - DNA, 21 bp, Artificial Sequence
  Description of Artificial Sequence: Synthetic oligonucleotide
ggcggcggcacccccctcatc

SEQ ID NO: 19941 - DNA, 21 bp, Artificial Sequence
  Description of Artificial Sequence: Synthetic oligonucleotide
tctcaggcggattctaagcag

SEQ ID NO: 19942 - DNA, 21 bp, Artificial Sequence
  Description of Artificial Sequence: Synthetic oligonucleotide
agcaccagcgccaccaacacc

SEQ ID NO: 19943 - DNA, 21 bp, Artificial Sequence
  Description of Artificial Sequence: Synthetic oligonucleotide
aacagcggcgaacacgccagc

SEQ ID NO: 19944 - DNA, 21 bp, Artificial Sequence
  Description of Artificial Sequence: Synthetic oligonucleotide
ggtccgcagcctagtaaggcg

SEQ ID NO: 19945 - DNA, 21 bp, Artificial Sequence
  Description of Artificial Sequence: Synthetic oligonucleotide
gtcaacggcaccagcaaagtc

SEQ ID NO: 19946 - DNA, 21 bp, Artificial Sequence
  Description of Artificial Sequence: Synthetic oligonucleotide
gatgttgcgaagacttcttct

SEQ ID NO: 19947 - DNA, 21 bp, Artificial Sequence
  Description of Artificial Sequence: Synthetic oligonucleotide
ggtacgtcgcctcctgggact

SEQ ID NO: 19948 - DNA, 21 bp, Artificial Sequence
  Description of Artificial Sequence: Synthetic oligonucleotide
aatccttctcctgctaatgtt

SEQ ID NO: 19949 - DNA, 21 bp, Artificial Sequence
  Description of Artificial Sequence: Synthetic oligonucleotide
caacacaccagcaccaacgcc

SEQ ID NO: 19950 - DNA, 21 bp, Artificial Sequence
  Description of Artificial Sequence: Synthetic oligonucleotide
gtcagcagcagcaccaacagc

SEQ ID NO: 19951 - DNA, 21 bp, Artificial Sequence
  Description of Artificial Sequence: Synthetic oligonucleotide
ctcaccagcaaaggccccagc

SEQ ID NO: 19952 - DNA, 21 bp, Artificial Sequence
  Description of Artificial Sequence: Synthetic oligonucleotide
agaagcaacggcagcgccggc

SEQ ID NO: 19953 - DNA, 21 bp, Artificial Sequence
  Description of Artificial Sequence: Synthetic oligonucleotide
agcagcaacaccagcaacgtc

SEQ ID NO: 19954 - DNA, 21 bp, Artificial Sequence
  Description of Artificial Sequence: Synthetic oligonucleotide
aacagcaaaaacaacaaagaa

SEQ ID NO: 19955 - DNA, 21 bp, Artificial Sequence
  Description of Artificial Sequence: Synthetic oligonucleotide
aacagccaaggcaacctcggc

SEQ ID NO: 19956 - DNA, 21 bp, Artificial Sequence
  Description of Artificial Sequence: Synthetic oligonucleotide
aacgccggcagccacagccaa

SEQ ID NO: 19957 - DNA, 21 bp, Artificial Sequence
  Description of Artificial Sequence: Synthetic oligonucleotide
aaggttgggcaggatcgtctt

SEQ ID NO: 19958 - DNA, 21 bp, Artificial Sequence
  Description of Artificial Sequence: Synthetic oligonucleotide
aatggtgtggcttcggcgact

SEQ ID NO: 19959 - DNA, 21 bp, Artificial Sequence
  Description of Artificial Sequence: Synthetic oligonucleotide
accagaagcgaaaccagccaa

SEQ ID NO: 19960 - DNA, 21 bp, Artificial Sequence
  Description of Artificial Sequence: Synthetic oligonucleotide
acccaagtccccgcccccagc

SEQ ID NO: 19961 - DNA, 21 bp, Artificial Sequence
  Description of Artificial Sequence: Synthetic oligonucleotide
actggtaagggttctccgaat

SEQ ID NO: 19962 - DNA, 21 bp, Artificial Sequence
  Description of Artificial Sequence: Synthetic oligonucleotide
agcagagtcagcagcggcacc

SEQ ID NO: 19963 - DNA, 21 bp, Artificial Sequence
  Description of Artificial Sequence: Synthetic oligonucleotide
atcgccggcaacaccagcacc

SEQ ID NO: 19964 - DNA, 21 bp, Artificial Sequence
  Description of Artificial Sequence: Synthetic oligonucleotide
caagccagcgccagcagcaga

SEQ ID NO: 19965 - DNA, 21 bp, Artificial Sequence
  Description of Artificial Sequence: Synthetic oligonucleotide
caaggcggcagcccccccggc

SEQ ID NO: 19966 - DNA, 21 bp, Artificial Sequence
  Description of Artificial Sequence: Synthetic oligonucleotide
ctcatggaccaaaaaagcgcc

SEQ ID NO: 19967 - DNA, 21 bp, Artificial Sequence
  Description of Artificial Sequence: Synthetic oligonucleotide
gaaggcaccaacctcagaagc

SEQ ID NO: 19968 - DNA, 21 bp, Artificial Sequence
  Description of Artificial Sequence: Synthetic oligonucleotide
ggcaaagaaaccagagacaaa

SEQ ID NO: 19969 - DNA, 21 bp, Artificial Sequence
  Description of Artificial Sequence: Synthetic oligonucleotide
ggccccggcggcagaaacgac

SEQ ID NO: 19970 - DNA, 21 bp, Artificial Sequence
  Description of Artificial Sequence: Synthetic oligonucleotide
ggtaatactagggatagttct

SEQ ID NO: 19971 - DNA, 21 bp, Artificial Sequence
  Description of Artificial Sequence: Synthetic oligonucleotide
ggtagtaattctggggctacg

SEQ ID NO: 19972 - DNA, 21 bp, Artificial Sequence
  Description of Artificial Sequence: Synthetic oligonucleotide
gtcagcaacaaagtccaagaa

SEQ ID NO: 19973 - DNA, 21 bp, Artificial Sequence
  Description of Artificial Sequence: Synthetic oligonucleotide
gttcagcagtctgctagtcgg

SEQ ID NO: 19974 - DNA, 21 bp, Artificial Sequence
  Description of Artificial Sequence: Synthetic oligonucleotide
ttcgccgccagcgaaaacaga

SEQ ID NO: 19975 - DNA, 21 bp, Artificial Sequence
  Description of Artificial Sequence: Synthetic oligonucleotide
caacccaaaagcagcagcacc

SEQ ID NO: 19976 - DNA, 21 bp, Artificial Sequence
  Description of Artificial Sequence: Synthetic oligonucleotide
tcgagtgcgtctaatcatacg

SEQ ID NO: 19977 - DNA, 21 bp, Artificial Sequence
  Description of Artificial Sequence: Synthetic oligonucleotide
gattcggttcgttcttcgggg

SEQ ID NO: 19978 - DNA, 21 bp, Artificial Sequence
  Description of Artificial Sequence: Synthetic oligonucleotide
aatgctgtgacgacgcctaat

SEQ ID NO: 19979 - DNA, 21 bp, Artificial Sequence
  Description of Artificial Sequence: Synthetic oligonucleotide
gttactgcggcgtctaattct

SEQ ID NO: 19980 - DNA, 21 bp, Artificial Sequence
  Description of Artificial Sequence: Synthetic oligonucleotide
gaacccagcagcagcaaaacc

SEQ ID NO: 19981 - DNA, 21 bp, Artificial Sequence
  Description of Artificial Sequence: Synthetic oligonucleotide
acgccgacgaatagtaaggtt

SEQ ID NO: 19982 - DNA, 21 bp, Artificial Sequence
  Description of Artificial Sequence: Synthetic oligonucleotide
agcggccccaccaccgtcagc

SEQ ID NO: 19983 - DNA, 21 bp, Artificial Sequence
  Description of Artificial Sequence: Synthetic oligonucleotide
gccatgaccagcggcagcaaa

SEQ ID NO: 19984 - DNA, 21 bp, Artificial Sequence
  Description of Artificial Sequence: Synthetic oligonucleotide
gtcaacgccagcagcgtccaa

SEQ ID NO: 19985 - DNA, 21 bp, Artificial Sequence
  Description of Artificial Sequence: Synthetic oligonucleotide
gacagcgccagcagcagaggc

SEQ ID NO: 19986 - DNA, 21 bp, Artificial Sequence
  Description of Artificial Sequence: Synthetic oligonucleotide
ggtacgggggatcgtgagcgt

SEQ ID NO: 19987 - DNA, 21 bp, Artificial Sequence
  Description of Artificial Sequence: Synthetic oligonucleotide
gggagtggtggtcataattcg

SEQ ID NO: 19988 - DNA, 21 bp, Artificial Sequence
  Description of Artificial Sequence: Synthetic oligonucleotide
ctcacccaaggccaaaccaaa

SEQ ID NO: 19989 - DNA, 21 bp, Artificial Sequence
  Description of Artificial Sequence: Synthetic oligonucleotide
ggcggcgtcgaaagccaccaa

SEQ ID NO: 19990 - DNA, 21 bp, Artificial Sequence
  Description of Artificial Sequence: Synthetic oligonucleotide
tttggggcgggtactagttct

SEQ ID NO: 19991 - DNA, 21 bp, Artificial Sequence
  Description of Artificial Sequence: Synthetic oligonucleotide
caaagaaacagcggcaacggc

SEQ ID NO: 19992 - DNA, 21 bp, Artificial Sequence
  Description of Artificial Sequence: Synthetic oligonucleotide
gacaccgtcaccggcaaacaa

SEQ ID NO: 19993 - DNA, 21 bp, Artificial Sequence
  Description of Artificial Sequence: Synthetic oligonucleotide
gctggttcttcgactgctgcg

SEQ ID NO: 19994 - DNA, 21 bp, Artificial Sequence
  Description of Artificial Sequence: Synthetic oligonucleotide
agaagcgaaaacacccccagc

SEQ ID NO: 19995 - DNA, 21 bp, Artificial Sequence
  Description of Artificial Sequence: Synthetic oligonucleotide
agcttcgacaacaaaggcaaa

SEQ ID NO: 19996 - DNA, 21 bp, Artificial Sequence
  Description of Artificial Sequence: Synthetic oligonucleotide
gaaagaggcacccccggcggc

SEQ ID NO: 19997 - DNA, 21 bp, Artificial Sequence
  Description of Artificial Sequence: Synthetic oligonucleotide
gtcggcaccagcaccatcgtc

SEQ ID NO: 19998 - DNA, 21 bp, Artificial Sequence
  Description of Artificial Sequence: Synthetic oligonucleotide
tcggggggtaagggtgctgcg

SEQ ID NO: 19999 - DNA, 21 bp, Artificial Sequence
  Description of Artificial Sequence: Synthetic oligonucleotide
cagtctcggcctactgtggcg

SEQ ID NO: 20000 - DNA, 21 bp, Artificial Sequence
  Description of Artificial Sequence: Synthetic oligonucleotide
gccggcgaaagcgcccacagc

SEQ ID NO: 20001 - DNA, 21 bp, Artificial Sequence
  Description of Artificial Sequence: Synthetic oligonucleotide
tctacttcgacgagttcgctg

SEQ ID NO: 20002 - DNA, 21 bp, Artificial Sequence
  Description of Artificial Sequence: Synthetic oligonucleotide
aagcctgatgcgccgggtgtg

SEQ ID NO: 20003 - DNA, 21 bp, Artificial Sequence
  Description of Artificial Sequence: Synthetic oligonucleotide
agtagtagtacgacggcgggt

SEQ ID NO: 20004 - DNA, 21 bp, Artificial Sequence
  Description of Artificial Sequence: Synthetic oligonucleotide
ggtcgtgagactccgtctctg

SEQ ID NO: 20005 - DNA, 21 bp, Artificial Sequence
  Description of Artificial Sequence: Synthetic oligonucleotide
tctgctgattctcagaagggg

SEQ ID NO: 20006 - DNA, 21 bp, Artificial Sequence
  Description of Artificial Sequence: Synthetic oligonucleotide
ctcggcagcggcagcggcgcc

SEQ ID NO: 20007 - DNA, 21 bp, Artificial Sequence
  Description of Artificial Sequence: Synthetic oligonucleotide
agcaacagcgaaagaaccagc

SEQ ID NO: 20008 - DNA, 21 bp, Artificial Sequence
  Description of Artificial Sequence: Synthetic oligonucleotide
agcagcccccccagccccagc

SEQ ID NO: 20009 - DNA, 21 bp, Artificial Sequence
  Description of Artificial Sequence: Synthetic oligonucleotide
gatcgggctgggactcataat

SEQ ID NO: 20010 - DNA, 21 bp, Artificial Sequence
  Description of Artificial Sequence: Synthetic oligonucleotide
ttgggtacgccgagtaatggg

SEQ ID NO: 20011 - DNA, 21 bp, Artificial Sequence
  Description of Artificial Sequence: Synthetic oligonucleotide
gaaggcagcaacaaagtcgtc

SEQ ID NO: 20012 - DNA, 21 bp, Artificial Sequence
  Description of Artificial Sequence: Synthetic oligonucleotide
ggcaccagcgccaccgccctc

SEQ ID NO: 20013 - DNA, 21 bp, Artificial Sequence
  Description of Artificial Sequence: Synthetic oligonucleotide
aagcaggtttcgtctcctgtt

SEQ ID NO: 20014 - DNA, 21 bp, Artificial Sequence
  Description of Artificial Sequence: Synthetic oligonucleotide
gacgccaccagcagcccccaa

SEQ ID NO: 20015 - DNA, 21 bp, Artificial Sequence
  Description of Artificial Sequence: Synthetic oligonucleotide
gggcaggagcatggtgtgagt

SEQ ID NO: 20016 - DNA, 21 bp, Artificial Sequence
  Description of Artificial Sequence: Synthetic oligonucleotide
ggtgtgaatagtaaggcgacg

SEQ ID NO: 20017 - DNA, 21 bp, Artificial Sequence
  Description of Artificial Sequence: Synthetic oligonucleotide
agccccgccagcaccaccaaa

SEQ ID NO: 20018 - DNA, 21 bp, Artificial Sequence
  Description of Artificial Sequence: Synthetic oligonucleotide
gaaagcaccaaacccagagac

SEQ ID NO: 20019 - DNA, 21 bp, Artificial Sequence
  Description of Artificial Sequence: Synthetic oligonucleotide
aatccgtctcgggagtcttcg

SEQ ID NO: 20020 - DNA, 21 bp, Artificial Sequence
  Description of Artificial Sequence: Synthetic oligonucleotide
agtgagtctcctaaggcgggt

SEQ ID NO: 20021 - DNA, 21 bp, Artificial Sequence
  Description of Artificial Sequence: Synthetic oligonucleotide
aatcagtctggtgatcggtcg

SEQ ID NO: 20022 - DNA, 21 bp, Artificial Sequence
  Description of Artificial Sequence: Synthetic oligonucleotide
gcccaaggcagcagcaaaacc

SEQ ID NO: 20023 - DNA, 21 bp, Artificial Sequence
  Description of Artificial Sequence: Synthetic oligonucleotide
agagtcgacgccagcaacgtc

SEQ ID NO: 20024 - DNA, 21 bp, Artificial Sequence
  Description of Artificial Sequence: Synthetic oligonucleotide
agcaaaaacggcctccaaggc

SEQ ID NO: 20025 - DNA, 21 bp, Artificial Sequence
  Description of Artificial Sequence: Synthetic oligonucleotide
agcgacgacagcagcagacac

SEQ ID NO: 20026 - DNA, 21 bp, Artificial Sequence
  Description of Artificial Sequence: Synthetic oligonucleotide
cagcatgcgacgtcggctggg

SEQ ID NO: 20027 - DNA, 21 bp, Artificial Sequence
  Description of Artificial Sequence: Synthetic oligonucleotide
gatcttgggtcgcataatagg

SEQ ID NO: 20028 - DNA, 21 bp, Artificial Sequence
  Description of Artificial Sequence: Synthetic oligonucleotide
gcccccggcggcaaaatggtc

SEQ ID NO: 20029 - DNA, 21 bp, Artificial Sequence
  Description of Artificial Sequence: Synthetic oligonucleotide
ggcagcgaaagcagaagcggc

SEQ ID NO: 20030 - DNA, 21 bp, Artificial Sequence
  Description of Artificial Sequence: Synthetic oligonucleotide
gtggcgtcgtcgtcgactgtg

SEQ ID NO: 20031 - DNA, 21 bp, Artificial Sequence
  Description of Artificial Sequence: Synthetic oligonucleotide
agtggtacttctaaggcggag

SEQ ID NO: 20032 - DNA, 21 bp, Artificial Sequence
  Description of Artificial Sequence: Synthetic oligonucleotide
ctgggtaaggatcagattcag

SEQ ID NO: 20033 - DNA, 21 bp, Artificial Sequence
  Description of Artificial Sequence: Synthetic oligonucleotide
gtcaccagcagcagcagccaa

SEQ ID NO: 20034 - DNA, 21 bp, Artificial Sequence
  Description of Artificial Sequence: Synthetic oligonucleotide
aacaaaaaccaagccgccaac

SEQ ID NO: 20035 - DNA, 21 bp, Artificial Sequence
  Description of Artificial Sequence: Synthetic oligonucleotide
caaggccaacaacacagccaa

SEQ ID NO: 20036 - DNA, 21 bp, Artificial Sequence
  Description of Artificial Sequence: Synthetic oligonucleotide
ctgtcggatccgcagaggggg

SEQ ID NO: 20037 - DNA, 21 bp, Artificial Sequence
  Description of Artificial Sequence: Synthetic oligonucleotide
ggtgagaagcctggtggtaat

SEQ ID NO: 20038 - DNA, 21 bp, Artificial Sequence
  Description of Artificial Sequence: Synthetic oligonucleotide
ggtgatattagttctaagaat

SEQ ID NO: 20039 - DNA, 21 bp, Artificial Sequence
  Description of Artificial Sequence: Synthetic oligonucleotide
tcttcgagtacgcatagtctt

SEQ ID NO: 20040 - DNA, 21 bp, Artificial Sequence
  Description of Artificial Sequence: Synthetic oligonucleotide
tcttctggtaatggtcatgct

SEQ ID NO: 20041 - DNA, 21 bp, Artificial Sequence
  Description of Artificial Sequence: Synthetic oligonucleotide
ggtgattcttctcctaagacg

SEQ ID NO: 20042 - DNA, 21 bp, Artificial Sequence
  Description of Artificial Sequence: Synthetic oligonucleotide
gctgttaattcttcggctggg

SEQ ID NO: 20043 - DNA, 21 bp, Artificial Sequence
  Description of Artificial Sequence: Synthetic oligonucleotide
actacgggttctagttctact

SEQ ID NO: 20044 - DNA, 21 bp, Artificial Sequence
  Description of Artificial Sequence: Synthetic oligonucleotide
agtgatgggcagacgaatagg

SEQ ID NO: 20045 - DNA, 21 bp, Artificial Sequence
  Description of Artificial Sequence: Synthetic oligonucleotide
agttcgagtaattcttcgcag

SEQ ID NO: 20046 - DNA, 21 bp, Artificial Sequence
  Description of Artificial Sequence: Synthetic oligonucleotide
agttctacgcctaatgggaag

SEQ ID NO: 20047 - DNA, 21 bp, Artificial Sequence
  Description of Artificial Sequence: Synthetic oligonucleotide
caccccgacagcaccggcaaa

SEQ ID NO: 20048 - DNA, 21 bp, Artificial Sequence
  Description of Artificial Sequence: Synthetic oligonucleotide
gacagcaccaaaaccagcgtc

SEQ ID NO: 20049 - DNA, 21 bp, Artificial Sequence
  Description of Artificial Sequence: Synthetic oligonucleotide
caggtgagtgctgctgcgggt

SEQ ID NO: 20050 - DNA, 21 bp, Artificial Sequence
  Description of Artificial Sequence: Synthetic oligonucleotide
ggcgacatcaaacccagcagc

SEQ ID NO: 20051 - DNA, 21 bp, Artificial Sequence
  Description of Artificial Sequence: Synthetic oligonucleotide
aagactggtaatgtgagtagc

SEQ ID NO: 20052 - DNA, 21 bp, Artificial Sequence
  Description of Artificial Sequence: Synthetic oligonucleotide
agcagcgacagcaaaaccagc

SEQ ID NO: 20053 - DNA, 21 bp, Artificial Sequence
  Description of Artificial Sequence: Synthetic oligonucleotide
ggcaccgaacccagccacaaa

SEQ ID NO: 20054 - DNA, 21 bp, Artificial Sequence
  Description of Artificial Sequence: Synthetic oligonucleotide
acgacggagaaggctcagtct

SEQ ID NO: 20055 - DNA, 21 bp, Artificial Sequence
  Description of Artificial Sequence: Synthetic oligonucleotide
gaaaaaagagacgccgtcgcc

SEQ ID NO: 20056 - DNA, 21 bp, Artificial Sequence
  Description of Artificial Sequence: Synthetic oligonucleotide
ttggggacttctacgtctagt

SEQ ID NO: 20057 - DNA, 21 bp, Artificial Sequence
  Description of Artificial Sequence: Synthetic oligonucleotide
gttcagggttcgtcggctact

SEQ ID NO: 20058 - DNA, 21 bp, Artificial Sequence
  Description of Artificial Sequence: Synthetic oligonucleotide
aatctgaatttgcctaagggt

SEQ ID NO: 20059 - DNA, 21 bp, Artificial Sequence
  Description of Artificial Sequence: Synthetic oligonucleotide
acggttactagttctcgtgat

SEQ ID NO: 20060 - DNA, 21 bp, Artificial Sequence
  Description of Artificial Sequence: Synthetic oligonucleotide
agcctcaccagccccgccgaa

SEQ ID NO: 20061 - DNA, 21 bp, Artificial Sequence
  Description of Artificial Sequence: Synthetic oligonucleotide
cagcgtagtcagacttcggct

SEQ ID NO: 20062 - DNA, 21 bp, Artificial Sequence
  Description of Artificial Sequence: Synthetic oligonucleotide
ggcacccaaagcgtccccgcc

SEQ ID NO: 20063 - DNA, 21 bp, Artificial Sequence
  Description of Artificial Sequence: Synthetic oligonucleotide
gtcgccagcagcagcggcggc

SEQ ID NO: 20064 - DNA, 21 bp, Artificial Sequence
  Description of Artificial Sequence: Synthetic oligonucleotide
tcgaatactcagccggttagc

SEQ ID NO: 20065 - DNA, 21 bp, Artificial Sequence
  Description of Artificial Sequence: Synthetic oligonucleotide
gacagcaaacccagcgccctc

SEQ ID NO: 20066 - DNA, 21 bp, Artificial Sequence
  Description of Artificial Sequence: Synthetic oligonucleotide
ggcgaaaccagcaaagtcgtc

SEQ ID NO: 20067 - DNA, 21 bp, Artificial Sequence
  Description of Artificial Sequence: Synthetic oligonucleotide
agcggccaagccagcacccac

SEQ ID NO: 20068 - DNA, 21 bp, Artificial Sequence
  Description of Artificial Sequence: Synthetic oligonucleotide
gattcgcataagacgtctacg

SEQ ID NO: 20069 - DNA, 21 bp, Artificial Sequence
  Description of Artificial Sequence: Synthetic oligonucleotide
agcgtcgacaaaagcaccaga

SEQ ID NO: 20070 - DNA, 21 bp, Artificial Sequence
  Description of Artificial Sequence: Synthetic oligonucleotide
gaagtcagccccgccgccaaa

SEQ ID NO: 20071 - DNA, 21 bp, Artificial Sequence
  Description of Artificial Sequence: Synthetic oligonucleotide
aaagacagcggcggccacaaa

SEQ ID NO: 20072 - DNA, 21 bp, Artificial Sequence
  Description of Artificial Sequence: Synthetic oligonucleotide
aacaaagacaccagacccgaa

SEQ ID NO: 20073 - DNA, 21 bp, Artificial Sequence
  Description of Artificial Sequence: Synthetic oligonucleotide
aataagctggggtcggctggt

SEQ ID NO: 20074 - DNA, 21 bp, Artificial Sequence
  Description of Artificial Sequence: Synthetic oligonucleotide
actactagtgctgtgagttct

SEQ ID NO: 20075 - DNA, 21 bp, Artificial Sequence
  Description of Artificial Sequence: Synthetic oligonucleotide
agcggcgtcggcacccacacc

SEQ ID NO: 20076 - DNA, 21 bp, Artificial Sequence
  Description of Artificial Sequence: Synthetic oligonucleotide
gcgccgactagtggtggtcag

SEQ ID NO: 20077 - DNA, 21 bp, Artificial Sequence
  Description of Artificial Sequence: Synthetic oligonucleotide
ggtgaggttaagccttcggct

SEQ ID NO: 20078 - DNA, 21 bp, Artificial Sequence
  Description of Artificial Sequence: Synthetic oligonucleotide
gttagtaagcctggtgggaat

SEQ ID NO: 20079 - DNA, 21 bp, Artificial Sequence
  Description of Artificial Sequence: Synthetic oligonucleotide
tcgagtacgaaggatcaggtg

SEQ ID NO: 20080 - DNA, 21 bp, Artificial Sequence
  Description of Artificial Sequence: Synthetic oligonucleotide
aatgggagtaatggtcagaac

SEQ ID NO: 20081 - DNA, 21 bp, Artificial Sequence
  Description of Artificial Sequence: Synthetic oligonucleotide
ttgcctgatgctaagggtacg

SEQ ID NO: 20082 - DNA, 21 bp, Artificial Sequence
  Description of Artificial Sequence: Synthetic oligonucleotide
caaagcggcacccacagcagc

SEQ ID NO: 20083 - DNA, 21 bp, Artificial Sequence
  Description of Artificial Sequence: Synthetic oligonucleotide
tcgactaattcttctcgtgat

SEQ ID NO: 20084 - DNA, 21 bp, Artificial Sequence
  Description of Artificial Sequence: Synthetic oligonucleotide
accagcaaccccaccagcggc

SEQ ID NO: 20085 - DNA, 21 bp, Artificial Sequence
  Description of Artificial Sequence: Synthetic oligonucleotide
gtccccgtcgacggcaaacaa

SEQ ID NO: 20086 - DNA, 21 bp, Artificial Sequence
  Description of Artificial Sequence: Synthetic oligonucleotide
accgccaccagcaaacccgac

SEQ ID NO: 20087 - DNA, 21 bp, Artificial Sequence
  Description of Artificial Sequence: Synthetic oligonucleotide
gacagcacccccgccacccaa

SEQ ID NO: 20088 - DNA, 21 bp, Artificial Sequence
  Description of Artificial Sequence: Synthetic oligonucleotide
gacggcgccagcagagcccaa

SEQ ID NO: 20089 - DNA, 21 bp, Artificial Sequence
  Description of Artificial Sequence: Synthetic oligonucleotide
tctcctcagaatactccgagt

SEQ ID NO: 20090 - DNA, 21 bp, Artificial Sequence
  Description of Artificial Sequence: Synthetic oligonucleotide
cgttctaatagtcctgtggag

SEQ ID NO: 20091 - DNA, 21 bp, Artificial Sequence
  Description of Artificial Sequence: Synthetic oligonucleotide
aagaatggtgatagggcttct

SEQ ID NO: 20092 - DNA, 21 bp, Artificial Sequence
  Description of Artificial Sequence: Synthetic oligonucleotide
aatgtggagggttctcggacg

SEQ ID NO: 20093 - DNA, 21 bp, Artificial Sequence
  Description of Artificial Sequence: Synthetic oligonucleotide
agtgagaatcggagtcctgcg

SEQ ID NO: 20094 - DNA, 21 bp, Artificial Sequence
  Description of Artificial Sequence: Synthetic oligonucleotide
agcagacaagccggcagcggc

SEQ ID NO: 20095 - DNA, 21 bp, Artificial Sequence
  Description of Artificial Sequence: Synthetic oligonucleotide
agtggtgagtctaagcggggg

SEQ ID NO: 20096 - DNA, 21 bp, Artificial Sequence
  Description of Artificial Sequence: Synthetic oligonucleotide
gattctaatagtcggtctatt

SEQ ID NO: 20097 - DNA, 21 bp, Artificial Sequence
  Description of Artificial Sequence: Synthetic oligonucleotide
tctggtgcgaataattcttcg

SEQ ID NO: 20098 - DNA, 21 bp, Artificial Sequence
  Description of Artificial Sequence: Synthetic oligonucleotide
gttgggggtcctgctcctaat

SEQ ID NO: 20099 - DNA, 21 bp, Artificial Sequence
  Description of Artificial Sequence: Synthetic oligonucleotide
aacggcacccaaaccagcaga

SEQ ID NO: 20100 - DNA, 21 bp, Artificial Sequence
  Description of Artificial Sequence: Synthetic oligonucleotide
tctgctgattcgaataggagt

SEQ ID NO: 20101 - DNA, 21 bp, Artificial Sequence
  Description of Artificial Sequence: Synthetic oligonucleotide
ggccaaaacaaaaccaaccac

SEQ ID NO: 20102 - DNA, 21 bp, Artificial Sequence
  Description of Artificial Sequence: Synthetic oligonucleotide
aacagcggcaacgaaaacaga

SEQ ID NO: 20103 - DNA, 21 bp, Artificial Sequence
  Description of Artificial Sequence: Synthetic oligonucleotide
agcagcgccggcgccaccagc

SEQ ID NO: 20104 - DNA, 21 bp, Artificial Sequence
  Description of Artificial Sequence: Synthetic oligonucleotide
agccccgtcgaaagcagcaga

SEQ ID NO: 20105 - DNA, 21 bp, Artificial Sequence
  Description of Artificial Sequence: Synthetic oligonucleotide
gccggcagcagagaaagcacc

SEQ ID NO: 20106 - DNA, 21 bp, Artificial Sequence
  Description of Artificial Sequence: Synthetic oligonucleotide
tcgcagccgcctacggggaag

SEQ ID NO: 20107 - DNA, 21 bp, Artificial Sequence
  Description of Artificial Sequence: Synthetic oligonucleotide
tctgcgggtagttcgattagt

SEQ ID NO: 20108 - DNA, 21 bp, Artificial Sequence
  Description of Artificial Sequence: Synthetic oligonucleotide
tctggtcagagtgataagaat

SEQ ID NO: 20109 - DNA, 21 bp, Artificial Sequence
  Description of Artificial Sequence: Synthetic oligonucleotide
actcatacggctactagttcg

SEQ ID NO: 20110 - DNA, 21 bp, Artificial Sequence
  Description of Artificial Sequence: Synthetic oligonucleotide
agcaccgcccaaagaagcgaa

SEQ ID NO: 20111 - DNA, 21 bp, Artificial Sequence
  Description of Artificial Sequence: Synthetic oligonucleotide
ggtaaggagacgcagagtgtt

SEQ ID NO: 20112 - DNA, 21 bp, Artificial Sequence
  Description of Artificial Sequence: Synthetic oligonucleotide
gtgtcgggggagcattctcag

SEQ ID NO: 20113 - DNA, 21 bp, Artificial Sequence
  Description of Artificial Sequence: Synthetic oligonucleotide
tcgtatgggaagacgggtagt

SEQ ID NO: 20114 - DNA, 21 bp, Artificial Sequence
  Description of Artificial Sequence: Synthetic oligonucleotide
cagcagacgtcggatcatcgg

SEQ ID NO: 20115 - DNA, 21 bp, Artificial Sequence
  Description of Artificial Sequence: Synthetic oligonucleotide
acgcggggtaatcctgggacg

SEQ ID NO: 20116 - DNA, 21 bp, Artificial Sequence
  Description of Artificial Sequence: Synthetic oligonucleotide
caaaccagcggcaaaagcaac

SEQ ID NO: 20117 - DNA, 21 bp, Artificial Sequence
  Description of Artificial Sequence: Synthetic oligonucleotide
atgggcaacaacacccccagc

SEQ ID NO: 20118 - DNA, 21 bp, Artificial Sequence
  Description of Artificial Sequence: Synthetic oligonucleotide
catggtgttagtacgtcgaat

SEQ ID NO: 20119 - DNA, 21 bp, Artificial Sequence
  Description of Artificial Sequence: Synthetic oligonucleotide
cagggtcatactaatgggaag

SEQ ID NO: 20120 - DNA, 21 bp, Artificial Sequence
  Description of Artificial Sequence: Synthetic oligonucleotide
gtggtgacgggttcgtctaag

SEQ ID NO: 20121 - DNA, 21 bp, Artificial Sequence
  Description of Artificial Sequence: Synthetic oligonucleotide
tctgctgatcgttctggtaag

SEQ ID NO: 20122 - DNA, 21 bp, Artificial Sequence
  Description of Artificial Sequence: Synthetic oligonucleotide
tgtgatgctaagaatacgggt

SEQ ID NO: 20123 - DNA, 21 bp, Artificial Sequence
  Description of Artificial Sequence: Synthetic oligonucleotide
ggcaccaccaaagaacactac

SEQ ID NO: 20124 - DNA, 21 bp, Artificial Sequence
  Description of Artificial Sequence: Synthetic oligonucleotide
atgccgtcgaaggttgcgtct

SEQ ID NO: 20125 - DNA, 21 bp, Artificial Sequence
  Description of Artificial Sequence: Synthetic oligonucleotide
aacggttctggacagaagtta

SEQ ID NO: 20126 - DNA, 21 bp, Artificial Sequence
  Description of Artificial Sequence: Synthetic oligonucleotide
agtgggcttacggataagaag

SEQ ID NO: 20127 - DNA, 21 bp, Artificial Sequence
  Description of Artificial Sequence: Synthetic oligonucleotide
gaaaacgtcagcggcatcaaa

SEQ ID NO: 20128 - DNA, 21 bp, Artificial Sequence
  Description of Artificial Sequence: Synthetic oligonucleotide
gccggcagcagcggcaaaacc

SEQ ID NO: 20129 - DNA, 21 bp, Artificial Sequence
  Description of Artificial Sequence: Synthetic oligonucleotide
gggatgaagcagacttcgact

SEQ ID NO: 20130 - DNA, 21 bp, Artificial Sequence
  Description of Artificial Sequence: Synthetic oligonucleotide
agcgccgcccaacaaggcaac

SEQ ID NO: 20131 - DNA, 21 bp, Artificial Sequence
  Description of Artificial Sequence: Synthetic oligonucleotide
agcggcgaccaacacagcaga

SEQ ID NO: 20132 - DNA, 21 bp, Artificial Sequence
  Description of Artificial Sequence: Synthetic oligonucleotide
gtttcgaattctaagtcggag

SEQ ID NO: 20133 - DNA, 21 bp, Artificial Sequence
  Description of Artificial Sequence: Synthetic oligonucleotide
accatgagccccagcggccac

SEQ ID NO: 20134 - DNA, 21 bp, Artificial Sequence
  Description of Artificial Sequence: Synthetic oligonucleotide
agcctcaccaaaggcgtcggc

SEQ ID NO: 20135 - DNA, 21 bp, Artificial Sequence
  Description of Artificial Sequence: Synthetic oligonucleotide
agcggcaccggcgaacccaga

SEQ ID NO: 20136 - DNA, 21 bp, Artificial Sequence
  Description of Artificial Sequence: Synthetic oligonucleotide
cacggcaccagccccagcatg

SEQ ID NO: 20137 - DNA, 21 bp, Artificial Sequence
  Description of Artificial Sequence: Synthetic oligonucleotide
ggcgccaaaggcagcaacctc

SEQ ID NO: 20138 - DNA, 21 bp, Artificial Sequence
  Description of Artificial Sequence: Synthetic oligonucleotide
gggtctggtagtagtgcgcag

SEQ ID NO: 20139 - DNA, 21 bp, Artificial Sequence
  Description of Artificial Sequence: Synthetic oligonucleotide
actctttcgcagccgaatacg

SEQ ID NO: 20140 - DNA, 21 bp, Artificial Sequence
  Description of Artificial Sequence: Synthetic oligonucleotide
accacccacaaccccagccaa

SEQ ID NO: 20141 - DNA, 21 bp, Artificial Sequence
  Description of Artificial Sequence: Synthetic oligonucleotide
agcatcaaccaacaaggcaaa

SEQ ID NO: 20142 - DNA, 21 bp, Artificial Sequence
  Description of Artificial Sequence: Synthetic oligonucleotide
acccaaaacagcagagcccaa

SEQ ID NO: 20143 - DNA, 21 bp, Artificial Sequence
  Description of Artificial Sequence: Synthetic oligonucleotide
cagtcggatattaaggtgaat

SEQ ID NO: 20144 - DNA, 21 bp, Artificial Sequence
  Description of Artificial Sequence: Synthetic oligonucleotide
cttgggacttcgtctaatggg

SEQ ID NO: 20145 - DNA, 21 bp, Artificial Sequence
  Description of Artificial Sequence: Synthetic oligonucleotide
agcagcggcaaaaccctcacc

SEQ ID NO: 20146 - DNA, 21 bp, Artificial Sequence
  Description of Artificial Sequence: Synthetic oligonucleotide
acggttgcttcgactaatgcg

SEQ ID NO: 20147 - DNA, 21 bp, Artificial Sequence
  Description of Artificial Sequence: Synthetic oligonucleotide
gaggtgactaagacgggtttg

SEQ ID NO: 20148 - DNA, 21 bp, Artificial Sequence
  Description of Artificial Sequence: Synthetic oligonucleotide
gccgtcgacaacaaaaacagc

SEQ ID NO: 20149 - DNA, 21 bp, Artificial Sequence
  Description of Artificial Sequence: Synthetic oligonucleotide
ggtagggatagttcgcctaat

SEQ ID NO: 20150 - DNA, 21 bp, Artificial Sequence
  Description of Artificial Sequence: Synthetic oligonucleotide
gttactggtccttcgacgagt

SEQ ID NO: 20151 - DNA, 21 bp, Artificial Sequence
  Description of Artificial Sequence: Synthetic oligonucleotide
acgactggtactccgtcgggt

SEQ ID NO: 20152 - DNA, 21 bp, Artificial Sequence
  Description of Artificial Sequence: Synthetic oligonucleotide
agcaaagaaggcaaaccccac

SEQ ID NO: 20153 - DNA, 21 bp, Artificial Sequence
  Description of Artificial Sequence: Synthetic oligonucleotide
ctcaccaacaccaccagccaa

SEQ ID NO: 20154 - DNA, 21 bp, Artificial Sequence
  Description of Artificial Sequence: Synthetic oligonucleotide
gccagagacagcaaagcccaa

SEQ ID NO: 20155 - DNA, 21 bp, Artificial Sequence
  Description of Artificial Sequence: Synthetic oligonucleotide
gatcgtccgactcatcagtct

SEQ ID NO: 20156 - DNA, 21 bp, Artificial Sequence
  Description of Artificial Sequence: Synthetic oligonucleotide
gaaggcagacccaccagcagc

SEQ ID NO: 20157 - DNA, 21 bp, Artificial Sequence
  Description of Artificial Sequence: Synthetic oligonucleotide
tcgattggttctactaatgct

SEQ ID NO: 20158 - DNA, 21 bp, Artificial Sequence
  Description of Artificial Sequence: Synthetic oligonucleotide
tcggagagtgatccgaggaag

SEQ ID NO: 20159 - DNA, 21 bp, Artificial Sequence
  Description of Artificial Sequence: Synthetic oligonucleotide
aacagccaaacccacagcggc

SEQ ID NO: 20160 - DNA, 21 bp, Artificial Sequence
  Description of Artificial Sequence: Synthetic oligonucleotide
agcggcaaaagcgacttcagc

SEQ ID NO: 20161 - DNA, 21 bp, Artificial Sequence
  Description of Artificial Sequence: Synthetic oligonucleotide
atgtcgggtccttcgaatagt

SEQ ID NO: 20162 - DNA, 21 bp, Artificial Sequence
  Description of Artificial Sequence: Synthetic oligonucleotide
caaaaagccgacagcgtcaac

SEQ ID NO: 20163 - DNA, 21 bp, Artificial Sequence
  Description of Artificial Sequence: Synthetic oligonucleotide
gctactgcgcctttgaagaat

SEQ ID NO: 20164 - DNA, 21 bp, Artificial Sequence
  Description of Artificial Sequence: Synthetic oligonucleotide
accagcgacgccaaactcgtc

SEQ ID NO: 20165 - DNA, 21 bp, Artificial Sequence
  Description of Artificial Sequence: Synthetic oligonucleotide
ggttcgggttcgggttcttcg

SEQ ID NO: 20166 - DNA, 21 bp, Artificial Sequence
  Description of Artificial Sequence: Synthetic oligonucleotide
acgcagggtgatagggctggt

SEQ ID NO: 20167 - DNA, 21 bp, Artificial Sequence
  Description of Artificial Sequence: Synthetic oligonucleotide
actcgggagacggatgtgcgt

SEQ ID NO: 20168 - DNA, 21 bp, Artificial Sequence
  Description of Artificial Sequence: Synthetic oligonucleotide
gatcgtgctactagttctcat

SEQ ID NO: 20169 - DNA, 21 bp, Artificial Sequence
  Description of Artificial Sequence: Synthetic oligonucleotide
cagcctaataatgctcaggtt

SEQ ID NO: 20170 - DNA, 21 bp, Artificial Sequence
  Description of Artificial Sequence: Synthetic oligonucleotide
gaccccgccaaaagcgccgtc

SEQ ID NO: 20171 - DNA, 21 bp, Artificial Sequence
  Description of Artificial Sequence: Synthetic oligonucleotide
ggttctggtaaggggggtaat

SEQ ID NO: 20172 - DNA, 21 bp, Artificial Sequence
  Description of Artificial Sequence: Synthetic oligonucleotide
aaaagaagcgacaccaccacc

SEQ ID NO: 20173 - DNA, 21 bp, Artificial Sequence
  Description of Artificial Sequence: Synthetic oligonucleotide
aaggattctggggggaattcg

SEQ ID NO: 20174 - DNA, 21 bp, Artificial Sequence
  Description of Artificial Sequence: Synthetic oligonucleotide
actgtgagtccgtcgcatcag

SEQ ID NO: 20175 - DNA, 21 bp, Artificial Sequence
  Description of Artificial Sequence: Synthetic oligonucleotide
agcagccccggcaaagaccaa

SEQ ID NO: 20176 - DNA, 21 bp, Artificial Sequence
  Description of Artificial Sequence: Synthetic oligonucleotide
agccaaacccccggcaaccaa

SEQ ID NO: 20177 - DNA, 21 bp, Artificial Sequence
  Description of Artificial Sequence: Synthetic oligonucleotide
cacaacgccagcaaaatcgaa

SEQ ID NO: 20178 - DNA, 21 bp, Artificial Sequence
  Description of Artificial Sequence: Synthetic oligonucleotide
cagcgtgattcttcgcctgtt

SEQ ID NO: 20179 - DNA, 21 bp, Artificial Sequence
  Description of Artificial Sequence: Synthetic oligonucleotide
gaggcgactgcgaatacgaag

SEQ ID NO: 20180 - DNA, 21 bp, Artificial Sequence
  Description of Artificial Sequence: Synthetic oligonucleotide
ggcttcggccaaagcaaagcc

SEQ ID NO: 20181 - DNA, 21 bp, Artificial Sequence
  Description of Artificial Sequence: Synthetic oligonucleotide
aattctaaggcgactcagtcg

SEQ ID NO: 20182 - DNA, 21 bp, Artificial Sequence
  Description of Artificial Sequence: Synthetic oligonucleotide
actcctgctccttctcttact

SEQ ID NO: 20183 - DNA, 21 bp, Artificial Sequence
  Description of Artificial Sequence: Synthetic oligonucleotide
gaagccagcgtcaaaggcctc

SEQ ID NO: 20184 - DNA, 21 bp, Artificial Sequence
  Description of Artificial Sequence: Synthetic oligonucleotide
gttaatacgcctccgagtaag

SEQ ID NO: 20185 - DNA, 21 bp, Artificial Sequence
  Description of Artificial Sequence: Synthetic oligonucleotide
gccaacgccgtccccgccgcc

SEQ ID NO: 20186 - DNA, 21 bp, Artificial Sequence
  Description of Artificial Sequence: Synthetic oligonucleotide
gtgacgggtactcctattgct

SEQ ID NO: 20187 - DNA, 21 bp, Artificial Sequence
  Description of Artificial Sequence: Synthetic oligonucleotide
accgtcgacaaagccgccagc

SEQ ID NO: 20188 - DNA, 21 bp, Artificial Sequence
  Description of Artificial Sequence: Synthetic oligonucleotide
acggggtctgggactcctact

SEQ ID NO: 20189 - DNA, 21 bp, Artificial Sequence
  Description of Artificial Sequence: Synthetic oligonucleotide
ggccaaaacagcagcatccaa

SEQ ID NO: 20190 - DNA, 21 bp, Artificial Sequence
  Description of Artificial Sequence: Synthetic oligonucleotide
gttccgaatgatcatccggtg

SEQ ID NO: 20191 - DNA, 21 bp, Artificial Sequence
  Description of Artificial Sequence: Synthetic oligonucleotide
cacggcgacacccccaccaaa

SEQ ID NO: 20192 - DNA, 21 bp, Artificial Sequence
  Description of Artificial Sequence: Synthetic oligonucleotide
gcgggtaatggtccgacttcg

SEQ ID NO: 20193 - DNA, 21 bp, Artificial Sequence
  Description of Artificial Sequence: Synthetic oligonucleotide
ggcatgaaaaacgcccccacc

SEQ ID NO: 20194 - DNA, 21 bp, Artificial Sequence
  Description of Artificial Sequence: Synthetic oligonucleotide
ggtcttaagccttctgataag

SEQ ID NO: 20195 - DNA, 21 bp, Artificial Sequence
  Description of Artificial Sequence: Synthetic oligonucleotide
actgcgcagtcttcttcgcat

SEQ ID NO: 20196 - DNA, 21 bp, Artificial Sequence
  Description of Artificial Sequence: Synthetic oligonucleotide
agtgggcaggggactattttg

SEQ ID NO: 20197 - DNA, 21 bp, Artificial Sequence
  Description of Artificial Sequence: Synthetic oligonucleotide
ctcggcggcagcagcaccacc

SEQ ID NO: 20198 - DNA, 21 bp, Artificial Sequence
  Description of Artificial Sequence: Synthetic oligonucleotide
ctgacgagtgataaggcgtcg

SEQ ID NO: 20199 - DNA, 21 bp, Artificial Sequence
  Description of Artificial Sequence: Synthetic oligonucleotide
aacaccaccgaccacaacaga

SEQ ID NO: 20200 - DNA, 21 bp, Artificial Sequence
  Description of Artificial Sequence: Synthetic oligonucleotide
caaagagtcaacagcagcgcc

SEQ ID NO: 20201 - DNA, 21 bp, Artificial Sequence
  Description of Artificial Sequence: Synthetic oligonucleotide
acggctgatagggtgggtcat

SEQ ID NO: 20202 - DNA, 21 bp, Artificial Sequence
  Description of Artificial Sequence: Synthetic oligonucleotide
agcaccggcgccagcaacggc

SEQ ID NO: 20203 - DNA, 21 bp, Artificial Sequence
  Description of Artificial Sequence: Synthetic oligonucleotide
agcggcatcgccagcaccgcc

SEQ ID NO: 20204 - DNA, 21 bp, Artificial Sequence
  Description of Artificial Sequence: Synthetic oligonucleotide
agtgctccgggtacttcttct

SEQ ID NO: 20205 - DNA, 21 bp, Artificial Sequence
  Description of Artificial Sequence: Synthetic oligonucleotide
ggcagcggcagcaacggcagc

SEQ ID NO: 20206 - DNA, 21 bp, Artificial Sequence
  Description of Artificial Sequence: Synthetic oligonucleotide
agtagttctagtacgccgtcg

SEQ ID NO: 20207 - DNA, 21 bp, Artificial Sequence
  Description of Artificial Sequence: Synthetic oligonucleotide
gcttcggttgatagtaagtct

SEQ ID NO: 20208 - DNA, 21 bp, Artificial Sequence
  Description of Artificial Sequence: Synthetic oligonucleotide
accagcaacggcagcctcacc

SEQ ID NO: 20209 - DNA, 21 bp, Artificial Sequence
  Description of Artificial Sequence: Synthetic oligonucleotide
agacaagaaagcagcaaagac

SEQ ID NO: 20210 - DNA, 21 bp, Artificial Sequence
  Description of Artificial Sequence: Synthetic oligonucleotide
agcggcaacagccccaacaaa

SEQ ID NO: 20211 - DNA, 21 bp, Artificial Sequence
  Description of Artificial Sequence: Synthetic oligonucleotide
atgggcgaaaaaagcaccccc

SEQ ID NO: 20212 - DNA, 21 bp, Artificial Sequence
  Description of Artificial Sequence: Synthetic oligonucleotide
ggggcgcatcagccttctagt

SEQ ID NO: 20213 - DNA, 21 bp, Artificial Sequence
  Description of Artificial Sequence: Synthetic oligonucleotide
tcgacgactacggctaatact

SEQ ID NO: 20214 - DNA, 21 bp, Artificial Sequence
  Description of Artificial Sequence: Synthetic oligonucleotide
gagcgtactgatcgtccgggg

SEQ ID NO: 20215 - DNA, 21 bp, Artificial Sequence
  Description of Artificial Sequence: Synthetic oligonucleotide
ggcgtcggccaagccagcagc

SEQ ID NO: 20216 - DNA, 21 bp, Artificial Sequence
  Description of Artificial Sequence: Synthetic oligonucleotide
accggcgtcaaagacagaccc

SEQ ID NO: 20217 - DNA, 21 bp, Artificial Sequence
  Description of Artificial Sequence: Synthetic oligonucleotide
aagtcgggtactccgcctgtt

SEQ ID NO: 20218 - DNA, 21 bp, Artificial Sequence
  Description of Artificial Sequence: Synthetic oligonucleotide
accagagaaaccgccaccagc

SEQ ID NO: 20219 - DNA, 21 bp, Artificial Sequence
  Description of Artificial Sequence: Synthetic oligonucleotide
caaaaaagcaaagaccaagcc

SEQ ID NO: 20220 - DNA, 21 bp, Artificial Sequence
  Description of Artificial Sequence: Synthetic oligonucleotide
gataaggggaatggtcagttg

SEQ ID NO: 20221 - DNA, 21 bp, Artificial Sequence
  Description of Artificial Sequence: Synthetic oligonucleotide
ggccccgacagcaacaaaagc

SEQ ID NO: 20222 - DNA, 21 bp, Artificial Sequence
  Description of Artificial Sequence: Synthetic oligonucleotide
gaaaccaccagcaaccccaga

SEQ ID NO: 20223 - DNA, 21 bp, Artificial Sequence
  Description of Artificial Sequence: Synthetic oligonucleotide
agcggcaccccccccgccagc

SEQ ID NO: 20224 - DNA, 21 bp, Artificial Sequence
  Description of Artificial Sequence: Synthetic oligonucleotide
agcggcagcggccaccaaagc

SEQ ID NO: 20225 - DNA, 21 bp, Artificial Sequence
  Description of Artificial Sequence: Synthetic oligonucleotide
gctgggtctcagtcgcctctg

SEQ ID NO: 20226 - DNA, 21 bp, Artificial Sequence
  Description of Artificial Sequence: Synthetic oligonucleotide
ggcgccagcagcaaccaaaac

SEQ ID NO: 20227 - DNA, 21 bp, Artificial Sequence
  Description of Artificial Sequence: Synthetic oligonucleotide
tttacggggaaggagtcggtt

SEQ ID NO: 20228 - DNA, 21 bp, Artificial Sequence
  Description of Artificial Sequence: Synthetic oligonucleotide
aatacgccggctaagcctacg

SEQ ID NO: 20229 - DNA, 21 bp, Artificial Sequence
  Description of Artificial Sequence: Synthetic oligonucleotide
atgcctgatcgttctgggagt

SEQ ID NO: 20230 - DNA, 21 bp, Artificial Sequence
  Description of Artificial Sequence: Synthetic oligonucleotide
caaaacaacagccacagcgcc

SEQ ID NO: 20231 - DNA, 21 bp, Artificial Sequence
  Description of Artificial Sequence: Synthetic oligonucleotide
gccagcagcggccaacacccc

SEQ ID NO: 20232 - DNA, 21 bp, Artificial Sequence
  Description of Artificial Sequence: Synthetic oligonucleotide
ggcggccaagacgacagaaaa

SEQ ID NO: 20233 - DNA, 21 bp, Artificial Sequence
  Description of Artificial Sequence: Synthetic oligonucleotide
aatacgagtagtaagtcgggg

SEQ ID NO: 20234 - DNA, 21 bp, Artificial Sequence
  Description of Artificial Sequence: Synthetic oligonucleotide
gtttctgataagagtgtgagt

SEQ ID NO: 20235 - DNA, 21 bp, Artificial Sequence
  Description of Artificial Sequence: Synthetic oligonucleotide
ggcagcgaaggcaccaacagc

SEQ ID NO: 20236 - DNA, 21 bp, Artificial Sequence
  Description of Artificial Sequence: Synthetic oligonucleotide
aatgttggtggggggtctggg

SEQ ID NO: 20237 - DNA, 21 bp, Artificial Sequence
  Description of Artificial Sequence: Synthetic oligonucleotide
gaaaccagcagcacccccagc

SEQ ID NO: 20238 - DNA, 21 bp, Artificial Sequence
  Description of Artificial Sequence: Synthetic oligonucleotide
ggcggccccaccgaacccaaa

SEQ ID NO: 20239 - DNA, 21 bp, Artificial Sequence
  Description of Artificial Sequence: Synthetic oligonucleotide
gttactgataagtcgagtaat

SEQ ID NO: 20240 - DNA, 21 bp, Artificial Sequence
  Description of Artificial Sequence: Synthetic oligonucleotide
caaatgggcgccacccccaac

SEQ ID NO: 20241 - DNA, 21 bp, Artificial Sequence
  Description of Artificial Sequence: Synthetic oligonucleotide
actccgtcgtcttctactacg

SEQ ID NO: 20242 - DNA, 21 bp, Artificial Sequence
  Description of Artificial Sequence: Synthetic oligonucleotide
gacaacatgagcaaacaactc

SEQ ID NO: 20243 - DNA, 21 bp, Artificial Sequence
  Description of Artificial Sequence: Synthetic oligonucleotide
gagactcagaggccgaatgcg

SEQ ID NO: 20244 - DNA, 21 bp, Artificial Sequence
  Description of Artificial Sequence: Synthetic oligonucleotide
aacggcgtcaccaacaacaga

SEQ ID NO: 20245 - DNA, 21 bp, Artificial Sequence
  Description of Artificial Sequence: Synthetic oligonucleotide
tctctgaatggttctaggggt

SEQ ID NO: 20246 - DNA, 21 bp, Artificial Sequence
  Description of Artificial Sequence: Synthetic oligonucleotide
aacggcctcaacgtcaaaggc

SEQ ID NO: 20247 - DNA, 21 bp, Artificial Sequence
  Description of Artificial Sequence: Synthetic oligonucleotide
accggcgaaagccaagtcaaa

SEQ ID NO: 20248 - DNA, 21 bp, Artificial Sequence
  Description of Artificial Sequence: Synthetic oligonucleotide
accggcggcagcagcaccctc

SEQ ID NO: 20249 - DNA, 21 bp, Artificial Sequence
  Description of Artificial Sequence: Synthetic oligonucleotide
gaaagagccacccacacccaa

SEQ ID NO: 20250 - DNA, 21 bp, Artificial Sequence
  Description of Artificial Sequence: Synthetic oligonucleotide
agcagcacccccagagtcgcc

SEQ ID NO: 20251 - DNA, 21 bp, Artificial Sequence
  Description of Artificial Sequence: Synthetic oligonucleotide
agcagcagccccaccaaccac

SEQ ID NO: 20252 - DNA, 21 bp, Artificial Sequence
  Description of Artificial Sequence: Synthetic oligonucleotide
acggtgaattcgggttctggt

SEQ ID NO: 20253 - DNA, 21 bp, Artificial Sequence
  Description of Artificial Sequence: Synthetic oligonucleotide
cacgccggcaacgcccccgtc

SEQ ID NO: 20254 - DNA, 21 bp, Artificial Sequence
  Description of Artificial Sequence: Synthetic oligonucleotide
ggtcaggctgagactttgaag

SEQ ID NO: 20255 - DNA, 21 bp, Artificial Sequence
  Description of Artificial Sequence: Synthetic oligonucleotide
ggtgcgaagtcgcaggcggtt

SEQ ID NO: 20256 - DNA, 21 bp, Artificial Sequence
  Description of Artificial Sequence: Synthetic oligonucleotide
accctcagcgacagaggcagc

SEQ ID NO: 20257 - DNA, 21 bp, Artificial Sequence
  Description of Artificial Sequence: Synthetic oligonucleotide
tcggggacgtcgcatactcag

SEQ ID NO: 20258 - DNA, 21 bp, Artificial Sequence
  Description of Artificial Sequence: Synthetic oligonucleotide
agagaaggcgccccccccgcc

SEQ ID NO: 20259 - DNA, 21 bp, Artificial Sequence
  Description of Artificial Sequence: Synthetic oligonucleotide
acggctactacgactggttct

SEQ ID NO: 20260 - DNA, 21 bp, Artificial Sequence
  Description of Artificial Sequence: Synthetic oligonucleotide
caaggccaaaaccaaaccaga

SEQ ID NO: 20261 - DNA, 21 bp, Artificial Sequence
  Description of Artificial Sequence: Synthetic oligonucleotide
ctcgaccccagcaaaagcagc

SEQ ID NO: 20262 - DNA, 21 bp, Artificial Sequence
  Description of Artificial Sequence: Synthetic oligonucleotide
gacaccaaccacagcaccaaa

SEQ ID NO: 20263 - DNA, 21 bp, Artificial Sequence
  Description of Artificial Sequence: Synthetic oligonucleotide
ggggagaagagttcgctttcg

SEQ ID NO: 20264 - DNA, 21 bp, Artificial Sequence
  Description of Artificial Sequence: Synthetic oligonucleotide
agccacagcaacaacggcagc

SEQ ID NO: 20265 - DNA, 21 bp, Artificial Sequence
  Description of Artificial Sequence: Synthetic oligonucleotide
tctcaggttaagccaacgagt

SEQ ID NO: 20266 - DNA, 21 bp, Artificial Sequence
  Description of Artificial Sequence: Synthetic oligonucleotide
gcgtcgaaggagcgtaatatg

SEQ ID NO: 20267 - DNA, 21 bp, Artificial Sequence
  Description of Artificial Sequence: Synthetic oligonucleotide
accgccaacagcgccagcacc

SEQ ID NO: 20268 - DNA, 21 bp, Artificial Sequence
  Description of Artificial Sequence: Synthetic oligonucleotide
agaggcctccccgacaaaaac

SEQ ID NO: 20269 - DNA, 21 bp, Artificial Sequence
  Description of Artificial Sequence: Synthetic oligonucleotide
aatgcttcggatcggggtggt

SEQ ID NO: 20270 - DNA, 21 bp, Artificial Sequence
  Description of Artificial Sequence: Synthetic oligonucleotide
agcgccaacagcaaactcggc

SEQ ID NO: 20271 - DNA, 21 bp, Artificial Sequence
  Description of Artificial Sequence: Synthetic oligonucleotide
ctttctgatgggaagggtaat

SEQ ID NO: 20272 - DNA, 21 bp, Artificial Sequence
  Description of Artificial Sequence: Synthetic oligonucleotide
ggcggcaaaagccacggcggc

SEQ ID NO: 20273 - DNA, 21 bp, Artificial Sequence
  Description of Artificial Sequence: Synthetic oligonucleotide
ggtgataataagttgaatcag

SEQ ID NO: 20274 - DNA, 21 bp, Artificial Sequence
  Description of Artificial Sequence: Synthetic oligonucleotide
tgttcgggtcagtcgaataag

SEQ ID NO: 20275 - DNA, 21 bp, Artificial Sequence
  Description of Artificial Sequence: Synthetic oligonucleotide
ttggtgacgaaggctagtcag

SEQ ID NO: 20276 - DNA, 21 bp, Artificial Sequence
  Description of Artificial Sequence: Synthetic oligonucleotide
agcaccagaaccgacaacaga

SEQ ID NO: 20277 - DNA, 21 bp, Artificial Sequence
  Description of Artificial Sequence: Synthetic oligonucleotide
ggcaaaaacaccgccgccgtc

SEQ ID NO: 20278 - DNA, 21 bp, Artificial Sequence
  Description of Artificial Sequence: Synthetic oligonucleotide
actaatgggactcatgcgggt

SEQ ID NO: 20279 - DNA, 21 bp, Artificial Sequence
  Description of Artificial Sequence: Synthetic oligonucleotide
actgggtctggggttaagagt

SEQ ID NO: 20280 - DNA, 21 bp, Artificial Sequence
  Description of Artificial Sequence: Synthetic oligonucleotide
agcgacaaagccaccgacaga

SEQ ID NO: 20281 - DNA, 21 bp, Artificial Sequence
  Description of Artificial Sequence: Synthetic oligonucleotide
gaccaaagcgccgccagaaac

SEQ ID NO: 20282 - DNA, 21 bp, Artificial Sequence
  Description of Artificial Sequence: Synthetic oligonucleotide
ggcagaagcaccgacgtcaaa

SEQ ID NO: 20283 - DNA, 21 bp, Artificial Sequence
  Description of Artificial Sequence: Synthetic oligonucleotide
gtcgccaacagcagcaccgcc

SEQ ID NO: 20284 - DNA, 21 bp, Artificial Sequence
  Description of Artificial Sequence: Synthetic oligonucleotide
gcgcagaagtctagtgtgaat

SEQ ID NO: 20285 - DNA, 21 bp, Artificial Sequence
  Description of Artificial Sequence: Synthetic oligonucleotide
aacaccagcggcaaaggcctc

SEQ ID NO: 20286 - DNA, 21 bp, Artificial Sequence
  Description of Artificial Sequence: Synthetic oligonucleotide
agcggcaacaacgtcaccagc

SEQ ID NO: 20287 - DNA, 21 bp, Artificial Sequence
  Description of Artificial Sequence: Synthetic oligonucleotide
atgggcagcggcgccaaagaa

SEQ ID NO: 20288 - DNA, 21 bp, Artificial Sequence
  Description of Artificial Sequence: Synthetic oligonucleotide
aattctatcggtaagtctgat

SEQ ID NO: 20289 - DNA, 21 bp, Artificial Sequence
  Description of Artificial Sequence: Synthetic oligonucleotide
agtcgggattctggtgcgctg

SEQ ID NO: 20290 - DNA, 21 bp, Artificial Sequence
  Description of Artificial Sequence: Synthetic oligonucleotide
gacagctacgccgacaaaaaa

SEQ ID NO: 20291 - DNA, 21 bp, Artificial Sequence
  Description of Artificial Sequence: Synthetic oligonucleotide
gcccacagcagcgccaccagc

SEQ ID NO: 20292 - DNA, 21 bp, Artificial Sequence
  Description of Artificial Sequence: Synthetic oligonucleotide
accgtcggcaacagccccacc

SEQ ID NO: 20293 - DNA, 21 bp, Artificial Sequence
  Description of Artificial Sequence: Synthetic oligonucleotide
gatgctgctaatccgcagaag

SEQ ID NO: 20294 - DNA, 21 bp, Artificial Sequence
  Description of Artificial Sequence: Synthetic oligonucleotide
tggggcaccgacagaagcagc

SEQ ID NO: 20295 - DNA, 21 bp, Artificial Sequence
  Description of Artificial Sequence: Synthetic oligonucleotide
cacaccgaaagcaaaatggcc

SEQ ID NO: 20296 - DNA, 21 bp, Artificial Sequence
  Description of Artificial Sequence: Synthetic oligonucleotide
gatacgaatccggcggttaag

SEQ ID NO: 20297 - DNA, 21 bp, Artificial Sequence
  Description of Artificial Sequence: Synthetic oligonucleotide
tcgactccgggtagttcttct

SEQ ID NO: 20298 - DNA, 21 bp, Artificial Sequence
  Description of Artificial Sequence: Synthetic oligonucleotide
acgccgaatcagacgcctact

SEQ ID NO: 20299 - DNA, 21 bp, Artificial Sequence
  Description of Artificial Sequence: Synthetic oligonucleotide
accagcctcggcggcaacgcc

SEQ ID NO: 20300 - DNA, 21 bp, Artificial Sequence
  Description of Artificial Sequence: Synthetic oligonucleotide
caacaaagcaccagcagcacc

SEQ ID NO: 20301 - DNA, 21 bp, Artificial Sequence
  Description of Artificial Sequence: Synthetic oligonucleotide
gacagaagcggccaaagcacc

SEQ ID NO: 20302 - DNA, 21 bp, Artificial Sequence
  Description of Artificial Sequence: Synthetic oligonucleotide
gacagcaccaaaggcagagac

SEQ ID NO: 20303 - DNA, 21 bp, Artificial Sequence
  Description of Artificial Sequence: Synthetic oligonucleotide
agtgatggtcatgcgaataat

SEQ ID NO: 20304 - DNA, 21 bp, Artificial Sequence
  Description of Artificial Sequence: Synthetic oligonucleotide
caaagagaccaacaaaacgcc

SEQ ID NO: 20305 - DNA, 21 bp, Artificial Sequence
  Description of Artificial Sequence: Synthetic oligonucleotide
gaaggcgtccacaccagcaac

SEQ ID NO: 20306 - DNA, 21 bp, Artificial Sequence
  Description of Artificial Sequence: Synthetic oligonucleotide
gacaaagtcagcagcaacgcc

SEQ ID NO: 20307 - DNA, 21 bp, Artificial Sequence
  Description of Artificial Sequence: Synthetic oligonucleotide
gattcggttaatgcgcgtagt

SEQ ID NO: 20308 - DNA, 21 bp, Artificial Sequence
  Description of Artificial Sequence: Synthetic oligonucleotide
ggtgtgtcgccttcggatagg

SEQ ID NO: 20309 - DNA, 21 bp, Artificial Sequence
  Description of Artificial Sequence: Synthetic oligonucleotide
agcagccaaagcagcgtcaaa

SEQ ID NO: 20310 - DNA, 21 bp, Artificial Sequence
  Description of Artificial Sequence: Synthetic oligonucleotide
agcagagccggcaccagcggc

SEQ ID NO: 20311 - DNA, 21 bp, Artificial Sequence
  Description of Artificial Sequence: Synthetic oligonucleotide
agcggcggcggcagaaacgac

SEQ ID NO: 20312 - DNA, 21 bp, Artificial Sequence
  Description of Artificial Sequence: Synthetic oligonucleotide
acttcggctactgcggttagt

SEQ ID NO: 20313 - DNA, 21 bp, Artificial Sequence
  Description of Artificial Sequence: Synthetic oligonucleotide
gacaaccaccccaaacccaac

SEQ ID NO: 20314 - DNA, 21 bp, Artificial Sequence
  Description of Artificial Sequence: Synthetic oligonucleotide
gcggcggtgaatccgaagggt

SEQ ID NO: 20315 - DNA, 21 bp, Artificial Sequence
  Description of Artificial Sequence: Synthetic oligonucleotide
aatcttacgaagccgggtagt

SEQ ID NO: 20316 - DNA, 21 bp, Artificial Sequence
  Description of Artificial Sequence: Synthetic oligonucleotide
agcagcagccccgccggcaga

SEQ ID NO: 20317 - DNA, 21 bp, Artificial Sequence
  Description of Artificial Sequence: Synthetic oligonucleotide
agtagtgggatgggtagtaag

SEQ ID NO: 20318 - DNA, 21 bp, Artificial Sequence
  Description of Artificial Sequence: Synthetic oligonucleotide
aacagccaaaccaccgtcgcc

SEQ ID NO: 20319 - DNA, 21 bp, Artificial Sequence
  Description of Artificial Sequence: Synthetic oligonucleotide
actggttctagtccgcttgtt

SEQ ID NO: 20320 - DNA, 21 bp, Artificial Sequence
  Description of Artificial Sequence: Synthetic oligonucleotide
gctgtggttaagagtccgatg

SEQ ID NO: 20321 - DNA, 21 bp, Artificial Sequence
  Description of Artificial Sequence: Synthetic oligonucleotide
ggcgacaaacccaacaccgcc

SEQ ID NO: 20322 - DNA, 21 bp, Artificial Sequence
  Description of Artificial Sequence: Synthetic oligonucleotide
cttcaggatagtccgtctaag

SEQ ID NO: 20323 - DNA, 21 bp, Artificial Sequence
  Description of Artificial Sequence: Synthetic oligonucleotide
actcctagtgataagattttg

SEQ ID NO: 20324 - DNA, 21 bp, Artificial Sequence
  Description of Artificial Sequence: Synthetic oligonucleotide
actgcggctagtccgagtaat

SEQ ID NO: 20325 - DNA, 21 bp, Artificial Sequence
  Description of Artificial Sequence: Synthetic oligonucleotide
agtgctgctcagacgtcgctg

SEQ ID NO: 20326 - DNA, 21 bp, Artificial Sequence
  Description of Artificial Sequence: Synthetic oligonucleotide
ggcaccgccggcgacaaacaa

SEQ ID NO: 20327 - DNA, 21 bp, Artificial Sequence
  Description of Artificial Sequence: Synthetic oligonucleotide
aaaaccaccgacagcaaaggc

SEQ ID NO: 20328 - DNA, 21 bp, Artificial Sequence
  Description of Artificial Sequence: Synthetic oligonucleotide
accagcagcgacctcagaaaa

SEQ ID NO: 20329 - DNA, 21 bp, Artificial Sequence
  Description of Artificial Sequence: Synthetic oligonucleotide
tctgtgtcgaaggagcgtgct

SEQ ID NO: 20330 - DNA, 21 bp, Artificial Sequence
  Description of Artificial Sequence: Synthetic oligonucleotide
agcaaaaccggcagcagcacc

SEQ ID NO: 20331 - DNA, 21 bp, Artificial Sequence
  Description of Artificial Sequence: Synthetic oligonucleotide
gctgggaatgggcagactatg

SEQ ID NO: 20332 - DNA, 21 bp, Artificial Sequence
  Description of Artificial Sequence: Synthetic oligonucleotide
tatgggcagacggtttctcag

SEQ ID NO: 20333 - DNA, 21 bp, Artificial Sequence
  Description of Artificial Sequence: Synthetic oligonucleotide
tcggatggtaatactacgaag

SEQ ID NO: 20334 - DNA, 21 bp, Artificial Sequence
  Description of Artificial Sequence: Synthetic oligonucleotide
actaaggctgctaatcaggcg

SEQ ID NO: 20335 - DNA, 21 bp, Artificial Sequence
  Description of Artificial Sequence: Synthetic oligonucleotide
gggcttggtaaggatactggt

SEQ ID NO: 20336 - DNA, 21 bp, Artificial Sequence
  Description of Artificial Sequence: Synthetic oligonucleotide
agcatgcccagcggcaaagaa

SEQ ID NO: 20337 - DNA, 21 bp, Artificial Sequence
  Description of Artificial Sequence: Synthetic oligonucleotide
attccgtctaatgctgggact

SEQ ID NO: 20338 - DNA, 21 bp, Artificial Sequence
  Description of Artificial Sequence: Synthetic oligonucleotide
gttagtgcgtcgggtattagt

SEQ ID NO: 20339 - DNA, 21 bp, Artificial Sequence
  Description of Artificial Sequence: Synthetic oligonucleotide
tcgacttcgcgggagagtact

SEQ ID NO: 20340 - DNA, 21 bp, Artificial Sequence
  Description of Artificial Sequence: Synthetic oligonucleotide
tcggagggtcagctttctaag

SEQ ID NO: 20341 - DNA, 21 bp, Artificial Sequence
  Description of Artificial Sequence: Synthetic oligonucleotide
tctcatgagaaggctagtggt

SEQ ID NO: 20342 - DNA, 21 bp, Artificial Sequence
  Description of Artificial Sequence: Synthetic oligonucleotide
accgtcgacagcaaaagctac

SEQ ID NO: 20343 - DNA, 21 bp, Artificial Sequence
  Description of Artificial Sequence: Synthetic oligonucleotide
agagtcggcgccaccaacgaa

SEQ ID NO: 20344 - DNA, 21 bp, Artificial Sequence
  Description of Artificial Sequence: Synthetic oligonucleotide
gtcagagaaagccccagccac

SEQ ID NO: 20345 - DNA, 21 bp, Artificial Sequence
  Description of Artificial Sequence: Synthetic oligonucleotide
agcagcaccagcgccaaagaa

SEQ ID NO: 20346 - DNA, 21 bp, Artificial Sequence
  Description of Artificial Sequence: Synthetic oligonucleotide
ggcgaccaccacggcagcggc

SEQ ID NO: 20347 - DNA, 21 bp, Artificial Sequence
  Description of Artificial Sequence: Synthetic oligonucleotide
ggcagcggcaacctcggcacc

SEQ ID NO: 20348 - DNA, 21 bp, Artificial Sequence
  Description of Artificial Sequence: Synthetic oligonucleotide
aattcgcctaattctagtggg

SEQ ID NO: 20349 - DNA, 21 bp, Artificial Sequence
  Description of Artificial Sequence: Synthetic oligonucleotide
attacgtcttctaatcctccg

SEQ ID NO: 20350 - DNA, 21 bp, Artificial Sequence
  Description of Artificial Sequence: Synthetic oligonucleotide
tcgacggctccggctgggact

SEQ ID NO: 20351 - DNA, 21 bp, Artificial Sequence
  Description of Artificial Sequence: Synthetic oligonucleotide
aaaagcaccagcggcagcgtc

SEQ ID NO: 20352 - DNA, 21 bp, Artificial Sequence
  Description of Artificial Sequence: Synthetic oligonucleotide
aacagcggcaacagcatgagc

SEQ ID NO: 20353 - DNA, 21 bp, Artificial Sequence
  Description of Artificial Sequence: Synthetic oligonucleotide
agcagcagcggcaacaacaga

SEQ ID NO: 20354 - DNA, 21 bp, Artificial Sequence
  Description of Artificial Sequence: Synthetic oligonucleotide
aacagaggcagccccagcgaa

SEQ ID NO: 20355 - DNA, 21 bp, Artificial Sequence
  Description of Artificial Sequence: Synthetic oligonucleotide
gaaatgagcagccccaacaga

SEQ ID NO: 20356 - DNA, 21 bp, Artificial Sequence
  Description of Artificial Sequence: Synthetic oligonucleotide
ggcggcaccagcaaaagagac

SEQ ID NO: 20357 - DNA, 21 bp, Artificial Sequence
  Description of Artificial Sequence: Synthetic oligonucleotide
aacctcagcaccagcagcgcc

SEQ ID NO: 20358 - DNA, 21 bp, Artificial Sequence
  Description of Artificial Sequence: Synthetic oligonucleotide
gatcgtgaggagcgtagtcat

SEQ ID NO: 20359 - DNA, 21 bp, Artificial Sequence
  Description of Artificial Sequence: Synthetic oligonucleotide
aacgccagcaccgcccccagc

SEQ ID NO: 20360 - DNA, 21 bp, Artificial Sequence
  Description of Artificial Sequence: Synthetic oligonucleotide
agcggcaccagcagcctcagc

SEQ ID NO: 20361 - DNA, 21 bp, Artificial Sequence
  Description of Artificial Sequence: Synthetic oligonucleotide
ggcgacggcaccgccagcaac

SEQ ID NO: 20362 - DNA, 21 bp, Artificial Sequence
  Description of Artificial Sequence: Synthetic oligonucleotide
agtgcgtcttcttctactgtt

SEQ ID NO: 20363 - DNA, 21 bp, Artificial Sequence
  Description of Artificial Sequence: Synthetic oligonucleotide
gggactgagaagccggcgcct

SEQ ID NO: 20364 - DNA, 21 bp, Artificial Sequence
  Description of Artificial Sequence: Synthetic oligonucleotide
aatccgagtactccgtcttcg

SEQ ID NO: 20365 - DNA, 21 bp, Artificial Sequence
  Description of Artificial Sequence: Synthetic oligonucleotide
agccaaggcagcgccctcctc

SEQ ID NO: 20366 - DNA, 21 bp, Artificial Sequence
  Description of Artificial Sequence: Synthetic oligonucleotide
caaggcgaaggcagaaccctc

SEQ ID NO: 20367 - DNA, 21 bp, Artificial Sequence
  Description of Artificial Sequence: Synthetic oligonucleotide
cacggcgacagaaccaccgtc

SEQ ID NO: 20368 - DNA, 21 bp, Artificial Sequence
  Description of Artificial Sequence: Synthetic oligonucleotide
ggcggcaacgaacacgccaga

SEQ ID NO: 20369 - DNA, 21 bp, Artificial Sequence
  Description of Artificial Sequence: Synthetic oligonucleotide
aatcagtctacgtcgggttcg

SEQ ID NO: 20370 - DNA, 21 bp, Artificial Sequence
  Description of Artificial Sequence: Synthetic oligonucleotide
catgggacgtctaatacgcgt

SEQ ID NO: 20371 - DNA, 21 bp, Artificial Sequence
  Description of Artificial Sequence: Synthetic oligonucleotide
gaaaccaaaaccggcagcgcc

SEQ ID NO: 20372 - DNA, 21 bp, Artificial Sequence
  Description of Artificial Sequence: Synthetic oligonucleotide
attaatgtgaagggtagtcag

SEQ ID NO: 20373 - DNA, 21 bp, Artificial Sequence
  Description of Artificial Sequence: Synthetic oligonucleotide
agcggcaacccccccggcatc

SEQ ID NO: 20374 - DNA, 21 bp, Artificial Sequence
  Description of Artificial Sequence: Synthetic oligonucleotide
gaggggtcgactcgtcctgag

SEQ ID NO: 20375 - DNA, 21 bp, Artificial Sequence
  Description of Artificial Sequence: Synthetic oligonucleotide
agcagcgacaacagacccacc

SEQ ID NO: 20376 - DNA, 21 bp, Artificial Sequence
  Description of Artificial Sequence: Synthetic oligonucleotide
ggcaacggcaccagaggcacc

SEQ ID NO: 20377 - DNA, 21 bp, Artificial Sequence
  Description of Artificial Sequence: Synthetic oligonucleotide
acggggagtcagggtaatatt

SEQ ID NO: 20378 - DNA, 21 bp, Artificial Sequence
  Description of Artificial Sequence: Synthetic oligonucleotide
tctgaggataggaagagtcct

SEQ ID NO: 20379 - DNA, 21 bp, Artificial Sequence
  Description of Artificial Sequence: Synthetic oligonucleotide
gttacttcggataagtctctg

SEQ ID NO: 20380 - DNA, 21 bp, Artificial Sequence
  Description of Artificial Sequence: Synthetic oligonucleotide
agtaatggtcagagtaatggt

SEQ ID NO: 20381 - DNA, 21 bp, Artificial Sequence
  Description of Artificial Sequence: Synthetic oligonucleotide
aaagccagcaccgacaacaaa

SEQ ID NO: 20382 - DNA, 21 bp, Artificial Sequence
  Description of Artificial Sequence: Synthetic oligonucleotide
aacaacagcagcagaaacctc

SEQ ID NO: 20383 - DNA, 21 bp, Artificial Sequence
  Description of Artificial Sequence: Synthetic oligonucleotide
aattcgcagagtggtagtact

SEQ ID NO: 20384 - DNA, 21 bp, Artificial Sequence
  Description of Artificial Sequence: Synthetic oligonucleotide
aattcggtttcgtctactacg

SEQ ID NO: 20385 - DNA, 21 bp, Artificial Sequence
  Description of Artificial Sequence: Synthetic oligonucleotide
accagcgaacacagagccaac

SEQ ID NO: 20386 - DNA, 21 bp, Artificial Sequence
  Description of Artificial Sequence: Synthetic oligonucleotide
accgacggcacccaccccctc

SEQ ID NO: 20387 - DNA, 21 bp, Artificial Sequence
  Description of Artificial Sequence: Synthetic oligonucleotide
acgaataataatcagcctcgt

SEQ ID NO: 20388 - DNA, 21 bp, Artificial Sequence
  Description of Artificial Sequence: Synthetic oligonucleotide
acgcaggagcctcagttgaag

SEQ ID NO: 20389 - DNA, 21 bp, Artificial Sequence
  Description of Artificial Sequence: Synthetic oligonucleotide
actagttctacgggggttgtt

SEQ ID NO: 20390 - DNA, 21 bp, Artificial Sequence
  Description of Artificial Sequence: Synthetic oligonucleotide
agccccaccggccacaaagcc

SEQ ID NO: 20391 - DNA, 21 bp, Artificial Sequence
  Description of Artificial Sequence: Synthetic oligonucleotide
agccccagcaccgccaacctc

SEQ ID NO: 20392 - DNA, 21 bp, Artificial Sequence
  Description of Artificial Sequence: Synthetic oligonucleotide
agccccggcgacagacccctc

SEQ ID NO: 20393 - DNA, 21 bp, Artificial Sequence
  Description of Artificial Sequence: Synthetic oligonucleotide
agcggcgaagcccaaaaaacc

SEQ ID NO: 20394 - DNA, 21 bp, Artificial Sequence
  Description of Artificial Sequence: Synthetic oligonucleotide
agcggcgacaaaagcaaaacc

SEQ ID NO: 20395 - DNA, 21 bp, Artificial Sequence
  Description of Artificial Sequence: Synthetic oligonucleotide
agtcaggcttctaatcgtacg

SEQ ID NO: 20396 - DNA, 21 bp, Artificial Sequence
  Description of Artificial Sequence: Synthetic oligonucleotide
atggaaggcgccggccaaatc

SEQ ID NO: 20397 - DNA, 21 bp, Artificial Sequence
  Description of Artificial Sequence: Synthetic oligonucleotide
atggttgctactggtacgcag

SEQ ID NO: 20398 - DNA, 21 bp, Artificial Sequence
  Description of Artificial Sequence: Synthetic oligonucleotide
caagccaacgccagcaccggc

SEQ ID NO: 20399 - DNA, 21 bp, Artificial Sequence
  Description of Artificial Sequence: Synthetic oligonucleotide
caggttggggcgtcgtcgact

SEQ ID NO: 20400 - DNA, 21 bp, Artificial Sequence
  Description of Artificial Sequence: Synthetic oligonucleotide
cgtgagggggcgccgtcggct

SEQ ID NO: 20401 - DNA, 21 bp, Artificial Sequence
  Description of Artificial Sequence: Synthetic oligonucleotide
ctcaaaaccgaaagccaacac

SEQ ID NO: 20402 - DNA, 21 bp, Artificial Sequence
  Description of Artificial Sequence: Synthetic oligonucleotide
ctcaccggccacagccccccc

SEQ ID NO: 20403 - DNA, 21 bp, Artificial Sequence
  Description of Artificial Sequence: Synthetic oligonucleotide
ctcgccaccgccagccccagc

SEQ ID NO: 20404 - DNA, 21 bp, Artificial Sequence
  Description of Artificial Sequence: Synthetic oligonucleotide
ctcggccaacccagcagacaa

SEQ ID NO: 20405 - DNA, 21 bp, Artificial Sequence
  Description of Artificial Sequence: Synthetic oligonucleotide
ctgcttgagcctaaggggctg

SEQ ID NO: 20406 - DNA, 21 bp, Artificial Sequence
  Description of Artificial Sequence: Synthetic oligonucleotide
gaaaaacccaacgccggcgcc

SEQ ID NO: 20407 - DNA, 21 bp, Artificial Sequence
  Description of Artificial Sequence: Synthetic oligonucleotide
gaaagcgccacccacgccggc

SEQ ID NO: 20408 - DNA, 21 bp, Artificial Sequence
  Description of Artificial Sequence: Synthetic oligonucleotide
gacaaaccccccaacaacatc

SEQ ID NO: 20409 - DNA, 21 bp, Artificial Sequence
  Description of Artificial Sequence: Synthetic oligonucleotide
gacacccacagaacccccggc

SEQ ID NO: 20410 - DNA, 21 bp, Artificial Sequence
  Description of Artificial Sequence: Synthetic oligonucleotide
gacggcaacagcaaaaccccc

SEQ ID NO: 20411 - DNA, 21 bp, Artificial Sequence
  Description of Artificial Sequence: Synthetic oligonucleotide
gacggcagcaccaccaaactc

SEQ ID NO: 20412 - DNA, 21 bp, Artificial Sequence
  Description of Artificial Sequence: Synthetic oligonucleotide
gaggcggggtcttctgctagg

SEQ ID NO: 20413 - DNA, 21 bp, Artificial Sequence
  Description of Artificial Sequence: Synthetic oligonucleotide
gaggctcgtgataagactagg

SEQ ID NO: 20414 - DNA, 21 bp, Artificial Sequence
  Description of Artificial Sequence: Synthetic oligonucleotide
gatcggaatgggtctaataag

SEQ ID NO: 20415 - DNA, 21 bp, Artificial Sequence
  Description of Artificial Sequence: Synthetic oligonucleotide
gccgacagcagagaaaaaggc

SEQ ID NO: 20416 - DNA, 21 bp, Artificial Sequence
  Description of Artificial Sequence: Synthetic oligonucleotide
gccgccggcagcaccaaagac

SEQ ID NO: 20417 - DNA, 21 bp, Artificial Sequence
  Description of Artificial Sequence: Synthetic oligonucleotide
gccggccaagcccccctcaac

SEQ ID NO: 20418 - DNA, 21 bp, Artificial Sequence
  Description of Artificial Sequence: Synthetic oligonucleotide
gcgcagagtcagaaggcttct

SEQ ID NO: 20419 - DNA, 21 bp, Artificial Sequence
  Description of Artificial Sequence: Synthetic oligonucleotide
gctttgggtggggctcctact

SEQ ID NO: 20420 - DNA, 21 bp, Artificial Sequence
  Description of Artificial Sequence: Synthetic oligonucleotide
ggcaaaggcgaaaccagaacc

SEQ ID NO: 20421 - DNA, 21 bp, Artificial Sequence
  Description of Artificial Sequence: Synthetic oligonucleotide
ggcacccccggccacggccaa

SEQ ID NO: 20422 - DNA, 21 bp, Artificial Sequence
  Description of Artificial Sequence: Synthetic oligonucleotide
ggcctcgccagcagcaaaggc

SEQ ID NO: 20423 - DNA, 21 bp, Artificial Sequence
  Description of Artificial Sequence: Synthetic oligonucleotide
ggcgccgccagcagcaacaga

SEQ ID NO: 20424 - DNA, 21 bp, Artificial Sequence
  Description of Artificial Sequence: Synthetic oligonucleotide
gggactggtgataataaggtg

SEQ ID NO: 20425 - DNA, 21 bp, Artificial Sequence
  Description of Artificial Sequence: Synthetic oligonucleotide
ggtaaggcgcagacgtcgcag

SEQ ID NO: 20426 - DNA, 21 bp, Artificial Sequence
  Description of Artificial Sequence: Synthetic oligonucleotide
ggtgcgggggcgtctgttcag

SEQ ID NO: 20427 - DNA, 21 bp, Artificial Sequence
  Description of Artificial Sequence: Synthetic oligonucleotide
ggttctggtccgaatgctccg

SEQ ID NO: 20428 - DNA, 21 bp, Artificial Sequence
  Description of Artificial Sequence: Synthetic oligonucleotide
gtggcggataggtctggtcag

SEQ ID NO: 20429 - DNA, 21 bp, Artificial Sequence
  Description of Artificial Sequence: Synthetic oligonucleotide
tacagaaacgacagcagcgtc

SEQ ID NO: 20430 - DNA, 21 bp, Artificial Sequence
  Description of Artificial Sequence: Synthetic oligonucleotide
tatggtaagggggggagtcag

SEQ ID NO: 20431 - DNA, 21 bp, Artificial Sequence
  Description of Artificial Sequence: Synthetic oligonucleotide
tctatgttgcctcagaagggt

SEQ ID NO: 20432 - DNA, 21 bp, Artificial Sequence
  Description of Artificial Sequence: Synthetic oligonucleotide
tgcgtccccaccagcgccggc

SEQ ID NO: 20433 - DNA, 21 bp, Artificial Sequence
  Description of Artificial Sequence: Synthetic oligonucleotide
tggggcggccccaccgccagc

SEQ ID NO: 20434 - DNA, 21 bp, Artificial Sequence
  Description of Artificial Sequence: Synthetic oligonucleotide
ttgaattctgagcgtgctgct

SEQ ID NO: 20435 - DNA, 21 bp, Artificial Sequence
  Description of Artificial Sequence: Synthetic oligonucleotide
gatgataataagaagggtctt

SEQ ID NO: 20436 - DNA, 21 bp, Artificial Sequence
  Description of Artificial Sequence: Synthetic oligonucleotide
gataagcctgctcctggtaag

SEQ ID NO: 20437 - DNA, 21 bp, Artificial Sequence
  Description of Artificial Sequence: Synthetic oligonucleotide
ggcaacgccggcagcagcgtc

SEQ ID NO: 20438 - DNA, 21 bp, Artificial Sequence
  Description of Artificial Sequence: Synthetic oligonucleotide
aacagcaccaaccccgccagc

SEQ ID NO: 20439 - DNA, 21 bp, Artificial Sequence
  Description of Artificial Sequence: Synthetic oligonucleotide
actcctagtagtaagtctacg

SEQ ID NO: 20440 - DNA, 21 bp, Artificial Sequence
  Description of Artificial Sequence: Synthetic oligonucleotide
agcaccaacaccgccccccac

SEQ ID NO: 20441 - DNA, 21 bp, Artificial Sequence
  Description of Artificial Sequence: Synthetic oligonucleotide
ggtgctacgtcgccttctcat

SEQ ID NO: 20442 - DNA, 21 bp, Artificial Sequence
  Description of Artificial Sequence: Synthetic oligonucleotide
ggcaacgacagcgccggcaga

SEQ ID NO: 20443 - DNA, 21 bp, Artificial Sequence
  Description of Artificial Sequence: Synthetic oligonucleotide
ggcagcaacgtcagcaaccaa

SEQ ID NO: 20444 - DNA, 21 bp, Artificial Sequence
  Description of Artificial Sequence: Synthetic oligonucleotide
gatggtaagggtacgtctggg

SEQ ID NO: 20445 - DNA, 21 bp, Artificial Sequence
  Description of Artificial Sequence: Synthetic oligonucleotide
tctgctggtgcgactcctgtt

SEQ ID NO: 20446 - DNA, 21 bp, Artificial Sequence
  Description of Artificial Sequence: Synthetic oligonucleotide
accggcagcaacaccgtcatg

SEQ ID NO: 20447 - DNA, 21 bp, Artificial Sequence
  Description of Artificial Sequence: Synthetic oligonucleotide
actactgatgcgcggcctgcg

SEQ ID NO: 20448 - DNA, 21 bp, Artificial Sequence
  Description of Artificial Sequence: Synthetic oligonucleotide
gagactcgtagttctgctgct

SEQ ID NO: 20449 - DNA, 21 bp, Artificial Sequence
  Description of Artificial Sequence: Synthetic oligonucleotide
gataatggtaagtctaatagg

SEQ ID NO: 20450 - DNA, 21 bp, Artificial Sequence
  Description of Artificial Sequence: Synthetic oligonucleotide
tcttctcaggagcgtcctgtg

SEQ ID NO: 20451 - DNA, 21 bp, Artificial Sequence
  Description of Artificial Sequence: Synthetic oligonucleotide
agtcttgcttctactagtcag

SEQ ID NO: 20452 - DNA, 21 bp, Artificial Sequence
  Description of Artificial Sequence: Synthetic oligonucleotide
aatcagagtcgtaatgagtcg

SEQ ID NO: 20453 - DNA, 21 bp, Artificial Sequence
  Description of Artificial Sequence: Synthetic oligonucleotide
caggggtcttctccgactgct

SEQ ID NO: 20454 - DNA, 21 bp, Artificial Sequence
  Description of Artificial Sequence: Synthetic oligonucleotide
gataagtctgggcctcattcg

SEQ ID NO: 20455 - DNA, 21 bp, Artificial Sequence
  Description of Artificial Sequence: Synthetic oligonucleotide
gctaatgctcctgataagtct

SEQ ID NO: 20456 - DNA, 21 bp, Artificial Sequence
  Description of Artificial Sequence: Synthetic oligonucleotide
agtaagcagacgaatggtggt

SEQ ID NO: 20457 - DNA, 21 bp, Artificial Sequence
  Description of Artificial Sequence: Synthetic oligonucleotide
atcggcgaaggcaaaaccgcc

SEQ ID NO: 20458 - DNA, 21 bp, Artificial Sequence
  Description of Artificial Sequence: Synthetic oligonucleotide
gaaaaagccaccagcggcgtc

SEQ ID NO: 20459 - DNA, 21 bp, Artificial Sequence
  Description of Artificial Sequence: Synthetic oligonucleotide
gagacgacgggtactaggtct

SEQ ID NO: 20460 - DNA, 21 bp, Artificial Sequence
  Description of Artificial Sequence: Synthetic oligonucleotide
gtgactgaggggtctatgagg

SEQ ID NO: 20461 - DNA, 21 bp, Artificial Sequence
  Description of Artificial Sequence: Synthetic oligonucleotide
accgacagccaaagccccaga

SEQ ID NO: 20462 - DNA, 21 bp, Artificial Sequence
  Description of Artificial Sequence: Synthetic oligonucleotide
cagacgcctacgacgaatggt

SEQ ID NO: 20463 - DNA, 21 bp, Artificial Sequence
  Description of Artificial Sequence: Synthetic oligonucleotide
actcttggtgcgcagggtggt

SEQ ID NO: 20464 - DNA, 21 bp, Artificial Sequence
  Description of Artificial Sequence: Synthetic oligonucleotide
agcaccacccacaaaaccctc

SEQ ID NO: 20465 - DNA, 21 bp, Artificial Sequence
  Description of Artificial Sequence: Synthetic oligonucleotide
agcagaagcgacaaaacccac

SEQ ID NO: 20466 - DNA, 21 bp, Artificial Sequence
  Description of Artificial Sequence: Synthetic oligonucleotide
ctggggggtgctcagggtagt

SEQ ID NO: 20467 - DNA, 21 bp, Artificial Sequence
  Description of Artificial Sequence: Synthetic oligonucleotide
agcagaagcggcggcaccgcc

SEQ ID NO: 20468 - DNA, 21 bp, Artificial Sequence
  Description of Artificial Sequence: Synthetic oligonucleotide
gacaccaacgccggcaaccac

SEQ ID NO: 20469 - DNA, 21 bp, Artificial Sequence
  Description of Artificial Sequence: Synthetic oligonucleotide
gacagcaaagccaacaacctc

SEQ ID NO: 20470 - DNA, 21 bp, Artificial Sequence
  Description of Artificial Sequence: Synthetic oligonucleotide
gccgaaggcagcaacagacaa

SEQ ID NO: 20471 - DNA, 21 bp, Artificial Sequence
  Description of Artificial Sequence: Synthetic oligonucleotide
gggaagtcggctaatgtgggt

SEQ ID NO: 20472 - DNA, 21 bp, Artificial Sequence
  Description of Artificial Sequence: Synthetic oligonucleotide
ggcaccaaacccaacacccaa

SEQ ID NO: 20473 - DNA, 21 bp, Artificial Sequence
  Description of Artificial Sequence: Synthetic oligonucleotide
aagactacggagcggagtagt

SEQ ID NO: 20474 - DNA, 21 bp, Artificial Sequence
  Description of Artificial Sequence: Synthetic oligonucleotide
actctttctgagaggggtgtg

SEQ ID NO: 20475 - DNA, 21 bp, Artificial Sequence
  Description of Artificial Sequence: Synthetic oligonucleotide
ggtacggttgatcttaagcgg

SEQ ID NO: 20476 - DNA, 21 bp, Artificial Sequence
  Description of Artificial Sequence: Synthetic oligonucleotide
ctcggcgcccccgccagccaa

SEQ ID NO: 20477 - DNA, 21 bp, Artificial Sequence
  Description of Artificial Sequence: Synthetic oligonucleotide
caggggaagcctaatttgggg

SEQ ID NO: 20478 - DNA, 21 bp, Artificial Sequence
  Description of Artificial Sequence: Synthetic oligonucleotide
gataggcctggtacgcctggg

SEQ ID NO: 20479 - DNA, 21 bp, Artificial Sequence
  Description of Artificial Sequence: Synthetic oligonucleotide
gacgccgccagcagcagactc

SEQ ID NO: 20480 - DNA, 21 bp, Artificial Sequence
  Description of Artificial Sequence: Synthetic oligonucleotide
ggccaaagcgccaccaccgtc

SEQ ID NO: 20481 - DNA, 21 bp, Artificial Sequence
  Description of Artificial Sequence: Synthetic oligonucleotide
caagtcgacaccaaaagcagc

SEQ ID NO: 20482 - DNA, 21 bp, Artificial Sequence
  Description of Artificial Sequence: Synthetic oligonucleotide
ggcggcggcaacgccaccagc

SEQ ID NO: 20483 - DNA, 21 bp, Artificial Sequence
  Description of Artificial Sequence: Synthetic oligonucleotide
gtcagcaaaagccccgccaac

SEQ ID NO: 20484 - DNA, 21 bp, Artificial Sequence
  Description of Artificial Sequence: Synthetic oligonucleotide
ctcggcgccggcaaagacctc

SEQ ID NO: 20485 - DNA, 21 bp, Artificial Sequence
  Description of Artificial Sequence: Synthetic oligonucleotide
gctccggagtcgaaggttact

SEQ ID NO: 20486 - DNA, 21 bp, Artificial Sequence
  Description of Artificial Sequence: Synthetic oligonucleotide
ggcacccaagcccaacccctc

SEQ ID NO: 20487 - DNA, 21 bp, Artificial Sequence
  Description of Artificial Sequence: Synthetic oligonucleotide
gccctcaacgacagcagaagc

SEQ ID NO: 20488 - DNA, 21 bp, Artificial Sequence
  Description of Artificial Sequence: Synthetic oligonucleotide
agcagcgaaaaagccagagcc

SEQ ID NO: 20489 - DNA, 21 bp, Artificial Sequence
  Description of Artificial Sequence: Synthetic oligonucleotide
ggggatggggtgaagggtgtg

SEQ ID NO: 20490 - DNA, 21 bp, Artificial Sequence
  Description of Artificial Sequence: Synthetic oligonucleotide
gttaataatagtcctgctact

SEQ ID NO: 20491 - DNA, 21 bp, Artificial Sequence
  Description of Artificial Sequence: Synthetic oligonucleotide
accgcccaaagcaacccccac

SEQ ID NO: 20492 - DNA, 21 bp, Artificial Sequence
  Description of Artificial Sequence: Synthetic oligonucleotide
accaacaccaccagcaaagtc

SEQ ID NO: 20493 - DNA, 21 bp, Artificial Sequence
  Description of Artificial Sequence: Synthetic oligonucleotide
gattcgactgcgcgtcctggt

SEQ ID NO: 20494 - DNA, 21 bp, Artificial Sequence
  Description of Artificial Sequence: Synthetic oligonucleotide
aacagcaaaggcccccaaggc

SEQ ID NO: 20495 - DNA, 21 bp, Artificial Sequence
  Description of Artificial Sequence: Synthetic oligonucleotide
gagcattcgggtgcggctaag

SEQ ID NO: 20496 - DNA, 21 bp, Artificial Sequence
  Description of Artificial Sequence: Synthetic oligonucleotide
caaaccgccagcagcgtcagc

SEQ ID NO: 20497 - DNA, 21 bp, Artificial Sequence
  Description of Artificial Sequence: Synthetic oligonucleotide
gtcggcacccaaagccaagcc

SEQ ID NO: 20498 - DNA, 21 bp, Artificial Sequence
  Description of Artificial Sequence: Synthetic oligonucleotide
agttcggcgcaggggagttct

SEQ ID NO: 20499 - DNA, 21 bp, Artificial Sequence
  Description of Artificial Sequence: Synthetic oligonucleotide
tcttcggaggatcgtaagctg

SEQ ID NO: 20500 - DNA, 21 bp, Artificial Sequence
  Description of Artificial Sequence: Synthetic oligonucleotide
aacggcagccaaaccatccaa

SEQ ID NO: 20501 - DNA, 21 bp, Artificial Sequence
  Description of Artificial Sequence: Synthetic oligonucleotide
acttcgggtggggagccgcgt

SEQ ID NO: 20502 - DNA, 21 bp, Artificial Sequence
  Description of Artificial Sequence: Synthetic oligonucleotide
agccaacacaaagacctcagc

SEQ ID NO: 20503 - DNA, 21 bp, Artificial Sequence
  Description of Artificial Sequence: Synthetic oligonucleotide
cagcagactaagagttcggag

SEQ ID NO: 20504 - DNA, 21 bp, Artificial Sequence
  Description of Artificial Sequence: Synthetic oligonucleotide
gcccccgacagcagaagcgcc

SEQ ID NO: 20505 - DNA, 21 bp, Artificial Sequence
  Description of Artificial Sequence: Synthetic oligonucleotide
gcccaaagcggcggcaaaagc

SEQ ID NO: 20506 - DNA, 21 bp, Artificial Sequence
  Description of Artificial Sequence: Synthetic oligonucleotide
aatggggcggggacttcttct

SEQ ID NO: 20507 - DNA, 21 bp, Artificial Sequence
  Description of Artificial Sequence: Synthetic oligonucleotide
agtaagcagaatgcttcggct

SEQ ID NO: 20508 - DNA, 21 bp, Artificial Sequence
  Description of Artificial Sequence: Synthetic oligonucleotide
caggggaatctgagttcgggg

SEQ ID NO: 20509 - DNA, 21 bp, Artificial Sequence
  Description of Artificial Sequence: Synthetic oligonucleotide
cagggtgcgagtcagaatatt

SEQ ID NO: 20510 - DNA, 21 bp, Artificial Sequence
  Description of Artificial Sequence: Synthetic oligonucleotide
gccgtcaccagcggcggcaaa

SEQ ID NO: 20511 - DNA, 21 bp, Artificial Sequence
  Description of Artificial Sequence: Synthetic oligonucleotide
gggggggtggatacttctaag

SEQ ID NO: 20512 - DNA, 21 bp, Artificial Sequence
  Description of Artificial Sequence: Synthetic oligonucleotide
aggtctaatggttcggctagt

SEQ ID NO: 20513 - DNA, 21 bp, Artificial Sequence
  Description of Artificial Sequence: Synthetic oligonucleotide
gattctcttgggactaagaag

SEQ ID NO: 20514 - DNA, 21 bp, Artificial Sequence
  Description of Artificial Sequence: Synthetic oligonucleotide
gggcctgggagtaatcggggg

SEQ ID NO: 20515 - DNA, 21 bp, Artificial Sequence
  Description of Artificial Sequence: Synthetic oligonucleotide
aacaccagcagcagcggcctc

SEQ ID NO: 20516 - DNA, 21 bp, Artificial Sequence
  Description of Artificial Sequence: Synthetic oligonucleotide
aatcagagttctggggtgtcg

SEQ ID NO: 20517 - DNA, 21 bp, Artificial Sequence
  Description of Artificial Sequence: Synthetic oligonucleotide
actaatggtaatcctactacg

SEQ ID NO: 20518 - DNA, 21 bp, Artificial Sequence
  Description of Artificial Sequence: Synthetic oligonucleotide
agcaacagccaaagaagcagc

SEQ ID NO: 20519 - DNA, 21 bp, Artificial Sequence
  Description of Artificial Sequence: Synthetic oligonucleotide
gagtctgggggtagtgcgtcg

SEQ ID NO: 20520 - DNA, 21 bp, Artificial Sequence
  Description of Artificial Sequence: Synthetic oligonucleotide
ggcgccgacagcatgcccaaa

SEQ ID NO: 20521 - DNA, 21 bp, Artificial Sequence
  Description of Artificial Sequence: Synthetic oligonucleotide
ttgaatgctgatcatcagaag

SEQ ID NO: 20522 - DNA, 21 bp, Artificial Sequence
  Description of Artificial Sequence: Synthetic oligonucleotide
accagcggcaccgtcgccaga

SEQ ID NO: 20523 - DNA, 21 bp, Artificial Sequence
  Description of Artificial Sequence: Synthetic oligonucleotide
agccaaagcagagacgccctc

SEQ ID NO: 20524 - DNA, 21 bp, Artificial Sequence
  Description of Artificial Sequence: Synthetic oligonucleotide
aacaccaaccccagcatggcc

SEQ ID NO: 20525 - DNA, 21 bp, Artificial Sequence
  Description of Artificial Sequence: Synthetic oligonucleotide
actggtcagagtaatagtgcg

SEQ ID NO: 20526 - DNA, 21 bp, Artificial Sequence
  Description of Artificial Sequence: Synthetic oligonucleotide
gacaccaccaccgccaaagcc

SEQ ID NO: 20527 - DNA, 21 bp, Artificial Sequence
  Description of Artificial Sequence: Synthetic oligonucleotide
gagaatccgggtggggggcgt

SEQ ID NO: 20528 - DNA, 21 bp, Artificial Sequence
  Description of Artificial Sequence: Synthetic oligonucleotide
gagcgtaattctaatccgggg

SEQ ID NO: 20529 - DNA, 21 bp, Artificial Sequence
  Description of Artificial Sequence: Synthetic oligonucleotide
ggcgccggcaacgacagaacc

SEQ ID NO: 20530 - DNA, 21 bp, Artificial Sequence
  Description of Artificial Sequence: Synthetic oligonucleotide
gggaatactgaggggaggagt

SEQ ID NO: 20531 - DNA, 21 bp, Artificial Sequence
  Description of Artificial Sequence: Synthetic oligonucleotide
tcgcttgctacgtctaatcag

SEQ ID NO: 20532 - DNA, 21 bp, Artificial Sequence
  Description of Artificial Sequence: Synthetic oligonucleotide
gttactaaggattcgcagagt

SEQ ID NO: 20533 - DNA, 21 bp, Artificial Sequence
  Description of Artificial Sequence: Synthetic oligonucleotide
agcagcgccaacaacaaactc

SEQ ID NO: 20534 - DNA, 21 bp, Artificial Sequence
  Description of Artificial Sequence: Synthetic oligonucleotide
aatgatcagggtaagtcttcg

SEQ ID NO: 20535 - DNA, 21 bp, Artificial Sequence
  Description of Artificial Sequence: Synthetic oligonucleotide
aaaaacggcaacgacagagcc

SEQ ID NO: 20536 - DNA, 21 bp, Artificial Sequence
  Description of Artificial Sequence: Synthetic oligonucleotide
aaaggcacccccgccagcgcc

SEQ ID NO: 20537 - DNA, 21 bp, Artificial Sequence
  Description of Artificial Sequence: Synthetic oligonucleotide
aatactaagggtactaatact

SEQ ID NO: 20538 - DNA, 21 bp, Artificial Sequence
  Description of Artificial Sequence: Synthetic oligonucleotide
gagacgagtaagtctttgccg

SEQ ID NO: 20539 - DNA, 21 bp, Artificial Sequence
  Description of Artificial Sequence: Synthetic oligonucleotide
ggcctcagcaccgaagcccac

SEQ ID NO: 20540 - DNA, 21 bp, Artificial Sequence
  Description of Artificial Sequence: Synthetic oligonucleotide
tcgaattcgaataaggtgagt

SEQ ID NO: 20541 - DNA, 21 bp, Artificial Sequence
  Description of Artificial Sequence: Synthetic oligonucleotide
aatcaggcgccttctggttcg

SEQ ID NO: 20542 - DNA, 21 bp, Artificial Sequence
  Description of Artificial Sequence: Synthetic oligonucleotide
agcagaaacgacaaagacgcc

SEQ ID NO: 20543 - DNA, 21 bp, Artificial Sequence
  Description of Artificial Sequence: Synthetic oligonucleotide
tatagtggtcatgagccgaag

SEQ ID NO: 20544 - DNA, 21 bp, Artificial Sequence
  Description of Artificial Sequence: Synthetic oligonucleotide
agtactggggtgactccggtg

SEQ ID NO: 20545 - DNA, 21 bp, Artificial Sequence
  Description of Artificial Sequence: Synthetic oligonucleotide
gctactggtacggggcagggt

SEQ ID NO: 20546 - DNA, 21 bp, Artificial Sequence
  Description of Artificial Sequence: Synthetic oligonucleotide
gggcatgcggataataagacg

SEQ ID NO: 20547 - DNA, 21 bp, Artificial Sequence
  Description of Artificial Sequence: Synthetic oligonucleotide
gatggggttggtcataatcct

SEQ ID NO: 20548 - DNA, 21 bp, Artificial Sequence
  Description of Artificial Sequence: Synthetic oligonucleotide
tctgggacttcttctattttg

SEQ ID NO: 20549 - DNA, 21 bp, Artificial Sequence
  Description of Artificial Sequence: Synthetic oligonucleotide
acccaacacaccagcaaccaa

SEQ ID NO: 20550 - DNA, 21 bp, Artificial Sequence
  Description of Artificial Sequence: Synthetic oligonucleotide
ggcagcagcaaaggcagcaac

SEQ ID NO: 20551 - DNA, 21 bp, Artificial Sequence
  Description of Artificial Sequence: Synthetic oligonucleotide
gacagaaccagcggcgtcagc

SEQ ID NO: 20552 - DNA, 21 bp, Artificial Sequence
  Description of Artificial Sequence: Synthetic oligonucleotide
aacatcagcgaacaaagaagc

SEQ ID NO: 20553 - DNA, 21 bp, Artificial Sequence
  Description of Artificial Sequence: Synthetic oligonucleotide
aacgccaaaaccagcgtcggc

SEQ ID NO: 20554 - DNA, 21 bp, Artificial Sequence
  Description of Artificial Sequence: Synthetic oligonucleotide
actggtggtaattcttctagt

SEQ ID NO: 20555 - DNA, 21 bp, Artificial Sequence
  Description of Artificial Sequence: Synthetic oligonucleotide
gacagcggcgaaagaggcaga

SEQ ID NO: 20556 - DNA, 21 bp, Artificial Sequence
  Description of Artificial Sequence: Synthetic oligonucleotide
ggcgccaacagcagccccagc

SEQ ID NO: 20557 - DNA, 21 bp, Artificial Sequence
  Description of Artificial Sequence: Synthetic oligonucleotide
ggcggccacaaaagcagcacc

SEQ ID NO: 20558 - DNA, 21 bp, Artificial Sequence
  Description of Artificial Sequence: Synthetic oligonucleotide
gggaagagtgggacgtcgagt

SEQ ID NO: 20559 - DNA, 21 bp, Artificial Sequence
  Description of Artificial Sequence: Synthetic oligonucleotide
tctcgggcttctggggtgagt

SEQ ID NO: 20560 - DNA, 21 bp, Artificial Sequence
  Description of Artificial Sequence: Synthetic oligonucleotide
tctctggcttcgactcatgct

SEQ ID NO: 20561 - DNA, 21 bp, Artificial Sequence
  Description of Artificial Sequence: Synthetic oligonucleotide
tctcagacgtcgactcatact

SEQ ID NO: 20562 - DNA, 21 bp, Artificial Sequence
  Description of Artificial Sequence: Synthetic oligonucleotide
gatgggcgttctgcggcttct

SEQ ID NO: 20563 - DNA, 21 bp, Artificial Sequence
  Description of Artificial Sequence: Synthetic oligonucleotide
agtgtgggtacgtcttcttct

SEQ ID NO: 20564 - DNA, 21 bp, Artificial Sequence
  Description of Artificial Sequence: Synthetic oligonucleotide
cacagcggcaacagcaacagc

SEQ ID NO: 20565 - DNA, 21 bp, Artificial Sequence
  Description of Artificial Sequence: Synthetic oligonucleotide
ggcaccggcagcagcgtcagc

SEQ ID NO: 20566 - DNA, 21 bp, Artificial Sequence
  Description of Artificial Sequence: Synthetic oligonucleotide
acgaatgagggtacgaatcgt

SEQ ID NO: 20567 - DNA, 21 bp, Artificial Sequence
  Description of Artificial Sequence: Synthetic oligonucleotide
agcaaaagcaaagacatcgcc

SEQ ID NO: 20568 - DNA, 21 bp, Artificial Sequence
  Description of Artificial Sequence: Synthetic oligonucleotide
gctagtcctgggtcttcgggt

SEQ ID NO: 20569 - DNA, 21 bp, Artificial Sequence
  Description of Artificial Sequence: Synthetic oligonucleotide
aatctggagtctcggtctgct

SEQ ID NO: 20570 - DNA, 21 bp, Artificial Sequence
  Description of Artificial Sequence: Synthetic oligonucleotide
cacggcatcgacagcatgaaa

SEQ ID NO: 20571 - DNA, 21 bp, Artificial Sequence
  Description of Artificial Sequence: Synthetic oligonucleotide
aataatggtcagaattcgacg

SEQ ID NO: 20572 - DNA, 21 bp, Artificial Sequence
  Description of Artificial Sequence: Synthetic oligonucleotide
aatagtgcggcgtcgagtgtg

SEQ ID NO: 20573 - DNA, 21 bp, Artificial Sequence
  Description of Artificial Sequence: Synthetic oligonucleotide
accggcaaagaaagcatgatc

SEQ ID NO: 20574 - DNA, 21 bp, Artificial Sequence
  Description of Artificial Sequence: Synthetic oligonucleotide
accgccggcaccggcaaaacc

SEQ ID NO: 20575 - DNA, 21 bp, Artificial Sequence
  Description of Artificial Sequence: Synthetic oligonucleotide
agtacgactaaggatcgggtt

SEQ ID NO: 20576 - DNA, 21 bp, Artificial Sequence
  Description of Artificial Sequence: Synthetic oligonucleotide
agtccttcgaaggataaggag

SEQ ID NO: 20577 - DNA, 21 bp, Artificial Sequence
  Description of Artificial Sequence: Synthetic oligonucleotide
cacatgaacaccagcagcaaa

SEQ ID NO: 20578 - DNA, 21 bp, Artificial Sequence
  Description of Artificial Sequence: Synthetic oligonucleotide
catactcatggtgagggtaag

SEQ ID NO: 20579 - DNA, 21 bp, Artificial Sequence
  Description of Artificial Sequence: Synthetic oligonucleotide
ctcagcggccacagcccccaa

SEQ ID NO: 20580 - DNA, 21 bp, Artificial Sequence
  Description of Artificial Sequence: Synthetic oligonucleotide
gaggggtctgtgcagagtaag

SEQ ID NO: 20581 - DNA, 21 bp, Artificial Sequence
  Description of Artificial Sequence: Synthetic oligonucleotide
gccggcaacacccccaaaaga

SEQ ID NO: 20582 - DNA, 21 bp, Artificial Sequence
  Description of Artificial Sequence: Synthetic oligonucleotide
ggtcctgagcatacgcctgct

SEQ ID NO: 20583 - DNA, 21 bp, Artificial Sequence
  Description of Artificial Sequence: Synthetic oligonucleotide
tcttctgggaaggatctggcg

SEQ ID NO: 20584 - DNA, 21 bp, Artificial Sequence
  Description of Artificial Sequence: Synthetic oligonucleotide
aggactgatactgggccggtg

SEQ ID NO: 20585 - DNA, 21 bp, Artificial Sequence
  Description of Artificial Sequence: Synthetic oligonucleotide
gctcaggatcctacgcataag

SEQ ID NO: 20586 - DNA, 21 bp, Artificial Sequence
  Description of Artificial Sequence: Synthetic oligonucleotide
accaacagcgaaagaaacctc

SEQ ID NO: 20587 - DNA, 21 bp, Artificial Sequence
  Description of Artificial Sequence: Synthetic oligonucleotide
gcggctgatagtaagggtggt

SEQ ID NO: 20588 - DNA, 21 bp, Artificial Sequence
  Description of Artificial Sequence: Synthetic oligonucleotide
ggtaatacgacttcgactcag

SEQ ID NO: 20589 - DNA, 21 bp, Artificial Sequence
  Description of Artificial Sequence: Synthetic oligonucleotide
gtcggcgccgcccccgtcagc

SEQ ID NO: 20590 - DNA, 21 bp, Artificial Sequence
  Description of Artificial Sequence: Synthetic oligonucleotide
gataagggtcctcaggtggtg

SEQ ID NO: 20591 - DNA, 21 bp, Artificial Sequence
  Description of Artificial Sequence: Synthetic oligonucleotide
aatcctagttcttctcatatg

SEQ ID NO: 20592 - DNA, 21 bp, Artificial Sequence
  Description of Artificial Sequence: Synthetic oligonucleotide
aaccacggcacccccgtcgaa

SEQ ID NO: 20593 - DNA, 21 bp, Artificial Sequence
  Description of Artificial Sequence: Synthetic oligonucleotide
aatcctagtacgaatggtaat

SEQ ID NO: 20594 - DNA, 21 bp, Artificial Sequence
  Description of Artificial Sequence: Synthetic oligonucleotide
aattctgaggttagttctaag

SEQ ID NO: 20595 - DNA, 21 bp, Artificial Sequence
  Description of Artificial Sequence: Synthetic oligonucleotide
caggggccgaatcattcgtcc

SEQ ID NO: 20596 - DNA, 21 bp, Artificial Sequence
  Description of Artificial Sequence: Synthetic oligonucleotide
gtcaaagccggcaaaaacgaa

SEQ ID NO: 20597 - DNA, 21 bp, Artificial Sequence
  Description of Artificial Sequence: Synthetic oligonucleotide
ggggcttttggggagaagggt

SEQ ID NO: 20598 - DNA, 21 bp, Artificial Sequence
  Description of Artificial Sequence: Synthetic oligonucleotide
acgagtcgttcggcgcaggct

SEQ ID NO: 20599 - DNA, 21 bp, Artificial Sequence
  Description of Artificial Sequence: Synthetic oligonucleotide
agtccggggtcgtcgactttg

SEQ ID NO: 20600 - DNA, 21 bp, Artificial Sequence
  Description of Artificial Sequence: Synthetic oligonucleotide
cgtcagggtactacttcgggt

SEQ ID NO: 20601 - DNA, 21 bp, Artificial Sequence
  Description of Artificial Sequence: Synthetic oligonucleotide
gccgaacaaaacagaagcagc

SEQ ID NO: 20602 - DNA, 21 bp, Artificial Sequence
  Description of Artificial Sequence: Synthetic oligonucleotide
ggggggacgaaggggaccact

SEQ ID NO: 20603 - DNA, 21 bp, Artificial Sequence
  Description of Artificial Sequence: Synthetic oligonucleotide
tttggtgatagtaggtcgaat

SEQ ID NO: 20604 - DNA, 21 bp, Artificial Sequence
  Description of Artificial Sequence: Synthetic oligonucleotide
cagactaatacggggaagggg

SEQ ID NO: 20605 - DNA, 21 bp, Artificial Sequence
  Description of Artificial Sequence: Synthetic oligonucleotide
aaggggaatgctggtgttgag

SEQ ID NO: 20606 - DNA, 21 bp, Artificial Sequence
  Description of Artificial Sequence: Synthetic oligonucleotide
cttactcaggataagccggtt

SEQ ID NO: 20607 - DNA, 21 bp, Artificial Sequence
  Description of Artificial Sequence: Synthetic oligonucleotide
gggcagcataagtctgggacg

SEQ ID NO: 20608 - DNA, 21 bp, Artificial Sequence
  Description of Artificial Sequence: Synthetic oligonucleotide
gtgaaggagagtaaggggact

SEQ ID NO: 20609 - DNA, 21 bp, Artificial Sequence
  Description of Artificial Sequence: Synthetic oligonucleotide
gttgagtctcctagtaatagg

SEQ ID NO: 20610 - DNA, 21 bp, Artificial Sequence
  Description of Artificial Sequence: Synthetic oligonucleotide
tacaaagaacaaaacgccaaa

SEQ ID NO: 20611 - DNA, 21 bp, Artificial Sequence
  Description of Artificial Sequence: Synthetic oligonucleotide
gacctccccagcgccaaagcc

SEQ ID NO: 20612 - DNA, 21 bp, Artificial Sequence
  Description of Artificial Sequence: Synthetic oligonucleotide
gcgacttcggagactaagggt

SEQ ID NO: 20613 - DNA, 21 bp, Artificial Sequence
  Description of Artificial Sequence: Synthetic oligonucleotide
agtcggactactgctcctgct

SEQ ID NO: 20614 - DNA, 21 bp, Artificial Sequence
  Description of Artificial Sequence: Synthetic oligonucleotide
agtatggggacgcctccttct

SEQ ID NO: 20615 - DNA, 21 bp, Artificial Sequence
  Description of Artificial Sequence: Synthetic oligonucleotide
ctcggccccagccaaaacaac

SEQ ID NO: 20616 - DNA, 21 bp, Artificial Sequence
  Description of Artificial Sequence: Synthetic oligonucleotide
aacaccgccatgaaaggcgcc

SEQ ID NO: 20617 - DNA, 21 bp, Artificial Sequence
  Description of Artificial Sequence: Synthetic oligonucleotide
actcatggtaaggggtcggag

SEQ ID NO: 20618 - DNA, 21 bp, Artificial Sequence
  Description of Artificial Sequence: Synthetic oligonucleotide
acttctgatccgaggggtgtg

SEQ ID NO: 20619 - DNA, 21 bp, Artificial Sequence
  Description of Artificial Sequence: Synthetic oligonucleotide
agaaccagcaccgaaaaaaac

SEQ ID NO: 20620 - DNA, 21 bp, Artificial Sequence
  Description of Artificial Sequence: Synthetic oligonucleotide
agcgtcatccaaggcggcagc

SEQ ID NO: 20621 - DNA, 21 bp, Artificial Sequence
  Description of Artificial Sequence: Synthetic oligonucleotide
caggggcagacgactaaggct

SEQ ID NO: 20622 - DNA, 21 bp, Artificial Sequence
  Description of Artificial Sequence: Synthetic oligonucleotide
gaaaaagaaaacagccaaaga

SEQ ID NO: 20623 - DNA, 21 bp, Artificial Sequence
  Description of Artificial Sequence: Synthetic oligonucleotide
gccgacagcggccacaacacc

SEQ ID NO: 20624 - DNA, 21 bp, Artificial Sequence
  Description of Artificial Sequence: Synthetic oligonucleotide
gggactattggggagaagttg

SEQ ID NO: 20625 - DNA, 21 bp, Artificial Sequence
  Description of Artificial Sequence: Synthetic oligonucleotide
gtgccttctgctaagacggcg

SEQ ID NO: 20626 - DNA, 21 bp, Artificial Sequence
  Description of Artificial Sequence: Synthetic oligonucleotide
ggcaccgtccccaccaacagc

SEQ ID NO: 20627 - DNA, 21 bp, Artificial Sequence
  Description of Artificial Sequence: Synthetic oligonucleotide
accgccaacgccacccccgtc

SEQ ID NO: 20628 - DNA, 21 bp, Artificial Sequence
  Description of Artificial Sequence: Synthetic oligonucleotide
accaccagcagagacgccagc

SEQ ID NO: 20629 - DNA, 21 bp, Artificial Sequence
  Description of Artificial Sequence: Synthetic oligonucleotide
gacggcgtcgaaagcaacaga

SEQ ID NO: 20630 - DNA, 21 bp, Artificial Sequence
  Description of Artificial Sequence: Synthetic oligonucleotide
accgccggcaaaagcaccgac

SEQ ID NO: 20631 - DNA, 21 bp, Artificial Sequence
  Description of Artificial Sequence: Synthetic oligonucleotide
acgggggttggtaatgctgcc

SEQ ID NO: 20632 - DNA, 21 bp, Artificial Sequence
  Description of Artificial Sequence: Synthetic oligonucleotide
gaccccggcaaaatggcctgc

SEQ ID NO: 20633 - DNA, 21 bp, Artificial Sequence
  Description of Artificial Sequence: Synthetic oligonucleotide
gaggggagtgattcgcgttct

SEQ ID NO: 20634 - DNA, 21 bp, Artificial Sequence
  Description of Artificial Sequence: Synthetic oligonucleotide
gccgccaacagccccagaagc

SEQ ID NO: 20635 - DNA, 21 bp, Artificial Sequence
  Description of Artificial Sequence: Synthetic oligonucleotide
ggcaccagcgccaacatcaaa

SEQ ID NO: 20636 - DNA, 21 bp, Artificial Sequence
  Description of Artificial Sequence: Synthetic oligonucleotide
aacagcagcagcaacaccaaa

SEQ ID NO: 20637 - DNA, 21 bp, Artificial Sequence
  Description of Artificial Sequence: Synthetic oligonucleotide
ggtatgagtgatacggtgaag

SEQ ID NO: 20638 - DNA, 21 bp, Artificial Sequence
  Description of Artificial Sequence: Synthetic oligonucleotide
tctgtgacttctaagaatgtt

SEQ ID NO: 20639 - DNA, 21 bp, Artificial Sequence
  Description of Artificial Sequence: Synthetic oligonucleotide
ggcggcaacaacgccaaaaac

SEQ ID NO: 20640 - DNA, 21 bp, Artificial Sequence
  Description of Artificial Sequence: Synthetic oligonucleotide
gacctcgacaaacccagcacc

SEQ ID NO: 20641 - DNA, 21 bp, Artificial Sequence
  Description of Artificial Sequence: Synthetic oligonucleotide
ggcggcaccgaacacagagcc

SEQ ID NO: 20642 - DNA, 21 bp, Artificial Sequence
  Description of Artificial Sequence: Synthetic oligonucleotide
gacagcagcagcagccacaac

SEQ ID NO: 20643 - DNA, 21 bp, Artificial Sequence
  Description of Artificial Sequence: Synthetic oligonucleotide
agccacggcgaaaaccccaga

SEQ ID NO: 20644 - DNA, 21 bp, Artificial Sequence
  Description of Artificial Sequence: Synthetic oligonucleotide
agcggcgacatcaccaaaagc

SEQ ID NO: 20645 - DNA, 21 bp, Artificial Sequence
  Description of Artificial Sequence: Synthetic oligonucleotide
cggaatgatggttctactggg

SEQ ID NO: 20646 - DNA, 21 bp, Artificial Sequence
  Description of Artificial Sequence: Synthetic oligonucleotide
ggcagccacagcgccagcaac

SEQ ID NO: 20647 - DNA, 21 bp, Artificial Sequence
  Description of Artificial Sequence: Synthetic oligonucleotide
tcttcgaatactaagggtctt

SEQ ID NO: 20648 - DNA, 21 bp, Artificial Sequence
  Description of Artificial Sequence: Synthetic oligonucleotide
aacaccagcaccagcctcaac

SEQ ID NO: 20649 - DNA, 21 bp, Artificial Sequence
  Description of Artificial Sequence: Synthetic oligonucleotide
gtgcgtaatgagaagtcgagt

SEQ ID NO: 20650 - DNA, 21 bp, Artificial Sequence
  Description of Artificial Sequence: Synthetic oligonucleotide
accaaacacggccaacccgtc

SEQ ID NO: 20651 - DNA, 21 bp, Artificial Sequence
  Description of Artificial Sequence: Synthetic oligonucleotide
ggcagcagcgaccacgccaga

SEQ ID NO: 20652 - DNA, 21 bp, Artificial Sequence
  Description of Artificial Sequence: Synthetic oligonucleotide
ggcggcagcgacagcagaaaa

SEQ ID NO: 20653 - DNA, 21 bp, Artificial Sequence
  Description of Artificial Sequence: Synthetic oligonucleotide
aatagggcgggtgctgggact

SEQ ID NO: 20654 - DNA, 21 bp, Artificial Sequence
  Description of Artificial Sequence: Synthetic oligonucleotide
cgtcagaattcgaatgctggg

SEQ ID NO: 20655 - DNA, 21 bp, Artificial Sequence
  Description of Artificial Sequence: Synthetic oligonucleotide
ctgggtgctcaggtgaataag

SEQ ID NO: 20656 - DNA, 21 bp, Artificial Sequence
  Description of Artificial Sequence: Synthetic oligonucleotide
gccaccgtcaaacccgaagtc

SEQ ID NO: 20657 - DNA, 21 bp, Artificial Sequence
  Description of Artificial Sequence: Synthetic oligonucleotide
tcgaagtctcaggtgaatacg

SEQ ID NO: 20658 - DNA, 21 bp, Artificial Sequence
  Description of Artificial Sequence: Synthetic oligonucleotide
accggcaacaaagacaaaccc

SEQ ID NO: 20659 - DNA, 21 bp, Artificial Sequence
  Description of Artificial Sequence: Synthetic oligonucleotide
actagtaagaatgttaatacg

SEQ ID NO: 20660 - DNA, 21 bp, Artificial Sequence
  Description of Artificial Sequence: Synthetic oligonucleotide
agcaccaacggcggccccagc

SEQ ID NO: 20661 - DNA, 21 bp, Artificial Sequence
  Description of Artificial Sequence: Synthetic oligonucleotide
gatgttgggcttggtaataag

SEQ ID NO: 20662 - DNA, 21 bp, Artificial Sequence
  Description of Artificial Sequence: Synthetic oligonucleotide
gcgccgtctaatgctaaggtt

SEQ ID NO: 20663 - DNA, 21 bp, Artificial Sequence
  Description of Artificial Sequence: Synthetic oligonucleotide
atcagcggcaccgtcgccaaa

SEQ ID NO: 20664 - DNA, 21 bp, Artificial Sequence
  Description of Artificial Sequence: Synthetic oligonucleotide
gggggtacggtgtcgcagggt

SEQ ID NO: 20665 - DNA, 21 bp, Artificial Sequence
  Description of Artificial Sequence: Synthetic oligonucleotide
cgtactacgccgtctagtggt

SEQ ID NO: 20666 - DNA, 21 bp, Artificial Sequence
  Description of Artificial Sequence: Synthetic oligonucleotide
tctagtggtgtgggtagtgtg

SEQ ID NO: 20667 - DNA, 21 bp, Artificial Sequence
  Description of Artificial Sequence: Synthetic oligonucleotide
ggtaatcagaagagttcgcag

SEQ ID NO: 20668 - DNA, 21 bp, Artificial Sequence
  Description of Artificial Sequence: Synthetic oligonucleotide
accaaagccagccaaaccgcc

SEQ ID NO: 20669 - DNA, 21 bp, Artificial Sequence
  Description of Artificial Sequence: Synthetic oligonucleotide
aggcagtctactccgtctgtg

SEQ ID NO: 20670 - DNA, 21 bp, Artificial Sequence
  Description of Artificial Sequence: Synthetic oligonucleotide
ctcgccgaaaccaaacccacc

SEQ ID NO: 20671 - DNA, 21 bp, Artificial Sequence
  Description of Artificial Sequence: Synthetic oligonucleotide
gccagcagcggcaccctcgtc

SEQ ID NO: 20672 - DNA, 21 bp, Artificial Sequence
  Description of Artificial Sequence: Synthetic oligonucleotide
gcgggtggttcgggtagtcct

SEQ ID NO: 20673 - DNA, 21 bp, Artificial Sequence
  Description of Artificial Sequence: Synthetic oligonucleotide
gtggattcggggggttcgaag

SEQ ID NO: 20674 - DNA, 21 bp, Artificial Sequence
  Description of Artificial Sequence: Synthetic oligonucleotide
tctcagaatgtttcgtctggg

SEQ ID NO: 20675 - DNA, 21 bp, Artificial Sequence
  Description of Artificial Sequence: Synthetic oligonucleotide
gagtctcagagtgctcgtact

SEQ ID NO: 20676 - DNA, 21 bp, Artificial Sequence
  Description of Artificial Sequence: Synthetic oligonucleotide
agccaagccgacgccaaacaa

SEQ ID NO: 20677 - DNA, 21 bp, Artificial Sequence
  Description of Artificial Sequence: Synthetic oligonucleotide
caggatcctgctccgactaag

SEQ ID NO: 20678 - DNA, 21 bp, Artificial Sequence
  Description of Artificial Sequence: Synthetic oligonucleotide
ttgtctggtactagttcgtct

SEQ ID NO: 20679 - DNA, 21 bp, Artificial Sequence
  Description of Artificial Sequence: Synthetic oligonucleotide
gagaattcggatcggcttcgg

SEQ ID NO: 20680 - DNA, 21 bp, Artificial Sequence
  Description of Artificial Sequence: Synthetic oligonucleotide
agccccaaaggccaaggcgac

SEQ ID NO: 20681 - DNA, 21 bp, Artificial Sequence
  Description of Artificial Sequence: Synthetic oligonucleotide
cttggtaatggtcagggtaat

SEQ ID NO: 20682 - DNA, 21 bp, Artificial Sequence
  Description of Artificial Sequence: Synthetic oligonucleotide
gttggtgctacgactggttct

SEQ ID NO: 20683 - DNA, 21 bp, Artificial Sequence
  Description of Artificial Sequence: Synthetic oligonucleotide
aagctggctcagcagaatgcg

SEQ ID NO: 20684 - DNA, 21 bp, Artificial Sequence
  Description of Artificial Sequence: Synthetic oligonucleotide
agtagtcaggctcagggtcag

SEQ ID NO: 20685 - DNA, 21 bp, Artificial Sequence
  Description of Artificial Sequence: Synthetic oligonucleotide
caccaaaaaggcggcggccaa

SEQ ID NO: 20686 - DNA, 21 bp, Artificial Sequence
  Description of Artificial Sequence: Synthetic oligonucleotide
gagggtaataatcgggcgcat

SEQ ID NO: 20687 - DNA, 21 bp, Artificial Sequence
  Description of Artificial Sequence: Synthetic oligonucleotide
gctacgaatgctaatccgagg

SEQ ID NO: 20688 - DNA, 21 bp, Artificial Sequence
  Description of Artificial Sequence: Synthetic oligonucleotide
tctactagtagtcagagtggt

SEQ ID NO: 20689 - DNA, 21 bp, Artificial Sequence
  Description of Artificial Sequence: Synthetic oligonucleotide
actccttcgaagactgctact

SEQ ID NO: 20690 - DNA, 21 bp, Artificial Sequence
  Description of Artificial Sequence: Synthetic oligonucleotide
caaaccggcaccaccagcgcc

SEQ ID NO: 20691 - DNA, 21 bp, Artificial Sequence
  Description of Artificial Sequence: Synthetic oligonucleotide
caaggcagccacagcgtcatg

SEQ ID NO: 20692 - DNA, 21 bp, Artificial Sequence
  Description of Artificial Sequence: Synthetic oligonucleotide
aaccaagtcagcaccctcggc

SEQ ID NO: 20693 - DNA, 21 bp, Artificial Sequence
  Description of Artificial Sequence: Synthetic oligonucleotide
catgctgggaagggtccgact

SEQ ID NO: 20694 - DNA, 21 bp, Artificial Sequence
  Description of Artificial Sequence: Synthetic oligonucleotide
tcgtcgactgggagtacgggt

SEQ ID NO: 20695 - DNA, 21 bp, Artificial Sequence
  Description of Artificial Sequence: Synthetic oligonucleotide
ggcagaaccgacagcgccacc

SEQ ID NO: 20696 - DNA, 21 bp, Artificial Sequence
  Description of Artificial Sequence: Synthetic oligonucleotide
agcaccagcggcagcagccac

SEQ ID NO: 20697 - DNA, 21 bp, Artificial Sequence
  Description of Artificial Sequence: Synthetic oligonucleotide
agccaagtcggcaccaacacc

SEQ ID NO: 20698 - DNA, 21 bp, Artificial Sequence
  Description of Artificial Sequence: Synthetic oligonucleotide
agccacaacagcaaagccagc

SEQ ID NO: 20699 - DNA, 21 bp, Artificial Sequence
  Description of Artificial Sequence: Synthetic oligonucleotide
ctcaccagagaaagaaacgaa

SEQ ID NO: 20700 - DNA, 21 bp, Artificial Sequence
  Description of Artificial Sequence: Synthetic oligonucleotide
agaaacgacggccccagcaaa

SEQ ID NO: 20701 - DNA, 21 bp, Artificial Sequence
  Description of Artificial Sequence: Synthetic oligonucleotide
agaatggacggcaaaaacgcc

SEQ ID NO: 20702 - DNA, 21 bp, Artificial Sequence
  Description of Artificial Sequence: Synthetic oligonucleotide
agcgccaccagcaccgccgcc

SEQ ID NO: 20703 - DNA, 21 bp, Artificial Sequence
  Description of Artificial Sequence: Synthetic oligonucleotide
cagctggataagcataatgtg

SEQ ID NO: 20704 - DNA, 21 bp, Artificial Sequence
  Description of Artificial Sequence: Synthetic oligonucleotide
gctcatagtcagggtaatact

SEQ ID NO: 20705 - DNA, 21 bp, Artificial Sequence
  Description of Artificial Sequence: Synthetic oligonucleotide
agcaccacccccagcggcccc

SEQ ID NO: 20706 - DNA, 21 bp, Artificial Sequence
  Description of Artificial Sequence: Synthetic oligonucleotide
agcgtcgcccccagaagcggc

SEQ ID NO: 20707 - DNA, 21 bp, Artificial Sequence
  Description of Artificial Sequence: Synthetic oligonucleotide
cagggggagcatgcttcgtcg

SEQ ID NO: 20708 - DNA, 21 bp, Artificial Sequence
  Description of Artificial Sequence: Synthetic oligonucleotide
gacaccaacagcggccccaga

SEQ ID NO: 20709 - DNA, 21 bp, Artificial Sequence
  Description of Artificial Sequence: Synthetic oligonucleotide
gataaggcgattcctgggagt

SEQ ID NO: 20710 - DNA, 21 bp, Artificial Sequence
  Description of Artificial Sequence: Synthetic oligonucleotide
gatgcgcctactagtcggagt

SEQ ID NO: 20711 - DNA, 21 bp, Artificial Sequence
  Description of Artificial Sequence: Synthetic oligonucleotide
cagagtactggtattcatggg

SEQ ID NO: 20712 - DNA, 21 bp, Artificial Sequence
  Description of Artificial Sequence: Synthetic oligonucleotide
ggggtgatgccgaaggagaat

SEQ ID NO: 20713 - DNA, 21 bp, Artificial Sequence
  Description of Artificial Sequence: Synthetic oligonucleotide
acccccagcaccgaaaaaggc

SEQ ID NO: 20714 - DNA, 21 bp, Artificial Sequence
  Description of Artificial Sequence: Synthetic oligonucleotide
atggctgatagtaaggctaat

SEQ ID NO: 20715 - DNA, 21 bp, Artificial Sequence
  Description of Artificial Sequence: Synthetic oligonucleotide
ggtcttacgactgggaagctt

SEQ ID NO: 20716 - DNA, 21 bp, Artificial Sequence
  Description of Artificial Sequence: Synthetic oligonucleotide
gtgagtgggccgaatccggct

SEQ ID NO: 20717 - DNA, 21 bp, Artificial Sequence
  Description of Artificial Sequence: Synthetic oligonucleotide
gccctcaccaccaacaaagac

SEQ ID NO: 20718 - DNA, 21 bp, Artificial Sequence
  Description of Artificial Sequence: Synthetic oligonucleotide
gtcagcggccaaagcagcccc

SEQ ID NO: 20719 - DNA, 21 bp, Artificial Sequence
  Description of Artificial Sequence: Synthetic oligonucleotide
tcgtcgtcgccggctaaggtt

SEQ ID NO: 20720 - DNA, 21 bp, Artificial Sequence
  Description of Artificial Sequence: Synthetic oligonucleotide
gattcggcttctaaggcttcg

SEQ ID NO: 20721 - DNA, 21 bp, Artificial Sequence
  Description of Artificial Sequence: Synthetic oligonucleotide
ctcgccaccagcaaaaccacc

SEQ ID NO: 20722 - DNA, 21 bp, Artificial Sequence
  Description of Artificial Sequence: Synthetic oligonucleotide
gcccacagcagcaaacccgcc

SEQ ID NO: 20723 - DNA, 21 bp, Artificial Sequence
  Description of Artificial Sequence: Synthetic oligonucleotide
gggggtgtgccttcgactcat

SEQ ID NO: 20724 - DNA, 21 bp, Artificial Sequence
  Description of Artificial Sequence: Synthetic oligonucleotide
gaaagcggcgaaagaagccac

SEQ ID NO: 20725 - DNA, 21 bp, Artificial Sequence
  Description of Artificial Sequence: Synthetic oligonucleotide
ggtggggagccgaagttggct

SEQ ID NO: 20726 - DNA, 21 bp, Artificial Sequence
  Description of Artificial Sequence: Synthetic oligonucleotide
aacagcggcgacagaggcggc

SEQ ID NO: 20727 - DNA, 21 bp, Artificial Sequence
  Description of Artificial Sequence: Synthetic oligonucleotide
aacggcgtcaaaagcaccagc

SEQ ID NO: 20728 - DNA, 21 bp, Artificial Sequence
  Description of Artificial Sequence: Synthetic oligonucleotide
accggcgccagagaaaccgcc

SEQ ID NO: 20729 - DNA, 21 bp, Artificial Sequence
  Description of Artificial Sequence: Synthetic oligonucleotide
agcaacgccggccaacacagc

SEQ ID NO: 20730 - DNA, 21 bp, Artificial Sequence
  Description of Artificial Sequence: Synthetic oligonucleotide
agcggcggcaccagcctcgtc

SEQ ID NO: 20731 - DNA, 21 bp, Artificial Sequence
  Description of Artificial Sequence: Synthetic oligonucleotide
agttcgggtaatattcattcg

SEQ ID NO: 20732 - DNA, 21 bp, Artificial Sequence
  Description of Artificial Sequence: Synthetic oligonucleotide
caaagcagcagcaaaaccagc

SEQ ID NO: 20733 - DNA, 21 bp, Artificial Sequence
  Description of Artificial Sequence: Synthetic oligonucleotide
catgcgggtgggacggctgct

SEQ ID NO: 20734 - DNA, 21 bp, Artificial Sequence
  Description of Artificial Sequence: Synthetic oligonucleotide
gatccgtcgcggaagaatagt

SEQ ID NO: 20735 - DNA, 21 bp, Artificial Sequence
  Description of Artificial Sequence: Synthetic oligonucleotide
gctatggataagcagaatacg

SEQ ID NO: 20736 - DNA, 21 bp, Artificial Sequence
  Description of Artificial Sequence: Synthetic oligonucleotide
ggccaagaaggcgccggcaga

SEQ ID NO: 20737 - DNA, 21 bp, Artificial Sequence
  Description of Artificial Sequence: Synthetic oligonucleotide
ggtacttcgaatagtagggtt

SEQ ID NO: 20738 - DNA, 21 bp, Artificial Sequence
  Description of Artificial Sequence: Synthetic oligonucleotide
tctacggggcctagttcgctt

SEQ ID NO: 20739 - DNA, 21 bp, Artificial Sequence
  Description of Artificial Sequence: Synthetic oligonucleotide
tctggtacggagattcgtaag

SEQ ID NO: 20740 - DNA, 21 bp, Artificial Sequence
  Description of Artificial Sequence: Synthetic oligonucleotide
agaagagaaaaagccaacgaa

SEQ ID NO: 20741 - DNA, 21 bp, Artificial Sequence
  Description of Artificial Sequence: Synthetic oligonucleotide
cgtgatcttaagcctattgag

SEQ ID NO: 20742 - DNA, 21 bp, Artificial Sequence
  Description of Artificial Sequence: Synthetic oligonucleotide
gagggtaagtcgccgcttact

SEQ ID NO: 20743 - DNA, 21 bp, Artificial Sequence
  Description of Artificial Sequence: Synthetic oligonucleotide
gcggggtctaatgagcatcgt

SEQ ID NO: 20744 - DNA, 21 bp, Artificial Sequence
  Description of Artificial Sequence: Synthetic oligonucleotide
ttggcgtctggtgataagggg

SEQ ID NO: 20745 - DNA, 21 bp, Artificial Sequence
  Description of Artificial Sequence: Synthetic oligonucleotide
gctgagacgactaagtcgttg

SEQ ID NO: 20746 - DNA, 21 bp, Artificial Sequence
  Description of Artificial Sequence: Synthetic oligonucleotide
gggatgcatacgtcggctggt

SEQ ID NO: 20747 - DNA, 21 bp, Artificial Sequence
  Description of Artificial Sequence: Synthetic oligonucleotide
aatgcgattagttcgacgaag

SEQ ID NO: 20748 - DNA, 21 bp, Artificial Sequence
  Description of Artificial Sequence: Synthetic oligonucleotide
acggatggtaatcggggttct

SEQ ID NO: 20749 - DNA, 21 bp, Artificial Sequence
  Description of Artificial Sequence: Synthetic oligonucleotide
actcagaagactgtgacgggt

SEQ ID NO: 20750 - DNA, 21 bp, Artificial Sequence
  Description of Artificial Sequence: Synthetic oligonucleotide
agagacaccaaagaaagcggc

SEQ ID NO: 20751 - DNA, 21 bp, Artificial Sequence
  Description of Artificial Sequence: Synthetic oligonucleotide
gccacccaaagcagcaacaaa

SEQ ID NO: 20752 - DNA, 21 bp, Artificial Sequence
  Description of Artificial Sequence: Synthetic oligonucleotide
gggatttctaaggcgacgtcg

SEQ ID NO: 20753 - DNA, 21 bp, Artificial Sequence
  Description of Artificial Sequence: Synthetic oligonucleotide
actcaggagtcgtctagtcgt

SEQ ID NO: 20754 - DNA, 21 bp, Artificial Sequence
  Description of Artificial Sequence: Synthetic oligonucleotide
agcagcggcagcggcgtcccc

SEQ ID NO: 20755 - DNA, 21 bp, Artificial Sequence
  Description of Artificial Sequence: Synthetic oligonucleotide
aatcctacgaataattctagt

SEQ ID NO: 20756 - DNA, 21 bp, Artificial Sequence
  Description of Artificial Sequence: Synthetic oligonucleotide
aatgcggggaaggatcttatt

SEQ ID NO: 20757 - DNA, 21 bp, Artificial Sequence
  Description of Artificial Sequence: Synthetic oligonucleotide
agtgcggcgtctcctggtgct

SEQ ID NO: 20758 - DNA, 21 bp, Artificial Sequence
  Description of Artificial Sequence: Synthetic oligonucleotide
gacaccaaccaccccggcaga

SEQ ID NO: 20759 - DNA, 21 bp, Artificial Sequence
  Description of Artificial Sequence: Synthetic oligonucleotide
ggccaaaaaagccaaggcggc

SEQ ID NO: 20760 - DNA, 21 bp, Artificial Sequence
  Description of Artificial Sequence: Synthetic oligonucleotide
ggtgatggtaaggggtttttg

SEQ ID NO: 20761 - DNA, 21 bp, Artificial Sequence
  Description of Artificial Sequence: Synthetic oligonucleotide
cagtcgaattcgggtagtagg

SEQ ID NO: 20762 - DNA, 21 bp, Artificial Sequence
  Description of Artificial Sequence: Synthetic oligonucleotide
gaaagcggcgccagcaccgcc

SEQ ID NO: 20763 - DNA, 21 bp, Artificial Sequence
  Description of Artificial Sequence: Synthetic oligonucleotide
aacaacaccgaaagcaacaaa

SEQ ID NO: 20764 - DNA, 21 bp, Artificial Sequence
  Description of Artificial Sequence: Synthetic oligonucleotide
accactcatgagcgggggtcg

SEQ ID NO: 20765 - DNA, 21 bp, Artificial Sequence
  Description of Artificial Sequence: Synthetic oligonucleotide
agtgctcggagtcctaatgtg

SEQ ID NO: 20766 - DNA, 21 bp, Artificial Sequence
  Description of Artificial Sequence: Synthetic oligonucleotide
ggcgtcagcaccggcgacaga

SEQ ID NO: 20767 - DNA, 21 bp, Artificial Sequence
  Description of Artificial Sequence: Synthetic oligonucleotide
tatcagagtgcgaatgctcat

SEQ ID NO: 20768 - DNA, 21 bp, Artificial Sequence
  Description of Artificial Sequence: Synthetic oligonucleotide
attagtgggaattctcaggcg

SEQ ID NO: 20769 - DNA, 21 bp, Artificial Sequence
  Description of Artificial Sequence: Synthetic oligonucleotide
agaggcagcgacgccaaaagc

SEQ ID NO: 20770 - DNA, 21 bp, Artificial Sequence
  Description of Artificial Sequence: Synthetic oligonucleotide
agcggcagcagccaaggcaac

SEQ ID NO: 20771 - DNA, 21 bp, Artificial Sequence
  Description of Artificial Sequence: Synthetic oligonucleotide
gatcgtggttctggtacggct

SEQ ID NO: 20772 - DNA, 21 bp, Artificial Sequence
  Description of Artificial Sequence: Synthetic oligonucleotide
ggccacgacagcgcccccgtc

SEQ ID NO: 20773 - DNA, 21 bp, Artificial Sequence
  Description of Artificial Sequence: Synthetic oligonucleotide
ggtagtggtcagacgctgacg

SEQ ID NO: 20774 - DNA, 21 bp, Artificial Sequence
  Description of Artificial Sequence: Synthetic oligonucleotide
gtgactagttcttcggtgagt

SEQ ID NO: 20775 - DNA, 21 bp, Artificial Sequence
  Description of Artificial Sequence: Synthetic oligonucleotide
gaggggaagagttctctgaat

SEQ ID NO: 20776 - DNA, 21 bp, Artificial Sequence
  Description of Artificial Sequence: Synthetic oligonucleotide
gctaagacgaatgagaataag

SEQ ID NO: 20777 - DNA, 21 bp, Artificial Sequence
  Description of Artificial Sequence: Synthetic oligonucleotide
ggtgatcgtaagggtggtcag

SEQ ID NO: 20778 - DNA, 21 bp, Artificial Sequence
  Description of Artificial Sequence: Synthetic oligonucleotide
caggctgggtctgctagtatg

SEQ ID NO: 20779 - DNA, 21 bp, Artificial Sequence
  Description of Artificial Sequence: Synthetic oligonucleotide
gaaagcaccgaccccagaatc

SEQ ID NO: 20780 - DNA, 21 bp, Artificial Sequence
  Description of Artificial Sequence: Synthetic oligonucleotide
ttggagtctaagcatgcgacg

SEQ ID NO: 20781 - DNA, 21 bp, Artificial Sequence
  Description of Artificial Sequence: Synthetic oligonucleotide
ggcaaagcccaaaccaacgtc

SEQ ID NO: 20782 - DNA, 21 bp, Artificial Sequence
  Description of Artificial Sequence: Synthetic oligonucleotide
gaaagagtcagcaccaaccaa

SEQ ID NO: 20783 - DNA, 21 bp, Artificial Sequence
  Description of Artificial Sequence: Synthetic oligonucleotide
agtaatgtcagtggtagtggt

SEQ ID NO: 20784 - DNA, 21 bp, Artificial Sequence
  Description of Artificial Sequence: Synthetic oligonucleotide
accctccaaaaccccaacggc

SEQ ID NO: 20785 - DNA, 21 bp, Artificial Sequence
  Description of Artificial Sequence: Synthetic oligonucleotide
gctccgagtccgggtggttct

SEQ ID NO: 20786 - DNA, 21 bp, Artificial Sequence
  Description of Artificial Sequence: Synthetic oligonucleotide
tcggctcaggcgcctactttg

SEQ ID NO: 20787 - DNA, 21 bp, Artificial Sequence
  Description of Artificial Sequence: Synthetic oligonucleotide
accggcagcgacaaaagcgac

SEQ ID NO: 20788 - DNA, 21 bp, Artificial Sequence
  Description of Artificial Sequence: Synthetic oligonucleotide
accagcaccgcccaaagcacc

SEQ ID NO: 20789 - DNA, 21 bp, Artificial Sequence
  Description of Artificial Sequence: Synthetic oligonucleotide
agcaacggcgccgccagcgtc

SEQ ID NO: 20790 - DNA, 21 bp, Artificial Sequence
  Description of Artificial Sequence: Synthetic oligonucleotide
gaaagcatcaaagccaacagc

SEQ ID NO: 20791 - DNA, 21 bp, Artificial Sequence
  Description of Artificial Sequence: Synthetic oligonucleotide
accggcagcgcccccaccacc

SEQ ID NO: 20792 - DNA, 21 bp, Artificial Sequence
  Description of Artificial Sequence: Synthetic oligonucleotide
cttagggcgcagaagatggag

SEQ ID NO: 20793 - DNA, 21 bp, Artificial Sequence
  Description of Artificial Sequence: Synthetic oligonucleotide
aacaccgccgacagaatgggc

SEQ ID NO: 20794 - DNA, 21 bp, Artificial Sequence
  Description of Artificial Sequence: Synthetic oligonucleotide
gccgacgaaggcagcaaaaaa

SEQ ID NO: 20795 - DNA, 21 bp, Artificial Sequence
  Description of Artificial Sequence: Synthetic oligonucleotide
gtgaaggagtcttctaggggg

SEQ ID NO: 20796 - DNA, 21 bp, Artificial Sequence
  Description of Artificial Sequence: Synthetic oligonucleotide
tcgagtaagcaggttaatggt

SEQ ID NO: 20797 - DNA, 21 bp, Artificial Sequence
  Description of Artificial Sequence: Synthetic oligonucleotide
aacggcagcagcagccccagc

SEQ ID NO: 20798 - DNA, 21 bp, Artificial Sequence
  Description of Artificial Sequence: Synthetic oligonucleotide
gattcgcatggtgctcggact

SEQ ID NO: 20799 - DNA, 21 bp, Artificial Sequence
  Description of Artificial Sequence: Synthetic oligonucleotide
gccaacgccaaacaaggcgcc

SEQ ID NO: 20800 - DNA, 21 bp, Artificial Sequence
  Description of Artificial Sequence: Synthetic oligonucleotide
ggttcttctaatagtcaggct

SEQ ID NO: 20801 - DNA, 21 bp, Artificial Sequence
  Description of Artificial Sequence: Synthetic oligonucleotide
aacagcaccggcagccccatc

SEQ ID NO: 20802 - DNA, 21 bp, Artificial Sequence
  Description of Artificial Sequence: Synthetic oligonucleotide
gggacgactggtactcttacg

SEQ ID NO: 20803 - DNA, 21 bp, Artificial Sequence
  Description of Artificial Sequence: Synthetic oligonucleotide
ggtgttcaggatcctgctcgt

SEQ ID NO: 20804 - DNA, 21 bp, Artificial Sequence
  Description of Artificial Sequence: Synthetic oligonucleotide
gggtcgcagagtgggtcgtct

SEQ ID NO: 20805 - DNA, 21 bp, Artificial Sequence
  Description of Artificial Sequence: Synthetic oligonucleotide
gctacgagttcgagtcagtct

SEQ ID NO: 20806 - DNA, 21 bp, Artificial Sequence
  Description of Artificial Sequence: Synthetic oligonucleotide
aaagaaagcagccccagcctc

SEQ ID NO: 20807 - DNA, 21 bp, Artificial Sequence
  Description of Artificial Sequence: Synthetic oligonucleotide
gccctccccagcaaaaccacc

SEQ ID NO: 20808 - DNA, 21 bp, Artificial Sequence
  Description of Artificial Sequence: Synthetic oligonucleotide
tcggggagtaatactttgtcg

SEQ ID NO: 20809 - DNA, 21 bp, Artificial Sequence
  Description of Artificial Sequence: Synthetic oligonucleotide
agcaaccaaagcagcgtcatc

SEQ ID NO: 20810 - DNA, 21 bp, Artificial Sequence
  Description of Artificial Sequence: Synthetic oligonucleotide
agccccctcaaacaaggcggc

SEQ ID NO: 20811 - DNA, 21 bp, Artificial Sequence
  Description of Artificial Sequence: Synthetic oligonucleotide
agtaattctgggagtcggttg

SEQ ID NO: 20812 - DNA, 21 bp, Artificial Sequence
  Description of Artificial Sequence: Synthetic oligonucleotide
gacgccggcaacggcagccac

SEQ ID NO: 20813 - DNA, 21 bp, Artificial Sequence
  Description of Artificial Sequence: Synthetic oligonucleotide
gggcagaataagccggtgaat

SEQ ID NO: 20814 - DNA, 21 bp, Artificial Sequence
  Description of Artificial Sequence: Synthetic oligonucleotide
gccagcaccaaacccctcctc

SEQ ID NO: 20815 - DNA, 21 bp, Artificial Sequence
  Description of Artificial Sequence: Synthetic oligonucleotide
ggcgaaagacccagccccgcc

SEQ ID NO: 20816 - DNA, 21 bp, Artificial Sequence
  Description of Artificial Sequence: Synthetic oligonucleotide
aatagtcagaatactcatgtc

SEQ ID NO: 20817 - DNA, 21 bp, Artificial Sequence
  Description of Artificial Sequence: Synthetic oligonucleotide
agcagcggccaaagcggcaaa

SEQ ID NO: 20818 - DNA, 21 bp, Artificial Sequence
  Description of Artificial Sequence: Synthetic oligonucleotide
agccccaccaaacccgtcgac

SEQ ID NO: 20819 - DNA, 21 bp, Artificial Sequence
  Description of Artificial Sequence: Synthetic oligonucleotide
gatccgccgagtacttcgaag

SEQ ID NO: 20820 - DNA, 21 bp, Artificial Sequence
  Description of Artificial Sequence: Synthetic oligonucleotide
gtgatttcgcctaagactaat

SEQ ID NO: 20821 - DNA, 21 bp, Artificial Sequence
  Description of Artificial Sequence: Synthetic oligonucleotide
aatgtgtcggggcatccgaat

SEQ ID NO: 20822 - DNA, 21 bp, Artificial Sequence
  Description of Artificial Sequence: Synthetic oligonucleotide
agcagcggcagcggccccatg

SEQ ID NO: 20823 - DNA, 21 bp, Artificial Sequence
  Description of Artificial Sequence: Synthetic oligonucleotide
gaagccaccagcagcaccaac

SEQ ID NO: 20824 - DNA, 21 bp, Artificial Sequence
  Description of Artificial Sequence: Synthetic oligonucleotide
ggccaaacccaaggcagaccc

SEQ ID NO: 20825 - DNA, 21 bp, Artificial Sequence
  Description of Artificial Sequence: Synthetic oligonucleotide
ctcagcagcagccccatcaaa

SEQ ID NO: 20826 - DNA, 21 bp, Artificial Sequence
  Description of Artificial Sequence: Synthetic oligonucleotide
agcaccaacagcaaactcatg

SEQ ID NO: 20827 - DNA, 21 bp, Artificial Sequence
  Description of Artificial Sequence: Synthetic oligonucleotide
gaaaccgccagcaaagtccaa

SEQ ID NO: 20828 - DNA, 21 bp, Artificial Sequence
  Description of Artificial Sequence: Synthetic oligonucleotide
gtgatgagtaaggctggtagt

SEQ ID NO: 20829 - DNA, 21 bp, Artificial Sequence
  Description of Artificial Sequence: Synthetic oligonucleotide
tctggggggtctagtggtctt

SEQ ID NO: 20830 - DNA, 21 bp, Artificial Sequence
  Description of Artificial Sequence: Synthetic oligonucleotide
gccaacagcggcagcaacctc

SEQ ID NO: 20831 - DNA, 21 bp, Artificial Sequence
  Description of Artificial Sequence: Synthetic oligonucleotide
agcaccagacccagcagcgcc

SEQ ID NO: 20832 - DNA, 21 bp, Artificial Sequence
  Description of Artificial Sequence: Synthetic oligonucleotide
gcgcaggagcagtcgggtaag

SEQ ID NO: 20833 - DNA, 21 bp, Artificial Sequence
  Description of Artificial Sequence: Synthetic oligonucleotide
gttgctaattcgcacaataag

SEQ ID NO: 20834 - DNA, 21 bp, Artificial Sequence
  Description of Artificial Sequence: Synthetic oligonucleotide
gcgacgatgaatgcgtctaag

SEQ ID NO: 20835 - DNA, 21 bp, Artificial Sequence
  Description of Artificial Sequence: Synthetic oligonucleotide
aatcctgttaagtctactggt

SEQ ID NO: 20836 - DNA, 21 bp, Artificial Sequence
  Description of Artificial Sequence: Synthetic oligonucleotide
aacgccaacaacagcgccagc

SEQ ID NO: 20837 - DNA, 21 bp, Artificial Sequence
  Description of Artificial Sequence: Synthetic oligonucleotide
agcaacgccaccgccaccatg

SEQ ID NO: 20838 - DNA, 21 bp, Artificial Sequence
  Description of Artificial Sequence: Synthetic oligonucleotide
gacagacaacccaccaacacc

SEQ ID NO: 20839 - DNA, 21 bp, Artificial Sequence
  Description of Artificial Sequence: Synthetic oligonucleotide
ggcagcgaaaccaccgtcaga

SEQ ID NO: 20840 - DNA, 21 bp, Artificial Sequence
  Description of Artificial Sequence: Synthetic oligonucleotide
caaagcgccagcgccaacagc

SEQ ID NO: 20841 - DNA, 21 bp, Artificial Sequence
  Description of Artificial Sequence: Synthetic oligonucleotide
agcggcaccccccaaagaggc

SEQ ID NO: 20842 - DNA, 21 bp, Artificial Sequence
  Description of Artificial Sequence: Synthetic oligonucleotide
caaagccacaaagaaaccacc

SEQ ID NO: 20843 - DNA, 21 bp, Artificial Sequence
  Description of Artificial Sequence: Synthetic oligonucleotide
accgaaagcaacggccacagc

SEQ ID NO: 20844 - DNA, 21 bp, Artificial Sequence
  Description of Artificial Sequence: Synthetic oligonucleotide
acgaagaatactggtaatctt

SEQ ID NO: 20845 - DNA, 21 bp, Artificial Sequence
  Description of Artificial Sequence: Synthetic oligonucleotide
agcagcaacgaccaaagaaaa

SEQ ID NO: 20846 - DNA, 21 bp, Artificial Sequence
  Description of Artificial Sequence: Synthetic oligonucleotide
cgtaatggggggtcttcgctt

SEQ ID NO: 20847 - DNA, 21 bp, Artificial Sequence
  Description of Artificial Sequence: Synthetic oligonucleotide
gaaggcagagccagcagcggc

SEQ ID NO: 20848 - DNA, 21 bp, Artificial Sequence
  Description of Artificial Sequence: Synthetic oligonucleotide
gacgaaacccaaagcagaaaa

SEQ ID NO: 20849 - DNA, 21 bp, Artificial Sequence
  Description of Artificial Sequence: Synthetic oligonucleotide
gagacgcatactgctaagtct

SEQ ID NO: 20850 - DNA, 21 bp, Artificial Sequence
  Description of Artificial Sequence: Synthetic oligonucleotide
gccagcaccagcaacgccggc

SEQ ID NO: 20851 - DNA, 21 bp, Artificial Sequence
  Description of Artificial Sequence: Synthetic oligonucleotide
gccagcagcaacaaagaaggc

SEQ ID NO: 20852 - DNA, 21 bp, Artificial Sequence
  Description of Artificial Sequence: Synthetic oligonucleotide
gcgggtgcgaatactagtaat

SEQ ID NO: 20853 - DNA, 21 bp, Artificial Sequence
  Description of Artificial Sequence: Synthetic oligonucleotide
ggcaaagaaaccagcctcgtc

SEQ ID NO: 20854 - DNA, 21 bp, Artificial Sequence
  Description of Artificial Sequence: Synthetic oligonucleotide
ggtggtgtgagtactaatggg

SEQ ID NO: 20855 - DNA, 21 bp, Artificial Sequence
  Description of Artificial Sequence: Synthetic oligonucleotide
gtcgccaacagcaacgccaaa

SEQ ID NO: 20856 - DNA, 21 bp, Artificial Sequence
  Description of Artificial Sequence: Synthetic oligonucleotide
gttaatacgaagagtcctacg

SEQ ID NO: 20857 - DNA, 21 bp, Artificial Sequence
  Description of Artificial Sequence: Synthetic oligonucleotide
actactagtaaggcgtcgaat

SEQ ID NO: 20858 - DNA, 21 bp, Artificial Sequence
  Description of Artificial Sequence: Synthetic oligonucleotide
caactcgccgaacacggcaaa

SEQ ID NO: 20859 - DNA, 21 bp, Artificial Sequence
  Description of Artificial Sequence: Synthetic oligonucleotide
ggggcgaatgcgactgatcgt

SEQ ID NO: 20860 - DNA, 21 bp, Artificial Sequence
  Description of Artificial Sequence: Synthetic oligonucleotide
actgctgatacgccgaagcag

SEQ ID NO: 20861 - DNA, 21 bp, Artificial Sequence
  Description of Artificial Sequence: Synthetic oligonucleotide
accaacaccaccagcaccacc

SEQ ID NO: 20862 - DNA, 21 bp, Artificial Sequence
  Description of Artificial Sequence: Synthetic oligonucleotide
gacaccggcagaagcagcccc

SEQ ID NO: 20863 - DNA, 21 bp, Artificial Sequence
  Description of Artificial Sequence: Synthetic oligonucleotide
ggcaccgtccccaccagccaa

SEQ ID NO: 20864 - DNA, 21 bp, Artificial Sequence
  Description of Artificial Sequence: Synthetic oligonucleotide
ggcggcacccaagacctcaga

SEQ ID NO: 20865 - DNA, 21 bp, Artificial Sequence
  Description of Artificial Sequence: Synthetic oligonucleotide
ggtcatgataaggctctggcg

SEQ ID NO: 20866 - DNA, 21 bp, Artificial Sequence
  Description of Artificial Sequence: Synthetic oligonucleotide
ttgcctactacgggttcgggt

SEQ ID NO: 20867 - DNA, 21 bp, Artificial Sequence
  Description of Artificial Sequence: Synthetic oligonucleotide
caggggacgtcttcggtggtt

SEQ ID NO: 20868 - DNA, 21 bp, Artificial Sequence
  Description of Artificial Sequence: Synthetic oligonucleotide
caaggcaacggcggccccagc

SEQ ID NO: 20869 - DNA, 21 bp, Artificial Sequence
  Description of Artificial Sequence: Synthetic oligonucleotide
agacccaccgacaaaagcacc

SEQ ID NO: 20870 - DNA, 21 bp, Artificial Sequence
  Description of Artificial Sequence: Synthetic oligonucleotide
agcatcgccacccccagcaaa

SEQ ID NO: 20871 - DNA, 21 bp, Artificial Sequence
  Description of Artificial Sequence: Synthetic oligonucleotide
agacaagacaaactcggcagc

SEQ ID NO: 20872 - DNA, 21 bp, Artificial Sequence
  Description of Artificial Sequence: Synthetic oligonucleotide
agtacgaagcagagttcgggt

SEQ ID NO: 20873 - DNA, 21 bp, Artificial Sequence
  Description of Artificial Sequence: Synthetic oligonucleotide
atggctgataaggctgcggtt

SEQ ID NO: 20874 - DNA, 21 bp, Artificial Sequence
  Description of Artificial Sequence: Synthetic oligonucleotide
gtcggcagcgacgccgtcaga

SEQ ID NO: 20875 - DNA, 21 bp, Artificial Sequence
  Description of Artificial Sequence: Synthetic oligonucleotide
aacgtcaacagcaaagacaaa

SEQ ID NO: 20876 - DNA, 21 bp, Artificial Sequence
  Description of Artificial Sequence: Synthetic oligonucleotide
aatctgtcgacgggtggtggt

SEQ ID NO: 20877 - DNA, 21 bp, Artificial Sequence
  Description of Artificial Sequence: Synthetic oligonucleotide
ggcagaaacgtccccagcagc

SEQ ID NO: 20878 - DNA, 21 bp, Artificial Sequence
  Description of Artificial Sequence: Synthetic oligonucleotide
gctaataaggagggtccgcgg

SEQ ID NO: 20879 - DNA, 21 bp, Artificial Sequence
  Description of Artificial Sequence: Synthetic oligonucleotide
aacgccagccaaaccagcacc

SEQ ID NO: 20880 - DNA, 21 bp, Artificial Sequence
  Description of Artificial Sequence: Synthetic oligonucleotide
cgtaatggggggaattctaat

SEQ ID NO: 20881 - DNA, 21 bp, Artificial Sequence
  Description of Artificial Sequence: Synthetic oligonucleotide
gccagcgccaaaggcagctac

SEQ ID NO: 20882 - DNA, 21 bp, Artificial Sequence
  Description of Artificial Sequence: Synthetic oligonucleotide
ggtgagactaatactaatagg

SEQ ID NO: 20883 - DNA, 21 bp, Artificial Sequence
  Description of Artificial Sequence: Synthetic oligonucleotide
attggtacgcctgctacgtcg

SEQ ID NO: 20884 - DNA, 21 bp, Artificial Sequence
  Description of Artificial Sequence: Synthetic oligonucleotide
gattcgaatgctactagtcgg

SEQ ID NO: 20885 - DNA, 21 bp, Artificial Sequence
  Description of Artificial Sequence: Synthetic oligonucleotide
caaaaagtcaccaaccacgaa

SEQ ID NO: 20886 - DNA, 21 bp, Artificial Sequence
  Description of Artificial Sequence: Synthetic oligonucleotide
gccgacggcagaagcagcacc

SEQ ID NO: 20887 - DNA, 21 bp, Artificial Sequence
  Description of Artificial Sequence: Synthetic oligonucleotide
ggcgccaccggcagcatgaac

SEQ ID NO: 20888 - DNA, 21 bp, Artificial Sequence
  Description of Artificial Sequence: Synthetic oligonucleotide
ggtcttagtcagtcgcctacg

SEQ ID NO: 20889 - DNA, 21 bp, Artificial Sequence
  Description of Artificial Sequence: Synthetic oligonucleotide
actaagtcgaatgagcatgcg

SEQ ID NO: 20890 - DNA, 21 bp, Artificial Sequence
  Description of Artificial Sequence: Synthetic oligonucleotide
agcagcgacaccagaggcctc

SEQ ID NO: 20891 - DNA, 21 bp, Artificial Sequence
  Description of Artificial Sequence: Synthetic oligonucleotide
gtcgccaccaaagccaacacc

SEQ ID NO: 20892 - DNA, 21 bp, Artificial Sequence
  Description of Artificial Sequence: Synthetic oligonucleotide
gacaccggcggcaaaatggtc

SEQ ID NO: 20893 - DNA, 21 bp, Artificial Sequence
  Description of Artificial Sequence: Synthetic oligonucleotide
gctcagcatacgaagtctgct

SEQ ID NO: 20894 - DNA, 21 bp, Artificial Sequence
  Description of Artificial Sequence: Synthetic oligonucleotide
gcgcctggtagtaagcattcg

SEQ ID NO: 20895 - DNA, 21 bp, Artificial Sequence
  Description of Artificial Sequence: Synthetic oligonucleotide
ggcaccagcatcggcgacggc

SEQ ID NO: 20896 - DNA, 21 bp, Artificial Sequence
  Description of Artificial Sequence: Synthetic oligonucleotide
ggcagccaagaccccagaaga

SEQ ID NO: 20897 - DNA, 21 bp, Artificial Sequence
  Description of Artificial Sequence: Synthetic oligonucleotide
ggcctcatgaaagaaagcccc

SEQ ID NO: 20898 - DNA, 21 bp, Artificial Sequence
  Description of Artificial Sequence: Synthetic oligonucleotide
gtcacccacggcaaaagcgaa

SEQ ID NO: 20899 - DNA, 21 bp, Artificial Sequence
  Description of Artificial Sequence: Synthetic oligonucleotide
agcgccgccagcagcaacgcc

SEQ ID NO: 20900 - DNA, 21 bp, Artificial Sequence
  Description of Artificial Sequence: Synthetic oligonucleotide
gctgctggggtttcgtcggtg

SEQ ID NO: 20901 - DNA, 21 bp, Artificial Sequence
  Description of Artificial Sequence: Synthetic oligonucleotide
agccaaaacgaacaaagaagc

SEQ ID NO: 20902 - DNA, 21 bp, Artificial Sequence
  Description of Artificial Sequence: Synthetic oligonucleotide
aacagcaccagccacagcgaa

SEQ ID NO: 20903 - DNA, 21 bp, Artificial Sequence
  Description of Artificial Sequence: Synthetic oligonucleotide
aaccacgaagccggcaaactc

SEQ ID NO: 20904 - DNA, 21 bp, Artificial Sequence
  Description of Artificial Sequence: Synthetic oligonucleotide
aacggcagccccagcgcccaa

SEQ ID NO: 20905 - DNA, 21 bp, Artificial Sequence
  Description of Artificial Sequence: Synthetic oligonucleotide
acgaatacgaagactccttcg

SEQ ID NO: 20906 - DNA, 21 bp, Artificial Sequence
  Description of Artificial Sequence: Synthetic oligonucleotide
gacaaaggccaaaccagcaga

SEQ ID NO: 20907 - DNA, 21 bp, Artificial Sequence
  Description of Artificial Sequence: Synthetic oligonucleotide
agtggtacgtctacgggtcat

SEQ ID NO: 20908 - DNA, 21 bp, Artificial Sequence
  Description of Artificial Sequence: Synthetic oligonucleotide
gtttcgtctaattctgtggct

SEQ ID NO: 20909 - DNA, 21 bp, Artificial Sequence
  Description of Artificial Sequence: Synthetic oligonucleotide
caaagcaacgtccccagcagc

SEQ ID NO: 20910 - DNA, 21 bp, Artificial Sequence
  Description of Artificial Sequence: Synthetic oligonucleotide
gatggtggtactcatcaggct

SEQ ID NO: 20911 - DNA, 21 bp, Artificial Sequence
  Description of Artificial Sequence: Synthetic oligonucleotide
cacgacggcaaacaaagcctc

SEQ ID NO: 20912 - DNA, 21 bp, Artificial Sequence
  Description of Artificial Sequence: Synthetic oligonucleotide
cacaacaccagcagcacccaa

SEQ ID NO: 20913 - DNA, 21 bp, Artificial Sequence
  Description of Artificial Sequence: Synthetic oligonucleotide
tcgccggattctaatattaag

SEQ ID NO: 20914 - DNA, 21 bp, Artificial Sequence
  Description of Artificial Sequence: Synthetic oligonucleotide
atggccagcagcaccaacgtc

SEQ ID NO: 20915 - DNA, 21 bp, Artificial Sequence
  Description of Artificial Sequence: Synthetic oligonucleotide
ggccaaatccccgacgccaaa

SEQ ID NO: 20916 - DNA, 21 bp, Artificial Sequence
  Description of Artificial Sequence: Synthetic oligonucleotide
ggccacagcggcagccccaac

SEQ ID NO: 20917 - DNA, 21 bp, Artificial Sequence
  Description of Artificial Sequence: Synthetic oligonucleotide
gccggcgtcgccaacggcacc

SEQ ID NO: 20918 - DNA, 21 bp, Artificial Sequence
  Description of Artificial Sequence: Synthetic oligonucleotide
agaagcaccagccccagcaac

SEQ ID NO: 20919 - DNA, 21 bp, Artificial Sequence
  Description of Artificial Sequence: Synthetic oligonucleotide
catccgtcgaatacgcagaag

SEQ ID NO: 20920 - DNA, 21 bp, Artificial Sequence
  Description of Artificial Sequence: Synthetic oligonucleotide
accagcggcagcaccctcgcc

SEQ ID NO: 20921 - DNA, 21 bp, Artificial Sequence
  Description of Artificial Sequence: Synthetic oligonucleotide
agttctacttctaagggtgct

SEQ ID NO: 20922 - DNA, 21 bp, Artificial Sequence
  Description of Artificial Sequence: Synthetic oligonucleotide
aacagcaaaaccagcagcggc

SEQ ID NO: 20923 - DNA, 21 bp, Artificial Sequence
  Description of Artificial Sequence: Synthetic oligonucleotide
ggggatatgagtacgaagaat

SEQ ID NO: 20924 - DNA, 21 bp, Artificial Sequence
  Description of Artificial Sequence: Synthetic oligonucleotide
ggggggactaagacggaggtt

SEQ ID NO: 20925 - DNA, 21 bp, Artificial Sequence
  Description of Artificial Sequence: Synthetic oligonucleotide
acgactggtgagaagggtttg

SEQ ID NO: 20926 - DNA, 21 bp, Artificial Sequence
  Description of Artificial Sequence: Synthetic oligonucleotide
gggcttgatacgaagagtgcg

SEQ ID NO: 20927 - DNA, 21 bp, Artificial Sequence
  Description of Artificial Sequence: Synthetic oligonucleotide
tctaatggtgcttcgcctgtt

SEQ ID NO: 20928 - DNA, 21 bp, Artificial Sequence
  Description of Artificial Sequence: Synthetic oligonucleotide
ctccaaaccgccagcagcggc

SEQ ID NO: 20929 - DNA, 21 bp, Artificial Sequence
  Description of Artificial Sequence: Synthetic oligonucleotide
ggtagtgttggtggtgatcgt

SEQ ID NO: 20930 - DNA, 21 bp, Artificial Sequence
  Description of Artificial Sequence: Synthetic oligonucleotide
tctactacgtcgtctaggtct

SEQ ID NO: 20931 - DNA, 21 bp, Artificial Sequence
  Description of Artificial Sequence: Synthetic oligonucleotide
agtgagagtcataagcctgcg

SEQ ID NO: 20932 - DNA, 21 bp, Artificial Sequence
  Description of Artificial Sequence: Synthetic oligonucleotide
aaccccagcagcgccccccaa

SEQ ID NO: 20933 - DNA, 21 bp, Artificial Sequence
  Description of Artificial Sequence: Synthetic oligonucleotide
accagcagcaacaaagaacaa

SEQ ID NO: 20934 - DNA, 21 bp, Artificial Sequence
  Description of Artificial Sequence: Synthetic oligonucleotide
agcggcgtcagcaccagcccc

SEQ ID NO: 20935 - DNA, 21 bp, Artificial Sequence
  Description of Artificial Sequence: Synthetic oligonucleotide
caggagagtcagcagaattcg

SEQ ID NO: 20936 - DNA, 21 bp, Artificial Sequence
  Description of Artificial Sequence: Synthetic oligonucleotide
ctcaacgaaggcaaacccctc

SEQ ID NO: 20937 - DNA, 21 bp, Artificial Sequence
  Description of Artificial Sequence: Synthetic oligonucleotide
gaaaaccccaccaacaccagc

SEQ ID NO: 20938 - DNA, 21 bp, Artificial Sequence
  Description of Artificial Sequence: Synthetic oligonucleotide
gacgccacccaacccagcaaa

SEQ ID NO: 20939 - DNA, 21 bp, Artificial Sequence
  Description of Artificial Sequence: Synthetic oligonucleotide
gcccaagacaaagccagcagc

SEQ ID NO: 20940 - DNA, 21 bp, Artificial Sequence
  Description of Artificial Sequence: Synthetic oligonucleotide
ggcagcaaaaacgccagcacc

SEQ ID NO: 20941 - DNA, 21 bp, Artificial Sequence
  Description of Artificial Sequence: Synthetic oligonucleotide
aacaattctggacagaatcaa

SEQ ID NO: 20942 - DNA, 21 bp, Artificial Sequence
  Description of Artificial Sequence: Synthetic oligonucleotide
gatggtcctgggtcgactaag

SEQ ID NO: 20943 - DNA, 21 bp, Artificial Sequence
  Description of Artificial Sequence: Synthetic oligonucleotide
ctcaacggcagccaaacccac

SEQ ID NO: 20944 - DNA, 21 bp, Artificial Sequence
  Description of Artificial Sequence: Synthetic oligonucleotide
aaggctactgcgcagagtggt

SEQ ID NO: 20945 - DNA, 21 bp, Artificial Sequence
  Description of Artificial Sequence: Synthetic oligonucleotide
accctcagcggcagcgcccac

SEQ ID NO: 20946 - DNA, 21 bp, Artificial Sequence
  Description of Artificial Sequence: Synthetic oligonucleotide
ggcagccccagcaccagcggc

SEQ ID NO: 20947 - DNA, 21 bp, Artificial Sequence
  Description of Artificial Sequence: Synthetic oligonucleotide
ggtttgagtcgtcctaatgag

SEQ ID NO: 20948 - DNA, 21 bp, Artificial Sequence
  Description of Artificial Sequence: Synthetic oligonucleotide
tctcggactgagaatcgtatt

SEQ ID NO: 20949 - DNA, 21 bp, Artificial Sequence
  Description of Artificial Sequence: Synthetic oligonucleotide
gatgataagtctaatcgtgct

SEQ ID NO: 20950 - DNA, 21 bp, Artificial Sequence
  Description of Artificial Sequence: Synthetic oligonucleotide
caaggcaacagcgccgtccaa

SEQ ID NO: 20951 - DNA, 21 bp, Artificial Sequence
  Description of Artificial Sequence: Synthetic oligonucleotide
gccagcaccagccccgccgtc

SEQ ID NO: 20952 - DNA, 21 bp, Artificial Sequence
  Description of Artificial Sequence: Synthetic oligonucleotide
actgggagtactaatactacg

SEQ ID NO: 20953 - DNA, 21 bp, Artificial Sequence
  Description of Artificial Sequence: Synthetic oligonucleotide
gagcgggcggggccttcgcct

SEQ ID NO: 20954 - DNA, 21 bp, Artificial Sequence
  Description of Artificial Sequence: Synthetic oligonucleotide
gtcgaccccagccccgccaga

SEQ ID NO: 20955 - DNA, 21 bp, Artificial Sequence
  Description of Artificial Sequence: Synthetic oligonucleotide
gtggttaattcttctacggct

SEQ ID NO: 20956 - DNA, 21 bp, Artificial Sequence
  Description of Artificial Sequence: Synthetic oligonucleotide
ttgcgtgagccgaaggggacg

SEQ ID NO: 20957 - DNA, 21 bp, Artificial Sequence
  Description of Artificial Sequence: Synthetic oligonucleotide
ctcaacgccagcagcaccacc

SEQ ID NO: 20958 - DNA, 21 bp, Artificial Sequence
  Description of Artificial Sequence: Synthetic oligonucleotide
agcaccatgagcagcagcagc

SEQ ID NO: 20959 - DNA, 21 bp, Artificial Sequence
  Description of Artificial Sequence: Synthetic oligonucleotide
gaaatcaacaaccccaaaatc

SEQ ID NO: 20960 - DNA, 21 bp, Artificial Sequence
  Description of Artificial Sequence: Synthetic oligonucleotide
aaaagcaaccaaaccagccaa

SEQ ID NO: 20961 - DNA, 21 bp, Artificial Sequence
  Description of Artificial Sequence: Synthetic oligonucleotide
ggcagcaccagccaagaaaaa

SEQ ID NO: 20962 - DNA, 21 bp, Artificial Sequence
  Description of Artificial Sequence: Synthetic oligonucleotide
ggtaattctggtgatttgagg

SEQ ID NO: 20963 - DNA, 21 bp, Artificial Sequence
  Description of Artificial Sequence: Synthetic oligonucleotide
tctgggagtaatagtgttagt

SEQ ID NO: 20964 - DNA, 21 bp, Artificial Sequence
  Description of Artificial Sequence: Synthetic oligonucleotide
aaaagcggcagcagcaccaac

SEQ ID NO: 20965 - DNA, 21 bp, Artificial Sequence
  Description of Artificial Sequence: Synthetic oligonucleotide
agccaaggcagcgcccccacc

SEQ ID NO: 20966 - DNA, 21 bp, Artificial Sequence
  Description of Artificial Sequence: Synthetic oligonucleotide
aacagaaccgcccaaagcacc

SEQ ID NO: 20967 - DNA, 21 bp, Artificial Sequence
  Description of Artificial Sequence: Synthetic oligonucleotide
caaggcagcaccaaaaacctc

SEQ ID NO: 20968 - DNA, 21 bp, Artificial Sequence
  Description of Artificial Sequence: Synthetic oligonucleotide
gaaagcaaacaacccagcctc

SEQ ID NO: 20969 - DNA, 21 bp, Artificial Sequence
  Description of Artificial Sequence: Synthetic oligonucleotide
aaccacggccaaaaagacaac

SEQ ID NO: 20970 - DNA, 21 bp, Artificial Sequence
  Description of Artificial Sequence: Synthetic oligonucleotide
aacgccgccacccaaaccaga

SEQ ID NO: 20971 - DNA, 21 bp, Artificial Sequence
  Description of Artificial Sequence: Synthetic oligonucleotide
agacccgtcaacccccccgaa

SEQ ID NO: 20972 - DNA, 21 bp, Artificial Sequence
  Description of Artificial Sequence: Synthetic oligonucleotide
agcggcagcagcagcctcggc

SEQ ID NO: 20973 - DNA, 21 bp, Artificial Sequence
  Description of Artificial Sequence: Synthetic oligonucleotide
caacaaggccacaacagcgcc

SEQ ID NO: 20974 - DNA, 21 bp, Artificial Sequence
  Description of Artificial Sequence: Synthetic oligonucleotide
cggaaggatgtgtctagtact

SEQ ID NO: 20975 - DNA, 21 bp, Artificial Sequence
  Description of Artificial Sequence: Synthetic oligonucleotide
gatggtgtgtcttctaagggg

SEQ ID NO: 20976 - DNA, 21 bp, Artificial Sequence
  Description of Artificial Sequence: Synthetic oligonucleotide
ggcgacagccccagcaaactc

SEQ ID NO: 20977 - DNA, 21 bp, Artificial Sequence
  Description of Artificial Sequence: Synthetic oligonucleotide
tcccaggatactcatcataag

SEQ ID NO: 20978 - DNA, 21 bp, Artificial Sequence
  Description of Artificial Sequence: Synthetic oligonucleotide
tctaatactggtggtgttgct

SEQ ID NO: 20979 - DNA, 21 bp, Artificial Sequence
  Description of Artificial Sequence: Synthetic oligonucleotide
aacggcgccaccagcagaggc

SEQ ID NO: 20980 - DNA, 21 bp, Artificial Sequence
  Description of Artificial Sequence: Synthetic oligonucleotide
catcggggtgagactagtgcg

SEQ ID NO: 20981 - DNA, 21 bp, Artificial Sequence
  Description of Artificial Sequence: Synthetic oligonucleotide
gaaaacagacaaaccatcaaa

SEQ ID NO: 20982 - DNA, 21 bp, Artificial Sequence
  Description of Artificial Sequence: Synthetic oligonucleotide
cacaacgtcgaaaaaaccaaa

SEQ ID NO: 20983 - DNA, 21 bp, Artificial Sequence
  Description of Artificial Sequence: Synthetic oligonucleotide
ctccaaagcaacagcagccaa

SEQ ID NO: 20984 - DNA, 21 bp, Artificial Sequence
  Description of Artificial Sequence: Synthetic oligonucleotide
aatggtaattcttcgacgtcg

SEQ ID NO: 20985 - DNA, 21 bp, Artificial Sequence
  Description of Artificial Sequence: Synthetic oligonucleotide
accgtccaaagcaccagcaga

SEQ ID NO: 20986 - DNA, 21 bp, Artificial Sequence
  Description of Artificial Sequence: Synthetic oligonucleotide
agcaccgacagcacccccaaa

SEQ ID NO: 20987 - DNA, 21 bp, Artificial Sequence
  Description of Artificial Sequence: Synthetic oligonucleotide
accagcaaacccaccaacatg

SEQ ID NO: 20988 - DNA, 21 bp, Artificial Sequence
  Description of Artificial Sequence: Synthetic oligonucleotide
gccaaaagcagcaccaccagc

SEQ ID NO: 20989 - DNA, 21 bp, Artificial Sequence
  Description of Artificial Sequence: Synthetic oligonucleotide
aagactcagggtgttgggaat

SEQ ID NO: 20990 - DNA, 21 bp, Artificial Sequence
  Description of Artificial Sequence: Synthetic oligonucleotide
atgggcaccggcaacaccagc

SEQ ID NO: 20991 - DNA, 21 bp, Artificial Sequence
  Description of Artificial Sequence: Synthetic oligonucleotide
atgggtacggcgaataatcat

SEQ ID NO: 20992 - DNA, 21 bp, Artificial Sequence
  Description of Artificial Sequence: Synthetic oligonucleotide
ggcaccgaaatgcccaaactc

SEQ ID NO: 20993 - DNA, 21 bp, Artificial Sequence
  Description of Artificial Sequence: Synthetic oligonucleotide
gggtctacgtcgaagactcag

SEQ ID NO: 20994 - DNA, 21 bp, Artificial Sequence
  Description of Artificial Sequence: Synthetic oligonucleotide
gtccaaagcaccggcagcggc

SEQ ID NO: 20995 - DNA, 21 bp, Artificial Sequence
  Description of Artificial Sequence: Synthetic oligonucleotide
tcgcagccgggtacgacttcg

SEQ ID NO: 20996 - DNA, 21 bp, Artificial Sequence
  Description of Artificial Sequence: Synthetic oligonucleotide
ggcaccctcacccccgccacc

SEQ ID NO: 20997 - DNA, 21 bp, Artificial Sequence
  Description of Artificial Sequence: Synthetic oligonucleotide
agccccgccgcccacagccaa

SEQ ID NO: 20998 - DNA, 21 bp, Artificial Sequence
  Description of Artificial Sequence: Synthetic oligonucleotide
accggcagcaaaacccaaagc

SEQ ID NO: 20999 - DNA, 21 bp, Artificial Sequence
  Description of Artificial Sequence: Synthetic oligonucleotide
aatagggcggctcagggtggg

SEQ ID NO: 21000 - DNA, 21 bp, Artificial Sequence
  Description of Artificial Sequence: Synthetic oligonucleotide
acggcggatcgtagtggggcg

SEQ ID NO: 21001 - DNA, 21 bp, Artificial Sequence
  Description of Artificial Sequence: Synthetic oligonucleotide
agcaccaccagcgacagcaaa

SEQ ID NO: 21002 - DNA, 21 bp, Artificial Sequence
  Description of Artificial Sequence: Synthetic oligonucleotide
atgagcgaaggcaccagaagc

SEQ ID NO: 21003 - DNA, 21 bp, Artificial Sequence
  Description of Artificial Sequence: Synthetic oligonucleotide
catcaggggtctaagcttgcg

SEQ ID NO: 21004 - DNA, 21 bp, Artificial Sequence
  Description of Artificial Sequence: Synthetic oligonucleotide
gtgcagcaggcttcgtctatt

SEQ ID NO: 21005 - DNA, 21 bp, Artificial Sequence
  Description of Artificial Sequence: Synthetic oligonucleotide
gatcggaatggtaaggttgcg

SEQ ID NO: 21006 - DNA, 21 bp, Artificial Sequence
  Description of Artificial Sequence: Synthetic oligonucleotide
gctggtcgggatgcggcggct

SEQ ID NO: 21007 - DNA, 21 bp, Artificial Sequence
  Description of Artificial Sequence: Synthetic oligonucleotide
accagcagccaaacccccgtc

SEQ ID NO: 21008 - DNA, 21 bp, Artificial Sequence
  Description of Artificial Sequence: Synthetic oligonucleotide
acgacgatgtctagtcatgct

SEQ ID NO: 21009 - DNA, 21 bp, Artificial Sequence
  Description of Artificial Sequence: Synthetic oligonucleotide
actacggggcagggtatgacg

SEQ ID NO: 21010 - DNA, 21 bp, Artificial Sequence
  Description of Artificial Sequence: Synthetic oligonucleotide
agcgaaaaaagcagcgccatg

SEQ ID NO: 21011 - DNA, 21 bp, Artificial Sequence
  Description of Artificial Sequence: Synthetic oligonucleotide
agcggcgccagccaaaaaccc

SEQ ID NO: 21012 - DNA, 21 bp, Artificial Sequence
  Description of Artificial Sequence: Synthetic oligonucleotide
agtgggaataggactgatggg

SEQ ID NO: 21013 - DNA, 21 bp, Artificial Sequence
  Description of Artificial Sequence: Synthetic oligonucleotide
gatttgagtactaagtctggt

SEQ ID NO: 21014 - DNA, 21 bp, Artificial Sequence
  Description of Artificial Sequence: Synthetic oligonucleotide
ggccccgacagagcccccacc

SEQ ID NO: 21015 - DNA, 21 bp, Artificial Sequence
  Description of Artificial Sequence: Synthetic oligonucleotide
aatccggctagttcgtcgagg

SEQ ID NO: 21016 - DNA, 21 bp, Artificial Sequence
  Description of Artificial Sequence: Synthetic oligonucleotide
accgacgaccacaaaggccaa

SEQ ID NO: 21017 - DNA, 21 bp, Artificial Sequence
  Description of Artificial Sequence: Synthetic oligonucleotide
gacggcgtcaaaagcagcagc

SEQ ID NO: 21018 - DNA, 21 bp, Artificial Sequence
  Description of Artificial Sequence: Synthetic oligonucleotide
gccgaaaacaaaagcatgagc

SEQ ID NO: 21019 - DNA, 21 bp, Artificial Sequence
  Description of Artificial Sequence: Synthetic oligonucleotide
gctggttctagtagtattgct

SEQ ID NO: 21020 - DNA, 21 bp, Artificial Sequence
  Description of Artificial Sequence: Synthetic oligonucleotide
tcgacgacggatcgtaatgtt

SEQ ID NO: 21021 - DNA, 21 bp, Artificial Sequence
  Description of Artificial Sequence: Synthetic oligonucleotide
acccaaagcggcggcaccacc

SEQ ID NO: 21022 - DNA, 21 bp, Artificial Sequence
  Description of Artificial Sequence: Synthetic oligonucleotide
agcggccccccccccagcacc

SEQ ID NO: 21023 - DNA, 21 bp, Artificial Sequence
  Description of Artificial Sequence: Synthetic oligonucleotide
gctaggcagagtgaggtggct

SEQ ID NO: 21024 - DNA, 21 bp, Artificial Sequence
  Description of Artificial Sequence: Synthetic oligonucleotide
agcagcggccacggcaacgtc

SEQ ID NO: 21025 - DNA, 21 bp, Artificial Sequence
  Description of Artificial Sequence: Synthetic oligonucleotide
agcgacagcagcaacagagtc

SEQ ID NO: 21026 - DNA, 21 bp, Artificial Sequence
  Description of Artificial Sequence: Synthetic oligonucleotide
cttggttcgccgactaatacg

SEQ ID NO: 21027 - DNA, 21 bp, Artificial Sequence
  Description of Artificial Sequence: Synthetic oligonucleotide
ggcatggacagccccagcaga

SEQ ID NO: 21028 - DNA, 21 bp, Artificial Sequence
  Description of Artificial Sequence: Synthetic oligonucleotide
agcggcaccagcagcagcacc

SEQ ID NO: 21029 - DNA, 21 bp, Artificial Sequence
  Description of Artificial Sequence: Synthetic oligonucleotide
agcaaaggcgacgccgtcggc

SEQ ID NO: 21030 - DNA, 21 bp, Artificial Sequence
  Description of Artificial Sequence: Synthetic oligonucleotide
agtactcctgcggggaatcag

SEQ ID NO: 21031 - DNA, 21 bp, Artificial Sequence
  Description of Artificial Sequence: Synthetic oligonucleotide
caagcccaaagcaccaacctc

SEQ ID NO: 21032 - DNA, 21 bp, Artificial Sequence
  Description of Artificial Sequence: Synthetic oligonucleotide
gaaggcagcaacaccgtcgtc

SEQ ID NO: 21033 - DNA, 21 bp, Artificial Sequence
  Description of Artificial Sequence: Synthetic oligonucleotide
agcagcaaccccagcaacgaa

SEQ ID NO: 21034 - DNA, 21 bp, Artificial Sequence
  Description of Artificial Sequence: Synthetic oligonucleotide
gatcaggggagtgtgcttaag

SEQ ID NO: 21035 - DNA, 21 bp, Artificial Sequence
  Description of Artificial Sequence: Synthetic oligonucleotide
ggcgacagaggcaaaagcagc

SEQ ID NO: 21036 - DNA, 21 bp, Artificial Sequence
  Description of Artificial Sequence: Synthetic oligonucleotide
agcaaagccagcagccacagc

SEQ ID NO: 21037 - DNA, 21 bp, Artificial Sequence
  Description of Artificial Sequence: Synthetic oligonucleotide
gatgggagtggttcgacgcgt

SEQ ID NO: 21038 - DNA, 21 bp, Artificial Sequence
  Description of Artificial Sequence: Synthetic oligonucleotide
cagggtggtggtggtcagggt

SEQ ID NO: 21039 - DNA, 21 bp, Artificial Sequence
  Description of Artificial Sequence: Synthetic oligonucleotide
caaggcaacggcctcctcacc

SEQ ID NO: 21040 - DNA, 21 bp, Artificial Sequence
  Description of Artificial Sequence: Synthetic oligonucleotide
tcgggtacgagtactctgatg

SEQ ID NO: 21041 - DNA, 21 bp, Artificial Sequence
  Description of Artificial Sequence: Synthetic oligonucleotide
gggacgtctggtaaggggtct

SEQ ID NO: 21042 - DNA, 21 bp, Artificial Sequence
  Description of Artificial Sequence: Synthetic oligonucleotide
ggtgttcgtgggaaggagagt

SEQ ID NO: 21043 - DNA, 21 bp, Artificial Sequence
  Description of Artificial Sequence: Synthetic oligonucleotide
gccaaaagccaaggcagcctc

SEQ ID NO: 21044 - DNA, 21 bp, Artificial Sequence
  Description of Artificial Sequence: Synthetic oligonucleotide
cacaccaccggcaccctcgcc

SEQ ID NO: 21045 - DNA, 21 bp, Artificial Sequence
  Description of Artificial Sequence: Synthetic oligonucleotide
acccccgccgtcaacggccac

SEQ ID NO: 21046 - DNA, 21 bp, Artificial Sequence
  Description of Artificial Sequence: Synthetic oligonucleotide
agcgccgtcaccaccagcgcc

SEQ ID NO: 21047 - DNA, 21 bp, Artificial Sequence
  Description of Artificial Sequence: Synthetic oligonucleotide
tctaatgctagtgctgcggtt

SEQ ID NO: 21048 - DNA, 21 bp, Artificial Sequence
  Description of Artificial Sequence: Synthetic oligonucleotide
gctcctcatgatggtaagacg

SEQ ID NO: 21049 - DNA, 21 bp, Artificial Sequence
  Description of Artificial Sequence: Synthetic oligonucleotide
agcagcgccggcaccacccaa

SEQ ID NO: 21050 - DNA, 21 bp, Artificial Sequence
  Description of Artificial Sequence: Synthetic oligonucleotide
aaccaagccagaaccggcgaa

SEQ ID NO: 21051 - DNA, 21 bp, Artificial Sequence
  Description of Artificial Sequence: Synthetic oligonucleotide
actcctcaggcggtgccgacg

SEQ ID NO: 21052 - DNA, 21 bp, Artificial Sequence
  Description of Artificial Sequence: Synthetic oligonucleotide
agcaccggcacccccaccggc

SEQ ID NO: 21053 - DNA, 21 bp, Artificial Sequence
  Description of Artificial Sequence: Synthetic oligonucleotide
agcagcggcaaacccgccggc

SEQ ID NO: 21054 - DNA, 21 bp, Artificial Sequence
  Description of Artificial Sequence: Synthetic oligonucleotide
agtactacgaatgctgctctt

SEQ ID NO: 21055 - DNA, 21 bp, Artificial Sequence
  Description of Artificial Sequence: Synthetic oligonucleotide
atcgccgccaaaggcatgaac

SEQ ID NO: 21056 - DNA, 21 bp, Artificial Sequence
  Description of Artificial Sequence: Synthetic oligonucleotide
atggtcagcgccgccggcagc

SEQ ID NO: 21057 - DNA, 21 bp, Artificial Sequence
  Description of Artificial Sequence: Synthetic oligonucleotide
caaagagacaaaaccagcggc

SEQ ID NO: 21058 - DNA, 21 bp, Artificial Sequence
  Description of Artificial Sequence: Synthetic oligonucleotide
cacggcgccggcagccccagc

SEQ ID NO: 21059 - DNA, 21 bp, Artificial Sequence
  Description of Artificial Sequence: Synthetic oligonucleotide
cagaattcgcatgctacgact

SEQ ID NO: 21060 - DNA, 21 bp, Artificial Sequence
  Description of Artificial Sequence: Synthetic oligonucleotide
cagactactggttctcggaat

SEQ ID NO: 21061 - DNA, 21 bp, Artificial Sequence
  Description of Artificial Sequence: Synthetic oligonucleotide
ctcaccggccaacaccacagc

SEQ ID NO: 21062 - DNA, 21 bp, Artificial Sequence
  Description of Artificial Sequence: Synthetic oligonucleotide
ctcagcggcaccagcaccgtc

SEQ ID NO: 21063 - DNA, 21 bp, Artificial Sequence
  Description of Artificial Sequence: Synthetic oligonucleotide
ctccccaacagcagcagcgcc

SEQ ID NO: 21064 - DNA, 21 bp, Artificial Sequence
  Description of Artificial Sequence: Synthetic oligonucleotide
gagaagggtgcgacgaatttg

SEQ ID NO: 21065 - DNA, 21 bp, Artificial Sequence
  Description of Artificial Sequence: Synthetic oligonucleotide
gatagtggtcgttcgtcgggg

SEQ ID NO: 21066 - DNA, 21 bp, Artificial Sequence
  Description of Artificial Sequence: Synthetic oligonucleotide
gatccgacgaaggagagtcat

SEQ ID NO: 21067 - DNA, 21 bp, Artificial Sequence
  Description of Artificial Sequence: Synthetic oligonucleotide
gatgggattaaggagcatacg

SEQ ID NO: 21068 - DNA, 21 bp, Artificial Sequence
  Description of Artificial Sequence: Synthetic oligonucleotide
gatttgacgtcgcataagact

SEQ ID NO: 21069 - DNA, 21 bp, Artificial Sequence
  Description of Artificial Sequence: Synthetic oligonucleotide
ggcagccaagacagccacaga

SEQ ID NO: 21070 - DNA, 21 bp, Artificial Sequence
  Description of Artificial Sequence: Synthetic oligonucleotide
ggcggcaacaaacacggcaac

SEQ ID NO: 21071 - DNA, 21 bp, Artificial Sequence
  Description of Artificial Sequence: Synthetic oligonucleotide
gtcaccgtcagccccagcaaa

SEQ ID NO: 21072 - DNA, 21 bp, Artificial Sequence
  Description of Artificial Sequence: Synthetic oligonucleotide
gtcggcggcaccgccgtcaaa

SEQ ID NO: 21073 - DNA, 21 bp, Artificial Sequence
  Description of Artificial Sequence: Synthetic oligonucleotide
gtggcttctcagcgtaatgag

SEQ ID NO: 21074 - DNA, 21 bp, Artificial Sequence
  Description of Artificial Sequence: Synthetic oligonucleotide
tgtcaggataagaatgctccg

SEQ ID NO: 21075 - DNA, 21 bp, Artificial Sequence
  Description of Artificial Sequence: Synthetic oligonucleotide
ttggcgagtaagtcttctaat

SEQ ID NO: 21076 - DNA, 21 bp, Artificial Sequence
  Description of Artificial Sequence: Synthetic oligonucleotide
caggtggctgcgaagtcgagt

SEQ ID NO: 21077 - DNA, 21 bp, Artificial Sequence
  Description of Artificial Sequence: Synthetic oligonucleotide
tctgagacgaagggaacggcg

SEQ ID NO: 21078 - DNA, 21 bp, Artificial Sequence
  Description of Artificial Sequence: Synthetic oligonucleotide
agcaccaaaagccccgtcgcc

SEQ ID NO: 21079 - DNA, 21 bp, Artificial Sequence
  Description of Artificial Sequence: Synthetic oligonucleotide
gtcagcagcaacccccccgcc

SEQ ID NO: 21080 - DNA, 21 bp, Artificial Sequence
  Description of Artificial Sequence: Synthetic oligonucleotide
catggtgcttcggcgggtagt

SEQ ID NO: 21081 - DNA, 21 bp, Artificial Sequence
  Description of Artificial Sequence: Synthetic oligonucleotide
aacaccgtcagcagccaaaac

SEQ ID NO: 21082 - DNA, 21 bp, Artificial Sequence
  Description of Artificial Sequence: Synthetic oligonucleotide
gcccacagccaaagcagccaa

SEQ ID NO: 21083 - DNA, 21 bp, Artificial Sequence
  Description of Artificial Sequence: Synthetic oligonucleotide
aatcctaatggttcgagtacg

SEQ ID NO: 21084 - DNA, 21 bp, Artificial Sequence
  Description of Artificial Sequence: Synthetic oligonucleotide
agcgtcgccagcagcaacatg

SEQ ID NO: 21085 - DNA, 21 bp, Artificial Sequence
  Description of Artificial Sequence: Synthetic oligonucleotide
agcagcgacagacaaagcgcc

SEQ ID NO: 21086 - DNA, 21 bp, Artificial Sequence
  Description of Artificial Sequence: Synthetic oligonucleotide
actgctgattcggcgcgttcg

SEQ ID NO: 21087 - DNA, 21 bp, Artificial Sequence
  Description of Artificial Sequence: Synthetic oligonucleotide
ggccccagccacaaccaaagc

SEQ ID NO: 21088 - DNA, 21 bp, Artificial Sequence
  Description of Artificial Sequence: Synthetic oligonucleotide
gtcgccggccccagccccaaa

SEQ ID NO: 21089 - DNA, 21 bp, Artificial Sequence
  Description of Artificial Sequence: Synthetic oligonucleotide
tcgacttctgatagttcgcgg

SEQ ID NO: 21090 - DNA, 21 bp, Artificial Sequence
  Description of Artificial Sequence: Synthetic oligonucleotide
caaaacaccggcagccccacc

SEQ ID NO: 21091 - DNA, 21 bp, Artificial Sequence
  Description of Artificial Sequence: Synthetic oligonucleotide
atgaaggctcagagttcgggg

SEQ ID NO: 21092 - DNA, 21 bp, Artificial Sequence
  Description of Artificial Sequence: Synthetic oligonucleotide
gaaagcggcaaaaccaacatg

SEQ ID NO: 21093 - DNA, 21 bp, Artificial Sequence
  Description of Artificial Sequence: Synthetic oligonucleotide
ctcggcagcggcgaaagaacc

SEQ ID NO: 21094 - DNA, 21 bp, Artificial Sequence
  Description of Artificial Sequence: Synthetic oligonucleotide
ggcctccaaaaaaccagcggc

SEQ ID NO: 21095 - DNA, 21 bp, Artificial Sequence
  Description of Artificial Sequence: Synthetic oligonucleotide
tacaaaagcgacagccaagtc

SEQ ID NO: 21096 - DNA, 21 bp, Artificial Sequence
  Description of Artificial Sequence: Synthetic oligonucleotide
accgccaccaccaaagtcgac

SEQ ID NO: 21097 - DNA, 21 bp, Artificial Sequence
  Description of Artificial Sequence: Synthetic oligonucleotide
ctcaccagcagcaccagcaac

SEQ ID NO: 21098 - DNA, 21 bp, Artificial Sequence
  Description of Artificial Sequence: Synthetic oligonucleotide
tctggggcgtcgcataatttg

SEQ ID NO: 21099 - DNA, 21 bp, Artificial Sequence
  Description of Artificial Sequence: Synthetic oligonucleotide
agcgccgtcaacagcagcaaa

SEQ ID NO: 21100 - DNA, 21 bp, Artificial Sequence
  Description of Artificial Sequence: Synthetic oligonucleotide
atgaccccccccaacaaagaa

SEQ ID NO: 21101 - DNA, 21 bp, Artificial Sequence
  Description of Artificial Sequence: Synthetic oligonucleotide
ggcgacagcgccagcagcaaa

SEQ ID NO: 21102 - DNA, 21 bp, Artificial Sequence
  Description of Artificial Sequence: Synthetic oligonucleotide
ggtaataggtctgaggggaag

SEQ ID NO: 21103 - DNA, 21 bp, Artificial Sequence
  Description of Artificial Sequence: Synthetic oligonucleotide
gccaaacaaaccagcgtcgtc

SEQ ID NO: 21104 - DNA, 21 bp, Artificial Sequence
  Description of Artificial Sequence: Synthetic oligonucleotide
ggcatcggcgccaacagcatc

SEQ ID NO: 21105 - DNA, 21 bp, Artificial Sequence
  Description of Artificial Sequence: Synthetic oligonucleotide
aatgctgagaagcttggtagt

SEQ ID NO: 21106 - DNA, 21 bp, Artificial Sequence
  Description of Artificial Sequence: Synthetic oligonucleotide
ctcgccggcgccggcagcagc

SEQ ID NO: 21107 - DNA, 21 bp, Artificial Sequence
  Description of Artificial Sequence: Synthetic oligonucleotide
ggcgaaagcgccaaagacggc

SEQ ID NO: 21108 - DNA, 21 bp, Artificial Sequence
  Description of Artificial Sequence: Synthetic oligonucleotide
gggactgcgaagcctacgcat

SEQ ID NO: 21109 - DNA, 21 bp, Artificial Sequence
  Description of Artificial Sequence: Synthetic oligonucleotide
atgacgcagaagtcgactgcg

SEQ ID NO: 21110 - DNA, 21 bp, Artificial Sequence
  Description of Artificial Sequence: Synthetic oligonucleotide
ggggttgcgaatactcagtct

SEQ ID NO: 21111 - DNA, 21 bp, Artificial Sequence
  Description of Artificial Sequence: Synthetic oligonucleotide
tcttcgtctaatccttctacg

SEQ ID NO: 21112 - DNA, 21 bp, Artificial Sequence
  Description of Artificial Sequence: Synthetic oligonucleotide
accgccaacgcccaaaacaga

SEQ ID NO: 21113 - DNA, 21 bp, Artificial Sequence
  Description of Artificial Sequence: Synthetic oligonucleotide
agccaaaccagcagcagcgtc

SEQ ID NO: 21114 - DNA, 21 bp, Artificial Sequence
  Description of Artificial Sequence: Synthetic oligonucleotide
agccccaacgaaagaagccac

SEQ ID NO: 21115 - DNA, 21 bp, Artificial Sequence
  Description of Artificial Sequence: Synthetic oligonucleotide
cagggttcgcaggcgactttg

SEQ ID NO: 21116 - DNA, 21 bp, Artificial Sequence
  Description of Artificial Sequence: Synthetic oligonucleotide
gcggagggtgctcgtggtttg

SEQ ID NO: 21117 - DNA, 21 bp, Artificial Sequence
  Description of Artificial Sequence: Synthetic oligonucleotide
ggcgaagaaggcaaaaccaaa

SEQ ID NO: 21118 - DNA, 21 bp, Artificial Sequence
  Description of Artificial Sequence: Synthetic oligonucleotide
gggaagactcagcatggggct

SEQ ID NO: 21119 - DNA, 21 bp, Artificial Sequence
  Description of Artificial Sequence: Synthetic oligonucleotide
ggcgacagcaaacccaccacc

SEQ ID NO: 21120 - DNA, 21 bp, Artificial Sequence
  Description of Artificial Sequence: Synthetic oligonucleotide
ctcaacggcagagaaagcggc

SEQ ID NO: 21121 - DNA, 21 bp, Artificial Sequence
  Description of Artificial Sequence: Synthetic oligonucleotide
ctcgccgcccccagcaacgcc

SEQ ID NO: 21122 - DNA, 21 bp, Artificial Sequence
  Description of Artificial Sequence: Synthetic oligonucleotide
gattcgagtaagtctgctggg

SEQ ID NO: 21123 - DNA, 21 bp, Artificial Sequence
  Description of Artificial Sequence: Synthetic oligonucleotide
ggcggcaccagcgtccacacc

SEQ ID NO: 21124 - DNA, 21 bp, Artificial Sequence
  Description of Artificial Sequence: Synthetic oligonucleotide
ggcgtcaacagcagcaaaagc

SEQ ID NO: 21125 - DNA, 21 bp, Artificial Sequence
  Description of Artificial Sequence: Synthetic oligonucleotide
agccacaacggcagcaacacc

SEQ ID NO: 21126 - DNA, 21 bp, Artificial Sequence
  Description of Artificial Sequence: Synthetic oligonucleotide
gtcggcgtccccgtcagcacc

SEQ ID NO: 21127 - DNA, 21 bp, Artificial Sequence
  Description of Artificial Sequence: Synthetic oligonucleotide
gccagcaacaaagtcaccagc

SEQ ID NO: 21128 - DNA, 21 bp, Artificial Sequence
  Description of Artificial Sequence: Synthetic oligonucleotide
ggcaaaagcggcggcagcagc

SEQ ID NO: 21129 - DNA, 21 bp, Artificial Sequence
  Description of Artificial Sequence: Synthetic oligonucleotide
acgacgggtagtgggaatcgg

SEQ ID NO: 21130 - DNA, 21 bp, Artificial Sequence
  Description of Artificial Sequence: Synthetic oligonucleotide
actactggtgatggtgctaag

SEQ ID NO: 21131 - DNA, 21 bp, Artificial Sequence
  Description of Artificial Sequence: Synthetic oligonucleotide
ctcggcggcgccaccaacagc

SEQ ID NO: 21132 - DNA, 21 bp, Artificial Sequence
  Description of Artificial Sequence: Synthetic oligonucleotide
gaaggcaacagcaaactcgtc

SEQ ID NO: 21133 - DNA, 21 bp, Artificial Sequence
  Description of Artificial Sequence: Synthetic oligonucleotide
gacggcggcagcaaccaagcc

SEQ ID NO: 21134 - DNA, 21 bp, Artificial Sequence
  Description of Artificial Sequence: Synthetic oligonucleotide
gagggtacggagagtcggagg

SEQ ID NO: 21135 - DNA, 21 bp, Artificial Sequence
  Description of Artificial Sequence: Synthetic oligonucleotide
gttggttctacttcgtcgagt

SEQ ID NO: 21136 - DNA, 21 bp, Artificial Sequence
  Description of Artificial Sequence: Synthetic oligonucleotide
accgacggcaaacaccaaccc

SEQ ID NO: 21137 - DNA, 21 bp, Artificial Sequence
  Description of Artificial Sequence: Synthetic oligonucleotide
atcagcaccagcgccagcaaa

SEQ ID NO: 21138 - DNA, 21 bp, Artificial Sequence
  Description of Artificial Sequence: Synthetic oligonucleotide
aacgccaacaaagacgtcgcc

SEQ ID NO: 21139 - DNA, 21 bp, Artificial Sequence
  Description of Artificial Sequence: Synthetic oligonucleotide
caggaggcgcagaaggtgggg

SEQ ID NO: 21140 - DNA, 21 bp, Artificial Sequence
  Description of Artificial Sequence: Synthetic oligonucleotide
gggctggattcgactcgtatt

SEQ ID NO: 21141 - DNA, 21 bp, Artificial Sequence
  Description of Artificial Sequence: Synthetic oligonucleotide
tctgctaataatgctgcttct

SEQ ID NO: 21142 - DNA, 21 bp, Artificial Sequence
  Description of Artificial Sequence: Synthetic oligonucleotide
ggtgcgactgtgaagaatttg

SEQ ID NO: 21143 - DNA, 21 bp, Artificial Sequence
  Description of Artificial Sequence: Synthetic oligonucleotide
aacagccccagcaccaacagc

SEQ ID NO: 21144 - DNA, 21 bp, Artificial Sequence
  Description of Artificial Sequence: Synthetic oligonucleotide
atgggccaaagccaaaccctc

SEQ ID NO: 21145 - DNA, 21 bp, Artificial Sequence
  Description of Artificial Sequence: Synthetic oligonucleotide
caaggcagcaccaaaggcatc

SEQ ID NO: 21146 - DNA, 21 bp, Artificial Sequence
  Description of Artificial Sequence: Synthetic oligonucleotide
agcaccggccccagcgccgcc

SEQ ID NO: 21147 - DNA, 21 bp, Artificial Sequence
  Description of Artificial Sequence: Synthetic oligonucleotide
atgtctactaatggttctact

SEQ ID NO: 21148 - DNA, 21 bp, Artificial Sequence
  Description of Artificial Sequence: Synthetic oligonucleotide
gaggtgacgcctcataggggt

SEQ ID NO: 21149 - DNA, 21 bp, Artificial Sequence
  Description of Artificial Sequence: Synthetic oligonucleotide
gatactactgataagactcgg

SEQ ID NO: 21150 - DNA, 21 bp, Artificial Sequence
  Description of Artificial Sequence: Synthetic oligonucleotide
cacaacagccccagcgccaaa

SEQ ID NO: 21151 - DNA, 21 bp, Artificial Sequence
  Description of Artificial Sequence: Synthetic oligonucleotide
gacgccagaagcagcgccgcc

SEQ ID NO: 21152 - DNA, 21 bp, Artificial Sequence
  Description of Artificial Sequence: Synthetic oligonucleotide
ggtaagaatggttctacgatg

SEQ ID NO: 21153 - DNA, 21 bp, Artificial Sequence
  Description of Artificial Sequence: Synthetic oligonucleotide
accggcggcggcggccaacaa

SEQ ID NO: 21154 - DNA, 21 bp, Artificial Sequence
  Description of Artificial Sequence: Synthetic oligonucleotide
agcagaagcaaagccagcgaa

SEQ ID NO: 21155 - DNA, 21 bp, Artificial Sequence
  Description of Artificial Sequence: Synthetic oligonucleotide
agcggcgacagaaccgaaggc

SEQ ID NO: 21156 - DNA, 21 bp, Artificial Sequence
  Description of Artificial Sequence: Synthetic oligonucleotide
atgtcgggtactagttctgtt

SEQ ID NO: 21157 - DNA, 21 bp, Artificial Sequence
  Description of Artificial Sequence: Synthetic oligonucleotide
gatgctaggccgacgtctggt

SEQ ID NO: 21158 - DNA, 21 bp, Artificial Sequence
  Description of Artificial Sequence: Synthetic oligonucleotide
gcttctgctagttcgaataag

SEQ ID NO: 21159 - DNA, 21 bp, Artificial Sequence
  Description of Artificial Sequence: Synthetic oligonucleotide
gttggtcagaaggttggttcg

SEQ ID NO: 21160 - DNA, 21 bp, Artificial Sequence
  Description of Artificial Sequence: Synthetic oligonucleotide
tattcgggtacggggaatcag

SEQ ID NO: 21161 - DNA, 21 bp, Artificial Sequence
  Description of Artificial Sequence: Synthetic oligonucleotide
tcggatacgaagtctcagagt

SEQ ID NO: 21162 - DNA, 21 bp, Artificial Sequence
  Description of Artificial Sequence: Synthetic oligonucleotide
ggtgctaataaggatacgtcg

SEQ ID NO: 21163 - DNA, 21 bp, Artificial Sequence
  Description of Artificial Sequence: Synthetic oligonucleotide
agacaaggccaaagcgtcagc

SEQ ID NO: 21164 - DNA, 21 bp, Artificial Sequence
  Description of Artificial Sequence: Synthetic oligonucleotide
gagaattctcaggctagtagg

SEQ ID NO: 21165 - DNA, 21 bp, Artificial Sequence
  Description of Artificial Sequence: Synthetic oligonucleotide
gagcatgtgtctaagcttggg

SEQ ID NO: 21166 - DNA, 21 bp, Artificial Sequence
  Description of Artificial Sequence: Synthetic oligonucleotide
gccaccggcaaccaagcccaa

SEQ ID NO: 21167 - DNA, 21 bp, Artificial Sequence
  Description of Artificial Sequence: Synthetic oligonucleotide
acgagtgggactgctaataat

SEQ ID NO: 21168 - DNA, 21 bp, Artificial Sequence
  Description of Artificial Sequence: Synthetic oligonucleotide
agcgtcgtcagcagcaaccaa

SEQ ID NO: 21169 - DNA, 21 bp, Artificial Sequence
  Description of Artificial Sequence: Synthetic oligonucleotide
gacaaaagcacccaaagcagc

SEQ ID NO: 21170 - DNA, 21 bp, Artificial Sequence
  Description of Artificial Sequence: Synthetic oligonucleotide
gtccaaagcagcaacatcggc

SEQ ID NO: 21171 - DNA, 21 bp, Artificial Sequence
  Description of Artificial Sequence: Synthetic oligonucleotide
tcgccgtctaattcgacgtct

SEQ ID NO: 21172 - DNA, 21 bp, Artificial Sequence
  Description of Artificial Sequence: Synthetic oligonucleotide
gacagcggcaaaagccaaagc

SEQ ID NO: 21173 - DNA, 21 bp, Artificial Sequence
  Description of Artificial Sequence: Synthetic oligonucleotide
cagcctacggcttcgccttct

SEQ ID NO: 21174 - DNA, 21 bp, Artificial Sequence
  Description of Artificial Sequence: Synthetic oligonucleotide
aacaccaacaaaaccgccagc

SEQ ID NO: 21175 - DNA, 21 bp, Artificial Sequence
  Description of Artificial Sequence: Synthetic oligonucleotide
agcgcccccagcggcaaagaa

SEQ ID NO: 21176 - DNA, 21 bp, Artificial Sequence
  Description of Artificial Sequence: Synthetic oligonucleotide
agcggcctcgaaaccaaaagc

SEQ ID NO: 21177 - DNA, 21 bp, Artificial Sequence
  Description of Artificial Sequence: Synthetic oligonucleotide
tatactgggaaggtgtctagt

SEQ ID NO: 21178 - DNA, 21 bp, Artificial Sequence
  Description of Artificial Sequence: Synthetic oligonucleotide
aacctcggcagcgtcagagac

SEQ ID NO: 21179 - DNA, 21 bp, Artificial Sequence
  Description of Artificial Sequence: Synthetic oligonucleotide
gctccggattctaagaatggg

SEQ ID NO: 21180 - DNA, 21 bp, Artificial Sequence
  Description of Artificial Sequence: Synthetic oligonucleotide
aattctgctaagggtattgct

SEQ ID NO: 21181 - DNA, 21 bp, Artificial Sequence
  Description of Artificial Sequence: Synthetic oligonucleotide
tcgacgggtgctcctgctact

SEQ ID NO: 21182 - DNA, 21 bp, Artificial Sequence
  Description of Artificial Sequence: Synthetic oligonucleotide
tctcagactggtggtaggggg

SEQ ID NO: 21183 - DNA, 21 bp, Artificial Sequence
  Description of Artificial Sequence: Synthetic oligonucleotide
tgcagcggcgaccccagaaaa

SEQ ID NO: 21184 - DNA, 21 bp, Artificial Sequence
  Description of Artificial Sequence: Synthetic oligonucleotide
aaaagcgccagccccgcccac

SEQ ID NO: 21185 - DNA, 21 bp, Artificial Sequence
  Description of Artificial Sequence: Synthetic oligonucleotide
gaaggcgtccccagcaaactc

SEQ ID NO: 21186 - DNA, 21 bp, Artificial Sequence
  Description of Artificial Sequence: Synthetic oligonucleotide
ggccccagcgccaaagtcaac

SEQ ID NO: 21187 - DNA, 21 bp, Artificial Sequence
  Description of Artificial Sequence: Synthetic oligonucleotide
actactgggactacgtcgagg

SEQ ID NO: 21188 - DNA, 21 bp, Artificial Sequence
  Description of Artificial Sequence: Synthetic oligonucleotide
accgccgaagtcagaggcagc

SEQ ID NO: 21189 - DNA, 21 bp, Artificial Sequence
  Description of Artificial Sequence: Synthetic oligonucleotide
tcgacggctgtgagttcgtcg

SEQ ID NO: 21190 - DNA, 21 bp, Artificial Sequence
  Description of Artificial Sequence: Synthetic oligonucleotide
aacggcaaccaacaaggcaga

SEQ ID NO: 21191 - DNA, 21 bp, Artificial Sequence
  Description of Artificial Sequence: Synthetic oligonucleotide
aacagcaccgaacacagcaga

SEQ ID NO: 21192 - DNA, 21 bp, Artificial Sequence
  Description of Artificial Sequence: Synthetic oligonucleotide
aaggatgatcggactacgggt

SEQ ID NO: 21193 - DNA, 21 bp, Artificial Sequence
  Description of Artificial Sequence: Synthetic oligonucleotide
aatcaggattctagtaagggt

SEQ ID NO: 21194 - DNA, 21 bp, Artificial Sequence
  Description of Artificial Sequence: Synthetic oligonucleotide
aatggtcctagtaatggttcg

SEQ ID NO: 21195 - DNA, 21 bp, Artificial Sequence
  Description of Artificial Sequence: Synthetic oligonucleotide
atggaggggggtcagcgtgct

SEQ ID NO: 21196 - DNA, 21 bp, Artificial Sequence
  Description of Artificial Sequence: Synthetic oligonucleotide
caagacggcagaaaccaaccc

SEQ ID NO: 21197 - DNA, 21 bp, Artificial Sequence
  Description of Artificial Sequence: Synthetic oligonucleotide
caggttggttctgcgacggct

SEQ ID NO: 21198 - DNA, 21 bp, Artificial Sequence
  Description of Artificial Sequence: Synthetic oligonucleotide
gaaggcagcagcagaagcggc

SEQ ID NO: 21199 - DNA, 21 bp, Artificial Sequence
  Description of Artificial Sequence: Synthetic oligonucleotide
gacagcagcaacctcaaaagc

SEQ ID NO: 21200 - DNA, 21 bp, Artificial Sequence
  Description of Artificial Sequence: Synthetic oligonucleotide
gccagaagcaaagacagcagc

SEQ ID NO: 21201 - DNA, 21 bp, Artificial Sequence
  Description of Artificial Sequence: Synthetic oligonucleotide
gggggtactagttcttctatt

SEQ ID NO: 21202 - DNA, 21 bp, Artificial Sequence
  Description of Artificial Sequence: Synthetic oligonucleotide
gtcaccaccagagaaagcgtc

SEQ ID NO: 21203 - DNA, 21 bp, Artificial Sequence
  Description of Artificial Sequence: Synthetic oligonucleotide
tcttcgggtacgggtccgtcg

SEQ ID NO: 21204 - DNA, 21 bp, Artificial Sequence
  Description of Artificial Sequence: Synthetic oligonucleotide
tcttctcagccgactttgggt

SEQ ID NO: 21205 - DNA, 21 bp, Artificial Sequence
  Description of Artificial Sequence: Synthetic oligonucleotide
gccgtcggcaccgccaccagc

SEQ ID NO: 21206 - DNA, 21 bp, Artificial Sequence
  Description of Artificial Sequence: Synthetic oligonucleotide
gccaccaccagcggcagcctc

SEQ ID NO: 21207 - DNA, 21 bp, Artificial Sequence
  Description of Artificial Sequence: Synthetic oligonucleotide
accgaaaacagagacagcagc

SEQ ID NO: 21208 - DNA, 21 bp, Artificial Sequence
  Description of Artificial Sequence: Synthetic oligonucleotide
gacaaaaacaacaccgccaga

SEQ ID NO: 21209 - DNA, 21 bp, Artificial Sequence
  Description of Artificial Sequence: Synthetic oligonucleotide
atggccagcaacgacagcaaa

SEQ ID NO: 21210 - DNA, 21 bp, Artificial Sequence
  Description of Artificial Sequence: Synthetic oligonucleotide
cacggcagcaccgccagccaa

SEQ ID NO: 21211 - DNA, 21 bp, Artificial Sequence
  Description of Artificial Sequence: Synthetic oligonucleotide
gatcatagtcatgctattaag

SEQ ID NO: 21212 - DNA, 21 bp, Artificial Sequence
  Description of Artificial Sequence: Synthetic oligonucleotide
aatagtggtcagcattcgaat

SEQ ID NO: 21213 - DNA, 21 bp, Artificial Sequence
  Description of Artificial Sequence: Synthetic oligonucleotide
agttctaatggtgtgggtgcg

SEQ ID NO: 21214 - DNA, 21 bp, Artificial Sequence
  Description of Artificial Sequence: Synthetic oligonucleotide
gaaggcaaaaaagccgacccc

SEQ ID NO: 21215 - DNA, 21 bp, Artificial Sequence
  Description of Artificial Sequence: Synthetic oligonucleotide
gccccccaaagcagcaacggc

SEQ ID NO: 21216 - DNA, 21 bp, Artificial Sequence
  Description of Artificial Sequence: Synthetic oligonucleotide
gctaggagtaaggagcagcag

SEQ ID NO: 21217 - DNA, 21 bp, Artificial Sequence
  Description of Artificial Sequence: Synthetic oligonucleotide
gggcagaatggtactattaat

SEQ ID NO: 21218 - DNA, 21 bp, Artificial Sequence
  Description of Artificial Sequence: Synthetic oligonucleotide
gtcaccaccgcccaacccgtc

SEQ ID NO: 21219 - DNA, 21 bp, Artificial Sequence
  Description of Artificial Sequence: Synthetic oligonucleotide
tctgggactaaggagatgagt

SEQ ID NO: 21220 - DNA, 21 bp, Artificial Sequence
  Description of Artificial Sequence: Synthetic oligonucleotide
accagccaagccaccacccaa

SEQ ID NO: 21221 - DNA, 21 bp, Artificial Sequence
  Description of Artificial Sequence: Synthetic oligonucleotide
accaaagaaaccacctacctc

SEQ ID NO: 21222 - DNA, 21 bp, Artificial Sequence
  Description of Artificial Sequence: Synthetic oligonucleotide
accggcgtcaacagcaccaga

SEQ ID NO: 21223 - DNA, 21 bp, Artificial Sequence
  Description of Artificial Sequence: Synthetic oligonucleotide
agcgccagcaccagcaccgtc

SEQ ID NO: 21224 - DNA, 21 bp, Artificial Sequence
  Description of Artificial Sequence: Synthetic oligonucleotide
cacaacgccgccgccaccgcc

SEQ ID NO: 21225 - DNA, 21 bp, Artificial Sequence
  Description of Artificial Sequence: Synthetic oligonucleotide
accggccaaagcgccggcacc

SEQ ID NO: 21226 - DNA, 21 bp, Artificial Sequence
  Description of Artificial Sequence: Synthetic oligonucleotide
ggcttcggcgacaaaagcgtc

SEQ ID NO: 21227 - DNA, 21 bp, Artificial Sequence
  Description of Artificial Sequence: Synthetic oligonucleotide
aacagcagccaacccaaaacc

SEQ ID NO: 21228 - DNA, 21 bp, Artificial Sequence
  Description of Artificial Sequence: Synthetic oligonucleotide
accaaacaaaacgcccccctc

SEQ ID NO: 21229 - DNA, 21 bp, Artificial Sequence
  Description of Artificial Sequence: Synthetic oligonucleotide
agccaagaaaaaagcctcggc

SEQ ID NO: 21230 - DNA, 21 bp, Artificial Sequence
  Description of Artificial Sequence: Synthetic oligonucleotide
agcgtcagccccagaaaaggc

SEQ ID NO: 21231 - DNA, 21 bp, Artificial Sequence
  Description of Artificial Sequence: Synthetic oligonucleotide
caggagcatacgaagacttcg

SEQ ID NO: 21232 - DNA, 21 bp, Artificial Sequence
  Description of Artificial Sequence: Synthetic oligonucleotide
gacagcagcaaccccccccaa

SEQ ID NO: 21233 - DNA, 21 bp, Artificial Sequence
  Description of Artificial Sequence: Synthetic oligonucleotide
ggcagccaagaaagcagacac

SEQ ID NO: 21234 - DNA, 21 bp, Artificial Sequence
  Description of Artificial Sequence: Synthetic oligonucleotide
ggcgaaggcaccagccccacc

SEQ ID NO: 21235 - DNA, 21 bp, Artificial Sequence
  Description of Artificial Sequence: Synthetic oligonucleotide
ggcgacagcggcgccaaccac

SEQ ID NO: 21236 - DNA, 21 bp, Artificial Sequence
  Description of Artificial Sequence: Synthetic oligonucleotide
tctggtgatcctagtcgtatt

SEQ ID NO: 21237 - DNA, 21 bp, Artificial Sequence
  Description of Artificial Sequence: Synthetic oligonucleotide
agtgctagttctagtgagaag

SEQ ID NO: 21238 - DNA, 21 bp, Artificial Sequence
  Description of Artificial Sequence: Synthetic oligonucleotide
agttcgaagacgtctaataat

SEQ ID NO: 21239 - DNA, 21 bp, Artificial Sequence
  Description of Artificial Sequence: Synthetic oligonucleotide
gagggttcgagtagtgctgcg

SEQ ID NO: 21240 - DNA, 21 bp, Artificial Sequence
  Description of Artificial Sequence: Synthetic oligonucleotide
ggccaaatcgacggccacaaa

SEQ ID NO: 21241 - DNA, 21 bp, Artificial Sequence
  Description of Artificial Sequence: Synthetic oligonucleotide
ggcgacgccaaagccgcctac

SEQ ID NO: 21242 - DNA, 21 bp, Artificial Sequence
  Description of Artificial Sequence: Synthetic oligonucleotide
gagcgtaatacggcgtcgcat

SEQ ID NO: 21243 - DNA, 21 bp, Artificial Sequence
  Description of Artificial Sequence: Synthetic oligonucleotide
aatggtactgcgcagattagt

SEQ ID NO: 21244 - DNA, 21 bp, Artificial Sequence
  Description of Artificial Sequence: Synthetic oligonucleotide
actacgagttctgggagtgct

SEQ ID NO: 21245 - DNA, 21 bp, Artificial Sequence
  Description of Artificial Sequence: Synthetic oligonucleotide
agccaaggcggccccagcgcc

SEQ ID NO: 21246 - DNA, 21 bp, Artificial Sequence
  Description of Artificial Sequence: Synthetic oligonucleotide
gctacgccgtcgaatacgggg

SEQ ID NO: 21247 - DNA, 21 bp, Artificial Sequence
  Description of Artificial Sequence: Synthetic oligonucleotide
atgaattcgggttcgtcgtct

SEQ ID NO: 21248 - DNA, 21 bp, Artificial Sequence
  Description of Artificial Sequence: Synthetic oligonucleotide
aattcgaatcccagtattagt

SEQ ID NO: 21249 - DNA, 21 bp, Artificial Sequence
  Description of Artificial Sequence: Synthetic oligonucleotide
tctgctgtttcgacgccttcg

SEQ ID NO: 21250 - DNA, 21 bp, Artificial Sequence
  Description of Artificial Sequence: Synthetic oligonucleotide
atcggcggccaaggcggcagc

SEQ ID NO: 21251 - DNA, 21 bp, Artificial Sequence
  Description of Artificial Sequence: Synthetic oligonucleotide
aacagagaaggcagcatggtc

SEQ ID NO: 21252 - DNA, 21 bp, Artificial Sequence
  Description of Artificial Sequence: Synthetic oligonucleotide
actcggagtgagcggagtcag

SEQ ID NO: 21253 - DNA, 21 bp, Artificial Sequence
  Description of Artificial Sequence: Synthetic oligonucleotide
gccaaacccggcagcagcgcc

SEQ ID NO: 21254 - DNA, 21 bp, Artificial Sequence
  Description of Artificial Sequence: Synthetic oligonucleotide
tcggataagactgggaatgtt

SEQ ID NO: 21255 - DNA, 21 bp, Artificial Sequence
  Description of Artificial Sequence: Synthetic oligonucleotide
tcgactcatggtactaaggct

SEQ ID NO: 21256 - DNA, 21 bp, Artificial Sequence
  Description of Artificial Sequence: Synthetic oligonucleotide
tctgctgagactagtaagggg

SEQ ID NO: 21257 - DNA, 21 bp, Artificial Sequence
  Description of Artificial Sequence: Synthetic oligonucleotide
agcaccggcaccagcagcaga

SEQ ID NO: 21258 - DNA, 21 bp, Artificial Sequence
  Description of Artificial Sequence: Synthetic oligonucleotide
acgggtggtacgccttcgccg

SEQ ID NO: 21259 - DNA, 21 bp, Artificial Sequence
  Description of Artificial Sequence: Synthetic oligonucleotide
agcaaaaccaccggccccgcc

SEQ ID NO: 21260 - DNA, 21 bp, Artificial Sequence
  Description of Artificial Sequence: Synthetic oligonucleotide
agcagcatcaccggcggcggc

SEQ ID NO: 21261 - DNA, 21 bp, Artificial Sequence
  Description of Artificial Sequence: Synthetic oligonucleotide
attaaaagtgagtctacgggg

SEQ ID NO: 21262 - DNA, 21 bp, Artificial Sequence
  Description of Artificial Sequence: Synthetic oligonucleotide
accagcagccccagcctcagc

SEQ ID NO: 21263 - DNA, 21 bp, Artificial Sequence
  Description of Artificial Sequence: Synthetic oligonucleotide
ggcgccagagacaaagccaac

SEQ ID NO: 21264 - DNA, 21 bp, Artificial Sequence
  Description of Artificial Sequence: Synthetic oligonucleotide
acccccgaaagcagaagcagc

SEQ ID NO: 21265 - DNA, 21 bp, Artificial Sequence
  Description of Artificial Sequence: Synthetic oligonucleotide
atgggggataagacgtttgct

SEQ ID NO: 21266 - DNA, 21 bp, Artificial Sequence
  Description of Artificial Sequence: Synthetic oligonucleotide
gcgcaggggagtcattcttct

SEQ ID NO: 21267 - DNA, 21 bp, Artificial Sequence
  Description of Artificial Sequence: Synthetic oligonucleotide
ttgaatgatcggtctcctagt

SEQ ID NO: 21268 - DNA, 21 bp, Artificial Sequence
  Description of Artificial Sequence: Synthetic oligonucleotide
ttgaatgctgggcctgggtct

SEQ ID NO: 21269 - DNA, 21 bp, Artificial Sequence
  Description of Artificial Sequence: Synthetic oligonucleotide
aatcggacgggtactaatagt

SEQ ID NO: 21270 - DNA, 21 bp, Artificial Sequence
  Description of Artificial Sequence: Synthetic oligonucleotide
accaacagccccgccagcagc

SEQ ID NO: 21271 - DNA, 21 bp, Artificial Sequence
  Description of Artificial Sequence: Synthetic oligonucleotide
agcaacagcgccaaaatgagc

SEQ ID NO: 21272 - DNA, 21 bp, Artificial Sequence
  Description of Artificial Sequence: Synthetic oligonucleotide
caggcttctggtggtacgagt

SEQ ID NO: 21273 - DNA, 21 bp, Artificial Sequence
  Description of Artificial Sequence: Synthetic oligonucleotide
gaacaagacagcaccaacaga

SEQ ID NO: 21274 - DNA, 21 bp, Artificial Sequence
  Description of Artificial Sequence: Synthetic oligonucleotide
acgcaggcgaaggctagtgcg

SEQ ID NO: 21275 - DNA, 21 bp, Artificial Sequence
  Description of Artificial Sequence: Synthetic oligonucleotide
ctcgccagcggcagccccgcc

SEQ ID NO: 21276 - DNA, 21 bp, Artificial Sequence
  Description of Artificial Sequence: Synthetic oligonucleotide
gacagcaccggcaaaggcagc

SEQ ID NO: 21277 - DNA, 21 bp, Artificial Sequence
  Description of Artificial Sequence: Synthetic oligonucleotide
agcagcagcaccagcagcaga

SEQ ID NO: 21278 - DNA, 21 bp, Artificial Sequence
  Description of Artificial Sequence: Synthetic oligonucleotide
aagaattcgggtactactggt

SEQ ID NO: 21279 - DNA, 21 bp, Artificial Sequence
  Description of Artificial Sequence: Synthetic oligonucleotide
ctggcgaatggggctactcag

SEQ ID NO: 21280 - DNA, 21 bp, Artificial Sequence
  Description of Artificial Sequence: Synthetic oligonucleotide
acttcgggtgggtcttctact

SEQ ID NO: 21281 - DNA, 21 bp, Artificial Sequence
  Description of Artificial Sequence: Synthetic oligonucleotide
gcccaagccaccgccagcgcc

SEQ ID NO: 21282 - DNA, 21 bp, Artificial Sequence
  Description of Artificial Sequence: Synthetic oligonucleotide
cagggtcagtcgagtcctggt

SEQ ID NO: 21283 - DNA, 21 bp, Artificial Sequence
  Description of Artificial Sequence: Synthetic oligonucleotide
accagaaccgacgccaccgtc

SEQ ID NO: 21284 - DNA, 21 bp, Artificial Sequence
  Description of Artificial Sequence: Synthetic oligonucleotide
actgagtctcagaggaatgag

SEQ ID NO: 21285 - DNA, 21 bp, Artificial Sequence
  Description of Artificial Sequence: Synthetic oligonucleotide
agaaccaacgccggccaaggc

SEQ ID NO: 21286 - DNA, 21 bp, Artificial Sequence
  Description of Artificial Sequence: Synthetic oligonucleotide
agtcctaatgggcagaagaat

SEQ ID NO: 21287 - DNA, 21 bp, Artificial Sequence
  Description of Artificial Sequence: Synthetic oligonucleotide
cacatcggcggcaacgccggc

SEQ ID NO: 21288 - DNA, 21 bp, Artificial Sequence
  Description of Artificial Sequence: Synthetic oligonucleotide
gacagcagacccaccatggtc

SEQ ID NO: 21289 - DNA, 21 bp, Artificial Sequence
  Description of Artificial Sequence: Synthetic oligonucleotide
gacggcagacccaccaccggc

SEQ ID NO: 21290 - DNA, 21 bp, Artificial Sequence
  Description of Artificial Sequence: Synthetic oligonucleotide
gataataagtcggggaatatg

SEQ ID NO: 21291 - DNA, 21 bp, Artificial Sequence
  Description of Artificial Sequence: Synthetic oligonucleotide
gcggggacgtctaagaaggac

SEQ ID NO: 21292 - DNA, 21 bp, Artificial Sequence
  Description of Artificial Sequence: Synthetic oligonucleotide
gtccaagacagcagcagaggc

SEQ ID NO: 21293 - DNA, 21 bp, Artificial Sequence
  Description of Artificial Sequence: Synthetic oligonucleotide
gtcgccggcagcagccccgcc

SEQ ID NO: 21294 - DNA, 21 bp, Artificial Sequence
  Description of Artificial Sequence: Synthetic oligonucleotide
caggggcatgggaatggtggg

SEQ ID NO: 21295 - DNA, 21 bp, Artificial Sequence
  Description of Artificial Sequence: Synthetic oligonucleotide
gtcaaacaagacgcccaaagc

SEQ ID NO: 21296 - DNA, 21 bp, Artificial Sequence
  Description of Artificial Sequence: Synthetic oligonucleotide
ggtcagtcgtctaagccgacg

SEQ ID NO: 21297 - DNA, 21 bp, Artificial Sequence
  Description of Artificial Sequence: Synthetic oligonucleotide
gattcgtcgaaggatcgtact

SEQ ID NO: 21298 - DNA, 21 bp, Artificial Sequence
  Description of Artificial Sequence: Synthetic oligonucleotide
ggtacggctgtgcctgcgcat

SEQ ID NO: 21299 - DNA, 21 bp, Artificial Sequence
  Description of Artificial Sequence: Synthetic oligonucleotide
aacgacacccccagaatgagc

SEQ ID NO: 21300 - DNA, 21 bp, Artificial Sequence
  Description of Artificial Sequence: Synthetic oligonucleotide
gagcatcagtctgggtcggct

SEQ ID NO: 21301 - DNA, 21 bp, Artificial Sequence
  Description of Artificial Sequence: Synthetic oligonucleotide
gccagcagcggcagccccacc

SEQ ID NO: 21302 - DNA, 21 bp, Artificial Sequence
  Description of Artificial Sequence: Synthetic oligonucleotide
ggtggtgcgcagccgagtaat

SEQ ID NO: 21303 - DNA, 21 bp, Artificial Sequence
  Description of Artificial Sequence: Synthetic oligonucleotide
accaccgccggcgaaagagcc

SEQ ID NO: 21304 - DNA, 21 bp, Artificial Sequence
  Description of Artificial Sequence: Synthetic oligonucleotide
caaggcaaagaaaaccccctc

SEQ ID NO: 21305 - DNA, 21 bp, Artificial Sequence
  Description of Artificial Sequence: Synthetic oligonucleotide
ggcagcggccaaagcgtcagc

SEQ ID NO: 21306 - DNA, 21 bp, Artificial Sequence
  Description of Artificial Sequence: Synthetic oligonucleotide
gtcgacggcaacacccccaga

SEQ ID NO: 21307 - DNA, 21 bp, Artificial Sequence
  Description of Artificial Sequence: Synthetic oligonucleotide
aaccaaagagacagccccgcc

SEQ ID NO: 21308 - DNA, 21 bp, Artificial Sequence
  Description of Artificial Sequence: Synthetic oligonucleotide
ggtattactaatggtgataag

SEQ ID NO: 21309 - DNA, 21 bp, Artificial Sequence
  Description of Artificial Sequence: Synthetic oligonucleotide
ctccccatcaaagacggcaac

SEQ ID NO: 21310 - DNA, 21 bp, Artificial Sequence
  Description of Artificial Sequence: Synthetic oligonucleotide
aacagcgacagcagaaaccac

SEQ ID NO: 21311 - DNA, 21 bp, Artificial Sequence
  Description of Artificial Sequence: Synthetic oligonucleotide
aatcaggggagtagtcttacg

SEQ ID NO: 21312 - DNA, 21 bp, Artificial Sequence
  Description of Artificial Sequence: Synthetic oligonucleotide
attaatcagagtccttctttg

SEQ ID NO: 21313 - DNA, 21 bp, Artificial Sequence
  Description of Artificial Sequence: Synthetic oligonucleotide
ggcagcgtcgtcaaacccgtc

SEQ ID NO: 21314 - DNA, 21 bp, Artificial Sequence
  Description of Artificial Sequence: Synthetic oligonucleotide
gggagtaatgtgagggttagt

SEQ ID NO: 21315 - DNA, 21 bp, Artificial Sequence
  Description of Artificial Sequence: Synthetic oligonucleotide
agcctccacgcccccaccgcc

SEQ ID NO: 21316 - DNA, 21 bp, Artificial Sequence
  Description of Artificial Sequence: Synthetic oligonucleotide
ctcggcagcagccccgtcacc

SEQ ID NO: 21317 - DNA, 21 bp, Artificial Sequence
  Description of Artificial Sequence: Synthetic oligonucleotide
ggcggcagcagcagacccagc

SEQ ID NO: 21318 - DNA, 21 bp, Artificial Sequence
  Description of Artificial Sequence: Synthetic oligonucleotide
ggtgtgaagggtaatgttggt

SEQ ID NO: 21319 - DNA, 21 bp, Artificial Sequence
  Description of Artificial Sequence: Synthetic oligonucleotide
tcgctgtctaattctaaggct

SEQ ID NO: 21320 - DNA, 21 bp, Artificial Sequence
  Description of Artificial Sequence: Synthetic oligonucleotide
aagctgaatgcttctggtggt

SEQ ID NO: 21321 - DNA, 21 bp, Artificial Sequence
  Description of Artificial Sequence: Synthetic oligonucleotide
ggcaccgtcaccagccacgcc

SEQ ID NO: 21322 - DNA, 21 bp, Artificial Sequence
  Description of Artificial Sequence: Synthetic oligonucleotide
gaccaaagcatccacggcaaa

SEQ ID NO: 21323 - DNA, 21 bp, Artificial Sequence
  Description of Artificial Sequence: Synthetic oligonucleotide
agcggccaaagcaaaggcgtc

SEQ ID NO: 21324 - DNA, 21 bp, Artificial Sequence
  Description of Artificial Sequence: Synthetic oligonucleotide
aaggatggtaagcagactatg

SEQ ID NO: 21325 - DNA, 21 bp, Artificial Sequence
  Description of Artificial Sequence: Synthetic oligonucleotide
agcatcgccaaagaaagactc

SEQ ID NO: 21326 - DNA, 21 bp, Artificial Sequence
  Description of Artificial Sequence: Synthetic oligonucleotide
tctactacgaaggggcctaat

SEQ ID NO: 21327 - DNA, 21 bp, Artificial Sequence
  Description of Artificial Sequence: Synthetic oligonucleotide
gaaagacccggcggcgccaaa

SEQ ID NO: 21328 - DNA, 21 bp, Artificial Sequence
  Description of Artificial Sequence: Synthetic oligonucleotide
ggcgtcgccgccgcccccagc

SEQ ID NO: 21329 - DNA, 21 bp, Artificial Sequence
  Description of Artificial Sequence: Synthetic oligonucleotide
gtcgaaggcagcgtcaccaaa

SEQ ID NO: 21330 - DNA, 21 bp, Artificial Sequence
  Description of Artificial Sequence: Synthetic oligonucleotide
gttggtaatgatactaatcgg

SEQ ID NO: 21331 - DNA, 21 bp, Artificial Sequence
  Description of Artificial Sequence: Synthetic oligonucleotide
aacagcagcaaacccagcacc

SEQ ID NO: 21332 - DNA, 21 bp, Artificial Sequence
  Description of Artificial Sequence: Synthetic oligonucleotide
gtgacttcgactcctattcag

SEQ ID NO: 21333 - DNA, 21 bp, Artificial Sequence
  Description of Artificial Sequence: Synthetic oligonucleotide
atgtctgggggtaatcagccg

SEQ ID NO: 21334 - DNA, 21 bp, Artificial Sequence
  Description of Artificial Sequence: Synthetic oligonucleotide
aagtctggtcagagtgcggtg

SEQ ID NO: 21335 - DNA, 21 bp, Artificial Sequence
  Description of Artificial Sequence: Synthetic oligonucleotide
agcggcaaagaagccgtcaaa

SEQ ID NO: 21336 - DNA, 21 bp, Artificial Sequence
  Description of Artificial Sequence: Synthetic oligonucleotide
cgtagtggtgagactcatact

SEQ ID NO: 21337 - DNA, 21 bp, Artificial Sequence
  Description of Artificial Sequence: Synthetic oligonucleotide
gacagcgccagcaaaatgacc

SEQ ID NO: 21338 - DNA, 21 bp, Artificial Sequence
  Description of Artificial Sequence: Synthetic oligonucleotide
gggtctgcgcaggagccaagg

SEQ ID NO: 21339 - DNA, 21 bp, Artificial Sequence
  Description of Artificial Sequence: Synthetic oligonucleotide
agccaagccaaagaaagcatc

SEQ ID NO: 21340 - DNA, 21 bp, Artificial Sequence
  Description of Artificial Sequence: Synthetic oligonucleotide
agcatcagcagcgacctcaaa

SEQ ID NO: 21341 - DNA, 21 bp, Artificial Sequence
  Description of Artificial Sequence: Synthetic oligonucleotide
ctccccagcaaagccaacctc

SEQ ID NO: 21342 - DNA, 21 bp, Artificial Sequence
  Description of Artificial Sequence: Synthetic oligonucleotide
catgggggtcagccgtcttcg

SEQ ID NO: 21343 - DNA, 21 bp, Artificial Sequence
  Description of Artificial Sequence: Synthetic oligonucleotide
ggcggcagcgaaagcagaaaa

SEQ ID NO: 21344 - DNA, 21 bp, Artificial Sequence
  Description of Artificial Sequence: Synthetic oligonucleotide
atgaatcagacgagggagtct

SEQ ID NO: 21345 - DNA, 21 bp, Artificial Sequence
  Description of Artificial Sequence: Synthetic oligonucleotide
caaaaaaccaacgaagccaga

SEQ ID NO: 21346 - DNA, 21 bp, Artificial Sequence
  Description of Artificial Sequence: Synthetic oligonucleotide
catggggataatagtcggcag

SEQ ID NO: 21347 - DNA, 21 bp, Artificial Sequence
  Description of Artificial Sequence: Synthetic oligonucleotide
gtcagaaccaacgcccccgaa

SEQ ID NO: 21348 - DNA, 21 bp, Artificial Sequence
  Description of Artificial Sequence: Synthetic oligonucleotide
tctgcggatacgaggtcggtt

SEQ ID NO: 21349 - DNA, 21 bp, Artificial Sequence
  Description of Artificial Sequence: Synthetic oligonucleotide
tcgggtaatcataagtcgcag

SEQ ID NO: 21350 - DNA, 21 bp, Artificial Sequence
  Description of Artificial Sequence: Synthetic oligonucleotide
caaaacggcggcaaagtcagc

SEQ ID NO: 21351 - DNA, 21 bp, Artificial Sequence
  Description of Artificial Sequence: Synthetic oligonucleotide
gcgggtgttgcgaatccgtcg

SEQ ID NO: 21352 - DNA, 21 bp, Artificial Sequence
  Description of Artificial Sequence: Synthetic oligonucleotide
aacgtcaacgtcggcaacacc

SEQ ID NO: 21353 - DNA, 21 bp, Artificial Sequence
  Description of Artificial Sequence: Synthetic oligonucleotide
atgagagacaaccacagcatc

SEQ ID NO: 21354 - DNA, 21 bp, Artificial Sequence
  Description of Artificial Sequence: Synthetic oligonucleotide
gtgcaggggggggcgtctcgg

SEQ ID NO: 21355 - DNA, 21 bp, Artificial Sequence
  Description of Artificial Sequence: Synthetic oligonucleotide
tctacggttggtaagccgcat

SEQ ID NO: 21356 - DNA, 21 bp, Artificial Sequence
  Description of Artificial Sequence: Synthetic oligonucleotide
gcgactgctgatactcctaag

SEQ ID NO: 21357 - DNA, 21 bp, Artificial Sequence
  Description of Artificial Sequence: Synthetic oligonucleotide
actattaatgcggctactaag

SEQ ID NO: 21358 - DNA, 21 bp, Artificial Sequence
  Description of Artificial Sequence: Synthetic oligonucleotide
gtcagcggcagcagccccaaa

SEQ ID NO: 21359 - DNA, 21 bp, Artificial Sequence
  Description of Artificial Sequence: Synthetic oligonucleotide
tctgctagttctaagcaggag

SEQ ID NO: 21360 - DNA, 21 bp, Artificial Sequence
  Description of Artificial Sequence: Synthetic oligonucleotide
aagaatgggaattcggttagt

SEQ ID NO: 21361 - DNA, 21 bp, Artificial Sequence
  Description of Artificial Sequence: Synthetic oligonucleotide
agcgcccacaacaaaagcgtc

SEQ ID NO: 21362 - DNA, 21 bp, Artificial Sequence
  Description of Artificial Sequence: Synthetic oligonucleotide
atgagcaacgaaaaaagccac

SEQ ID NO: 21363 - DNA, 21 bp, Artificial Sequence
  Description of Artificial Sequence: Synthetic oligonucleotide
gttcaggcgcaggctagtttg

SEQ ID NO: 21364 - DNA, 21 bp, Artificial Sequence
  Description of Artificial Sequence: Synthetic oligonucleotide
tcggtgactagggagcatgcg

SEQ ID NO: 21365 - DNA, 21 bp, Artificial Sequence
  Description of Artificial Sequence: Synthetic oligonucleotide
attagtactaagaagagtgag

SEQ ID NO: 21366 - DNA, 21 bp, Artificial Sequence
  Description of Artificial Sequence: Synthetic oligonucleotide
acgaatgttagtactactaag

SEQ ID NO: 21367 - DNA, 21 bp, Artificial Sequence
  Description of Artificial Sequence: Synthetic oligonucleotide
atggcgagtggggcgaagcct

SEQ ID NO: 21368 - DNA, 21 bp, Artificial Sequence
  Description of Artificial Sequence: Synthetic oligonucleotide
tcgagtgggtctaaggatcct

SEQ ID NO: 21369 - DNA, 21 bp, Artificial Sequence
  Description of Artificial Sequence: Synthetic oligonucleotide
ggcgtcggcaaagaccaacaa

SEQ ID NO: 21370 - DNA, 21 bp, Artificial Sequence
  Description of Artificial Sequence: Synthetic oligonucleotide
cggggtcagggttcgccgtct

SEQ ID NO: 21371 - DNA, 21 bp, Artificial Sequence
  Description of Artificial Sequence: Synthetic oligonucleotide
gagcaggagaagccggcttcg

SEQ ID NO: 21372 - DNA, 21 bp, Artificial Sequence
  Description of Artificial Sequence: Synthetic oligonucleotide
ggcagcaaccccagcaaaagc

SEQ ID NO: 21373 - DNA, 21 bp, Artificial Sequence
  Description of Artificial Sequence: Synthetic oligonucleotide
gttacttcgcagaatgctgct

SEQ ID NO: 21374 - DNA, 21 bp, Artificial Sequence
  Description of Artificial Sequence: Synthetic oligonucleotide
cacggcgccggcaacgccgtc

SEQ ID NO: 21375 - DNA, 21 bp, Artificial Sequence
  Description of Artificial Sequence: Synthetic oligonucleotide
agttctgagctgtctgggaag

SEQ ID NO: 21376 - DNA, 21 bp, Artificial Sequence
  Description of Artificial Sequence: Synthetic oligonucleotide
gaggttgcgaagggtaatatg

SEQ ID NO: 21377 - DNA, 21 bp, Artificial Sequence
  Description of Artificial Sequence: Synthetic oligonucleotide
ggcagcctcagcgaaaaaggc

SEQ ID NO: 21378 - DNA, 21 bp, Artificial Sequence
  Description of Artificial Sequence: Synthetic oligonucleotide
tacggcagcgaacccggcagc

SEQ ID NO: 21379 - DNA, 21 bp, Artificial Sequence
  Description of Artificial Sequence: Synthetic oligonucleotide
tcgcggtctgaggtgaagact

SEQ ID NO: 21380 - DNA, 21 bp, Artificial Sequence
  Description of Artificial Sequence: Synthetic oligonucleotide
gctaaggagcctaagcctgtg

SEQ ID NO: 21381 - DNA, 21 bp, Artificial Sequence
  Description of Artificial Sequence: Synthetic oligonucleotide
tcggctgtggataaggcgacg

SEQ ID NO: 21382 - DNA, 21 bp, Artificial Sequence
  Description of Artificial Sequence: Synthetic oligonucleotide
agtagtactgcgaagggtaat

SEQ ID NO: 21383 - DNA, 21 bp, Artificial Sequence
  Description of Artificial Sequence: Synthetic oligonucleotide
aatgctgaggcgaggtcggag

SEQ ID NO: 21384 - DNA, 21 bp, Artificial Sequence
  Description of Artificial Sequence: Synthetic oligonucleotide
gaccccagaagcccccccatc

SEQ ID NO: 21385 - DNA, 21 bp, Artificial Sequence
  Description of Artificial Sequence: Synthetic oligonucleotide
gctactgggggtacgcggctt

SEQ ID NO: 21386 - DNA, 21 bp, Artificial Sequence
  Description of Artificial Sequence: Synthetic oligonucleotide
agccaaatgagcagccccaaa

SEQ ID NO: 21387 - DNA, 21 bp, Artificial Sequence
  Description of Artificial Sequence: Synthetic oligonucleotide
caaatgagcaacagcaacacc

SEQ ID NO: 21388 - DNA, 21 bp, Artificial Sequence
  Description of Artificial Sequence: Synthetic oligonucleotide
ggcgtcaacaaacccagcatg

SEQ ID NO: 21389 - DNA, 21 bp, Artificial Sequence
  Description of Artificial Sequence: Synthetic oligonucleotide
accaccaccaacaaactcagc

SEQ ID NO: 21390 - DNA, 21 bp, Artificial Sequence
  Description of Artificial Sequence: Synthetic oligonucleotide
cacaaagtcggcgaccaaggc

SEQ ID NO: 21391 - DNA, 21 bp, Artificial Sequence
  Description of Artificial Sequence: Synthetic oligonucleotide
caaagcagcgcccaaagcatc

SEQ ID NO: 21392 - DNA, 21 bp, Artificial Sequence
  Description of Artificial Sequence: Synthetic oligonucleotide
gttggttctaattcggttagt

SEQ ID NO: 21393 - DNA, 21 bp, Artificial Sequence
  Description of Artificial Sequence: Synthetic oligonucleotide
aaagacaccggcaaagtcggc

SEQ ID NO: 21394 - DNA, 21 bp, Artificial Sequence
  Description of Artificial Sequence: Synthetic oligonucleotide
aagccggttaataataaggag

SEQ ID NO: 21395 - DNA, 21 bp, Artificial Sequence
  Description of Artificial Sequence: Synthetic oligonucleotide
aatcataatagtgcgaattct

SEQ ID NO: 21396 - DNA, 21 bp, Artificial Sequence
  Description of Artificial Sequence: Synthetic oligonucleotide
aatgggcggtcgaattcggcg

SEQ ID NO: 21397 - DNA, 21 bp, Artificial Sequence
  Description of Artificial Sequence: Synthetic oligonucleotide
aattcgggggggtctacgcag

SEQ ID NO: 21398 - DNA, 21 bp, Artificial Sequence
  Description of Artificial Sequence: Synthetic oligonucleotide
accaacaacaccgccagcggc

SEQ ID NO: 21399 - DNA, 21 bp, Artificial Sequence
  Description of Artificial Sequence: Synthetic oligonucleotide
agcagaagcgccagcaacgcc

SEQ ID NO: 21400 - DNA, 21 bp, Artificial Sequence
  Description of Artificial Sequence: Synthetic oligonucleotide
agcgaccaagtcaaaagcaac

SEQ ID NO: 21401 - DNA, 21 bp, Artificial Sequence
  Description of Artificial Sequence: Synthetic oligonucleotide
agcgccagcgaaagaagcctc

SEQ ID NO: 21402 - DNA, 21 bp, Artificial Sequence
  Description of Artificial Sequence: Synthetic oligonucleotide
cagtcttcggggagtacgatg

SEQ ID NO: 21403 - DNA, 21 bp, Artificial Sequence
  Description of Artificial Sequence: Synthetic oligonucleotide
catttgggttcttctaatgag

SEQ ID NO: 21404 - DNA, 21 bp, Artificial Sequence
  Description of Artificial Sequence: Synthetic oligonucleotide
ctcggcaacagcaccaccagc

SEQ ID NO: 21405 - DNA, 21 bp, Artificial Sequence
  Description of Artificial Sequence: Synthetic oligonucleotide
tcgcctacgggtaagggtgtt

SEQ ID NO: 21406 - DNA, 21 bp, Artificial Sequence
  Description of Artificial Sequence: Synthetic oligonucleotide
tcgggtagtaatgttccttcg

SEQ ID NO: 21407 - DNA, 21 bp, Artificial Sequence
  Description of Artificial Sequence: Synthetic oligonucleotide
tctaatactcctactactgtg

SEQ ID NO: 21408 - DNA, 21 bp, Artificial Sequence
  Description of Artificial Sequence: Synthetic oligonucleotide
tctaggtcggatccgaaggtt

SEQ ID NO: 21409 - DNA, 21 bp, Artificial Sequence
  Description of Artificial Sequence: Synthetic oligonucleotide
tctctggctgcgtcggctaat

SEQ ID NO: 21410 - DNA, 21 bp, Artificial Sequence
  Description of Artificial Sequence: Synthetic oligonucleotide
tctggtgtttcttcggctact

SEQ ID NO: 21411 - DNA, 21 bp, Artificial Sequence
  Description of Artificial Sequence: Synthetic oligonucleotide
tctgatagtccccataataag

SEQ ID NO: 21412 - DNA, 21 bp, Artificial Sequence
  Description of Artificial Sequence: Synthetic oligonucleotide
ggtaaggctggtaatacgacg

SEQ ID NO: 21413 - DNA, 21 bp, Artificial Sequence
  Description of Artificial Sequence: Synthetic oligonucleotide
aatcagggtaatcaggtgtct

SEQ ID NO: 21414 - DNA, 21 bp, Artificial Sequence
  Description of Artificial Sequence: Synthetic oligonucleotide
gctggtagttcttcgccgcgg

SEQ ID NO: 21415 - DNA, 21 bp, Artificial Sequence
  Description of Artificial Sequence: Synthetic oligonucleotide
aaagtcccccccacccaaggc

SEQ ID NO: 21416 - DNA, 21 bp, Artificial Sequence
  Description of Artificial Sequence: Synthetic oligonucleotide
gagggtcagggtacttttgcg

SEQ ID NO: 21417 - DNA, 21 bp, Artificial Sequence
  Description of Artificial Sequence: Synthetic oligonucleotide
gcgactaattcgcctagtttg

SEQ ID NO: 21418 - DNA, 21 bp, Artificial Sequence
  Description of Artificial Sequence: Synthetic oligonucleotide
tcttctcggcagtcggatggg

SEQ ID NO: 21419 - DNA, 21 bp, Artificial Sequence
  Description of Artificial Sequence: Synthetic oligonucleotide
gccctcagcgccacccccccc

SEQ ID NO: 21420 - DNA, 21 bp, Artificial Sequence
  Description of Artificial Sequence: Synthetic oligonucleotide
gtggatgggggttctacgggg

SEQ ID NO: 21421 - DNA, 21 bp, Artificial Sequence
  Description of Artificial Sequence: Synthetic oligonucleotide
ggcagcggcagcagcaacaaa

SEQ ID NO: 21422 - DNA, 21 bp, Artificial Sequence
  Description of Artificial Sequence: Synthetic oligonucleotide
ggcagcgccaccaccgccagc

SEQ ID NO: 21423 - DNA, 21 bp, Artificial Sequence
  Description of Artificial Sequence: Synthetic oligonucleotide
caaagcaaaggcgcccaaggc

SEQ ID NO: 21424 - DNA, 21 bp, Artificial Sequence
  Description of Artificial Sequence: Synthetic oligonucleotide
ggcctcgacaaacacagcgtc

SEQ ID NO: 21425 - DNA, 21 bp, Artificial Sequence
  Description of Artificial Sequence: Synthetic oligonucleotide
ggggatgtgagtcataagaat

SEQ ID NO: 21426 - DNA, 21 bp, Artificial Sequence
  Description of Artificial Sequence: Synthetic oligonucleotide
ggcgtcagcgccacccccctc

SEQ ID NO: 21427 - DNA, 21 bp, Artificial Sequence
  Description of Artificial Sequence: Synthetic oligonucleotide
actcgtgagtctcaggggtct

SEQ ID NO: 21428 - DNA, 21 bp, Artificial Sequence
  Description of Artificial Sequence: Synthetic oligonucleotide
cagcataatggggatcgtagt

SEQ ID NO: 21429 - DNA, 21 bp, Artificial Sequence
  Description of Artificial Sequence: Synthetic oligonucleotide
aacagcgtcaaagccaccagc

SEQ ID NO: 21430 - DNA, 21 bp, Artificial Sequence
  Description of Artificial Sequence: Synthetic oligonucleotide
cagaagaattcgaatagtgcg

SEQ ID NO: 21431 - DNA, 21 bp, Artificial Sequence
  Description of Artificial Sequence: Synthetic oligonucleotide
cgtcagacggataagatttct

SEQ ID NO: 21432 - DNA, 21 bp, Artificial Sequence
  Description of Artificial Sequence: Synthetic oligonucleotide
ggtgggcctggttctactcat

SEQ ID NO: 21433 - DNA, 21 bp, Artificial Sequence
  Description of Artificial Sequence: Synthetic oligonucleotide
tctagtggtcatacttcgggg

SEQ ID NO: 21434 - DNA, 21 bp, Artificial Sequence
  Description of Artificial Sequence: Synthetic oligonucleotide
agtggtacttcttcggtgagt

SEQ ID NO: 21435 - DNA, 21 bp, Artificial Sequence
  Description of Artificial Sequence: Synthetic oligonucleotide
caagccagcagcagcaacacc

SEQ ID NO: 21436 - DNA, 21 bp, Artificial Sequence
  Description of Artificial Sequence: Synthetic oligonucleotide
ggtagggagtctggggcgtct

SEQ ID NO: 21437 - DNA, 21 bp, Artificial Sequence
  Description of Artificial Sequence: Synthetic oligonucleotide
cagaagtcggatggttttcat

SEQ ID NO: 21438 - DNA, 21 bp, Artificial Sequence
  Description of Artificial Sequence: Synthetic oligonucleotide
gcttctggttctgcggcttcg

SEQ ID NO: 21439 - DNA, 21 bp, Artificial Sequence
  Description of Artificial Sequence: Synthetic oligonucleotide
gccgccgccatccccaacaac

SEQ ID NO: 21440 - DNA, 21 bp, Artificial Sequence
  Description of Artificial Sequence: Synthetic oligonucleotide
ggcaaaggcaccgacgcccac

SEQ ID NO: 21441 - DNA, 21 bp, Artificial Sequence
  Description of Artificial Sequence: Synthetic oligonucleotide
aacagcgtccaaggccaaggc

SEQ ID NO: 21442 - DNA, 21 bp, Artificial Sequence
  Description of Artificial Sequence: Synthetic oligonucleotide
agcagccacagcccccacacc

SEQ ID NO: 21443 - DNA, 21 bp, Artificial Sequence
  Description of Artificial Sequence: Synthetic oligonucleotide
ctcaacagaacccccaacgtc

SEQ ID NO: 21444 - DNA, 21 bp, Artificial Sequence
  Description of Artificial Sequence: Synthetic oligonucleotide
gctggggggacttctagtgtg

SEQ ID NO: 21445 - DNA, 21 bp, Artificial Sequence
  Description of Artificial Sequence: Synthetic oligonucleotide
gggacggggacgaattctccg

SEQ ID NO: 21446 - DNA, 21 bp, Artificial Sequence
  Description of Artificial Sequence: Synthetic oligonucleotide
tcgcaggataagagtgcgtcg

SEQ ID NO: 21447 - DNA, 21 bp, Artificial Sequence
  Description of Artificial Sequence: Synthetic oligonucleotide
aatggtatgacgcagaaggtg

SEQ ID NO: 21448 - DNA, 21 bp, Artificial Sequence
  Description of Artificial Sequence: Synthetic oligonucleotide
ctcgccgacaacaaaagcacc

SEQ ID NO: 21449 - DNA, 21 bp, Artificial Sequence
  Description of Artificial Sequence: Synthetic oligonucleotide
tctgctactactagtggtgct

SEQ ID NO: 21450 - DNA, 21 bp, Artificial Sequence
  Description of Artificial Sequence: Synthetic oligonucleotide
aacgccaccagcacccccgtc

SEQ ID NO: 21451 - DNA, 21 bp, Artificial Sequence
  Description of Artificial Sequence: Synthetic oligonucleotide
gatactgcttcgaggtctcat

SEQ ID NO: 21452 - DNA, 21 bp, Artificial Sequence
  Description of Artificial Sequence: Synthetic oligonucleotide
ggcaccagcgtccccagagtc

SEQ ID NO: 21453 - DNA, 21 bp, Artificial Sequence
  Description of Artificial Sequence: Synthetic oligonucleotide
caacccaaacccagaaccgaa

SEQ ID NO: 21454 - DNA, 21 bp, Artificial Sequence
  Description of Artificial Sequence: Synthetic oligonucleotide
atccaacccggcagccccaaa

SEQ ID NO: 21455 - DNA, 21 bp, Artificial Sequence
  Description of Artificial Sequence: Synthetic oligonucleotide
aagcaggaggctcctggtacg

SEQ ID NO: 21456 - DNA, 21 bp, Artificial Sequence
  Description of Artificial Sequence: Synthetic oligonucleotide
agcaacagccccggcccccac

SEQ ID NO: 21457 - DNA, 21 bp, Artificial Sequence
  Description of Artificial Sequence: Synthetic oligonucleotide
agcgacggcagcagcagagtc

SEQ ID NO: 21458 - DNA, 21 bp, Artificial Sequence
  Description of Artificial Sequence: Synthetic oligonucleotide
agcgccggcgtcgccggcaaa

SEQ ID NO: 21459 - DNA, 21 bp, Artificial Sequence
  Description of Artificial Sequence: Synthetic oligonucleotide
agcggcggcggcagcagcagc

SEQ ID NO: 21460 - DNA, 21 bp, Artificial Sequence
  Description of Artificial Sequence: Synthetic oligonucleotide
cacaacagcaccgccacccac

SEQ ID NO: 21461 - DNA, 21 bp, Artificial Sequence
  Description of Artificial Sequence: Synthetic oligonucleotide
gagggttcgcagggtgcggtg

SEQ ID NO: 21462 - DNA, 21 bp, Artificial Sequence
  Description of Artificial Sequence: Synthetic oligonucleotide
gccagaaccaccaacaaagaa

SEQ ID NO: 21463 - DNA, 21 bp, Artificial Sequence
  Description of Artificial Sequence: Synthetic oligonucleotide
ggggggaataggggtgatgtt

SEQ ID NO: 21464 - DNA, 21 bp, Artificial Sequence
  Description of Artificial Sequence: Synthetic oligonucleotide
tctagtggtaaggttcctggt

SEQ ID NO: 21465 - DNA, 21 bp, Artificial Sequence
  Description of Artificial Sequence: Synthetic oligonucleotide
atgacggctaaggggagtgtg

SEQ ID NO: 21466 - DNA, 21 bp, Artificial Sequence
  Description of Artificial Sequence: Synthetic oligonucleotide
agcggcagcagcagcaccagc

SEQ ID NO: 21467 - DNA, 21 bp, Artificial Sequence
  Description of Artificial Sequence: Synthetic oligonucleotide
acgaatactcagcagtatcag

SEQ ID NO: 21468 - DNA, 21 bp, Artificial Sequence
  Description of Artificial Sequence: Synthetic oligonucleotide
gccaaacaaaacaccaccctc

SEQ ID NO: 21469 - DNA, 21 bp, Artificial Sequence
  Description of Artificial Sequence: Synthetic oligonucleotide
ggtacgggtagtaagacggtt

SEQ ID NO: 21470 - DNA, 21 bp, Artificial Sequence
  Description of Artificial Sequence: Synthetic oligonucleotide
accggcggcgaccccctcaaa

SEQ ID NO: 21471 - DNA, 21 bp, Artificial Sequence
  Description of Artificial Sequence: Synthetic oligonucleotide
accagagtcaccagccccagc

SEQ ID NO: 21472 - DNA, 21 bp, Artificial Sequence
  Description of Artificial Sequence: Synthetic oligonucleotide
caacacggcaacaaagaaagc

SEQ ID NO: 21473 - DNA, 21 bp, Artificial Sequence
  Description of Artificial Sequence: Synthetic oligonucleotide
gacagaagccccaaccccgcc

SEQ ID NO: 21474 - DNA, 21 bp, Artificial Sequence
  Description of Artificial Sequence: Synthetic oligonucleotide
aattctgctaagagtacgttt

SEQ ID NO: 21475 - DNA, 21 bp, Artificial Sequence
  Description of Artificial Sequence: Synthetic oligonucleotide
ggccaaggccaacccagcagc

SEQ ID NO: 21476 - DNA, 21 bp, Artificial Sequence
  Description of Artificial Sequence: Synthetic oligonucleotide
cttatttctgataagtcggct

SEQ ID NO: 21477 - DNA, 21 bp, Artificial Sequence
  Description of Artificial Sequence: Synthetic oligonucleotide
agcgtcagccaaagccacgtc

SEQ ID NO: 21478 - DNA, 21 bp, Artificial Sequence
  Description of Artificial Sequence: Synthetic oligonucleotide
aatcctgctcaggctaatcag

SEQ ID NO: 21479 - DNA, 21 bp, Artificial Sequence
  Description of Artificial Sequence: Synthetic oligonucleotide
cacaacagcaccccccccgtc

SEQ ID NO: 21480 - DNA, 21 bp, Artificial Sequence
  Description of Artificial Sequence: Synthetic oligonucleotide
ggcaaacaaagccaagccgcc

SEQ ID NO: 21481 - DNA, 21 bp, Artificial Sequence
  Description of Artificial Sequence: Synthetic oligonucleotide
ggcatccaaacccccagcgcc

SEQ ID NO: 21482 - DNA, 21 bp, Artificial Sequence
  Description of Artificial Sequence: Synthetic oligonucleotide
gagtcgagtaatgctaggagt

SEQ ID NO: 21483 - DNA, 21 bp, Artificial Sequence
  Description of Artificial Sequence: Synthetic oligonucleotide
agcaccagagaacaaaaaggc

SEQ ID NO: 21484 - DNA, 21 bp, Artificial Sequence
  Description of Artificial Sequence: Synthetic oligonucleotide
atgccttcgaattcttcggct

SEQ ID NO: 21485 - DNA, 21 bp, Artificial Sequence
  Description of Artificial Sequence: Synthetic oligonucleotide
gacagcaccaccaaaaacacc

SEQ ID NO: 21486 - DNA, 21 bp, Artificial Sequence
  Description of Artificial Sequence: Synthetic oligonucleotide
gatgtgtctgggagtaaggct

SEQ ID NO: 21487 - DNA, 21 bp, Artificial Sequence
  Description of Artificial Sequence: Synthetic oligonucleotide
gatgttcctgctgcgaagatt

SEQ ID NO: 21488 - DNA, 21 bp, Artificial Sequence
  Description of Artificial Sequence: Synthetic oligonucleotide
gccggcggcaacaaagaaagc

SEQ ID NO: 21489 - DNA, 21 bp, Artificial Sequence
  Description of Artificial Sequence: Synthetic oligonucleotide
gctaatcaggctggtagtcag

SEQ ID NO: 21490 - DNA, 21 bp, Artificial Sequence
  Description of Artificial Sequence: Synthetic oligonucleotide
ggtcggggggataatgtgggt

SEQ ID NO: 21491 - DNA, 21 bp, Artificial Sequence
  Description of Artificial Sequence: Synthetic oligonucleotide
agtggtgattctcgggtgcat

SEQ ID NO: 21492 - DNA, 21 bp, Artificial Sequence
  Description of Artificial Sequence: Synthetic oligonucleotide
aacggcagcaacaacaccacc

SEQ ID NO: 21493 - DNA, 21 bp, Artificial Sequence
  Description of Artificial Sequence: Synthetic oligonucleotide
aacagcagaaccccccccaac

SEQ ID NO: 21494 - DNA, 21 bp, Artificial Sequence
  Description of Artificial Sequence: Synthetic oligonucleotide
acccccagcagcgaaaccaga

SEQ ID NO: 21495 - DNA, 21 bp, Artificial Sequence
  Description of Artificial Sequence: Synthetic oligonucleotide
accaacagcgccggcgccgcc

SEQ ID NO: 21496 - DNA, 21 bp, Artificial Sequence
  Description of Artificial Sequence: Synthetic oligonucleotide
acttcgcgggatgctcagaag

SEQ ID NO: 21497 - DNA, 21 bp, Artificial Sequence
  Description of Artificial Sequence: Synthetic oligonucleotide
ggcctcgaaagccccagaaaa

SEQ ID NO: 21498 - DNA, 21 bp, Artificial Sequence
  Description of Artificial Sequence: Synthetic oligonucleotide
gggagtaatacttctgtggct

SEQ ID NO: 21499 - DNA, 21 bp, Artificial Sequence
  Description of Artificial Sequence: Synthetic oligonucleotide
aaaggcctcagcagcagcacc

SEQ ID NO: 21500 - DNA, 21 bp, Artificial Sequence
  Description of Artificial Sequence: Synthetic oligonucleotide
agcagcggcggccaacaccaa

SEQ ID NO: 21501 - DNA, 21 bp, Artificial Sequence
  Description of Artificial Sequence: Synthetic oligonucleotide
cagtctacgaaggagcttgct

SEQ ID NO: 21502 - DNA, 21 bp, Artificial Sequence
  Description of Artificial Sequence: Synthetic oligonucleotide
gcgaaggctaatctgtcgact

SEQ ID NO: 21503 - DNA, 21 bp, Artificial Sequence
  Description of Artificial Sequence: Synthetic oligonucleotide
gctacgacttctccgagtacg

SEQ ID NO: 21504 - DNA, 21 bp, Artificial Sequence
  Description of Artificial Sequence: Synthetic oligonucleotide
tctgggtcgccttcgagtggg

SEQ ID NO: 21505 - DNA, 21 bp, Artificial Sequence
  Description of Artificial Sequence: Synthetic oligonucleotide
gaacccaaacccagcagcacc

SEQ ID NO: 21506 - DNA, 21 bp, Artificial Sequence
  Description of Artificial Sequence: Synthetic oligonucleotide
agcggcagcggccaaaaccaa

SEQ ID NO: 21507 - DNA, 21 bp, Artificial Sequence
  Description of Artificial Sequence: Synthetic oligonucleotide
gtcggcaccaacgccccccaa

SEQ ID NO: 21508 - DNA, 21 bp, Artificial Sequence
  Description of Artificial Sequence: Synthetic oligonucleotide
accagcagcaaagaagccgtc

SEQ ID NO: 21509 - DNA, 21 bp, Artificial Sequence
  Description of Artificial Sequence: Synthetic oligonucleotide
tctgcggggactaagcagact

SEQ ID NO: 21510 - DNA, 21 bp, Artificial Sequence
  Description of Artificial Sequence: Synthetic oligonucleotide
attactgcggcttcgtctact

SEQ ID NO: 21511 - DNA, 21 bp, Artificial Sequence
  Description of Artificial Sequence: Synthetic oligonucleotide
accagcgacaaaggccccaga

SEQ ID NO: 21512 - DNA, 21 bp, Artificial Sequence
  Description of Artificial Sequence: Synthetic oligonucleotide
accgacccccccagcagaagc

SEQ ID NO: 21513 - DNA, 21 bp, Artificial Sequence
  Description of Artificial Sequence: Synthetic oligonucleotide
agcaaaatgaacagcagcgtc

SEQ ID NO: 21514 - DNA, 21 bp, Artificial Sequence
  Description of Artificial Sequence: Synthetic oligonucleotide
agcagcagcaaacccggcctc

SEQ ID NO: 21515 - DNA, 21 bp, Artificial Sequence
  Description of Artificial Sequence: Synthetic oligonucleotide
gacaccggccccgcccacacc

SEQ ID NO: 21516 - DNA, 21 bp, Artificial Sequence
  Description of Artificial Sequence: Synthetic oligonucleotide
gagcctacgaggggttcgtct

SEQ ID NO: 21517 - DNA, 21 bp, Artificial Sequence
  Description of Artificial Sequence: Synthetic oligonucleotide
gcgactagtacggataagaat

SEQ ID NO: 21518 - DNA, 21 bp, Artificial Sequence
  Description of Artificial Sequence: Synthetic oligonucleotide
ggcgaacacggcagcagcggc

SEQ ID NO: 21519 - DNA, 21 bp, Artificial Sequence
  Description of Artificial Sequence: Synthetic oligonucleotide
ggcggccacaacgtcagcaac

SEQ ID NO: 21520 - DNA, 21 bp, Artificial Sequence
  Description of Artificial Sequence: Synthetic oligonucleotide
gggagtactgctggggagcgg

SEQ ID NO: 21521 - DNA, 21 bp, Artificial Sequence
  Description of Artificial Sequence: Synthetic oligonucleotide
gtcggcgacatgaccaaagcc

SEQ ID NO: 21522 - DNA, 21 bp, Artificial Sequence
  Description of Artificial Sequence: Synthetic oligonucleotide
gttaagggtggtgctactaat

SEQ ID NO: 21523 - DNA, 21 bp, Artificial Sequence
  Description of Artificial Sequence: Synthetic oligonucleotide
ctgggtaatggtattgctaat

SEQ ID NO: 21524 - DNA, 21 bp, Artificial Sequence
  Description of Artificial Sequence: Synthetic oligonucleotide
accctcgcccccaccaacgcc

SEQ ID NO: 21525 - DNA, 21 bp, Artificial Sequence
  Description of Artificial Sequence: Synthetic oligonucleotide
ggcggcaccaccagccccaaa

SEQ ID NO: 21526 - DNA, 21 bp, Artificial Sequence
  Description of Artificial Sequence: Synthetic oligonucleotide
cagtcgcagaaggttcctgct

SEQ ID NO: 21527 - DNA, 21 bp, Artificial Sequence
  Description of Artificial Sequence: Synthetic oligonucleotide
acgtcgggttcgaataggggg

SEQ ID NO: 21528 - DNA, 21 bp, Artificial Sequence
  Description of Artificial Sequence: Synthetic oligonucleotide
ggcatcgaccccaaactcgcc

SEQ ID NO: 21529 - DNA, 21 bp, Artificial Sequence
  Description of Artificial Sequence: Synthetic oligonucleotide
ctgagtggttctacgaatagt

SEQ ID NO: 21530 - DNA, 21 bp, Artificial Sequence
  Description of Artificial Sequence: Synthetic oligonucleotide
ggcaccaccagcggcatgaaa

SEQ ID NO: 21531 - DNA, 21 bp, Artificial Sequence
  Description of Artificial Sequence: Synthetic oligonucleotide
agcatcaaaagccccagcgac

SEQ ID NO: 21532 - DNA, 21 bp, Artificial Sequence
  Description of Artificial Sequence: Synthetic oligonucleotide
agccccagccccagcggcggc

SEQ ID NO: 21533 - DNA, 21 bp, Artificial Sequence
  Description of Artificial Sequence: Synthetic oligonucleotide
atgcccggcaccagcaaaagc

SEQ ID NO: 21534 - DNA, 21 bp, Artificial Sequence
  Description of Artificial Sequence: Synthetic oligonucleotide
catcaggctacgacgtctcag

SEQ ID NO: 21535 - DNA, 21 bp, Artificial Sequence
  Description of Artificial Sequence: Synthetic oligonucleotide
gctgctgttgcgggtaatggt

SEQ ID NO: 21536 - DNA, 21 bp, Artificial Sequence
  Description of Artificial Sequence: Synthetic oligonucleotide
tcggatcataagagtggtgtg

SEQ ID NO: 21537 - DNA, 21 bp, Artificial Sequence
  Description of Artificial Sequence: Synthetic oligonucleotide
tcgtcgagtaatgctgctaat

SEQ ID NO: 21538 - DNA, 21 bp, Artificial Sequence
  Description of Artificial Sequence: Synthetic oligonucleotide
gattctcgtgggtctcctaag

SEQ ID NO: 21539 - DNA, 21 bp, Artificial Sequence
  Description of Artificial Sequence: Synthetic oligonucleotide
agacaagacaacagaggcggc

SEQ ID NO: 21540 - DNA, 21 bp, Artificial Sequence
  Description of Artificial Sequence: Synthetic oligonucleotide
agcagcggcagcaaactcggc

SEQ ID NO: 21541 - DNA, 21 bp, Artificial Sequence
  Description of Artificial Sequence: Synthetic oligonucleotide
ggcagcggcggcaaccaaaac

SEQ ID NO: 21542 - DNA, 21 bp, Artificial Sequence
  Description of Artificial Sequence: Synthetic oligonucleotide
gttgcttctcagccgacgtct

SEQ ID NO: 21543 - DNA, 21 bp, Artificial Sequence
  Description of Artificial Sequence: Synthetic oligonucleotide
gctaaggcgtctggtttgtcg

SEQ ID NO: 21544 - DNA, 21 bp, Artificial Sequence
  Description of Artificial Sequence: Synthetic oligonucleotide
gcggtgtcgcaggagaagcag

SEQ ID NO: 21545 - DNA, 21 bp, Artificial Sequence
  Description of Artificial Sequence: Synthetic oligonucleotide
gctaagggggaggcgaatggt

SEQ ID NO: 21546 - DNA, 21 bp, Artificial Sequence
  Description of Artificial Sequence: Synthetic oligonucleotide
ggtacgggtaatagtaggact

SEQ ID NO: 21547 - DNA, 21 bp, Artificial Sequence
  Description of Artificial Sequence: Synthetic oligonucleotide
tcgggtcttggtaatagtgtt

SEQ ID NO: 21548 - DNA, 21 bp, Artificial Sequence
  Description of Artificial Sequence: Synthetic oligonucleotide
tgtgattctaagtcttgtagt

SEQ ID NO: 21549 - DNA, 21 bp, Artificial Sequence
  Description of Artificial Sequence: Synthetic oligonucleotide
gagcctaagcctgcgaatacg

SEQ ID NO: 21550 - DNA, 21 bp, Artificial Sequence
  Description of Artificial Sequence: Synthetic oligonucleotide
ggttcgagtcaggcttctctt

SEQ ID NO: 21551 - DNA, 21 bp, Artificial Sequence
  Description of Artificial Sequence: Synthetic oligonucleotide
acgcagtcgtctccgacttct

SEQ ID NO: 21552 - DNA, 21 bp, Artificial Sequence
  Description of Artificial Sequence: Synthetic oligonucleotide
acgaatggtcagaagtttagt

SEQ ID NO: 21553 - DNA, 21 bp, Artificial Sequence
  Description of Artificial Sequence: Synthetic oligonucleotide
agaagcgacgaaaaaagactc

SEQ ID NO: 21554 - DNA, 21 bp, Artificial Sequence
  Description of Artificial Sequence: Synthetic oligonucleotide
agcatgcaaaaagaacaaacc

SEQ ID NO: 21555 - DNA, 21 bp, Artificial Sequence
  Description of Artificial Sequence: Synthetic oligonucleotide
agtggggctggttctgttggt

SEQ ID NO: 21556 - DNA, 21 bp, Artificial Sequence
  Description of Artificial Sequence: Synthetic oligonucleotide
gaaatgcccaccagaaacggc

SEQ ID NO: 21557 - DNA, 21 bp, Artificial Sequence
  Description of Artificial Sequence: Synthetic oligonucleotide
gacgccatcaccaccaaaggc

SEQ ID NO: 21558 - DNA, 21 bp, Artificial Sequence
  Description of Artificial Sequence: Synthetic oligonucleotide
gaggctactaagtctccttct

SEQ ID NO: 21559 - DNA, 21 bp, Artificial Sequence
  Description of Artificial Sequence: Synthetic oligonucleotide
gatacgatggcgactagtaag

SEQ ID NO: 21560 - DNA, 21 bp, Artificial Sequence
  Description of Artificial Sequence: Synthetic oligonucleotide
gccggcggcaacgccggcctc

SEQ ID NO: 21561 - DNA, 21 bp, Artificial Sequence
  Description of Artificial Sequence: Synthetic oligonucleotide
ggtgttaatgggccgaattcg

SEQ ID NO: 21562 - DNA, 21 bp, Artificial Sequence
  Description of Artificial Sequence: Synthetic oligonucleotide
gtcagccccggccccaaaagc

SEQ ID NO: 21563 - DNA, 21 bp, Artificial Sequence
  Description of Artificial Sequence: Synthetic oligonucleotide
gttacggcgaatatgaatact

SEQ ID NO: 21564 - DNA, 21 bp, Artificial Sequence
  Description of Artificial Sequence: Synthetic oligonucleotide
ctcggcaacaacaccaccgcc

SEQ ID NO: 21565 - DNA, 21 bp, Artificial Sequence
  Description of Artificial Sequence: Synthetic oligonucleotide
ggtgcgacgagtcatactagt

SEQ ID NO: 21566 - DNA, 21 bp, Artificial Sequence
  Description of Artificial Sequence: Synthetic oligonucleotide
agtccgtctgtgacgagtact

SEQ ID NO: 21567 - DNA, 21 bp, Artificial Sequence
  Description of Artificial Sequence: Synthetic oligonucleotide
ggcaacgccaccgccaacagc

SEQ ID NO: 21568 - DNA, 21 bp, Artificial Sequence
  Description of Artificial Sequence: Synthetic oligonucleotide
aacaacaaagtcaaacccgaa

SEQ ID NO: 21569 - DNA, 21 bp, Artificial Sequence
  Description of Artificial Sequence: Synthetic oligonucleotide
caagccagcagccaccccagc

SEQ ID NO: 21570 - DNA, 21 bp, Artificial Sequence
  Description of Artificial Sequence: Synthetic oligonucleotide
gggttggttgatcataaggag

SEQ ID NO: 21571 - DNA, 21 bp, Artificial Sequence
  Description of Artificial Sequence: Synthetic oligonucleotide
tctgcgaatagtgggaatgtt

SEQ ID NO: 21572 - DNA, 21 bp, Artificial Sequence
  Description of Artificial Sequence: Synthetic oligonucleotide
agcaacaacgaccccagaaga

SEQ ID NO: 21573 - DNA, 21 bp, Artificial Sequence
  Description of Artificial Sequence: Synthetic oligonucleotide
gaggggaatactaggggtacg

SEQ ID NO: 21574 - DNA, 21 bp, Artificial Sequence
  Description of Artificial Sequence: Synthetic oligonucleotide
gccaacagcggcggcagcagc

SEQ ID NO: 21575 - DNA, 21 bp, Artificial Sequence
  Description of Artificial Sequence: Synthetic oligonucleotide
ggcagcaccagcacccccgtc

SEQ ID NO: 21576 - DNA, 21 bp, Artificial Sequence
  Description of Artificial Sequence: Synthetic oligonucleotide
ggtcatggggaggctaatacg

SEQ ID NO: 21577 - DNA, 21 bp, Artificial Sequence
  Description of Artificial Sequence: Synthetic oligonucleotide
ggcaacgtcgccaaacccagc

SEQ ID NO: 21578 - DNA, 21 bp, Artificial Sequence
  Description of Artificial Sequence: Synthetic oligonucleotide
accctcagcaaccccgtcgcc

SEQ ID NO: 21579 - DNA, 21 bp, Artificial Sequence
  Description of Artificial Sequence: Synthetic oligonucleotide
agcctcgccggcaacagaacc

SEQ ID NO: 21580 - DNA, 21 bp, Artificial Sequence
  Description of Artificial Sequence: Synthetic oligonucleotide
agcgacggcgccagaagcacc

SEQ ID NO: 21581 - DNA, 21 bp, Artificial Sequence
  Description of Artificial Sequence: Synthetic oligonucleotide
atgggtactaatactccggct

SEQ ID NO: 21582 - DNA, 21 bp, Artificial Sequence
  Description of Artificial Sequence: Synthetic oligonucleotide
ctcggccaaagcagcaccaac

SEQ ID NO: 21583 - DNA, 21 bp, Artificial Sequence
  Description of Artificial Sequence: Synthetic oligonucleotide
ggtcttgatagtagtgttaag

SEQ ID NO: 21584 - DNA, 21 bp, Artificial Sequence
  Description of Artificial Sequence: Synthetic oligonucleotide
ggtgagcgtgttggtaatcgg

SEQ ID NO: 21585 - DNA, 21 bp, Artificial Sequence
  Description of Artificial Sequence: Synthetic oligonucleotide
gtgcagggtcaggcgtctcat

SEQ ID NO: 21586 - DNA, 21 bp, Artificial Sequence
  Description of Artificial Sequence: Synthetic oligonucleotide
agcaccagaagccccaccatc

SEQ ID NO: 21587 - DNA, 21 bp, Artificial Sequence
  Description of Artificial Sequence: Synthetic oligonucleotide
ctgcagaattcgactacgctg

SEQ ID NO: 21588 - DNA, 21 bp, Artificial Sequence
  Description of Artificial Sequence: Synthetic oligonucleotide
cacgccaccaaagccaccacc

SEQ ID NO: 21589 - DNA, 21 bp, Artificial Sequence
  Description of Artificial Sequence: Synthetic oligonucleotide
accgtccaaagagacaaccaa

SEQ ID NO: 21590 - DNA, 21 bp, Artificial Sequence
  Description of Artificial Sequence: Synthetic oligonucleotide
cttaagtcggggtctacgggg

SEQ ID NO: 21591 - DNA, 21 bp, Artificial Sequence
  Description of Artificial Sequence: Synthetic oligonucleotide
tcgtctgagactcggactgcg

SEQ ID NO: 21592 - DNA, 21 bp, Artificial Sequence
  Description of Artificial Sequence: Synthetic oligonucleotide
aatcgggtttcgtctgcgaat

SEQ ID NO: 21593 - DNA, 21 bp, Artificial Sequence
  Description of Artificial Sequence: Synthetic oligonucleotide
acccccaacggccaaatgacc

SEQ ID NO: 21594 - DNA, 21 bp, Artificial Sequence
  Description of Artificial Sequence: Synthetic oligonucleotide
accggcaccagaagcatgcaa

SEQ ID NO: 21595 - DNA, 21 bp, Artificial Sequence
  Description of Artificial Sequence: Synthetic oligonucleotide
agcgtcggccaactccccaaa

SEQ ID NO: 21596 - DNA, 21 bp, Artificial Sequence
  Description of Artificial Sequence: Synthetic oligonucleotide
tcggcgacgaatcagatgagt

SEQ ID NO: 21597 - DNA, 21 bp, Artificial Sequence
  Description of Artificial Sequence: Synthetic oligonucleotide
aagggtgtggattcgcatggg

SEQ ID NO: 21598 - DNA, 21 bp, Artificial Sequence
  Description of Artificial Sequence: Synthetic oligonucleotide
aatcagcataagccgtcggag

SEQ ID NO: 21599 - DNA, 21 bp, Artificial Sequence
  Description of Artificial Sequence: Synthetic oligonucleotide
agcgcccaaagcagccccctc

SEQ ID NO: 21600 - DNA, 21 bp, Artificial Sequence
  Description of Artificial Sequence: Synthetic oligonucleotide
agtggtattagtggtgtggct

SEQ ID NO: 21601 - DNA, 21 bp, Artificial Sequence
  Description of Artificial Sequence: Synthetic oligonucleotide
catggtcagtcgtctgtggtg

SEQ ID NO: 21602 - DNA, 21 bp, Artificial Sequence
  Description of Artificial Sequence: Synthetic oligonucleotide
gtccccagcaacccccccaac

SEQ ID NO: 21603 - DNA, 21 bp, Artificial Sequence
  Description of Artificial Sequence: Synthetic oligonucleotide
tctactaagactgctccgacg

SEQ ID NO: 21604 - DNA, 21 bp, Artificial Sequence
  Description of Artificial Sequence: Synthetic oligonucleotide
aatagggagtcggcgagtact

SEQ ID NO: 21605 - DNA, 21 bp, Artificial Sequence
  Description of Artificial Sequence: Synthetic oligonucleotide
aatggttctggtgctcagatt

SEQ ID NO: 21606 - DNA, 21 bp, Artificial Sequence
  Description of Artificial Sequence: Synthetic oligonucleotide
acgcttggtagtactcctgtg

SEQ ID NO: 21607 - DNA, 21 bp, Artificial Sequence
  Description of Artificial Sequence: Synthetic oligonucleotide
agccccggcaacagaagcggc

SEQ ID NO: 21608 - DNA, 21 bp, Artificial Sequence
  Description of Artificial Sequence: Synthetic oligonucleotide
aggggtcagggtgcgaatgtg

SEQ ID NO: 21609 - DNA, 21 bp, Artificial Sequence
  Description of Artificial Sequence: Synthetic oligonucleotide
gataggactaagacgaatgtt

SEQ ID NO: 21610 - DNA, 21 bp, Artificial Sequence
  Description of Artificial Sequence: Synthetic oligonucleotide
cggagtgagagtagtgcggtg

SEQ ID NO: 21611 - DNA, 21 bp, Artificial Sequence
  Description of Artificial Sequence: Synthetic oligonucleotide
ctcgacagcaacaaagccccc

SEQ ID NO: 21612 - DNA, 21 bp, Artificial Sequence
  Description of Artificial Sequence: Synthetic oligonucleotide
aaaggcgaaagcggcggcgtc

SEQ ID NO: 21613 - DNA, 21 bp, Artificial Sequence
  Description of Artificial Sequence: Synthetic oligonucleotide
aacgccgaaaacagcagactc

SEQ ID NO: 21614 - DNA, 21 bp, Artificial Sequence
  Description of Artificial Sequence: Synthetic oligonucleotide
gacggccaaagaaccagcagc

SEQ ID NO: 21615 - DNA, 21 bp, Artificial Sequence
  Description of Artificial Sequence: Synthetic oligonucleotide
gccagcagccccggcggcatg

SEQ ID NO: 21616 - DNA, 21 bp, Artificial Sequence
  Description of Artificial Sequence: Synthetic oligonucleotide
acggggagtactggtattaag

SEQ ID NO: 21617 - DNA, 21 bp, Artificial Sequence
  Description of Artificial Sequence: Synthetic oligonucleotide
acgttgggggggactaattcg

SEQ ID NO: 21618 - DNA, 21 bp, Artificial Sequence
  Description of Artificial Sequence: Synthetic oligonucleotide
attgggtctagtactgggggt

SEQ ID NO: 21619 - DNA, 21 bp, Artificial Sequence
  Description of Artificial Sequence: Synthetic oligonucleotide
tctagtttgcataaggatggt

SEQ ID NO: 21620 - DNA, 21 bp, Artificial Sequence
  Description of Artificial Sequence: Synthetic oligonucleotide
aacagcggcagcaaagccagc

SEQ ID NO: 21621 - DNA, 21 bp, Artificial Sequence
  Description of Artificial Sequence: Synthetic oligonucleotide
tcgggggcgcagtcgaatcgt

SEQ ID NO: 21622 - DNA, 21 bp, Artificial Sequence
  Description of Artificial Sequence: Synthetic oligonucleotide
acggatgagcataaggcgtat

SEQ ID NO: 21623 - DNA, 21 bp, Artificial Sequence
  Description of Artificial Sequence: Synthetic oligonucleotide
caaggcgaaaacagcaccaaa

SEQ ID NO: 21624 - DNA, 21 bp, Artificial Sequence
  Description of Artificial Sequence: Synthetic oligonucleotide
ggcatggaccccaaagccagc

SEQ ID NO: 21625 - DNA, 21 bp, Artificial Sequence
  Description of Artificial Sequence: Synthetic oligonucleotide
gatggggctactggtacgcag

SEQ ID NO: 21626 - DNA, 21 bp, Artificial Sequence
  Description of Artificial Sequence: Synthetic oligonucleotide
acccaagccaacggcggcaaa

SEQ ID NO: 21627 - DNA, 21 bp, Artificial Sequence
  Description of Artificial Sequence: Synthetic oligonucleotide
ggcaacggccacaacgccatc

SEQ ID NO: 21628 - DNA, 21 bp, Artificial Sequence
  Description of Artificial Sequence: Synthetic oligonucleotide
ggtccgtctgggcaggagcgt

SEQ ID NO: 21629 - DNA, 21 bp, Artificial Sequence
  Description of Artificial Sequence: Synthetic oligonucleotide
aatggtacgtcttcgcatatg

SEQ ID NO: 21630 - DNA, 21 bp, Artificial Sequence
  Description of Artificial Sequence: Synthetic oligonucleotide
gacgtccccaaaaccggcagc

SEQ ID NO: 21631 - DNA, 21 bp, Artificial Sequence
  Description of Artificial Sequence: Synthetic oligonucleotide
ggtgcggttccggggcagact

SEQ ID NO: 21632 - DNA, 21 bp, Artificial Sequence
  Description of Artificial Sequence: Synthetic oligonucleotide
gatcgtcctccgccgggttcg

SEQ ID NO: 21633 - DNA, 21 bp, Artificial Sequence
  Description of Artificial Sequence: Synthetic oligonucleotide
accagagaaaccagcagcggc

SEQ ID NO: 21634 - DNA, 21 bp, Artificial Sequence
  Description of Artificial Sequence: Synthetic oligonucleotide
cgttctggggcggatccggct

SEQ ID NO: 21635 - DNA, 21 bp, Artificial Sequence
  Description of Artificial Sequence: Synthetic oligonucleotide
cttacgagtcagccggcgaat

SEQ ID NO: 21636 - DNA, 21 bp, Artificial Sequence
  Description of Artificial Sequence: Synthetic oligonucleotide
agtctgactacggcgacgaag

SEQ ID NO: 21637 - DNA, 21 bp, Artificial Sequence
  Description of Artificial Sequence: Synthetic oligonucleotide
gaccccgacagaagcgccaaa

SEQ ID NO: 21638 - DNA, 21 bp, Artificial Sequence
  Description of Artificial Sequence: Synthetic oligonucleotide
agtccgagtggttcgctgtcg

SEQ ID NO: 21639 - DNA, 21 bp, Artificial Sequence
  Description of Artificial Sequence: Synthetic oligonucleotide
agcaccagcggcaccagcagc

SEQ ID NO: 21640 - DNA, 21 bp, Artificial Sequence
  Description of Artificial Sequence: Synthetic oligonucleotide
ctgactggtgcgactagtagt

SEQ ID NO: 21641 - DNA, 21 bp, Artificial Sequence
  Description of Artificial Sequence: Synthetic oligonucleotide
ctgtctaattcgcctagtgcg

SEQ ID NO: 21642 - DNA, 21 bp, Artificial Sequence
  Description of Artificial Sequence: Synthetic oligonucleotide
attacggggtcggggcctgcg

SEQ ID NO: 21643 - DNA, 21 bp, Artificial Sequence
  Description of Artificial Sequence: Synthetic oligonucleotide
gggggggggaatgcttctggg

SEQ ID NO: 21644 - DNA, 21 bp, Artificial Sequence
  Description of Artificial Sequence: Synthetic oligonucleotide
ggtacgaattcgagtttgaat

SEQ ID NO: 21645 - DNA, 21 bp, Artificial Sequence
  Description of Artificial Sequence: Synthetic oligonucleotide
actatggatagtaggtctgcg

SEQ ID NO: 21646 - DNA, 21 bp, Artificial Sequence
  Description of Artificial Sequence: Synthetic oligonucleotide
caaagaaacggcagccccctc

SEQ ID NO: 21647 - DNA, 21 bp, Artificial Sequence
  Description of Artificial Sequence: Synthetic oligonucleotide
aacaacgccagcgccaaaagc

SEQ ID NO: 21648 - DNA, 21 bp, Artificial Sequence
  Description of Artificial Sequence: Synthetic oligonucleotide
aagcctcaggataattcgtcg

SEQ ID NO: 21649 - DNA, 21 bp, Artificial Sequence
  Description of Artificial Sequence: Synthetic oligonucleotide
attgctgggggtaagacggtg

SEQ ID NO: 21650 - DNA, 21 bp, Artificial Sequence
  Description of Artificial Sequence: Synthetic oligonucleotide
cttctttcgggggattcgagg

SEQ ID NO: 21651 - DNA, 21 bp, Artificial Sequence
  Description of Artificial Sequence: Synthetic oligonucleotide
ggcgtccaagtcagcagcggc

SEQ ID NO: 21652 - DNA, 21 bp, Artificial Sequence
  Description of Artificial Sequence: Synthetic oligonucleotide
gttcagaatacgggtgggggg

SEQ ID NO: 21653 - DNA, 21 bp, Artificial Sequence
  Description of Artificial Sequence: Synthetic oligonucleotide
agcagaaaccaaagcaacagc

SEQ ID NO: 21654 - DNA, 21 bp, Artificial Sequence
  Description of Artificial Sequence: Synthetic oligonucleotide
gccggcatcaaacccagccaa

SEQ ID NO: 21655 - DNA, 21 bp, Artificial Sequence
  Description of Artificial Sequence: Synthetic oligonucleotide
gccagccaacccgccggcagc

SEQ ID NO: 21656 - DNA, 21 bp, Artificial Sequence
  Description of Artificial Sequence: Synthetic oligonucleotide
aaggcgaatccttctcctgct

SEQ ID NO: 21657 - DNA, 21 bp, Artificial Sequence
  Description of Artificial Sequence: Synthetic oligonucleotide
aaggatcagcctagtacgaat

SEQ ID NO: 21658 - DNA, 21 bp, Artificial Sequence
  Description of Artificial Sequence: Synthetic oligonucleotide
atggtcggcaaaagcagcagc

SEQ ID NO: 21659 - DNA, 21 bp, Artificial Sequence
  Description of Artificial Sequence: Synthetic oligonucleotide
cagtctacggggtctccgact

SEQ ID NO: 21660 - DNA, 21 bp, Artificial Sequence
  Description of Artificial Sequence: Synthetic oligonucleotide
ctccccagccccagcaccctc

SEQ ID NO: 21661 - DNA, 21 bp, Artificial Sequence
  Description of Artificial Sequence: Synthetic oligonucleotide
gatgctattagtagtaagagg

SEQ ID NO: 21662 - DNA, 21 bp, Artificial Sequence
  Description of Artificial Sequence: Synthetic oligonucleotide
tgttcggttcctagtttgggg

SEQ ID NO: 21663 - DNA, 21 bp, Artificial Sequence
  Description of Artificial Sequence: Synthetic oligonucleotide
gtcagagacagcagcaccctc

SEQ ID NO: 21664 - DNA, 21 bp, Artificial Sequence
  Description of Artificial Sequence: Synthetic oligonucleotide
ggggtgggtgatggtaagctt

SEQ ID NO: 21665 - DNA, 21 bp, Artificial Sequence
  Description of Artificial Sequence: Synthetic oligonucleotide
atgcaggataataaggctatg

SEQ ID NO: 21666 - DNA, 21 bp, Artificial Sequence
  Description of Artificial Sequence: Synthetic oligonucleotide
gccagcgacagcgtccccaaa

SEQ ID NO: 21667 - DNA, 21 bp, Artificial Sequence
  Description of Artificial Sequence: Synthetic oligonucleotide
tcgggtaatgatgctcggcgt

SEQ ID NO: 21668 - DNA, 21 bp, Artificial Sequence
  Description of Artificial Sequence: Synthetic oligonucleotide
actgcgggtaattcgtctcag

SEQ ID NO: 21669 - DNA, 21 bp, Artificial Sequence
  Description of Artificial Sequence: Synthetic oligonucleotide
gagaaggcgaggcagagtgcg

SEQ ID NO: 21670 - DNA, 21 bp, Artificial Sequence
  Description of Artificial Sequence: Synthetic oligonucleotide
gccggcaaagaaagcaacaga

SEQ ID NO: 21671 - DNA, 21 bp, Artificial Sequence
  Description of Artificial Sequence: Synthetic oligonucleotide
gcgcatgggaatcctagtggt

SEQ ID NO: 21672 - DNA, 21 bp, Artificial Sequence
  Description of Artificial Sequence: Synthetic oligonucleotide
gtcggcagcagcagcgccaaa

SEQ ID NO: 21673 - DNA, 21 bp, Artificial Sequence
  Description of Artificial Sequence: Synthetic oligonucleotide
agcctcaccaaagcccaagcc

SEQ ID NO: 21674 - DNA, 21 bp, Artificial Sequence
  Description of Artificial Sequence: Synthetic oligonucleotide
actgcgtctaatgcttcgact

SEQ ID NO: 21675 - DNA, 21 bp, Artificial Sequence
  Description of Artificial Sequence: Synthetic oligonucleotide
agaaacgaaggcagccccaac

SEQ ID NO: 21676 - DNA, 21 bp, Artificial Sequence
  Description of Artificial Sequence: Synthetic oligonucleotide
caaagcaaagaagccaccagc

SEQ ID NO: 21677 - DNA, 21 bp, Artificial Sequence
  Description of Artificial Sequence: Synthetic oligonucleotide
catggtctgcctaatgctaag

SEQ ID NO: 21678 - DNA, 21 bp, Artificial Sequence
  Description of Artificial Sequence: Synthetic oligonucleotide
agcggcgccgccaaccccgcc

SEQ ID NO: 21679 - DNA, 21 bp, Artificial Sequence
  Description of Artificial Sequence: Synthetic oligonucleotide
ggcctcggcagcgaaaaccac

SEQ ID NO: 21680 - DNA, 21 bp, Artificial Sequence
  Description of Artificial Sequence: Synthetic oligonucleotide
tctagtaattcggatgtgagg

SEQ ID NO: 21681 - DNA, 21 bp, Artificial Sequence
  Description of Artificial Sequence: Synthetic oligonucleotide
agcgccaccggcagcaacaga

SEQ ID NO: 21682 - DNA, 21 bp, Artificial Sequence
  Description of Artificial Sequence: Synthetic oligonucleotide
agtaggacggataggcctgtc

SEQ ID NO: 21683 - DNA, 21 bp, Artificial Sequence
  Description of Artificial Sequence: Synthetic oligonucleotide
aacagccaaaaagtcaacatg

SEQ ID NO: 21684 - DNA, 21 bp, Artificial Sequence
  Description of Artificial Sequence: Synthetic oligonucleotide
aatggtgagacggggccgaag

SEQ ID NO: 21685 - DNA, 21 bp, Artificial Sequence
  Description of Artificial Sequence: Synthetic oligonucleotide
agccaagtccaaaccagcaaa

SEQ ID NO: 21686 - DNA, 21 bp, Artificial Sequence
  Description of Artificial Sequence: Synthetic oligonucleotide
gggggtcagccttctaaggat

SEQ ID NO: 21687 - DNA, 21 bp, Artificial Sequence
  Description of Artificial Sequence: Synthetic oligonucleotide
gggggtgttgcgcctaatcag

SEQ ID NO: 21688 - DNA, 21 bp, Artificial Sequence
  Description of Artificial Sequence: Synthetic oligonucleotide
gtcaccaaaggcagccaaagc

SEQ ID NO: 21689 - DNA, 21 bp, Artificial Sequence
  Description of Artificial Sequence: Synthetic oligonucleotide
gaaatgagcgccaccaacagc

SEQ ID NO: 21690 - DNA, 21 bp, Artificial Sequence
  Description of Artificial Sequence: Synthetic oligonucleotide
gacctccaaatcgccaaaggc

SEQ ID NO: 21691 - DNA, 21 bp, Artificial Sequence
  Description of Artificial Sequence: Synthetic oligonucleotide
gccaacaacagcagcatgcaa

SEQ ID NO: 21692 - DNA, 21 bp, Artificial Sequence
  Description of Artificial Sequence: Synthetic oligonucleotide
agccaagtcgccgccaccgtc

SEQ ID NO: 21693 - DNA, 21 bp, Artificial Sequence
  Description of Artificial Sequence: Synthetic oligonucleotide
ctcgtcaaaggcagcagcagc

SEQ ID NO: 21694 - DNA, 21 bp, Artificial Sequence
  Description of Artificial Sequence: Synthetic oligonucleotide
gatgtgtcttctaaggtgcct

SEQ ID NO: 21695 - DNA, 21 bp, Artificial Sequence
  Description of Artificial Sequence: Synthetic oligonucleotide
ttccccaacggcaacagcacc

SEQ ID NO: 21696 - DNA, 21 bp, Artificial Sequence
  Description of Artificial Sequence: Synthetic oligonucleotide
agaaacagcacccccagcacc

SEQ ID NO: 21697 - DNA, 21 bp, Artificial Sequence
  Description of Artificial Sequence: Synthetic oligonucleotide
agcgtcctcgacggcaaaagc

SEQ ID NO: 21698 - DNA, 21 bp, Artificial Sequence
  Description of Artificial Sequence: Synthetic oligonucleotide
gataggcagaatgcttcgtct

SEQ ID NO: 21699 - DNA, 21 bp, Artificial Sequence
  Description of Artificial Sequence: Synthetic oligonucleotide
gatggtggtagttctcttcgt

SEQ ID NO: 21700 - DNA, 21 bp, Artificial Sequence
  Description of Artificial Sequence: Synthetic oligonucleotide
atgccgacgaagacgtctact

SEQ ID NO: 21701 - DNA, 21 bp, Artificial Sequence
  Description of Artificial Sequence: Synthetic oligonucleotide
agccccgacaccgcccccaga

SEQ ID NO: 21702 - DNA, 21 bp, Artificial Sequence
  Description of Artificial Sequence: Synthetic oligonucleotide
accaaaagccaaagcatcatg

SEQ ID NO: 21703 - DNA, 21 bp, Artificial Sequence
  Description of Artificial Sequence: Synthetic oligonucleotide
agaggcaacggcgcccccgcc

SEQ ID NO: 21704 - DNA, 21 bp, Artificial Sequence
  Description of Artificial Sequence: Synthetic oligonucleotide
caggggagtacgagttcgagg

SEQ ID NO: 21705 - DNA, 21 bp, Artificial Sequence
  Description of Artificial Sequence: Synthetic oligonucleotide
accgaccccgcccccaaacac

SEQ ID NO: 21706 - DNA, 21 bp, Artificial Sequence
  Description of Artificial Sequence: Synthetic oligonucleotide
tctgctacgtctccgaatcgt

SEQ ID NO: 21707 - DNA, 21 bp, Artificial Sequence
  Description of Artificial Sequence: Synthetic oligonucleotide
agcgtcaacagcagcccccac

SEQ ID NO: 21708 - DNA, 21 bp, Artificial Sequence
  Description of Artificial Sequence: Synthetic oligonucleotide
gacgtcggcgacagacccgtc

SEQ ID NO: 21709 - DNA, 21 bp, Artificial Sequence
  Description of Artificial Sequence: Synthetic oligonucleotide
atgtctggtgcgtctacggct

SEQ ID NO: 21710 - DNA, 21 bp, Artificial Sequence
  Description of Artificial Sequence: Synthetic oligonucleotide
ctccccgccggcaaactcgcc

SEQ ID NO: 21711 - DNA, 21 bp, Artificial Sequence
  Description of Artificial Sequence: Synthetic oligonucleotide
agttcgttgaatggtaatagt

SEQ ID NO: 21712 - DNA, 21 bp, Artificial Sequence
  Description of Artificial Sequence: Synthetic oligonucleotide
gattctatggggacgcgtaat

SEQ ID NO: 21713 - DNA, 21 bp, Artificial Sequence
  Description of Artificial Sequence: Synthetic oligonucleotide
aacgccaacggcagcctcggc

SEQ ID NO: 21714 - DNA, 21 bp, Artificial Sequence
  Description of Artificial Sequence: Synthetic oligonucleotide
aaccccgacgtcagcggcaaa

SEQ ID NO: 21715 - DNA, 21 bp, Artificial Sequence
  Description of Artificial Sequence: Synthetic oligonucleotide
aatgctactacgccgactaac

SEQ ID NO: 21716 - DNA, 21 bp, Artificial Sequence
  Description of Artificial Sequence: Synthetic oligonucleotide
accaccaacaaacaactcgcc

SEQ ID NO: 21717 - DNA, 21 bp, Artificial Sequence
  Description of Artificial Sequence: Synthetic oligonucleotide
accacccaaagcaccgcccaa

SEQ ID NO: 21718 - DNA, 21 bp, Artificial Sequence
  Description of Artificial Sequence: Synthetic oligonucleotide
accggcagcaaccaacccggc

SEQ ID NO: 21719 - DNA, 21 bp, Artificial Sequence
  Description of Artificial Sequence: Synthetic oligonucleotide
acgaatagtaatccgtctttg

SEQ ID NO: 21720 - DNA, 21 bp, Artificial Sequence
  Description of Artificial Sequence: Synthetic oligonucleotide
actactggtgcgacgatgtct

SEQ ID NO: 21721 - DNA, 21 bp, Artificial Sequence
  Description of Artificial Sequence: Synthetic oligonucleotide
actcatggggatagtaagtcg

SEQ ID NO: 21722 - DNA, 21 bp, Artificial Sequence
  Description of Artificial Sequence: Synthetic oligonucleotide
agcagcggcgccaccgccgtc

SEQ ID NO: 21723 - DNA, 21 bp, Artificial Sequence
  Description of Artificial Sequence: Synthetic oligonucleotide
agcggcggccacaccaccgcc

SEQ ID NO: 21724 - DNA, 21 bp, Artificial Sequence
  Description of Artificial Sequence: Synthetic oligonucleotide
aggaatgcgcagccgatgact

SEQ ID NO: 21725 - DNA, 21 bp, Artificial Sequence
  Description of Artificial Sequence: Synthetic oligonucleotide
agggagtcgcagaagagtctg

SEQ ID NO: 21726 - DNA, 21 bp, Artificial Sequence
  Description of Artificial Sequence: Synthetic oligonucleotide
agtaagacgtcgaataatgcg

SEQ ID NO: 21727 - DNA, 21 bp, Artificial Sequence
  Description of Artificial Sequence: Synthetic oligonucleotide
agtaagcagccgggtggtatt

SEQ ID NO: 21728 - DNA, 21 bp, Artificial Sequence
  Description of Artificial Sequence: Synthetic oligonucleotide
agtactggtgcgactatgagt

SEQ ID NO: 21729 - DNA, 21 bp, Artificial Sequence
  Description of Artificial Sequence: Synthetic oligonucleotide
atggctcagtctgggactggt

SEQ ID NO: 21730 - DNA, 21 bp, Artificial Sequence
  Description of Artificial Sequence: Synthetic oligonucleotide
atgggcggcgtcagcagcagc

SEQ ID NO: 21731 - DNA, 21 bp, Artificial Sequence
  Description of Artificial Sequence: Synthetic oligonucleotide
caaaccagcagagacagcagc

SEQ ID NO: 21732 - DNA, 21 bp, Artificial Sequence
  Description of Artificial Sequence: Synthetic oligonucleotide
caaggcaaaagcatcaccggc

SEQ ID NO: 21733 - DNA, 21 bp, Artificial Sequence
  Description of Artificial Sequence: Synthetic oligonucleotide
cacaaaagcgccaacgtcggc

SEQ ID NO: 21734 - DNA, 21 bp, Artificial Sequence
  Description of Artificial Sequence: Synthetic oligonucleotide
cacaccgccaaaagcagcctc

SEQ ID NO: 21735 - DNA, 21 bp, Artificial Sequence
  Description of Artificial Sequence: Synthetic oligonucleotide
caccaaaaccaaagagacggc

SEQ ID NO: 21736 - DNA, 21 bp, Artificial Sequence
  Description of Artificial Sequence: Synthetic oligonucleotide
caggagggtacgcatacggct

SEQ ID NO: 21737 - DNA, 21 bp, Artificial Sequence
  Description of Artificial Sequence: Synthetic oligonucleotide
caggataagggtaatactggt

SEQ ID NO: 21738 - DNA, 21 bp, Artificial Sequence
  Description of Artificial Sequence: Synthetic oligonucleotide
caggtgggtagtactcctgct

SEQ ID NO: 21739 - DNA, 21 bp, Artificial Sequence
  Description of Artificial Sequence: Synthetic oligonucleotide
cgtggggagtctaaggctaat

SEQ ID NO: 21740 - DNA, 21 bp, Artificial Sequence
  Description of Artificial Sequence: Synthetic oligonucleotide
ctcaccaccagcggcagccaa

SEQ ID NO: 21741 - DNA, 21 bp, Artificial Sequence
  Description of Artificial Sequence: Synthetic oligonucleotide
ctcagcaccagccaacccagc

SEQ ID NO: 21742 - DNA, 21 bp, Artificial Sequence
  Description of Artificial Sequence: Synthetic oligonucleotide
ctccaagacagaaaagccagc

SEQ ID NO: 21743 - DNA, 21 bp, Artificial Sequence
  Description of Artificial Sequence: Synthetic oligonucleotide
ctcgccaacccccccgccggc

SEQ ID NO: 21744 - DNA, 21 bp, Artificial Sequence
  Description of Artificial Sequence: Synthetic oligonucleotide
gaaggccccagcggcacccac

SEQ ID NO: 21745 - DNA, 21 bp, Artificial Sequence
  Description of Artificial Sequence: Synthetic oligonucleotide
gaaggcggccaaagcagagtc

SEQ ID NO: 21746 - DNA, 21 bp, Artificial Sequence
  Description of Artificial Sequence: Synthetic oligonucleotide
gacaccacccccagaagcagc

SEQ ID NO: 21747 - DNA, 21 bp, Artificial Sequence
  Description of Artificial Sequence: Synthetic oligonucleotide
gacggcacccaagcccccgtc

SEQ ID NO: 21748 - DNA, 21 bp, Artificial Sequence
  Description of Artificial Sequence: Synthetic oligonucleotide
gacggcagaaaccacagcgcc

SEQ ID NO: 21749 - DNA, 21 bp, Artificial Sequence
  Description of Artificial Sequence: Synthetic oligonucleotide
gacggcggcagcgccgccaga

SEQ ID NO: 21750 - DNA, 21 bp, Artificial Sequence
  Description of Artificial Sequence: Synthetic oligonucleotide
gagcagggggcgagttctcat

SEQ ID NO: 21751 - DNA, 21 bp, Artificial Sequence
  Description of Artificial Sequence: Synthetic oligonucleotide
gatacggctcctagtaatcat

SEQ ID NO: 21752 - DNA, 21 bp, Artificial Sequence
  Description of Artificial Sequence: Synthetic oligonucleotide
gatcggagtgggactcctctt

SEQ ID NO: 21753 - DNA, 21 bp, Artificial Sequence
  Description of Artificial Sequence: Synthetic oligonucleotide
gccaaaagcaacggcagcaga

SEQ ID NO: 21754 - DNA, 21 bp, Artificial Sequence
  Description of Artificial Sequence: Synthetic oligonucleotide
gccgacgccagaaacgccggc

SEQ ID NO: 21755 - DNA, 21 bp, Artificial Sequence
  Description of Artificial Sequence: Synthetic oligonucleotide
gctcctactgataatcggtct

SEQ ID NO: 21756 - DNA, 21 bp, Artificial Sequence
  Description of Artificial Sequence: Synthetic oligonucleotide
gctgtggagtctcggaatgtg

SEQ ID NO: 21757 - DNA, 21 bp, Artificial Sequence
  Description of Artificial Sequence: Synthetic oligonucleotide
ggcagcaccggccaaggcaga

SEQ ID NO: 21758 - DNA, 21 bp, Artificial Sequence
  Description of Artificial Sequence: Synthetic oligonucleotide
ggcagcgaaaacagccccaga

SEQ ID NO: 21759 - DNA, 21 bp, Artificial Sequence
  Description of Artificial Sequence: Synthetic oligonucleotide
ggccacgacagagtcgccagc

SEQ ID NO: 21760 - DNA, 21 bp, Artificial Sequence
  Description of Artificial Sequence: Synthetic oligonucleotide
ggcctcggcgaacccagagcc

SEQ ID NO: 21761 - DNA, 21 bp, Artificial Sequence
  Description of Artificial Sequence: Synthetic oligonucleotide
gggatggctcaggctgggggt

SEQ ID NO: 21762 - DNA, 21 bp, Artificial Sequence
  Description of Artificial Sequence: Synthetic oligonucleotide
gggcctgagagggcggcgttg

SEQ ID NO: 21763 - DNA, 21 bp, Artificial Sequence
  Description of Artificial Sequence: Synthetic oligonucleotide
gggctgggggggaaggttaat

SEQ ID NO: 21764 - DNA, 21 bp, Artificial Sequence
  Description of Artificial Sequence: Synthetic oligonucleotide
ggggcgactacgcagagtact

SEQ ID NO: 21765 - DNA, 21 bp, Artificial Sequence
  Description of Artificial Sequence: Synthetic oligonucleotide
ggggtgggtggttctacgagt

SEQ ID NO: 21766 - DNA, 21 bp, Artificial Sequence
  Description of Artificial Sequence: Synthetic oligonucleotide
ggtcagaattcggggatgact

SEQ ID NO: 21767 - DNA, 21 bp, Artificial Sequence
  Description of Artificial Sequence: Synthetic oligonucleotide
ggtccgtctcagtctgggggg

SEQ ID NO: 21768 - DNA, 21 bp, Artificial Sequence
  Description of Artificial Sequence: Synthetic oligonucleotide
gtcagcaccaacaaaaccccc

SEQ ID NO: 21769 - DNA, 21 bp, Artificial Sequence
  Description of Artificial Sequence: Synthetic oligonucleotide
gtcagcgaaagcagacccggc

SEQ ID NO: 21770 - DNA, 21 bp, Artificial Sequence
  Description of Artificial Sequence: Synthetic oligonucleotide
gtcgccaaagccagcaacacc

SEQ ID NO: 21771 - DNA, 21 bp, Artificial Sequence
  Description of Artificial Sequence: Synthetic oligonucleotide
gtcgccagcgacagcagcaaa

SEQ ID NO: 21772 - DNA, 21 bp, Artificial Sequence
  Description of Artificial Sequence: Synthetic oligonucleotide
gtcggcagcgccaccgtcatc

SEQ ID NO: 21773 - DNA, 21 bp, Artificial Sequence
  Description of Artificial Sequence: Synthetic oligonucleotide
tcgcagtctcctcaggagagg

SEQ ID NO: 21774 - DNA, 21 bp, Artificial Sequence
  Description of Artificial Sequence: Synthetic oligonucleotide
tcggggccgacgaatcgtgag

SEQ ID NO: 21775 - DNA, 21 bp, Artificial Sequence
  Description of Artificial Sequence: Synthetic oligonucleotide
tcgggtgttgagcatactaat

SEQ ID NO: 21776 - DNA, 21 bp, Artificial Sequence
  Description of Artificial Sequence: Synthetic oligonucleotide
ttcggcgccaccgcccccggc

SEQ ID NO: 21777 - DNA, 21 bp, Artificial Sequence
  Description of Artificial Sequence: Synthetic oligonucleotide
agcgtcaccagcggcaccggc

SEQ ID NO: 21778 - DNA, 21 bp, Artificial Sequence
  Description of Artificial Sequence: Synthetic oligonucleotide
actaatggttctactatgtcg

SEQ ID NO: 21779 - DNA, 21 bp, Artificial Sequence
  Description of Artificial Sequence: Synthetic oligonucleotide
ggcagcctcagcaacagcggc

SEQ ID NO: 21780 - DNA, 21 bp, Artificial Sequence
  Description of Artificial Sequence: Synthetic oligonucleotide
cgtaatcagtcgccgtctatt

SEQ ID NO: 21781 - DNA, 21 bp, Artificial Sequence
  Description of Artificial Sequence: Synthetic oligonucleotide
accggcaccaacaaccccacc

SEQ ID NO: 21782 - DNA, 21 bp, Artificial Sequence
  Description of Artificial Sequence: Synthetic oligonucleotide
acgagtgctcagcctacgacg

SEQ ID NO: 21783 - DNA, 21 bp, Artificial Sequence
  Description of Artificial Sequence: Synthetic oligonucleotide
ctcaccaccgccaaagacccc

SEQ ID NO: 21784 - DNA, 21 bp, Artificial Sequence
  Description of Artificial Sequence: Synthetic oligonucleotide
agcaccggcaccaccacccaa

SEQ ID NO: 21785 - DNA, 21 bp, Artificial Sequence
  Description of Artificial Sequence: Synthetic oligonucleotide
agaaacggcaccagcaccaac

SEQ ID NO: 21786 - DNA, 21 bp, Artificial Sequence
  Description of Artificial Sequence: Synthetic oligonucleotide
gaccaaatcagaagcacccac

SEQ ID NO: 21787 - DNA, 21 bp, Artificial Sequence
  Description of Artificial Sequence: Synthetic oligonucleotide
gacgacggcaaacccggcacc

SEQ ID NO: 21788 - DNA, 21 bp, Artificial Sequence
  Description of Artificial Sequence: Synthetic oligonucleotide
gtcgccagcaacagcagcgtc

SEQ ID NO: 21789 - DNA, 21 bp, Artificial Sequence
  Description of Artificial Sequence: Synthetic oligonucleotide
ctcaccgaacccaaactcatc

SEQ ID NO: 21790 - DNA, 21 bp, Artificial Sequence
  Description of Artificial Sequence: Synthetic oligonucleotide
tcgccttcgaataataaggct

SEQ ID NO: 21791 - DNA, 21 bp, Artificial Sequence
  Description of Artificial Sequence: Synthetic oligonucleotide
gacgccaacggcaaaagcagc

SEQ ID NO: 21792 - DNA, 21 bp, Artificial Sequence
  Description of Artificial Sequence: Synthetic oligonucleotide
agccacaacgacaaacacgtc

SEQ ID NO: 21793 - DNA, 21 bp, Artificial Sequence
  Description of Artificial Sequence: Synthetic oligonucleotide
agcagagtcaccgtcaacgaa

SEQ ID NO: 21794 - DNA, 21 bp, Artificial Sequence
  Description of Artificial Sequence: Synthetic oligonucleotide
aggactacttcggggcctact

SEQ ID NO: 21795 - DNA, 21 bp, Artificial Sequence
  Description of Artificial Sequence: Synthetic oligonucleotide
gacaacggcaaaaaagtcgtc

SEQ ID NO: 21796 - DNA, 21 bp, Artificial Sequence
  Description of Artificial Sequence: Synthetic oligonucleotide
tcgaataatggtgcgatggct

SEQ ID NO: 21797 - DNA, 21 bp, Artificial Sequence
  Description of Artificial Sequence: Synthetic oligonucleotide
accacccacaccgccgccaaa

SEQ ID NO: 21798 - DNA, 21 bp, Artificial Sequence
  Description of Artificial Sequence: Synthetic oligonucleotide
atgaacagcagcgccagcacc

SEQ ID NO: 21799 - DNA, 21 bp, Artificial Sequence
  Description of Artificial Sequence: Synthetic oligonucleotide
atgagcaccgacaaaatcacc

SEQ ID NO: 21800 - DNA, 21 bp, Artificial Sequence
  Description of Artificial Sequence: Synthetic oligonucleotide
atgggtgttaatgggactagt

SEQ ID NO: 21801 - DNA, 21 bp, Artificial Sequence
  Description of Artificial Sequence: Synthetic oligonucleotide
gattctaattcgaagatggtt

SEQ ID NO: 21802 - DNA, 21 bp, Artificial Sequence
  Description of Artificial Sequence: Synthetic oligonucleotide
tcgactggtggtgataggtcc

SEQ ID NO: 21803 - DNA, 21 bp, Artificial Sequence
  Description of Artificial Sequence: Synthetic oligonucleotide
ctcaaaaacggcaacaccaac

SEQ ID NO: 21804 - DNA, 21 bp, Artificial Sequence
  Description of Artificial Sequence: Synthetic oligonucleotide
ggcaccagcaaccacgacaaa

SEQ ID NO: 21805 - DNA, 21 bp, Artificial Sequence
  Description of Artificial Sequence: Synthetic oligonucleotide
aaagacggcagcaccagcctc

SEQ ID NO: 21806 - DNA, 21 bp, Artificial Sequence
  Description of Artificial Sequence: Synthetic oligonucleotide
aaaggcgtcagccaaaccagc

SEQ ID NO: 21807 - DNA, 21 bp, Artificial Sequence
  Description of Artificial Sequence: Synthetic oligonucleotide
tcttctaatcgtgatactatg

SEQ ID NO: 21808 - DNA, 21 bp, Artificial Sequence
  Description of Artificial Sequence: Synthetic oligonucleotide
accaaaggcagcgaaccccac

SEQ ID NO: 21809 - DNA, 21 bp, Artificial Sequence
  Description of Artificial Sequence: Synthetic oligonucleotide
agcacccaaaaaggcgccatg

SEQ ID NO: 21810 - DNA, 21 bp, Artificial Sequence
  Description of Artificial Sequence: Synthetic oligonucleotide
agcggcatccccgccggcgtc

SEQ ID NO: 21811 - DNA, 21 bp, Artificial Sequence
  Description of Artificial Sequence: Synthetic oligonucleotide
agcggccaccccagcaacctc

SEQ ID NO: 21812 - DNA, 21 bp, Artificial Sequence
  Description of Artificial Sequence: Synthetic oligonucleotide
gacaacaacaacagcagaggc

SEQ ID NO: 21813 - DNA, 21 bp, Artificial Sequence
  Description of Artificial Sequence: Synthetic oligonucleotide
gggtcttcgcaggcgagggag

SEQ ID NO: 21814 - DNA, 21 bp, Artificial Sequence
  Description of Artificial Sequence: Synthetic oligonucleotide
cgtacgggtactggtactgag

SEQ ID NO: 21815 - DNA, 21 bp, Artificial Sequence
  Description of Artificial Sequence: Synthetic oligonucleotide
ggcaccggcagcaaaagcgtc

SEQ ID NO: 21816 - DNA, 21 bp, Artificial Sequence
  Description of Artificial Sequence: Synthetic oligonucleotide
caaaccgccaaccaaaacgcc

SEQ ID NO: 21817 - DNA, 21 bp, Artificial Sequence
  Description of Artificial Sequence: Synthetic oligonucleotide
gttagtgggagtagtacgggt

SEQ ID NO: 21818 - DNA, 21 bp, Artificial Sequence
  Description of Artificial Sequence: Synthetic oligonucleotide
caagacaaaagcggcagcatg

SEQ ID NO: 21819 - DNA, 21 bp, Artificial Sequence
  Description of Artificial Sequence: Synthetic oligonucleotide
ggccaaggccacgaaagagcc

SEQ ID NO: 21820 - DNA, 21 bp, Artificial Sequence
  Description of Artificial Sequence: Synthetic oligonucleotide
tcgaataatggtagtatttcg

SEQ ID NO: 21821 - DNA, 21 bp, Artificial Sequence
  Description of Artificial Sequence: Synthetic oligonucleotide
actcctaatacgggtagttcg

SEQ ID NO: 21822 - DNA, 21 bp, Artificial Sequence
  Description of Artificial Sequence: Synthetic oligonucleotide
cagaggacgaagactccggag

SEQ ID NO: 21823 - DNA, 21 bp, Artificial Sequence
  Description of Artificial Sequence: Synthetic oligonucleotide
gcgggtgtttcgaatacgggt

SEQ ID NO: 21824 - DNA, 21 bp, Artificial Sequence
  Description of Artificial Sequence: Synthetic oligonucleotide
ggcaccggccccgtcaccagc

SEQ ID NO: 21825 - DNA, 21 bp, Artificial Sequence
  Description of Artificial Sequence: Synthetic oligonucleotide
gggggtgtggcttcgaatggt

SEQ ID NO: 21826 - DNA, 21 bp, Artificial Sequence
  Description of Artificial Sequence: Synthetic oligonucleotide
tcgggtcataatagttcgact

SEQ ID NO: 21827 - DNA, 21 bp, Artificial Sequence
  Description of Artificial Sequence: Synthetic oligonucleotide
gacggcaccagagcccccagc

SEQ ID NO: 21828 - DNA, 21 bp, Artificial Sequence
  Description of Artificial Sequence: Synthetic oligonucleotide
ttgcctagtgatcctaggtcg

SEQ ID NO: 21829 - DNA, 21 bp, Artificial Sequence
  Description of Artificial Sequence: Synthetic oligonucleotide
cagaatacttcgaaggtgttg

SEQ ID NO: 21830 - DNA, 21 bp, Artificial Sequence
  Description of Artificial Sequence: Synthetic oligonucleotide
ggcggcagcagagaccaaacc

SEQ ID NO: 21831 - DNA, 21 bp, Artificial Sequence
  Description of Artificial Sequence: Synthetic oligonucleotide
atgcccagcaaaggcagccaa

SEQ ID NO: 21832 - DNA, 21 bp, Artificial Sequence
  Description of Artificial Sequence: Synthetic oligonucleotide
aatgttgggtctacttcgaat

SEQ ID NO: 21833 - DNA, 21 bp, Artificial Sequence
  Description of Artificial Sequence: Synthetic oligonucleotide
aattcgtcggggcaggttcat

SEQ ID NO: 21834 - DNA, 21 bp, Artificial Sequence
  Description of Artificial Sequence: Synthetic oligonucleotide
acccaaaaccacgaaagcaaa

SEQ ID NO: 21835 - DNA, 21 bp, Artificial Sequence
  Description of Artificial Sequence: Synthetic oligonucleotide
caggttacggggactttgggg

SEQ ID NO: 21836 - DNA, 21 bp, Artificial Sequence
  Description of Artificial Sequence: Synthetic oligonucleotide
gcgatttctggtaatagtaag

SEQ ID NO: 21837 - DNA, 21 bp, Artificial Sequence
  Description of Artificial Sequence: Synthetic oligonucleotide
accatggccaaaagcggcggc

SEQ ID NO: 21838 - DNA, 21 bp, Artificial Sequence
  Description of Artificial Sequence: Synthetic oligonucleotide
agcaaagtcgacaaacccatg

SEQ ID NO: 21839 - DNA, 21 bp, Artificial Sequence
  Description of Artificial Sequence: Synthetic oligonucleotide
aacagcagccccagcctcacc

SEQ ID NO: 21840 - DNA, 21 bp, Artificial Sequence
  Description of Artificial Sequence: Synthetic oligonucleotide
agcctccaaagcgaaagcaaa

SEQ ID NO: 21841 - DNA, 21 bp, Artificial Sequence
  Description of Artificial Sequence: Synthetic oligonucleotide
tcgggggcggcgactgcttct

SEQ ID NO: 21842 - DNA, 21 bp, Artificial Sequence
  Description of Artificial Sequence: Synthetic oligonucleotide
aatcagaataaggagactctg

SEQ ID NO: 21843 - DNA, 21 bp, Artificial Sequence
  Description of Artificial Sequence: Synthetic oligonucleotide
agttctacgggtgcgcctggt

SEQ ID NO: 21844 - DNA, 21 bp, Artificial Sequence
  Description of Artificial Sequence: Synthetic oligonucleotide
cacggcgccaccggcggcgcc

SEQ ID NO: 21845 - DNA, 21 bp, Artificial Sequence
  Description of Artificial Sequence: Synthetic oligonucleotide
gaaacccccggcgccggcaga

SEQ ID NO: 21846 - DNA, 21 bp, Artificial Sequence
  Description of Artificial Sequence: Synthetic oligonucleotide
gggagtcatgatatgaagaag

SEQ ID NO: 21847 - DNA, 21 bp, Artificial Sequence
  Description of Artificial Sequence: Synthetic oligonucleotide
gttattagtagtgatccgaag

SEQ ID NO: 21848 - DNA, 21 bp, Artificial Sequence
  Description of Artificial Sequence: Synthetic oligonucleotide
tctcctggggttactcctggt

SEQ ID NO: 21849 - DNA, 21 bp, Artificial Sequence
  Description of Artificial Sequence: Synthetic oligonucleotide
cacggcagcagccccaccacc

SEQ ID NO: 21850 - DNA, 21 bp, Artificial Sequence
  Description of Artificial Sequence: Synthetic oligonucleotide
gataagaatactaagtcgagt

SEQ ID NO: 21851 - DNA, 21 bp, Artificial Sequence
  Description of Artificial Sequence: Synthetic oligonucleotide
aacggcagcaaaaccagcctc

SEQ ID NO: 21852 - DNA, 21 bp, Artificial Sequence
  Description of Artificial Sequence: Synthetic oligonucleotide
actggtgcgccttctaatagt

SEQ ID NO: 21853 - DNA, 21 bp, Artificial Sequence
  Description of Artificial Sequence: Synthetic oligonucleotide
gcccccagcagcggcctcggc

SEQ ID NO: 21854 - DNA, 21 bp, Artificial Sequence
  Description of Artificial Sequence: Synthetic oligonucleotide
ggccaaaccagcaccccctac

SEQ ID NO: 21855 - DNA, 21 bp, Artificial Sequence
  Description of Artificial Sequence: Synthetic oligonucleotide
cattcgagtactgttagtcag

SEQ ID NO: 21856 - DNA, 21 bp, Artificial Sequence
  Description of Artificial Sequence: Synthetic oligonucleotide
caccaaggcaacggcagccac

SEQ ID NO: 21857 - DNA, 21 bp, Artificial Sequence
  Description of Artificial Sequence: Synthetic oligonucleotide
ctcggcctcggcaaaaccgaa

SEQ ID NO: 21858 - DNA, 21 bp, Artificial Sequence
  Description of Artificial Sequence: Synthetic oligonucleotide
agtggtctggcgactcctacg

SEQ ID NO: 21859 - DNA, 21 bp, Artificial Sequence
  Description of Artificial Sequence: Synthetic oligonucleotide
acccccgacagcaccccccaa

SEQ ID NO: 21860 - DNA, 21 bp, Artificial Sequence
  Description of Artificial Sequence: Synthetic oligonucleotide
accctcagccaaaaccccacc

SEQ ID NO: 21861 - DNA, 21 bp, Artificial Sequence
  Description of Artificial Sequence: Synthetic oligonucleotide
ggcaaaggccaaacccccagc

SEQ ID NO: 21862 - DNA, 21 bp, Artificial Sequence
  Description of Artificial Sequence: Synthetic oligonucleotide
ggcagcgtccaagccaacaaa

SEQ ID NO: 21863 - DNA, 21 bp, Artificial Sequence
  Description of Artificial Sequence: Synthetic oligonucleotide
ggtaatagtgatcataagaat

SEQ ID NO: 21864 - DNA, 21 bp, Artificial Sequence
  Description of Artificial Sequence: Synthetic oligonucleotide
accccccaaagcacccacgcc

SEQ ID NO: 21865 - DNA, 21 bp, Artificial Sequence
  Description of Artificial Sequence: Synthetic oligonucleotide
cacagcggcaaaggcagcagc

SEQ ID NO: 21866 - DNA, 21 bp, Artificial Sequence
  Description of Artificial Sequence: Synthetic oligonucleotide
ctgtctcagaagtcggctaat

SEQ ID NO: 21867 - DNA, 21 bp, Artificial Sequence
  Description of Artificial Sequence: Synthetic oligonucleotide
gccgccggcggcaccagcaga

SEQ ID NO: 21868 - DNA, 21 bp, Artificial Sequence
  Description of Artificial Sequence: Synthetic oligonucleotide
tcgaggggtgctactacgtct

SEQ ID NO: 21869 - DNA, 21 bp, Artificial Sequence
  Description of Artificial Sequence: Synthetic oligonucleotide
ggcagcaacgcccaaaccgtc

SEQ ID NO: 21870 - DNA, 21 bp, Artificial Sequence
  Description of Artificial Sequence: Synthetic oligonucleotide
caaaacagcaccaccagcgcc

SEQ ID NO: 21871 - DNA, 21 bp, Artificial Sequence
  Description of Artificial Sequence: Synthetic oligonucleotide
ctcggcagcggcaacagccac

SEQ ID NO: 21872 - DNA, 21 bp, Artificial Sequence
  Description of Artificial Sequence: Synthetic oligonucleotide
gacggcggcaacgccggcaga

SEQ ID NO: 21873 - DNA, 21 bp, Artificial Sequence
  Description of Artificial Sequence: Synthetic oligonucleotide
gataatgataagactaattct

SEQ ID NO: 21874 - DNA, 21 bp, Artificial Sequence
  Description of Artificial Sequence: Synthetic oligonucleotide
aacagcgccaccagcgtcagc

SEQ ID NO: 21875 - DNA, 21 bp, Artificial Sequence
  Description of Artificial Sequence: Synthetic oligonucleotide
accgacagccaacaaggcaga

SEQ ID NO: 21876 - DNA, 21 bp, Artificial Sequence
  Description of Artificial Sequence: Synthetic oligonucleotide
aacatgggcgccagcagcagc

SEQ ID NO: 21877 - DNA, 21 bp, Artificial Sequence
  Description of Artificial Sequence: Synthetic oligonucleotide
atgaatactcctaaggatggt

SEQ ID NO: 21878 - DNA, 21 bp, Artificial Sequence
  Description of Artificial Sequence: Synthetic oligonucleotide
caactcagcaacagcagcgcc

SEQ ID NO: 21879 - DNA, 21 bp, Artificial Sequence
  Description of Artificial Sequence: Synthetic oligonucleotide
gttacttctaattctagtagt

SEQ ID NO: 21880 - DNA, 21 bp, Artificial Sequence
  Description of Artificial Sequence: Synthetic oligonucleotide
agtcagacgacgcctagtctg

SEQ ID NO: 21881 - DNA, 21 bp, Artificial Sequence
  Description of Artificial Sequence: Synthetic oligonucleotide
actgggaatgctcctagtcat

SEQ ID NO: 21882 - DNA, 21 bp, Artificial Sequence
  Description of Artificial Sequence: Synthetic oligonucleotide
actactgctgataggaagggt

SEQ ID NO: 21883 - DNA, 21 bp, Artificial Sequence
  Description of Artificial Sequence: Synthetic oligonucleotide
accggcggcagcggcagccac

SEQ ID NO: 21884 - DNA, 21 bp, Artificial Sequence
  Description of Artificial Sequence: Synthetic oligonucleotide
ctcaaaagcgcccaagacgcc

SEQ ID NO: 21885 - DNA, 21 bp, Artificial Sequence
  Description of Artificial Sequence: Synthetic oligonucleotide
ctcgtcggcaccagcagcgcc

SEQ ID NO: 21886 - DNA, 21 bp, Artificial Sequence
  Description of Artificial Sequence: Synthetic oligonucleotide
gatgatcttagtaagccgagg

SEQ ID NO: 21887 - DNA, 21 bp, Artificial Sequence
  Description of Artificial Sequence: Synthetic oligonucleotide
gccagcgaccaagccagcaaa

SEQ ID NO: 21888 - DNA, 21 bp, Artificial Sequence
  Description of Artificial Sequence: Synthetic oligonucleotide
gcccacagcagcaacagcgtc

SEQ ID NO: 21889 - DNA, 21 bp, Artificial Sequence
  Description of Artificial Sequence: Synthetic oligonucleotide
tacaacgccagcggcatccaa

SEQ ID NO: 21890 - DNA, 21 bp, Artificial Sequence
  Description of Artificial Sequence: Synthetic oligonucleotide
gacaacggcaaaagcaccgtc

SEQ ID NO: 21891 - DNA, 21 bp, Artificial Sequence
  Description of Artificial Sequence: Synthetic oligonucleotide
tcgactcagtcgaatcctccg

SEQ ID NO: 21892 - DNA, 21 bp, Artificial Sequence
  Description of Artificial Sequence: Synthetic oligonucleotide
agtttggggactccgactcgt

SEQ ID NO: 21893 - DNA, 21 bp, Artificial Sequence
  Description of Artificial Sequence: Synthetic oligonucleotide
cgtaatggttctccttcggtt

SEQ ID NO: 21894 - DNA, 21 bp, Artificial Sequence
  Description of Artificial Sequence: Synthetic oligonucleotide
ggttcggatggttctcgtggt

SEQ ID NO: 21895 - DNA, 21 bp, Artificial Sequence
  Description of Artificial Sequence: Synthetic oligonucleotide
ctcggcaaaggcgaaaacaac

SEQ ID NO: 21896 - DNA, 21 bp, Artificial Sequence
  Description of Artificial Sequence: Synthetic oligonucleotide
gacgtcaacagcagcaaagtc

SEQ ID NO: 21897 - DNA, 21 bp, Artificial Sequence
  Description of Artificial Sequence: Synthetic oligonucleotide
gccagcacccacaccaacaac

SEQ ID NO: 21898 - DNA, 21 bp, Artificial Sequence
  Description of Artificial Sequence: Synthetic oligonucleotide
gaaagcggcagcaccgccacc

SEQ ID NO: 21899 - DNA, 21 bp, Artificial Sequence
  Description of Artificial Sequence: Synthetic oligonucleotide
agccccagcaacaacgccgtc

SEQ ID NO: 21900 - DNA, 21 bp, Artificial Sequence
  Description of Artificial Sequence: Synthetic oligonucleotide
aattcgagtgatgcgaaggcg

SEQ ID NO: 21901 - DNA, 21 bp, Artificial Sequence
  Description of Artificial Sequence: Synthetic oligonucleotide
agccacaccagcagccccgcc

SEQ ID NO: 21902 - DNA, 21 bp, Artificial Sequence
  Description of Artificial Sequence: Synthetic oligonucleotide
gaaaccagcaaaaccagagcc

SEQ ID NO: 21903 - DNA, 21 bp, Artificial Sequence
  Description of Artificial Sequence: Synthetic oligonucleotide
gtcgccggcgccaccaccagc

SEQ ID NO: 21904 - DNA, 21 bp, Artificial Sequence
  Description of Artificial Sequence: Synthetic oligonucleotide
tctcatcaggggaataatact

SEQ ID NO: 21905 - DNA, 21 bp, Artificial Sequence
  Description of Artificial Sequence: Synthetic oligonucleotide
actgctacttcttcgactgag

SEQ ID NO: 21906 - DNA, 21 bp, Artificial Sequence
  Description of Artificial Sequence: Synthetic oligonucleotide
cacacccaaaacaccaacagc

SEQ ID NO: 21907 - DNA, 21 bp, Artificial Sequence
  Description of Artificial Sequence: Synthetic oligonucleotide
tctgctgagcgtagtcctaat

SEQ ID NO: 21908 - DNA, 21 bp, Artificial Sequence
  Description of Artificial Sequence: Synthetic oligonucleotide
agcaacagcagcggcctcacc

SEQ ID NO: 21909 - DNA, 21 bp, Artificial Sequence
  Description of Artificial Sequence: Synthetic oligonucleotide
atgaatcagaaggagtcttcg

SEQ ID NO: 21910 - DNA, 21 bp, Artificial Sequence
  Description of Artificial Sequence: Synthetic oligonucleotide
agcaacggcacccccatggtc

SEQ ID NO: 21911 - DNA, 21 bp, Artificial Sequence
  Description of Artificial Sequence: Synthetic oligonucleotide
cagcagcataaggctagtgtt

SEQ ID NO: 21912 - DNA, 21 bp, Artificial Sequence
  Description of Artificial Sequence: Synthetic oligonucleotide
tctcgtaattcgaaggatctt

SEQ ID NO: 21913 - DNA, 21 bp, Artificial Sequence
  Description of Artificial Sequence: Synthetic oligonucleotide
gcttcgcagactgtgaatact

SEQ ID NO: 21914 - DNA, 21 bp, Artificial Sequence
  Description of Artificial Sequence: Synthetic oligonucleotide
ctccccagagaaggcagcggc

SEQ ID NO: 21915 - DNA, 21 bp, Artificial Sequence
  Description of Artificial Sequence: Synthetic oligonucleotide
gccgccagcgccagccccagc

SEQ ID NO: 21916 - DNA, 21 bp, Artificial Sequence
  Description of Artificial Sequence: Synthetic oligonucleotide
ggcatcggcagcagcagcggc

SEQ ID NO: 21917 - DNA, 21 bp, Artificial Sequence
  Description of Artificial Sequence: Synthetic oligonucleotide
gggcagaagggtgctcagctt

SEQ ID NO: 21918 - DNA, 21 bp, Artificial Sequence
  Description of Artificial Sequence: Synthetic oligonucleotide
gtcgccaccaccaaagccagc

SEQ ID NO: 21919 - DNA, 21 bp, Artificial Sequence
  Description of Artificial Sequence: Synthetic oligonucleotide
catcagtctactccttcgtct

SEQ ID NO: 21920 - DNA, 21 bp, Artificial Sequence
  Description of Artificial Sequence: Synthetic oligonucleotide
agcagcagcagccaacccgtc

SEQ ID NO: 21921 - DNA, 21 bp, Artificial Sequence
  Description of Artificial Sequence: Synthetic oligonucleotide
atgccttctggtcagaatctg

SEQ ID NO: 21922 - DNA, 21 bp, Artificial Sequence
  Description of Artificial Sequence: Synthetic oligonucleotide
gaccccaccagaatcggcgcc

SEQ ID NO: 21923 - DNA, 21 bp, Artificial Sequence
  Description of Artificial Sequence: Synthetic oligonucleotide
ggcagcggcggcaccaaccaa

SEQ ID NO: 21924 - DNA, 21 bp, Artificial Sequence
  Description of Artificial Sequence: Synthetic oligonucleotide
ggccaagccggcagcaacccc

SEQ ID NO: 21925 - DNA, 21 bp, Artificial Sequence
  Description of Artificial Sequence: Synthetic oligonucleotide
gtcggcagcaccagcgtcctc

SEQ ID NO: 21926 - DNA, 21 bp, Artificial Sequence
  Description of Artificial Sequence: Synthetic oligonucleotide
tcggctggttcgaagactggg

SEQ ID NO: 21927 - DNA, 21 bp, Artificial Sequence
  Description of Artificial Sequence: Synthetic oligonucleotide
tctgcttctacgaatcatgcg

SEQ ID NO: 21928 - DNA, 21 bp, Artificial Sequence
  Description of Artificial Sequence: Synthetic oligonucleotide
agtagtactcaggctaagggg

SEQ ID NO: 21929 - DNA, 21 bp, Artificial Sequence
  Description of Artificial Sequence: Synthetic oligonucleotide
accaccaaaagcgccagcacc

SEQ ID NO: 21930 - DNA, 21 bp, Artificial Sequence
  Description of Artificial Sequence: Synthetic oligonucleotide
cacccccccagcaacggcacc

SEQ ID NO: 21931 - DNA, 21 bp, Artificial Sequence
  Description of Artificial Sequence: Synthetic oligonucleotide
gaaggctacgacaaaaccaac

SEQ ID NO: 21932 - DNA, 21 bp, Artificial Sequence
  Description of Artificial Sequence: Synthetic oligonucleotide
ggcgccggcggccaaaaccaa

SEQ ID NO: 21933 - DNA, 21 bp, Artificial Sequence
  Description of Artificial Sequence: Synthetic oligonucleotide
gggcttgggggtaatgctccg

SEQ ID NO: 21934 - DNA, 21 bp, Artificial Sequence
  Description of Artificial Sequence: Synthetic oligonucleotide
agccccgccacccacagcagc

SEQ ID NO: 21935 - DNA, 21 bp, Artificial Sequence
  Description of Artificial Sequence: Synthetic oligonucleotide
gacagcagcgccggcagcaaa

SEQ ID NO: 21936 - DNA, 21 bp, Artificial Sequence
  Description of Artificial Sequence: Synthetic oligonucleotide
ggtggttcgtcgagtactctg

SEQ ID NO: 21937 - DNA, 21 bp, Artificial Sequence
  Description of Artificial Sequence: Synthetic oligonucleotide
agccccgtcgacagcaaaatg

SEQ ID NO: 21938 - DNA, 21 bp, Artificial Sequence
  Description of Artificial Sequence: Synthetic oligonucleotide
gctagtacgtctcatacttct

SEQ ID NO: 21939 - DNA, 21 bp, Artificial Sequence
  Description of Artificial Sequence: Synthetic oligonucleotide
ggcagcaccgtcaacatgggc

SEQ ID NO: 21940 - DNA, 21 bp, Artificial Sequence
  Description of Artificial Sequence: Synthetic oligonucleotide
aaccccagcgacgccctcaaa

SEQ ID NO: 21941 - DNA, 21 bp, Artificial Sequence
  Description of Artificial Sequence: Synthetic oligonucleotide
aattcgtctcagcaggctcgg

SEQ ID NO: 21942 - DNA, 21 bp, Artificial Sequence
  Description of Artificial Sequence: Synthetic oligonucleotide
accagcgccaaagccgcccaa

SEQ ID NO: 21943 - DNA, 21 bp, Artificial Sequence
  Description of Artificial Sequence: Synthetic oligonucleotide
agcgccgccagcgcccccctc

SEQ ID NO: 21944 - DNA, 21 bp, Artificial Sequence
  Description of Artificial Sequence: Synthetic oligonucleotide
agtaatgagaagacgatgaat

SEQ ID NO: 21945 - DNA, 21 bp, Artificial Sequence
  Description of Artificial Sequence: Synthetic oligonucleotide
atgcgggggaatgagggttcg

SEQ ID NO: 21946 - DNA, 21 bp, Artificial Sequence
  Description of Artificial Sequence: Synthetic oligonucleotide
atggttaatgataagccgtct

SEQ ID NO: 21947 - DNA, 21 bp, Artificial Sequence
  Description of Artificial Sequence: Synthetic oligonucleotide
caacaacccgaaatgaaaaga

SEQ ID NO: 21948 - DNA, 21 bp, Artificial Sequence
  Description of Artificial Sequence: Synthetic oligonucleotide
gaaaccagcggcagcccccac

SEQ ID NO: 21949 - DNA, 21 bp, Artificial Sequence
  Description of Artificial Sequence: Synthetic oligonucleotide
ggcaccgccaccggcagaggc

SEQ ID NO: 21950 - DNA, 21 bp, Artificial Sequence
  Description of Artificial Sequence: Synthetic oligonucleotide
tcggctgggacgaagagtagt

SEQ ID NO: 21951 - DNA, 21 bp, Artificial Sequence
  Description of Artificial Sequence: Synthetic oligonucleotide
caaaccgacagcagccccaga

SEQ ID NO: 21952 - DNA, 21 bp, Artificial Sequence
  Description of Artificial Sequence: Synthetic oligonucleotide
aacgtcggcaccagcagcgcc

SEQ ID NO: 21953 - DNA, 21 bp, Artificial Sequence
  Description of Artificial Sequence: Synthetic oligonucleotide
aaggttacgtcgtcgccggag

SEQ ID NO: 21954 - DNA, 21 bp, Artificial Sequence
  Description of Artificial Sequence: Synthetic oligonucleotide
gaaagcaaacaacaacccagc

SEQ ID NO: 21955 - DNA, 21 bp, Artificial Sequence
  Description of Artificial Sequence: Synthetic oligonucleotide
caaggcagccaaaccagagaa

SEQ ID NO: 21956 - DNA, 21 bp, Artificial Sequence
  Description of Artificial Sequence: Synthetic oligonucleotide
gaaagcaccagcgaccacaga

SEQ ID NO: 21957 - DNA, 21 bp, Artificial Sequence
  Description of Artificial Sequence: Synthetic oligonucleotide
gatgctaagtctgtgccgacg

SEQ ID NO: 21958 - DNA, 21 bp, Artificial Sequence
  Description of Artificial Sequence: Synthetic oligonucleotide
accagcaccaacgccgtcagc

SEQ ID NO: 21959 - DNA, 21 bp, Artificial Sequence
  Description of Artificial Sequence: Synthetic oligonucleotide
agcagccacggcgtcagcggc

SEQ ID NO: 21960 - DNA, 21 bp, Artificial Sequence
  Description of Artificial Sequence: Synthetic oligonucleotide
agcagcggcggcctcgacaaa

SEQ ID NO: 21961 - DNA, 21 bp, Artificial Sequence
  Description of Artificial Sequence: Synthetic oligonucleotide
agcgtcagcaaaagcagcggc

SEQ ID NO: 21962 - DNA, 21 bp, Artificial Sequence
  Description of Artificial Sequence: Synthetic oligonucleotide
agtcagaaggggaatggggcg

SEQ ID NO: 21963 - DNA, 21 bp, Artificial Sequence
  Description of Artificial Sequence: Synthetic oligonucleotide
cacagagaaggcagcggccac

SEQ ID NO: 21964 - DNA, 21 bp, Artificial Sequence
  Description of Artificial Sequence: Synthetic oligonucleotide
ctcgccaacagcagccaagtc

SEQ ID NO: 21965 - DNA, 21 bp, Artificial Sequence
  Description of Artificial Sequence: Synthetic oligonucleotide
gacggcagaaccccccccacc

SEQ ID NO: 21966 - DNA, 21 bp, Artificial Sequence
  Description of Artificial Sequence: Synthetic oligonucleotide
gcgggtgcgagtgcggtggcg

SEQ ID NO: 21967 - DNA, 21 bp, Artificial Sequence
  Description of Artificial Sequence: Synthetic oligonucleotide
aagggtgctaaggattcgggt

SEQ ID NO: 21968 - DNA, 21 bp, Artificial Sequence
  Description of Artificial Sequence: Synthetic oligonucleotide
agtgcttcttcggataatcgg

SEQ ID NO: 21969 - DNA, 21 bp, Artificial Sequence
  Description of Artificial Sequence: Synthetic oligonucleotide
catgggaatgagccgattaag

SEQ ID NO: 21970 - DNA, 21 bp, Artificial Sequence
  Description of Artificial Sequence: Synthetic oligonucleotide
gggacgggtaggagtccgatg

SEQ ID NO: 21971 - DNA, 21 bp, Artificial Sequence
  Description of Artificial Sequence: Synthetic oligonucleotide
gtcagcagcaaagacagcgcc

SEQ ID NO: 21972 - DNA, 21 bp, Artificial Sequence
  Description of Artificial Sequence: Synthetic oligonucleotide
agcggcggccccagcaccctc

SEQ ID NO: 21973 - DNA, 21 bp, Artificial Sequence
  Description of Artificial Sequence: Synthetic oligonucleotide
agaaacaacgcccacagcgtc

SEQ ID NO: 21974 - DNA, 21 bp, Artificial Sequence
  Description of Artificial Sequence: Synthetic oligonucleotide
gccgacgacaaaaacagagcc

SEQ ID NO: 21975 - DNA, 21 bp, Artificial Sequence
  Description of Artificial Sequence: Synthetic oligonucleotide
ctcaccagcagcaacggcagc

SEQ ID NO: 21976 - DNA, 21 bp, Artificial Sequence
  Description of Artificial Sequence: Synthetic oligonucleotide
atccaaggcgccggcatgacc

SEQ ID NO: 21977 - DNA, 21 bp, Artificial Sequence
  Description of Artificial Sequence: Synthetic oligonucleotide
atggaggagcgtaagcctaat

SEQ ID NO: 21978 - DNA, 21 bp, Artificial Sequence
  Description of Artificial Sequence: Synthetic oligonucleotide
attactggggggaatgggggt

SEQ ID NO: 21979 - DNA, 21 bp, Artificial Sequence
  Description of Artificial Sequence: Synthetic oligonucleotide
ctcagcgccaacgaaaccaaa

SEQ ID NO: 21980 - DNA, 21 bp, Artificial Sequence
  Description of Artificial Sequence: Synthetic oligonucleotide
ctccaaggcgccaacgccacc

SEQ ID NO: 21981 - DNA, 21 bp, Artificial Sequence
  Description of Artificial Sequence: Synthetic oligonucleotide
ctcggcgccggcgccagcacc

SEQ ID NO: 21982 - DNA, 21 bp, Artificial Sequence
  Description of Artificial Sequence: Synthetic oligonucleotide
ggcatcggcgaaagacccgcc

SEQ ID NO: 21983 - DNA, 21 bp, Artificial Sequence
  Description of Artificial Sequence: Synthetic oligonucleotide
gtgtcttctaattcttcgtct

SEQ ID NO: 21984 - DNA, 21 bp, Artificial Sequence
  Description of Artificial Sequence: Synthetic oligonucleotide
tcggctacgaatgcgaagatt

SEQ ID NO: 21985 - DNA, 21 bp, Artificial Sequence
  Description of Artificial Sequence: Synthetic oligonucleotide
tctggtcgtggtactagtact

SEQ ID NO: 21986 - DNA, 21 bp, Artificial Sequence
  Description of Artificial Sequence: Synthetic oligonucleotide
tggggggggaataattcgacg

SEQ ID NO: 21987 - DNA, 21 bp, Artificial Sequence
  Description of Artificial Sequence: Synthetic oligonucleotide
caagacaccagcaacaccaga

SEQ ID NO: 21988 - DNA, 21 bp, Artificial Sequence
  Description of Artificial Sequence: Synthetic oligonucleotide
ggcaacgacgcccccagagtc

SEQ ID NO: 21989 - DNA, 21 bp, Artificial Sequence
  Description of Artificial Sequence: Synthetic oligonucleotide
gcccaaagcggcaacagagtc

SEQ ID NO: 21990 - DNA, 21 bp, Artificial Sequence
  Description of Artificial Sequence: Synthetic oligonucleotide
acccaaaccagcggcgtcccc

SEQ ID NO: 21991 - DNA, 21 bp, Artificial Sequence
  Description of Artificial Sequence: Synthetic oligonucleotide
agcgacggcgccggcatgaaa

SEQ ID NO: 21992 - DNA, 21 bp, Artificial Sequence
  Description of Artificial Sequence: Synthetic oligonucleotide
agcgccgcccaagccaaagtc

SEQ ID NO: 21993 - DNA, 21 bp, Artificial Sequence
  Description of Artificial Sequence: Synthetic oligonucleotide
gacggcaccggcaaacaaggc

SEQ ID NO: 21994 - DNA, 21 bp, Artificial Sequence
  Description of Artificial Sequence: Synthetic oligonucleotide
gtcagaggcgccagcagcgaa

SEQ ID NO: 21995 - DNA, 21 bp, Artificial Sequence
  Description of Artificial Sequence: Synthetic oligonucleotide
agcggcaacaaaagcagcatc

SEQ ID NO: 21996 - DNA, 21 bp, Artificial Sequence
  Description of Artificial Sequence: Synthetic oligonucleotide
acttcttctcctacttctgct

SEQ ID NO: 21997 - DNA, 21 bp, Artificial Sequence
  Description of Artificial Sequence: Synthetic oligonucleotide
aatcagggtgatcgttcggtg

SEQ ID NO: 21998 - DNA, 21 bp, Artificial Sequence
  Description of Artificial Sequence: Synthetic oligonucleotide
cagggtacgccgactcagagt

SEQ ID NO: 21999 - DNA, 21 bp, Artificial Sequence
  Description of Artificial Sequence: Synthetic oligonucleotide
accagactcagcgaacaaaaa

SEQ ID NO: 22000 - DNA, 21 bp, Artificial Sequence
  Description of Artificial Sequence: Synthetic oligonucleotide
ctcagccaaaaccccggcaaa

SEQ ID NO: 22001 - DNA, 21 bp, Artificial Sequence
  Description of Artificial Sequence: Synthetic oligonucleotide
ctttcttctgcggggtctcag

SEQ ID NO: 22002 - DNA, 21 bp, Artificial Sequence
  Description of Artificial Sequence: Synthetic oligonucleotide
gaggggagtagtaatacgcag

SEQ ID NO: 22003 - DNA, 21 bp, Artificial Sequence
  Description of Artificial Sequence: Synthetic oligonucleotide
tcgccggagactcgtggttcc

SEQ ID NO: 22004 - DNA, 21 bp, Artificial Sequence
  Description of Artificial Sequence: Synthetic oligonucleotide
catcagtcgaataagcctctg

SEQ ID NO: 22005 - DNA, 21 bp, Artificial Sequence
  Description of Artificial Sequence: Synthetic oligonucleotide
ctgccggcggatcgttctagt

SEQ ID NO: 22006 - DNA, 21 bp, Artificial Sequence
  Description of Artificial Sequence: Synthetic oligonucleotide
gacaacggccaagccccccaa

SEQ ID NO: 22007 - DNA, 21 bp, Artificial Sequence
  Description of Artificial Sequence: Synthetic oligonucleotide
gccagaaacggcgccggcgcc

SEQ ID NO: 22008 - DNA, 21 bp, Artificial Sequence
  Description of Artificial Sequence: Synthetic oligonucleotide
tcgagtagtccgtcgaatcat

SEQ ID NO: 22009 - DNA, 21 bp, Artificial Sequence
  Description of Artificial Sequence: Synthetic oligonucleotide
acccccagccaaggcagcctc

SEQ ID NO: 22010 - DNA, 21 bp, Artificial Sequence
  Description of Artificial Sequence: Synthetic oligonucleotide
gctgggggggctggtacttct

SEQ ID NO: 22011 - DNA, 21 bp, Artificial Sequence
  Description of Artificial Sequence: Synthetic oligonucleotide
ggcaacggccaagaccacgcc

SEQ ID NO: 22012 - DNA, 21 bp, Artificial Sequence
  Description of Artificial Sequence: Synthetic oligonucleotide
agcctcggcagcacccccatc

SEQ ID NO: 22013 - DNA, 21 bp, Artificial Sequence
  Description of Artificial Sequence: Synthetic oligonucleotide
actacgggtgctagtactacg

SEQ ID NO: 22014 - DNA, 21 bp, Artificial Sequence
  Description of Artificial Sequence: Synthetic oligonucleotide
gccaccgtcggcggcgccaaa

SEQ ID NO: 22015 - DNA, 21 bp, Artificial Sequence
  Description of Artificial Sequence: Synthetic oligonucleotide
gcgggttctcctaaggattct

SEQ ID NO: 22016 - DNA, 21 bp, Artificial Sequence
  Description of Artificial Sequence: Synthetic oligonucleotide
ggtagtgtttctcatagtact

SEQ ID NO: 22017 - DNA, 21 bp, Artificial Sequence
  Description of Artificial Sequence: Synthetic oligonucleotide
atgcccaaagacagcaaccaa

SEQ ID NO: 22018 - DNA, 21 bp, Artificial Sequence
  Description of Artificial Sequence: Synthetic oligonucleotide
gtcaaaaccaacggcaccagc

SEQ ID NO: 22019 - DNA, 21 bp, Artificial Sequence
  Description of Artificial Sequence: Synthetic oligonucleotide
acttcgcagcctacgtcggtt

SEQ ID NO: 22020 - DNA, 21 bp, Artificial Sequence
  Description of Artificial Sequence: Synthetic oligonucleotide
gacagcgccaaaagcagccac

SEQ ID NO: 22021 - DNA, 21 bp, Artificial Sequence
  Description of Artificial Sequence: Synthetic oligonucleotide
agccaaaacaccaccggcaaa

SEQ ID NO: 22022 - DNA, 21 bp, Artificial Sequence
  Description of Artificial Sequence: Synthetic oligonucleotide
catcctctggagaataagggt

SEQ ID NO: 22023 - DNA, 21 bp, Artificial Sequence
  Description of Artificial Sequence: Synthetic oligonucleotide
aagactgcgcagtctgttgtg

SEQ ID NO: 22024 - DNA, 21 bp, Artificial Sequence
  Description of Artificial Sequence: Synthetic oligonucleotide
accctcgacgccaaaagcaac

SEQ ID NO: 22025 - DNA, 21 bp, Artificial Sequence
  Description of Artificial Sequence: Synthetic oligonucleotide
acttctagtgggaatagtcat

SEQ ID NO: 22026 - DNA, 21 bp, Artificial Sequence
  Description of Artificial Sequence: Synthetic oligonucleotide
agagaacaaacccccaccagc

SEQ ID NO: 22027 - DNA, 21 bp, Artificial Sequence
  Description of Artificial Sequence: Synthetic oligonucleotide
agcgaaaccgacagaaaaaga

SEQ ID NO: 22028 - DNA, 21 bp, Artificial Sequence
  Description of Artificial Sequence: Synthetic oligonucleotide
cacggccccgaaaaacaaatc

SEQ ID NO: 22029 - DNA, 21 bp, Artificial Sequence
  Description of Artificial Sequence: Synthetic oligonucleotide
ctttcggagacgtcgtctaag

SEQ ID NO: 22030 - DNA, 21 bp, Artificial Sequence
  Description of Artificial Sequence: Synthetic oligonucleotide
gataatgctaagcctaatatt

SEQ ID NO: 22031 - DNA, 21 bp, Artificial Sequence
  Description of Artificial Sequence: Synthetic oligonucleotide
gattctatgagggcgaatgtt

SEQ ID NO: 22032 - DNA, 21 bp, Artificial Sequence
  Description of Artificial Sequence: Synthetic oligonucleotide
ggcaccagcgtcagcgcccac

SEQ ID NO: 22033 - DNA, 21 bp, Artificial Sequence
  Description of Artificial Sequence: Synthetic oligonucleotide
ggccacaacggcaaaagcagc

SEQ ID NO: 22034 - DNA, 21 bp, Artificial Sequence
  Description of Artificial Sequence: Synthetic oligonucleotide
ggtcatcagtcttcttctggt

SEQ ID NO: 22035 - DNA, 21 bp, Artificial Sequence
  Description of Artificial Sequence: Synthetic oligonucleotide
gtcagcagcaccagcagcaaa

SEQ ID NO: 22036 - DNA, 21 bp, Artificial Sequence
  Description of Artificial Sequence: Synthetic oligonucleotide
gtggcgtcggagaagccggtt

SEQ ID NO: 22037 - DNA, 21 bp, Artificial Sequence
  Description of Artificial Sequence: Synthetic oligonucleotide
tttactggttcggcgccttcg

SEQ ID NO: 22038 - DNA, 21 bp, Artificial Sequence
  Description of Artificial Sequence: Synthetic oligonucleotide
aacgtcgccaaaagccccctc

SEQ ID NO: 22039 - DNA, 21 bp, Artificial Sequence
  Description of Artificial Sequence: Synthetic oligonucleotide
gagactattactaagcctgtg

SEQ ID NO: 22040 - DNA, 21 bp, Artificial Sequence
  Description of Artificial Sequence: Synthetic oligonucleotide
ggcagcaccagccccaacctc

SEQ ID NO: 22041 - DNA, 21 bp, Artificial Sequence
  Description of Artificial Sequence: Synthetic oligonucleotide
tcgcttaatactaaggctctg

SEQ ID NO: 22042 - DNA, 21 bp, Artificial Sequence
  Description of Artificial Sequence: Synthetic oligonucleotide
accatggccgccagcccccac

SEQ ID NO: 22043 - DNA, 21 bp, Artificial Sequence
  Description of Artificial Sequence: Synthetic oligonucleotide
accggcgtcggcaccatgagc

SEQ ID NO: 22044 - DNA, 21 bp, Artificial Sequence
  Description of Artificial Sequence: Synthetic oligonucleotide
agcctcgccagccaacacagc

SEQ ID NO: 22045 - DNA, 21 bp, Artificial Sequence
  Description of Artificial Sequence: Synthetic oligonucleotide
caccaagacaccagcaacaga

SEQ ID NO: 22046 - DNA, 21 bp, Artificial Sequence
  Description of Artificial Sequence: Synthetic oligonucleotide
ctgcctcctgctgagagtaag

SEQ ID NO: 22047 - DNA, 21 bp, Artificial Sequence
  Description of Artificial Sequence: Synthetic oligonucleotide
gaggttccgagtaagagtagg

SEQ ID NO: 22048 - DNA, 21 bp, Artificial Sequence
  Description of Artificial Sequence: Synthetic oligonucleotide
gacggcaacagcagcaaacaa

SEQ ID NO: 22049 - DNA, 21 bp, Artificial Sequence
  Description of Artificial Sequence: Synthetic oligonucleotide
accggcaaaccccccagcagc

SEQ ID NO: 22050 - DNA, 21 bp, Artificial Sequence
  Description of Artificial Sequence: Synthetic oligonucleotide
agcggcagcaccagcagcagc

SEQ ID NO: 22051 - DNA, 21 bp, Artificial Sequence
  Description of Artificial Sequence: Synthetic oligonucleotide
gccagaaccgccaccagcgtc

SEQ ID NO: 22052 - DNA, 21 bp, Artificial Sequence
  Description of Artificial Sequence: Synthetic oligonucleotide
gctacggatcgggagaagggt

SEQ ID NO: 22053 - DNA, 21 bp, Artificial Sequence
  Description of Artificial Sequence: Synthetic oligonucleotide
ggcaacagccccaccgccagc

SEQ ID NO: 22054 - DNA, 21 bp, Artificial Sequence
  Description of Artificial Sequence: Synthetic oligonucleotide
ggcaccagaagcggcaccgcc

SEQ ID NO: 22055 - DNA, 21 bp, Artificial Sequence
  Description of Artificial Sequence: Synthetic oligonucleotide
gtcggcagcggcagccaaacc

SEQ ID NO: 22056 - DNA, 21 bp, Artificial Sequence
  Description of Artificial Sequence: Synthetic oligonucleotide
gtgcgggattctggttcgtct

SEQ ID NO: 22057 - DNA, 21 bp, Artificial Sequence
  Description of Artificial Sequence: Synthetic oligonucleotide
actcgtgggcagcctgctggg

SEQ ID NO: 22058 - DNA, 21 bp, Artificial Sequence
  Description of Artificial Sequence: Synthetic oligonucleotide
cagacggtgcctgcgcctagt

SEQ ID NO: 22059 - DNA, 21 bp, Artificial Sequence
  Description of Artificial Sequence: Synthetic oligonucleotide
aataataatcagcagtcttct

SEQ ID NO: 22060 - DNA, 21 bp, Artificial Sequence
  Description of Artificial Sequence: Synthetic oligonucleotide
agcagcgccgacagaagcacc

SEQ ID NO: 22061 - DNA, 21 bp, Artificial Sequence
  Description of Artificial Sequence: Synthetic oligonucleotide
ggccaaagcagcaaaaaagaa

SEQ ID NO: 22062 - DNA, 21 bp, Artificial Sequence
  Description of Artificial Sequence: Synthetic oligonucleotide
ggcgtcagcggccccaccagc

SEQ ID NO: 22063 - DNA, 21 bp, Artificial Sequence
  Description of Artificial Sequence: Synthetic oligonucleotide
aaccccgccagcaccgcccaa

SEQ ID NO: 22064 - DNA, 21 bp, Artificial Sequence
  Description of Artificial Sequence: Synthetic oligonucleotide
cagcctcgtcctagtcctact

SEQ ID NO: 22065 - DNA, 21 bp, Artificial Sequence
  Description of Artificial Sequence: Synthetic oligonucleotide
cagtcttcggataagttgcgt

SEQ ID NO: 22066 - DNA, 21 bp, Artificial Sequence
  Description of Artificial Sequence: Synthetic oligonucleotide
cttggtcagtcttctcagggt

SEQ ID NO: 22067 - DNA, 21 bp, Artificial Sequence
  Description of Artificial Sequence: Synthetic oligonucleotide
ttggtggataatccgaagggg

SEQ ID NO: 22068 - DNA, 21 bp, Artificial Sequence
  Description of Artificial Sequence: Synthetic oligonucleotide
aacagcaacggcaacaacagc

SEQ ID NO: 22069 - DNA, 21 bp, Artificial Sequence
  Description of Artificial Sequence: Synthetic oligonucleotide
agcagcagacaacccgtcgtc

SEQ ID NO: 22070 - DNA, 21 bp, Artificial Sequence
  Description of Artificial Sequence: Synthetic oligonucleotide
agtacttctgctaatcctgcg

SEQ ID NO: 22071 - DNA, 21 bp, Artificial Sequence
  Description of Artificial Sequence: Synthetic oligonucleotide
ctttctcagggtggtggtgcg

SEQ ID NO: 22072 - DNA, 21 bp, Artificial Sequence
  Description of Artificial Sequence: Synthetic oligonucleotide
gataagacttcgtcgcctttg

SEQ ID NO: 22073 - DNA, 21 bp, Artificial Sequence
  Description of Artificial Sequence: Synthetic oligonucleotide
agcgtccaaaaagtcaacctc

SEQ ID NO: 22074 - DNA, 21 bp, Artificial Sequence
  Description of Artificial Sequence: Synthetic oligonucleotide
caccccgcccaagccagcggc

SEQ ID NO: 22075 - DNA, 21 bp, Artificial Sequence
  Description of Artificial Sequence: Synthetic oligonucleotide
gccagcgtcagcaccaccaaa

SEQ ID NO: 22076 - DNA, 21 bp, Artificial Sequence
  Description of Artificial Sequence: Synthetic oligonucleotide
aacagcctcaaaggcagcagc

SEQ ID NO: 22077 - DNA, 21 bp, Artificial Sequence
  Description of Artificial Sequence: Synthetic oligonucleotide
agtacttcgcgtgagaatttg

SEQ ID NO: 22078 - DNA, 21 bp, Artificial Sequence
  Description of Artificial Sequence: Synthetic oligonucleotide
ctttcggttggtaataattcg

SEQ ID NO: 22079 - DNA, 21 bp, Artificial Sequence
  Description of Artificial Sequence: Synthetic oligonucleotide
ggcatcaacagcagcagaacc

SEQ ID NO: 22080 - DNA, 21 bp, Artificial Sequence
  Description of Artificial Sequence: Synthetic oligonucleotide
gaagccaaagccaacgccgcc

SEQ ID NO: 22081 - DNA, 21 bp, Artificial Sequence
  Description of Artificial Sequence: Synthetic oligonucleotide
ggcaccctccccagccaacaa

SEQ ID NO: 22082 - DNA, 21 bp, Artificial Sequence
  Description of Artificial Sequence: Synthetic oligonucleotide
aaccccctcgccagcaaagac

SEQ ID NO: 22083 - DNA, 21 bp, Artificial Sequence
  Description of Artificial Sequence: Synthetic oligonucleotide
aacgccagcagccaacccgcc

SEQ ID NO: 22084 - DNA, 21 bp, Artificial Sequence
  Description of Artificial Sequence: Synthetic oligonucleotide
gggaatgagatgagtgttaag

SEQ ID NO: 22085 - DNA, 21 bp, Artificial Sequence
  Description of Artificial Sequence: Synthetic oligonucleotide
accagcgccaccgcccaccac

SEQ ID NO: 22086 - DNA, 21 bp, Artificial Sequence
  Description of Artificial Sequence: Synthetic oligonucleotide
gtccaaaaaagcgtcagcacc

SEQ ID NO: 22087 - DNA, 21 bp, Artificial Sequence
  Description of Artificial Sequence: Synthetic oligonucleotide
tctgtttctactacgaatgct

SEQ ID NO: 22088 - DNA, 21 bp, Artificial Sequence
  Description of Artificial Sequence: Synthetic oligonucleotide
ctcagcggccaaagcgccaac

SEQ ID NO: 22089 - DNA, 21 bp, Artificial Sequence
  Description of Artificial Sequence: Synthetic oligonucleotide
aatcagtctcagacgacgatt

SEQ ID NO: 22090 - DNA, 21 bp, Artificial Sequence
  Description of Artificial Sequence: Synthetic oligonucleotide
aatgcgactaagggttctgtg

SEQ ID NO: 22091 - DNA, 21 bp, Artificial Sequence
  Description of Artificial Sequence: Synthetic oligonucleotide
accagcagcgacgccagagtc

SEQ ID NO: 22092 - DNA, 21 bp, Artificial Sequence
  Description of Artificial Sequence: Synthetic oligonucleotide
acccaaaaagacagcaaagtc

SEQ ID NO: 22093 - DNA, 21 bp, Artificial Sequence
  Description of Artificial Sequence: Synthetic oligonucleotide
agagaagccgaaagcagcaga

SEQ ID NO: 22094 - DNA, 21 bp, Artificial Sequence
  Description of Artificial Sequence: Synthetic oligonucleotide
agtactacgaagggtgagatg

SEQ ID NO: 22095 - DNA, 21 bp, Artificial Sequence
  Description of Artificial Sequence: Synthetic oligonucleotide
agtgatggtaatgctaatagg

SEQ ID NO: 22096 - DNA, 21 bp, Artificial Sequence
  Description of Artificial Sequence: Synthetic oligonucleotide
agtgggacggagtctggtagt

SEQ ID NO: 22097 - DNA, 21 bp, Artificial Sequence
  Description of Artificial Sequence: Synthetic oligonucleotide
atgccgactacggatatgaag

SEQ ID NO: 22098 - DNA, 21 bp, Artificial Sequence
  Description of Artificial Sequence: Synthetic oligonucleotide
cacggcgaaaaactcggccaa

SEQ ID NO: 22099 - DNA, 21 bp, Artificial Sequence
  Description of Artificial Sequence: Synthetic oligonucleotide
catgggaggggtagtgagggt

SEQ ID NO: 22100 - DNA, 21 bp, Artificial Sequence
  Description of Artificial Sequence: Synthetic oligonucleotide
catggtgttagtacggggtcg

SEQ ID NO: 22101 - DNA, 21 bp, Artificial Sequence
  Description of Artificial Sequence: Synthetic oligonucleotide
gagagtgattctcgtaatcgg

SEQ ID NO: 22102 - DNA, 21 bp, Artificial Sequence
  Description of Artificial Sequence: Synthetic oligonucleotide
gagcagactcagccggttagg

SEQ ID NO: 22103 - DNA, 21 bp, Artificial Sequence
  Description of Artificial Sequence: Synthetic oligonucleotide
gccagcagcggcaccatgagc

SEQ ID NO: 22104 - DNA, 21 bp, Artificial Sequence
  Description of Artificial Sequence: Synthetic oligonucleotide
gctccgaatagtaaggtggtg

SEQ ID NO: 22105 - DNA, 21 bp, Artificial Sequence
  Description of Artificial Sequence: Synthetic oligonucleotide
ggcagcaacggcaaagtcttc

SEQ ID NO: 22106 - DNA, 21 bp, Artificial Sequence
  Description of Artificial Sequence: Synthetic oligonucleotide
ggcagcaccaacaccaaagtc

SEQ ID NO: 22107 - DNA, 21 bp, Artificial Sequence
  Description of Artificial Sequence: Synthetic oligonucleotide
ggccccaacaaacccagcttc

SEQ ID NO: 22108 - DNA, 21 bp, Artificial Sequence
  Description of Artificial Sequence: Synthetic oligonucleotide
gggaatggtgagcatagtact

SEQ ID NO: 22109 - DNA, 21 bp, Artificial Sequence
  Description of Artificial Sequence: Synthetic oligonucleotide
gggactaggcctgctgatacg

SEQ ID NO: 22110 - DNA, 21 bp, Artificial Sequence
  Description of Artificial Sequence: Synthetic oligonucleotide
tctacggatagtaattttcgt

SEQ ID NO: 22111 - DNA, 21 bp, Artificial Sequence
  Description of Artificial Sequence: Synthetic oligonucleotide
agcatcagcggcaaaaaccaa

SEQ ID NO: 22112 - DNA, 21 bp, Artificial Sequence
  Description of Artificial Sequence: Synthetic oligonucleotide
gtccaaaccaccaaaagcaac

SEQ ID NO: 22113 - DNA, 21 bp, Artificial Sequence
  Description of Artificial Sequence: Synthetic oligonucleotide
ggtgcttctaagcatacggct

SEQ ID NO: 22114 - DNA, 21 bp, Artificial Sequence
  Description of Artificial Sequence: Synthetic oligonucleotide
cacaccaaaaccacccccgaa

SEQ ID NO: 22115 - DNA, 21 bp, Artificial Sequence
  Description of Artificial Sequence: Synthetic oligonucleotide
caacaagccagcaaagccacc

SEQ ID NO: 22116 - DNA, 21 bp, Artificial Sequence
  Description of Artificial Sequence: Synthetic oligonucleotide
acgagtaatgggattgctaag

SEQ ID NO: 22117 - DNA, 21 bp, Artificial Sequence
  Description of Artificial Sequence: Synthetic oligonucleotide
acgaattcgtctaagatgact

SEQ ID NO: 22118 - DNA, 21 bp, Artificial Sequence
  Description of Artificial Sequence: Synthetic oligonucleotide
agcaacggcagcagcgccagc

SEQ ID NO: 22119 - DNA, 21 bp, Artificial Sequence
  Description of Artificial Sequence: Synthetic oligonucleotide
ggcggccaaagcgtcccccaa

SEQ ID NO: 22120 - DNA, 21 bp, Artificial Sequence
  Description of Artificial Sequence: Synthetic oligonucleotide
accgacagcaccaaacacggc

SEQ ID NO: 22121 - DNA, 21 bp, Artificial Sequence
  Description of Artificial Sequence: Synthetic oligonucleotide
cagggtatggggaatgttatt

SEQ ID NO: 22122 - DNA, 21 bp, Artificial Sequence
  Description of Artificial Sequence: Synthetic oligonucleotide
gacaaaatcaaaacccaacaa

SEQ ID NO: 22123 - DNA, 21 bp, Artificial Sequence
  Description of Artificial Sequence: Synthetic oligonucleotide
gagtctgagtcgagtaagggg

SEQ ID NO: 22124 - DNA, 21 bp, Artificial Sequence
  Description of Artificial Sequence: Synthetic oligonucleotide
gtcgtcagcggcggcaacagc

SEQ ID NO: 22125 - DNA, 21 bp, Artificial Sequence
  Description of Artificial Sequence: Synthetic oligonucleotide
gctgagggttctcggggtggt

SEQ ID NO: 22126 - DNA, 21 bp, Artificial Sequence
  Description of Artificial Sequence: Synthetic oligonucleotide
ggcatggaaagaagcctcggc

SEQ ID NO: 22127 - DNA, 21 bp, Artificial Sequence
  Description of Artificial Sequence: Synthetic oligonucleotide
ggtcagcagcgggagccgatg

SEQ ID NO: 22128 - DNA, 21 bp, Artificial Sequence
  Description of Artificial Sequence: Synthetic oligonucleotide
atgcaaagcaacgacaccaaa

SEQ ID NO: 22129 - DNA, 21 bp, Artificial Sequence
  Description of Artificial Sequence: Synthetic oligonucleotide
caggggacggctcagattgcg

SEQ ID NO: 22130 - DNA, 21 bp, Artificial Sequence
  Description of Artificial Sequence: Synthetic oligonucleotide
agccccaccggcgacagcaaa

SEQ ID NO: 22131 - DNA, 21 bp, Artificial Sequence
  Description of Artificial Sequence: Synthetic oligonucleotide
agcaccagcggcagcaccaaa

SEQ ID NO: 22132 - DNA, 21 bp, Artificial Sequence
  Description of Artificial Sequence: Synthetic oligonucleotide
cataatgtggagaaggcgggg

SEQ ID NO: 22133 - DNA, 21 bp, Artificial Sequence
  Description of Artificial Sequence: Synthetic oligonucleotide
gaaaacagcaaccccagaagc

SEQ ID NO: 22134 - DNA, 21 bp, Artificial Sequence
  Description of Artificial Sequence: Synthetic oligonucleotide
gattctaaggcggggactgtg

SEQ ID NO: 22135 - DNA, 21 bp, Artificial Sequence
  Description of Artificial Sequence: Synthetic oligonucleotide
agacacggcagcgaacaaggc

SEQ ID NO: 22136 - DNA, 21 bp, Artificial Sequence
  Description of Artificial Sequence: Synthetic oligonucleotide
cacgccagcagcagcaaaggc

SEQ ID NO: 22137 - DNA, 21 bp, Artificial Sequence
  Description of Artificial Sequence: Synthetic oligonucleotide
gccaccggcagcaccgccatc

SEQ ID NO: 22138 - DNA, 21 bp, Artificial Sequence
  Description of Artificial Sequence: Synthetic oligonucleotide
acgatggctagtaagcctaat

SEQ ID NO: 22139 - DNA, 21 bp, Artificial Sequence
  Description of Artificial Sequence: Synthetic oligonucleotide
gtcaaaaacggcaacgtcctc

SEQ ID NO: 22140 - DNA, 21 bp, Artificial Sequence
  Description of Artificial Sequence: Synthetic oligonucleotide
accaccctccaaaaacccgtc

SEQ ID NO: 22141 - DNA, 21 bp, Artificial Sequence
  Description of Artificial Sequence: Synthetic oligonucleotide
accgtccaaaacagcaaagaa

SEQ ID NO: 22142 - DNA, 21 bp, Artificial Sequence
  Description of Artificial Sequence: Synthetic oligonucleotide
agccaaaaacccagcggcgcc

SEQ ID NO: 22143 - DNA, 21 bp, Artificial Sequence
  Description of Artificial Sequence: Synthetic oligonucleotide
agcgccgtccaaagcagcggc

SEQ ID NO: 22144 - DNA, 21 bp, Artificial Sequence
  Description of Artificial Sequence: Synthetic oligonucleotide
gataggagtgagcggtctatt

SEQ ID NO: 22145 - DNA, 21 bp, Artificial Sequence
  Description of Artificial Sequence: Synthetic oligonucleotide
gccggcgtcaccccccccagc

SEQ ID NO: 22146 - DNA, 21 bp, Artificial Sequence
  Description of Artificial Sequence: Synthetic oligonucleotide
gcgacgcgggataaggttgtg

SEQ ID NO: 22147 - DNA, 21 bp, Artificial Sequence
  Description of Artificial Sequence: Synthetic oligonucleotide
tctgtgcatagtggttctgcg

SEQ ID NO: 22148 - DNA, 21 bp, Artificial Sequence
  Description of Artificial Sequence: Synthetic oligonucleotide
accaccgccagcagcccccaa

SEQ ID NO: 22149 - DNA, 21 bp, Artificial Sequence
  Description of Artificial Sequence: Synthetic oligonucleotide
aacgccaacggcagcagcgcc

SEQ ID NO: 22150 - DNA, 21 bp, Artificial Sequence
  Description of Artificial Sequence: Synthetic oligonucleotide
agcggcagcacccccagagaa

SEQ ID NO: 22151 - DNA, 21 bp, Artificial Sequence
  Description of Artificial Sequence: Synthetic oligonucleotide
cagaataagtcgggtagtatg

SEQ ID NO: 22152 - DNA, 21 bp, Artificial Sequence
  Description of Artificial Sequence: Synthetic oligonucleotide
tctgctcttggtaaggagtcg

SEQ ID NO: 22153 - DNA, 21 bp, Artificial Sequence
  Description of Artificial Sequence: Synthetic oligonucleotide
cagtctgggtctaaggttacg

SEQ ID NO: 22154 - DNA, 21 bp, Artificial Sequence
  Description of Artificial Sequence: Synthetic oligonucleotide
atgacgtctgataagtctacg

SEQ ID NO: 22155 - DNA, 21 bp, Artificial Sequence
  Description of Artificial Sequence: Synthetic oligonucleotide
ctttctaatgggaagtcgacg

SEQ ID NO: 22156 - DNA, 21 bp, Artificial Sequence
  Description of Artificial Sequence: Synthetic oligonucleotide
gacaacagcaccggcatcaga

SEQ ID NO: 22157 - DNA, 21 bp, Artificial Sequence
  Description of Artificial Sequence: Synthetic oligonucleotide
gatactcttgataggtctagg

SEQ ID NO: 22158 - DNA, 21 bp, Artificial Sequence
  Description of Artificial Sequence: Synthetic oligonucleotide
gccagcaacaacagccaaagc

SEQ ID NO: 22159 - DNA, 21 bp, Artificial Sequence
  Description of Artificial Sequence: Synthetic oligonucleotide
gccagccccaccaaaagcatc

SEQ ID NO: 22160 - DNA, 21 bp, Artificial Sequence
  Description of Artificial Sequence: Synthetic oligonucleotide
ggtcctactaatgttcaggct

SEQ ID NO: 22161 - DNA, 21 bp, Artificial Sequence
  Description of Artificial Sequence: Synthetic oligonucleotide
gtgggggtggataaggtggct

SEQ ID NO: 22162 - DNA, 21 bp, Artificial Sequence
  Description of Artificial Sequence: Synthetic oligonucleotide
tcgtcgggtcagtctatgggt

SEQ ID NO: 22163 - DNA, 21 bp, Artificial Sequence
  Description of Artificial Sequence: Synthetic oligonucleotide
agcggcaccaaagtcgccctc

SEQ ID NO: 22164 - DNA, 21 bp, Artificial Sequence
  Description of Artificial Sequence: Synthetic oligonucleotide
gctgcggtgagttcgcctagt

SEQ ID NO: 22165 - DNA, 21 bp, Artificial Sequence
  Description of Artificial Sequence: Synthetic oligonucleotide
cacggcgccaacaacgtccaa

SEQ ID NO: 22166 - DNA, 21 bp, Artificial Sequence
  Description of Artificial Sequence: Synthetic oligonucleotide
aatacttcggatactaagaat

SEQ ID NO: 22167 - DNA, 21 bp, Artificial Sequence
  Description of Artificial Sequence: Synthetic oligonucleotide
aatcccactaatgatcagaag

SEQ ID NO: 22168 - DNA, 21 bp, Artificial Sequence
  Description of Artificial Sequence: Synthetic oligonucleotide
agcacccaaaaccacggcaac

SEQ ID NO: 22169 - DNA, 21 bp, Artificial Sequence
  Description of Artificial Sequence: Synthetic oligonucleotide
caaggcaacaacaccctcatg

SEQ ID NO: 22170 - DNA, 21 bp, Artificial Sequence
  Description of Artificial Sequence: Synthetic oligonucleotide
ctcgccatccccgacaaaggc

SEQ ID NO: 22171 - DNA, 21 bp, Artificial Sequence
  Description of Artificial Sequence: Synthetic oligonucleotide
gccctcagcggcggcaacagc

SEQ ID NO: 22172 - DNA, 21 bp, Artificial Sequence
  Description of Artificial Sequence: Synthetic oligonucleotide
gtcgccgccacccccccccaa

SEQ ID NO: 22173 - DNA, 21 bp, Artificial Sequence
  Description of Artificial Sequence: Synthetic oligonucleotide
aaagccggcagcagcgtcggc

SEQ ID NO: 22174 - DNA, 21 bp, Artificial Sequence
  Description of Artificial Sequence: Synthetic oligonucleotide
attggtgctgggaatccttct

SEQ ID NO: 22175 - DNA, 21 bp, Artificial Sequence
  Description of Artificial Sequence: Synthetic oligonucleotide
cacaaagacagagaaaacaaa

SEQ ID NO: 22176 - DNA, 21 bp, Artificial Sequence
  Description of Artificial Sequence: Synthetic oligonucleotide
cagaatagtaatcagctgaag

SEQ ID NO: 22177 - DNA, 21 bp, Artificial Sequence
  Description of Artificial Sequence: Synthetic oligonucleotide
ggtacgactaatacgagtagt

SEQ ID NO: 22178 - DNA, 21 bp, Artificial Sequence
  Description of Artificial Sequence: Synthetic oligonucleotide
tcgcctgatcatgctaagagt

SEQ ID NO: 22179 - DNA, 21 bp, Artificial Sequence
  Description of Artificial Sequence: Synthetic oligonucleotide
ctgccggtgaattctactaag

SEQ ID NO: 22180 - DNA, 21 bp, Artificial Sequence
  Description of Artificial Sequence: Synthetic oligonucleotide
agcggcaccaaagtcagcgaa

SEQ ID NO: 22181 - DNA, 21 bp, Artificial Sequence
  Description of Artificial Sequence: Synthetic oligonucleotide
cccctcagcggcaaaggcccc

SEQ ID NO: 22182 - DNA, 21 bp, Artificial Sequence
  Description of Artificial Sequence: Synthetic oligonucleotide
gccaacagccaccaaaacacc

SEQ ID NO: 22183 - DNA, 21 bp, Artificial Sequence
  Description of Artificial Sequence: Synthetic oligonucleotide
ggtgttgattcgagtaggggt

SEQ ID NO: 22184 - DNA, 21 bp, Artificial Sequence
  Description of Artificial Sequence: Synthetic oligonucleotide
ggttcgaatcatagttcttct

SEQ ID NO: 22185 - DNA, 21 bp, Artificial Sequence
  Description of Artificial Sequence: Synthetic oligonucleotide
accgacggcagcaaaggcagc

SEQ ID NO: 22186 - DNA, 21 bp, Artificial Sequence
  Description of Artificial Sequence: Synthetic oligonucleotide
aatgggggtacgccgatgcgg

SEQ ID NO: 22187 - DNA, 21 bp, Artificial Sequence
  Description of Artificial Sequence: Synthetic oligonucleotide
tcggctactacggttaattct

SEQ ID NO: 22188 - DNA, 21 bp, Artificial Sequence
  Description of Artificial Sequence: Synthetic oligonucleotide
aacaccagcagccccgtcgtc

SEQ ID NO: 22189 - DNA, 21 bp, Artificial Sequence
  Description of Artificial Sequence: Synthetic oligonucleotide
gacagcagccaccacggcaga

SEQ ID NO: 22190 - DNA, 21 bp, Artificial Sequence
  Description of Artificial Sequence: Synthetic oligonucleotide
gacctcctcccccccggcaaa

SEQ ID NO: 22191 - DNA, 21 bp, Artificial Sequence
  Description of Artificial Sequence: Synthetic oligonucleotide
agttctggtattggtggtgcg

SEQ ID NO: 22192 - DNA, 21 bp, Artificial Sequence
  Description of Artificial Sequence: Synthetic oligonucleotide
accggcaaaaccagccccacc

SEQ ID NO: 22193 - DNA, 21 bp, Artificial Sequence
  Description of Artificial Sequence: Synthetic oligonucleotide
accaccgtcaacagccccagc

SEQ ID NO: 22194 - DNA, 21 bp, Artificial Sequence
  Description of Artificial Sequence: Synthetic oligonucleotide
aagacggggactggttcgtcg

SEQ ID NO: 22195 - DNA, 21 bp, Artificial Sequence
  Description of Artificial Sequence: Synthetic oligonucleotide
accaaaggccaaacccccggc

SEQ ID NO: 22196 - DNA, 21 bp, Artificial Sequence
  Description of Artificial Sequence: Synthetic oligonucleotide
accggcggccacaaaggcagc

SEQ ID NO: 22197 - DNA, 21 bp, Artificial Sequence
  Description of Artificial Sequence: Synthetic oligonucleotide
acgcataatggtactgctgcg

SEQ ID NO: 22198 - DNA, 21 bp, Artificial Sequence
  Description of Artificial Sequence: Synthetic oligonucleotide
agcaacagcagccccaccgtc

SEQ ID NO: 22199 - DNA, 21 bp, Artificial Sequence
  Description of Artificial Sequence: Synthetic oligonucleotide
agcagcgcccaaaaagaccaa

SEQ ID NO: 22200 - DNA, 21 bp, Artificial Sequence
  Description of Artificial Sequence: Synthetic oligonucleotide
agttctgggcagcctgtttct

SEQ ID NO: 22201 - DNA, 21 bp, Artificial Sequence
  Description of Artificial Sequence: Synthetic oligonucleotide
atgaatgatgtgaagtctaat

SEQ ID NO: 22202 - DNA, 21 bp, Artificial Sequence
  Description of Artificial Sequence: Synthetic oligonucleotide
ctcagagccggccaaggcatg

SEQ ID NO: 22203 - DNA, 21 bp, Artificial Sequence
  Description of Artificial Sequence: Synthetic oligonucleotide
ctttcgggtgcgactagtgtt

SEQ ID NO: 22204 - DNA, 21 bp, Artificial Sequence
  Description of Artificial Sequence: Synthetic oligonucleotide
gatactaagcagcctcagctt

SEQ ID NO: 22205 - DNA, 21 bp, Artificial Sequence
  Description of Artificial Sequence: Synthetic oligonucleotide
gcgaagacggtgagttctggt

SEQ ID NO: 22206 - DNA, 21 bp, Artificial Sequence
  Description of Artificial Sequence: Synthetic oligonucleotide
ggccccacccccgccaacagc

SEQ ID NO: 22207 - DNA, 21 bp, Artificial Sequence
  Description of Artificial Sequence: Synthetic oligonucleotide
ggccccgaaagcagaaacagc

SEQ ID NO: 22208 - DNA, 21 bp, Artificial Sequence
  Description of Artificial Sequence: Synthetic oligonucleotide
ggggatgggcataatgcgggt

SEQ ID NO: 22209 - DNA, 21 bp, Artificial Sequence
  Description of Artificial Sequence: Synthetic oligonucleotide
gtcaccaacggcaccaccaga

SEQ ID NO: 22210 - DNA, 21 bp, Artificial Sequence
  Description of Artificial Sequence: Synthetic oligonucleotide
gtcgccgaaagcaaagtcaac

SEQ ID NO: 22211 - DNA, 21 bp, Artificial Sequence
  Description of Artificial Sequence: Synthetic oligonucleotide
gtcggcgaaagcaaccacagc

SEQ ID NO: 22212 - DNA, 21 bp, Artificial Sequence
  Description of Artificial Sequence: Synthetic oligonucleotide
tctgagccttcgcagaagacg

SEQ ID NO: 22213 - DNA, 21 bp, Artificial Sequence
  Description of Artificial Sequence: Synthetic oligonucleotide
tctggtgggcaggcgacgatg

SEQ ID NO: 22214 - DNA, 21 bp, Artificial Sequence
  Description of Artificial Sequence: Synthetic oligonucleotide
accaccagcaccagagccgaa

SEQ ID NO: 22215 - DNA, 21 bp, Artificial Sequence
  Description of Artificial Sequence: Synthetic oligonucleotide
agccaaagcaccagcaccctc

SEQ ID NO: 22216 - DNA, 21 bp, Artificial Sequence
  Description of Artificial Sequence: Synthetic oligonucleotide
agcgtcctccccaacaaagcc

SEQ ID NO: 22217 - DNA, 21 bp, Artificial Sequence
  Description of Artificial Sequence: Synthetic oligonucleotide
agcggcagcaccagcctcgcc

SEQ ID NO: 22218 - DNA, 21 bp, Artificial Sequence
  Description of Artificial Sequence: Synthetic oligonucleotide
gaccccctcagcaccaacaga

SEQ ID NO: 22219 - DNA, 21 bp, Artificial Sequence
  Description of Artificial Sequence: Synthetic oligonucleotide
gacgccagcgaaagaacccac

SEQ ID NO: 22220 - DNA, 21 bp, Artificial Sequence
  Description of Artificial Sequence: Synthetic oligonucleotide
actacgcaggggaatggtcat

SEQ ID NO: 22221 - DNA, 21 bp, Artificial Sequence
  Description of Artificial Sequence: Synthetic oligonucleotide
gctctggcgaagagtggtagt

SEQ ID NO: 22222 - DNA, 21 bp, Artificial Sequence
  Description of Artificial Sequence: Synthetic oligonucleotide
gatgtggggtcttcgtcgaat

SEQ ID NO: 22223 - DNA, 21 bp, Artificial Sequence
  Description of Artificial Sequence: Synthetic oligonucleotide
ggtactacgactcaggttaag

SEQ ID NO: 22224 - DNA, 21 bp, Artificial Sequence
  Description of Artificial Sequence: Synthetic oligonucleotide
aagaatactggggcgccttcg

SEQ ID NO: 22225 - DNA, 21 bp, Artificial Sequence
  Description of Artificial Sequence: Synthetic oligonucleotide
gaacacgccgacaaactcaaa

SEQ ID NO: 22226 - DNA, 21 bp, Artificial Sequence
  Description of Artificial Sequence: Synthetic oligonucleotide
ggcagcaaaggcaacagcacc

SEQ ID NO: 22227 - DNA, 21 bp, Artificial Sequence
  Description of Artificial Sequence: Synthetic oligonucleotide
ctcgccagcaaaagcagcacc

SEQ ID NO: 22228 - DNA, 21 bp, Artificial Sequence
  Description of Artificial Sequence: Synthetic oligonucleotide
gaacaaagcagcctcaaaaac

SEQ ID NO: 22229 - DNA, 21 bp, Artificial Sequence
  Description of Artificial Sequence: Synthetic oligonucleotide
gtcagcaccagcagacccagc

SEQ ID NO: 22230 - DNA, 21 bp, Artificial Sequence
  Description of Artificial Sequence: Synthetic oligonucleotide
ttgaaggatacttctagtatt

SEQ ID NO: 22231 - DNA, 21 bp, Artificial Sequence
  Description of Artificial Sequence: Synthetic oligonucleotide
actggggctggttcggtggct

SEQ ID NO: 22232 - DNA, 21 bp, Artificial Sequence
  Description of Artificial Sequence: Synthetic oligonucleotide
cagcagattgggagtaaggag

SEQ ID NO: 22233 - DNA, 21 bp, Artificial Sequence
  Description of Artificial Sequence: Synthetic oligonucleotide
gccctcagcagcaaaaacgtc

SEQ ID NO: 22234 - DNA, 21 bp, Artificial Sequence
  Description of Artificial Sequence: Synthetic oligonucleotide
gctggtgataattctcagaag

SEQ ID NO: 22235 - DNA, 21 bp, Artificial Sequence
  Description of Artificial Sequence: Synthetic oligonucleotide
ggtggtgagactccgttgaag

SEQ ID NO: 22236 - DNA, 21 bp, Artificial Sequence
  Description of Artificial Sequence: Synthetic oligonucleotide
aaagccagcggcaacgccgtc

SEQ ID NO: 22237 - DNA, 21 bp, Artificial Sequence
  Description of Artificial Sequence: Synthetic oligonucleotide
actacggcttcggatcatcgg

SEQ ID NO: 22238 - DNA, 21 bp, Artificial Sequence
  Description of Artificial Sequence: Synthetic oligonucleotide
gtgggtacttctgctactact

SEQ ID NO: 22239 - DNA, 21 bp, Artificial Sequence
  Description of Artificial Sequence: Synthetic oligonucleotide
aaccccggcggcagcaacaaa

SEQ ID NO: 22240 - DNA, 21 bp, Artificial Sequence
  Description of Artificial Sequence: Synthetic oligonucleotide
accagcgcccccaccaacaaa

SEQ ID NO: 22241 - DNA, 21 bp, Artificial Sequence
  Description of Artificial Sequence: Synthetic oligonucleotide
agcaaaagcaccggcgccatc

SEQ ID NO: 22242 - DNA, 21 bp, Artificial Sequence
  Description of Artificial Sequence: Synthetic oligonucleotide
agccaacaacccagccaaggc

SEQ ID NO: 22243 - DNA, 21 bp, Artificial Sequence
  Description of Artificial Sequence: Synthetic oligonucleotide
atgcatgagagtaagtcgctg

SEQ ID NO: 22244 - DNA, 21 bp, Artificial Sequence
  Description of Artificial Sequence: Synthetic oligonucleotide
cagaattctacgggtacgcag

SEQ ID NO: 22245 - DNA, 21 bp, Artificial Sequence
  Description of Artificial Sequence: Synthetic oligonucleotide
caggctcatgatagtaagtcg

SEQ ID NO: 22246 - DNA, 21 bp, Artificial Sequence
  Description of Artificial Sequence: Synthetic oligonucleotide
gaaggcagagacagcaacggc

SEQ ID NO: 22247 - DNA, 21 bp, Artificial Sequence
  Description of Artificial Sequence: Synthetic oligonucleotide
gacagagccaacagcaccagc

SEQ ID NO: 22248 - DNA, 21 bp, Artificial Sequence
  Description of Artificial Sequence: Synthetic oligonucleotide
gatgggagtacgggtcctcgt

SEQ ID NO: 22249 - DNA, 21 bp, Artificial Sequence
  Description of Artificial Sequence: Synthetic oligonucleotide
ggcagcacccaaagcaccagc

SEQ ID NO: 22250 - DNA, 21 bp, Artificial Sequence
  Description of Artificial Sequence: Synthetic oligonucleotide
gggagtactactagtgtgcat

SEQ ID NO: 22251 - DNA, 21 bp, Artificial Sequence
  Description of Artificial Sequence: Synthetic oligonucleotide
gtcaacggcagccaaatgctc

SEQ ID NO: 22252 - DNA, 21 bp, Artificial Sequence
  Description of Artificial Sequence: Synthetic oligonucleotide
aatccggcgcagactctttct

SEQ ID NO: 22253 - DNA, 21 bp, Artificial Sequence
  Description of Artificial Sequence: Synthetic oligonucleotide
agcggcgccacccccatcatg

SEQ ID NO: 22254 - DNA, 21 bp, Artificial Sequence
  Description of Artificial Sequence: Synthetic oligonucleotide
gacaacaccggcagcagaagc

SEQ ID NO: 22255 - DNA, 21 bp, Artificial Sequence
  Description of Artificial Sequence: Synthetic oligonucleotide
ggtggtgcggcttcgactctc

SEQ ID NO: 22256 - DNA, 21 bp, Artificial Sequence
  Description of Artificial Sequence: Synthetic oligonucleotide
acgactacgcgttctaatagt

SEQ ID NO: 22257 - DNA, 21 bp, Artificial Sequence
  Description of Artificial Sequence: Synthetic oligonucleotide
aacgcccacgacaccaaaggc

SEQ ID NO: 22258 - DNA, 21 bp, Artificial Sequence
  Description of Artificial Sequence: Synthetic oligonucleotide
accagccaaagcaaaatcatc

SEQ ID NO: 22259 - DNA, 21 bp, Artificial Sequence
  Description of Artificial Sequence: Synthetic oligonucleotide
agaggcaacggcgccagcggc

SEQ ID NO: 22260 - DNA, 21 bp, Artificial Sequence
  Description of Artificial Sequence: Synthetic oligonucleotide
catcattcgcaggattcgaag

SEQ ID NO: 22261 - DNA, 21 bp, Artificial Sequence
  Description of Artificial Sequence: Synthetic oligonucleotide
gccagcgccaccggcaacgcc

SEQ ID NO: 22262 - DNA, 21 bp, Artificial Sequence
  Description of Artificial Sequence: Synthetic oligonucleotide
tcggaggctaagacggtgcat

SEQ ID NO: 22263 - DNA, 21 bp, Artificial Sequence
  Description of Artificial Sequence: Synthetic oligonucleotide
tctaataagtctagtgctgtt

SEQ ID NO: 22264 - DNA, 21 bp, Artificial Sequence
  Description of Artificial Sequence: Synthetic oligonucleotide
gacagcacccccggcagaagc

SEQ ID NO: 22265 - DNA, 21 bp, Artificial Sequence
  Description of Artificial Sequence: Synthetic oligonucleotide
atcgccaaacccgacagcacc

SEQ ID NO: 22266 - DNA, 21 bp, Artificial Sequence
  Description of Artificial Sequence: Synthetic oligonucleotide
aacgccgaagtcagaagcagc

SEQ ID NO: 22267 - DNA, 21 bp, Artificial Sequence
  Description of Artificial Sequence: Synthetic oligonucleotide
gagcgtcctaataatgcgggt

SEQ ID NO: 22268 - DNA, 21 bp, Artificial Sequence
  Description of Artificial Sequence: Synthetic oligonucleotide
tctagtgggactagtagttcg

SEQ ID NO: 22269 - DNA, 21 bp, Artificial Sequence
  Description of Artificial Sequence: Synthetic oligonucleotide
tctgagggacagattcggagt

SEQ ID NO: 22270 - DNA, 21 bp, Artificial Sequence
  Description of Artificial Sequence: Synthetic oligonucleotide
acgagtcatacgcctcatacg

SEQ ID NO: 22271 - DNA, 21 bp, Artificial Sequence
  Description of Artificial Sequence: Synthetic oligonucleotide
agcaacggcggcagcggcagc

SEQ ID NO: 22272 - DNA, 21 bp, Artificial Sequence
  Description of Artificial Sequence: Synthetic oligonucleotide
atcaaaaccaccagcaacgcc

SEQ ID NO: 22273 - DNA, 21 bp, Artificial Sequence
  Description of Artificial Sequence: Synthetic oligonucleotide
ggcaacatggtcaaacccagc

SEQ ID NO: 22274 - DNA, 21 bp, Artificial Sequence
  Description of Artificial Sequence: Synthetic oligonucleotide
ggtagggagcctgttcagggg

SEQ ID NO: 22275 - DNA, 21 bp, Artificial Sequence
  Description of Artificial Sequence: Synthetic oligonucleotide
caagtcagcagcgaagccagc

SEQ ID NO: 22276 - DNA, 21 bp, Artificial Sequence
  Description of Artificial Sequence: Synthetic oligonucleotide
gacagcggcaacacccccaga

SEQ ID NO: 22277 - DNA, 21 bp, Artificial Sequence
  Description of Artificial Sequence: Synthetic oligonucleotide
ggcaccaacaccagcatggcc

SEQ ID NO: 22278 - DNA, 21 bp, Artificial Sequence
  Description of Artificial Sequence: Synthetic oligonucleotide
ggtgattctaagccgaatctt

SEQ ID NO: 22279 - DNA, 21 bp, Artificial Sequence
  Description of Artificial Sequence: Synthetic oligonucleotide
gtcaccagcaccaccagcagc

SEQ ID NO: 22280 - DNA, 21 bp, Artificial Sequence
  Description of Artificial Sequence: Synthetic oligonucleotide
tatgctgatgctagggcgtct

SEQ ID NO: 22281 - DNA, 21 bp, Artificial Sequence
  Description of Artificial Sequence: Synthetic oligonucleotide
ctgcctatgggtgggcagaat

SEQ ID NO: 22282 - DNA, 21 bp, Artificial Sequence
  Description of Artificial Sequence: Synthetic oligonucleotide
accatgagcggcaaaggcgaa

SEQ ID NO: 22283 - DNA, 21 bp, Artificial Sequence
  Description of Artificial Sequence: Synthetic oligonucleotide
gctacgactccgagtacgggt

SEQ ID NO: 22284 - DNA, 21 bp, Artificial Sequence
  Description of Artificial Sequence: Synthetic oligonucleotide
gtccaagaaagccaaagcaga

SEQ ID NO: 22285 - DNA, 21 bp, Artificial Sequence
  Description of Artificial Sequence: Synthetic oligonucleotide
ttgagtggtgctagtgcgccg

SEQ ID NO: 22286 - DNA, 21 bp, Artificial Sequence
  Description of Artificial Sequence: Synthetic oligonucleotide
ttggagactaataagcctcct

SEQ ID NO: 22287 - DNA, 21 bp, Artificial Sequence
  Description of Artificial Sequence: Synthetic oligonucleotide
atgaaaagcgacagccaactc

SEQ ID NO: 22288 - DNA, 21 bp, Artificial Sequence
  Description of Artificial Sequence: Synthetic oligonucleotide
ggcgtcaacggcacccaaaaa

SEQ ID NO: 22289 - DNA, 21 bp, Artificial Sequence
  Description of Artificial Sequence: Synthetic oligonucleotide
gggagtgctaagcagaatgtg

SEQ ID NO: 22290 - DNA, 21 bp, Artificial Sequence
  Description of Artificial Sequence: Synthetic oligonucleotide
aaaaccgtcagcaccagcagc

SEQ ID NO: 22291 - DNA, 21 bp, Artificial Sequence
  Description of Artificial Sequence: Synthetic oligonucleotide
caaaccggcgccagcaacatc

SEQ ID NO: 22292 - DNA, 21 bp, Artificial Sequence
  Description of Artificial Sequence: Synthetic oligonucleotide
gacaacagccacaaaatcagc

SEQ ID NO: 22293 - DNA, 21 bp, Artificial Sequence
  Description of Artificial Sequence: Synthetic oligonucleotide
ggcagcaacgacggcgtcaaa

SEQ ID NO: 22294 - DNA, 21 bp, Artificial Sequence
  Description of Artificial Sequence: Synthetic oligonucleotide
tctgctggtgcgcagagtact

SEQ ID NO: 22295 - DNA, 21 bp, Artificial Sequence
  Description of Artificial Sequence: Synthetic oligonucleotide
gctaatactagtacgtcgtcg

SEQ ID NO: 22296 - DNA, 21 bp, Artificial Sequence
  Description of Artificial Sequence: Synthetic oligonucleotide
cataatgggaagaatatgggg

SEQ ID NO: 22297 - DNA, 21 bp, Artificial Sequence
  Description of Artificial Sequence: Synthetic oligonucleotide
agccacagcagccccgccaac

SEQ ID NO: 22298 - DNA, 21 bp, Artificial Sequence
  Description of Artificial Sequence: Synthetic oligonucleotide
agtggtgagcgtgttgggcag

SEQ ID NO: 22299 - DNA, 21 bp, Artificial Sequence
  Description of Artificial Sequence: Synthetic oligonucleotide
ctcaacaccggccaaagccac

SEQ ID NO: 22300 - DNA, 21 bp, Artificial Sequence
  Description of Artificial Sequence: Synthetic oligonucleotide
gccaacaaaagcaacgccacc

SEQ ID NO: 22301 - DNA, 21 bp, Artificial Sequence
  Description of Artificial Sequence: Synthetic oligonucleotide
gccgtcagcgccagccccgtc

SEQ ID NO: 22302 - DNA, 21 bp, Artificial Sequence
  Description of Artificial Sequence: Synthetic oligonucleotide
gctaagaattctgctacgagt

SEQ ID NO: 22303 - DNA, 21 bp, Artificial Sequence
  Description of Artificial Sequence: Synthetic oligonucleotide
tcgcataagagtgagaatgtt

SEQ ID NO: 22304 - DNA, 21 bp, Artificial Sequence
  Description of Artificial Sequence: Synthetic oligonucleotide
aacggcacccaaagcatgagc

SEQ ID NO: 22305 - DNA, 21 bp, Artificial Sequence
  Description of Artificial Sequence: Synthetic oligonucleotide
aaaagagaaagccaaagcgcc

SEQ ID NO: 22306 - DNA, 21 bp, Artificial Sequence
  Description of Artificial Sequence: Synthetic oligonucleotide
accggcagcaaaaccgacagc

SEQ ID NO: 22307 - DNA, 21 bp, Artificial Sequence
  Description of Artificial Sequence: Synthetic oligonucleotide
atcagcggcaaagaaagcagc

SEQ ID NO: 22308 - DNA, 21 bp, Artificial Sequence
  Description of Artificial Sequence: Synthetic oligonucleotide
gacaaaggcagcggcaaaagc

SEQ ID NO: 22309 - DNA, 21 bp, Artificial Sequence
  Description of Artificial Sequence: Synthetic oligonucleotide
gagaagtcgagtactccgggg

SEQ ID NO: 22310 - DNA, 21 bp, Artificial Sequence
  Description of Artificial Sequence: Synthetic oligonucleotide
gatatggggtctactcagaag

SEQ ID NO: 22311 - DNA, 21 bp, Artificial Sequence
  Description of Artificial Sequence: Synthetic oligonucleotide
gcccacaacacccccagcagc

SEQ ID NO: 22312 - DNA, 21 bp, Artificial Sequence
  Description of Artificial Sequence: Synthetic oligonucleotide
tctaatgattctcgtttgcag

SEQ ID NO: 22313 - DNA, 21 bp, Artificial Sequence
  Description of Artificial Sequence: Synthetic oligonucleotide
actgcggagaagtcgattaag

SEQ ID NO: 22314 - DNA, 21 bp, Artificial Sequence
  Description of Artificial Sequence: Synthetic oligonucleotide
gaggggactactaattctaag

SEQ ID NO: 22315 - DNA, 21 bp, Artificial Sequence
  Description of Artificial Sequence: Synthetic oligonucleotide
gacaccgtcggcaccaccaaa

SEQ ID NO: 22316 - DNA, 21 bp, Artificial Sequence
  Description of Artificial Sequence: Synthetic oligonucleotide
caagacgtcaaaatggccccc

SEQ ID NO: 22317 - DNA, 21 bp, Artificial Sequence
  Description of Artificial Sequence: Synthetic oligonucleotide
aaaaccgacagcggcggccaa

SEQ ID NO: 22318 - DNA, 21 bp, Artificial Sequence
  Description of Artificial Sequence: Synthetic oligonucleotide
accgaaggcaaaagcatgggc

SEQ ID NO: 22319 - DNA, 21 bp, Artificial Sequence
  Description of Artificial Sequence: Synthetic oligonucleotide
agcagcgccagcggccaaccc

SEQ ID NO: 22320 - DNA, 21 bp, Artificial Sequence
  Description of Artificial Sequence: Synthetic oligonucleotide
agtcagaagccttcgtctggt

SEQ ID NO: 22321 - DNA, 21 bp, Artificial Sequence
  Description of Artificial Sequence: Synthetic oligonucleotide
ggggttacgacgaatccgggt

SEQ ID NO: 22322 - DNA, 21 bp, Artificial Sequence
  Description of Artificial Sequence: Synthetic oligonucleotide
tctgctgctcggaaggatggg

SEQ ID NO: 22323 - DNA, 21 bp, Artificial Sequence
  Description of Artificial Sequence: Synthetic oligonucleotide
agcgaaagcaaacaaaccgtc

SEQ ID NO: 22324 - DNA, 21 bp, Artificial Sequence
  Description of Artificial Sequence: Synthetic oligonucleotide
agcggcggcagccaaagcagc

SEQ ID NO: 22325 - DNA, 21 bp, Artificial Sequence
  Description of Artificial Sequence: Synthetic oligonucleotide
atgggtaatgagagggtgatg

SEQ ID NO: 22326 - DNA, 21 bp, Artificial Sequence
  Description of Artificial Sequence: Synthetic oligonucleotide
cagtctcctgcgaagagtggg

SEQ ID NO: 22327 - DNA, 21 bp, Artificial Sequence
  Description of Artificial Sequence: Synthetic oligonucleotide
ctggtgtctgatcattcgaag

SEQ ID NO: 22328 - DNA, 21 bp, Artificial Sequence
  Description of Artificial Sequence: Synthetic oligonucleotide
gacatcacccccggcaaaagc

SEQ ID NO: 22329 - DNA, 21 bp, Artificial Sequence
  Description of Artificial Sequence: Synthetic oligonucleotide
gagatgtcggggaagaatgat

SEQ ID NO: 22330 - DNA, 21 bp, Artificial Sequence
  Description of Artificial Sequence: Synthetic oligonucleotide
gccaacagcgacaaaatgaga

SEQ ID NO: 22331 - DNA, 21 bp, Artificial Sequence
  Description of Artificial Sequence: Synthetic oligonucleotide
accaacgcccccagccccatg

SEQ ID NO: 22332 - DNA, 21 bp, Artificial Sequence
  Description of Artificial Sequence: Synthetic oligonucleotide
gccgccgcccacggcaacgcc

SEQ ID NO: 22333 - DNA, 21 bp, Artificial Sequence
  Description of Artificial Sequence: Synthetic oligonucleotide
tctagtaggacgccttcgacg

SEQ ID NO: 22334 - DNA, 21 bp, Artificial Sequence
  Description of Artificial Sequence: Synthetic oligonucleotide
aaagacgccccccccacccaa

SEQ ID NO: 22335 - DNA, 21 bp, Artificial Sequence
  Description of Artificial Sequence: Synthetic oligonucleotide
aacgtcagccccaacggcgcc

SEQ ID NO: 22336 - DNA, 21 bp, Artificial Sequence
  Description of Artificial Sequence: Synthetic oligonucleotide
actacttctgggagttattcg

SEQ ID NO: 22337 - DNA, 21 bp, Artificial Sequence
  Description of Artificial Sequence: Synthetic oligonucleotide
agaagagaaggcgaaagcaaa

SEQ ID NO: 22338 - DNA, 21 bp, Artificial Sequence
  Description of Artificial Sequence: Synthetic oligonucleotide
agcaacaccagagaaatcacc

SEQ ID NO: 22339 - DNA, 21 bp, Artificial Sequence
  Description of Artificial Sequence: Synthetic oligonucleotide
agcaacagcgacagacccatg

SEQ ID NO: 22340 - DNA, 21 bp, Artificial Sequence
  Description of Artificial Sequence: Synthetic oligonucleotide
agcaccacccaccccagccaa

SEQ ID NO: 22341 - DNA, 21 bp, Artificial Sequence
  Description of Artificial Sequence: Synthetic oligonucleotide
agtttgggttctggtccgcat

SEQ ID NO: 22342 - DNA, 21 bp, Artificial Sequence
  Description of Artificial Sequence: Synthetic oligonucleotide
atcagcagcggcacccccagc

SEQ ID NO: 22343 - DNA, 21 bp, Artificial Sequence
  Description of Artificial Sequence: Synthetic oligonucleotide
gacagcagcgaaagagtcaga

SEQ ID NO: 22344 - DNA, 21 bp, Artificial Sequence
  Description of Artificial Sequence: Synthetic oligonucleotide
gagtctgggtcgtctcggggg

SEQ ID NO: 22345 - DNA, 21 bp, Artificial Sequence
  Description of Artificial Sequence: Synthetic oligonucleotide
ggcagcaccaaccccggcgcc

SEQ ID NO: 22346 - DNA, 21 bp, Artificial Sequence
  Description of Artificial Sequence: Synthetic oligonucleotide
caaggcagacccagcagcagc

SEQ ID NO: 22347 - DNA, 21 bp, Artificial Sequence
  Description of Artificial Sequence: Synthetic oligonucleotide
aacggccaaaccgcccacagc

SEQ ID NO: 22348 - DNA, 21 bp, Artificial Sequence
  Description of Artificial Sequence: Synthetic oligonucleotide
atgcctgctaaggatcgtggt

SEQ ID NO: 22349 - DNA, 21 bp, Artificial Sequence
  Description of Artificial Sequence: Synthetic oligonucleotide
accgaagacagaagcctcaga

SEQ ID NO: 22350 - DNA, 21 bp, Artificial Sequence
  Description of Artificial Sequence: Synthetic oligonucleotide
agcggcaccagcaaaagcgtc

SEQ ID NO: 22351 - DNA, 21 bp, Artificial Sequence
  Description of Artificial Sequence: Synthetic oligonucleotide
aagggtgatcgggtgcagggt

SEQ ID NO: 22352 - DNA, 21 bp, Artificial Sequence
  Description of Artificial Sequence: Synthetic oligonucleotide
aatactgcgactagtgagagg

SEQ ID NO: 22353 - DNA, 21 bp, Artificial Sequence
  Description of Artificial Sequence: Synthetic oligonucleotide
ggcagcgacatcaaaaaaacc

SEQ ID NO: 22354 - DNA, 21 bp, Artificial Sequence
  Description of Artificial Sequence: Synthetic oligonucleotide
agcaacgacaaaagcagccac

SEQ ID NO: 22355 - DNA, 21 bp, Artificial Sequence
  Description of Artificial Sequence: Synthetic oligonucleotide
ggccaagaaagcaccgccaga

SEQ ID NO: 22356 - DNA, 21 bp, Artificial Sequence
  Description of Artificial Sequence: Synthetic oligonucleotide
ggtggtcgtcctgagaatgcg

SEQ ID NO: 22357 - DNA, 21 bp, Artificial Sequence
  Description of Artificial Sequence: Synthetic oligonucleotide
actcctaattctgcttcgaat

SEQ ID NO: 22358 - DNA, 21 bp, Artificial Sequence
  Description of Artificial Sequence: Synthetic oligonucleotide
agcgccctcagcagccccagc

SEQ ID NO: 22359 - DNA, 21 bp, Artificial Sequence
  Description of Artificial Sequence: Synthetic oligonucleotide
ctcgccagcaacggcaacgtc

SEQ ID NO: 22360 - DNA, 21 bp, Artificial Sequence
  Description of Artificial Sequence: Synthetic oligonucleotide
gcttcgcagaagcctccggtt

SEQ ID NO: 22361 - DNA, 21 bp, Artificial Sequence
  Description of Artificial Sequence: Synthetic oligonucleotide
accgccggcagcaaaggcaac

SEQ ID NO: 22362 - DNA, 21 bp, Artificial Sequence
  Description of Artificial Sequence: Synthetic oligonucleotide
agcgcccaaaaaagcgtcggc

SEQ ID NO: 22363 - DNA, 21 bp, Artificial Sequence
  Description of Artificial Sequence: Synthetic oligonucleotide
cgtggtgctcctaatactacg

SEQ ID NO: 22364 - DNA, 21 bp, Artificial Sequence
  Description of Artificial Sequence: Synthetic oligonucleotide
gaaggcgccgcccccaacacc

SEQ ID NO: 22365 - DNA, 21 bp, Artificial Sequence
  Description of Artificial Sequence: Synthetic oligonucleotide
gagaagtcggttaagtatgat

SEQ ID NO: 22366 - DNA, 21 bp, Artificial Sequence
  Description of Artificial Sequence: Synthetic oligonucleotide
gagttgaatgataagaataag

SEQ ID NO: 22367 - DNA, 21 bp, Artificial Sequence
  Description of Artificial Sequence: Synthetic oligonucleotide
ggttctaagggtgagcttaat

SEQ ID NO: 22368 - DNA, 21 bp, Artificial Sequence
  Description of Artificial Sequence: Synthetic oligonucleotide
tatacggataagggttctcag

SEQ ID NO: 22369 - DNA, 21 bp, Artificial Sequence
  Description of Artificial Sequence: Synthetic oligonucleotide
gaggggcgttcgtctaatcag

SEQ ID NO: 22370 - DNA, 21 bp, Artificial Sequence
  Description of Artificial Sequence: Synthetic oligonucleotide
agcagcagccccaccatgacc

SEQ ID NO: 22371 - DNA, 21 bp, Artificial Sequence
  Description of Artificial Sequence: Synthetic oligonucleotide
aacatggacaccaaacccctc

SEQ ID NO: 22372 - DNA, 21 bp, Artificial Sequence
  Description of Artificial Sequence: Synthetic oligonucleotide
agagccaccagcgaaagaagc

SEQ ID NO: 22373 - DNA, 21 bp, Artificial Sequence
  Description of Artificial Sequence: Synthetic oligonucleotide
ctcacccaacaaaccagcacc

SEQ ID NO: 22374 - DNA, 21 bp, Artificial Sequence
  Description of Artificial Sequence: Synthetic oligonucleotide
gatgctcagaagactactttt

SEQ ID NO: 22375 - DNA, 21 bp, Artificial Sequence
  Description of Artificial Sequence: Synthetic oligonucleotide
gctgggtctccttcgcataat

SEQ ID NO: 22376 - DNA, 21 bp, Artificial Sequence
  Description of Artificial Sequence: Synthetic oligonucleotide
cttaattctaataagagtcag

SEQ ID NO: 22377 - DNA, 21 bp, Artificial Sequence
  Description of Artificial Sequence: Synthetic oligonucleotide
aacgtcaccggcaccaccgcc

SEQ ID NO: 22378 - DNA, 21 bp, Artificial Sequence
  Description of Artificial Sequence: Synthetic oligonucleotide
acccaaaacggcggccccaga

SEQ ID NO: 22379 - DNA, 21 bp, Artificial Sequence
  Description of Artificial Sequence: Synthetic oligonucleotide
ggcctcgacgccagcagacac

SEQ ID NO: 22380 - DNA, 21 bp, Artificial Sequence
  Description of Artificial Sequence: Synthetic oligonucleotide
atgggtggtacgtcttctaag

SEQ ID NO: 22381 - DNA, 21 bp, Artificial Sequence
  Description of Artificial Sequence: Synthetic oligonucleotide
gccagcaaccaaagccccagc

SEQ ID NO: 22382 - DNA, 21 bp, Artificial Sequence
  Description of Artificial Sequence: Synthetic oligonucleotide
agtggtgtggattcgccgcgt

SEQ ID NO: 22383 - DNA, 21 bp, Artificial Sequence
  Description of Artificial Sequence: Synthetic oligonucleotide
gctatttcggggtctccgtcg

SEQ ID NO: 22384 - DNA, 21 bp, Artificial Sequence
  Description of Artificial Sequence: Synthetic oligonucleotide
caacacagcaacccccccgcc

SEQ ID NO: 22385 - DNA, 21 bp, Artificial Sequence
  Description of Artificial Sequence: Synthetic oligonucleotide
gccagcagccccgtcaacagc

SEQ ID NO: 22386 - DNA, 21 bp, Artificial Sequence
  Description of Artificial Sequence: Synthetic oligonucleotide
aacaacaacccccccagcggc

SEQ ID NO: 22387 - DNA, 21 bp, Artificial Sequence
  Description of Artificial Sequence: Synthetic oligonucleotide
agtcagtctagttctaaggag

SEQ ID NO: 22388 - DNA, 21 bp, Artificial Sequence
  Description of Artificial Sequence: Synthetic oligonucleotide
agtgataataagactgagcgg

SEQ ID NO: 22389 - DNA, 21 bp, Artificial Sequence
  Description of Artificial Sequence: Synthetic oligonucleotide
cacaacaacagcagcgccgtc

SEQ ID NO: 22390 - DNA, 21 bp, Artificial Sequence
  Description of Artificial Sequence: Synthetic oligonucleotide
cttcagaagagtagtgtggag

SEQ ID NO: 22391 - DNA, 21 bp, Artificial Sequence
  Description of Artificial Sequence: Synthetic oligonucleotide
aatactgcgcctccgccttct

SEQ ID NO: 22392 - DNA, 21 bp, Artificial Sequence
  Description of Artificial Sequence: Synthetic oligonucleotide
cttggtacgggttcgaataat

SEQ ID NO: 22393 - DNA, 21 bp, Artificial Sequence
  Description of Artificial Sequence: Synthetic oligonucleotide
aacggcaaacaaaccagcaac

SEQ ID NO: 22394 - DNA, 21 bp, Artificial Sequence
  Description of Artificial Sequence: Synthetic oligonucleotide
aatcagtcgggtgctactaag

SEQ ID NO: 22395 - DNA, 21 bp, Artificial Sequence
  Description of Artificial Sequence: Synthetic oligonucleotide
aatggggctagtaagcttcat

SEQ ID NO: 22396 - DNA, 21 bp, Artificial Sequence
  Description of Artificial Sequence: Synthetic oligonucleotide
accaacaacggcgtccacgcc

SEQ ID NO: 22397 - DNA, 21 bp, Artificial Sequence
  Description of Artificial Sequence: Synthetic oligonucleotide
acgaataatgggtctggtaat

SEQ ID NO: 22398 - DNA, 21 bp, Artificial Sequence
  Description of Artificial Sequence: Synthetic oligonucleotide
acggagtcgggtaaggctatt

SEQ ID NO: 22399 - DNA, 21 bp, Artificial Sequence
  Description of Artificial Sequence: Synthetic oligonucleotide
gacagcagcaccaacgccaga

SEQ ID NO: 22400 - DNA, 21 bp, Artificial Sequence
  Description of Artificial Sequence: Synthetic oligonucleotide
cgtgctgttggtaagactgag

SEQ ID NO: 22401 - DNA, 21 bp, Artificial Sequence
  Description of Artificial Sequence: Synthetic oligonucleotide
gccaccagcagcgaaaaaagc

SEQ ID NO: 22402 - DNA, 21 bp, Artificial Sequence
  Description of Artificial Sequence: Synthetic oligonucleotide
aacaccggcggcgaaagcggc

SEQ ID NO: 22403 - DNA, 21 bp, Artificial Sequence
  Description of Artificial Sequence: Synthetic oligonucleotide
agcggcaaaagcaacgacgtc

SEQ ID NO: 22404 - DNA, 21 bp, Artificial Sequence
  Description of Artificial Sequence: Synthetic oligonucleotide
ctcggcacccaacacaccagc

SEQ ID NO: 22405 - DNA, 21 bp, Artificial Sequence
  Description of Artificial Sequence: Synthetic oligonucleotide
gacgacagcagcgccaaaagc

SEQ ID NO: 22406 - DNA, 21 bp, Artificial Sequence
  Description of Artificial Sequence: Synthetic oligonucleotide
ggcggccccaacaccacccac

SEQ ID NO: 22407 - DNA, 21 bp, Artificial Sequence
  Description of Artificial Sequence: Synthetic oligonucleotide
tctatttcgactaaggagtcg

SEQ ID NO: 22408 - DNA, 21 bp, Artificial Sequence
  Description of Artificial Sequence: Synthetic oligonucleotide
accaccagcgacgccagaaac

SEQ ID NO: 22409 - DNA, 21 bp, Artificial Sequence
  Description of Artificial Sequence: Synthetic oligonucleotide
actgatgcgtctgctcggaat

SEQ ID NO: 22410 - DNA, 21 bp, Artificial Sequence
  Description of Artificial Sequence: Synthetic oligonucleotide
agtagtgtgccggctaagggt

SEQ ID NO: 22411 - DNA, 21 bp, Artificial Sequence
  Description of Artificial Sequence: Synthetic oligonucleotide
ggccacaacggccccaacagc

SEQ ID NO: 22412 - DNA, 21 bp, Artificial Sequence
  Description of Artificial Sequence: Synthetic oligonucleotide
gggtctagtgggtcttctggt

SEQ ID NO: 22413 - DNA, 21 bp, Artificial Sequence
  Description of Artificial Sequence: Synthetic oligonucleotide
gtcgtcagcgacaacagcaga

SEQ ID NO: 22414 - DNA, 21 bp, Artificial Sequence
  Description of Artificial Sequence: Synthetic oligonucleotide
gatcgttctcctggttctcag

SEQ ID NO: 22415 - DNA, 21 bp, Artificial Sequence
  Description of Artificial Sequence: Synthetic oligonucleotide
ggcaccaccccccccaacgcc

SEQ ID NO: 22416 - DNA, 21 bp, Artificial Sequence
  Description of Artificial Sequence: Synthetic oligonucleotide
ctcgccgacaaaagcagctac

SEQ ID NO: 22417 - DNA, 21 bp, Artificial Sequence
  Description of Artificial Sequence: Synthetic oligonucleotide
atgagcaccaccaccaacgcc

SEQ ID NO: 22418 - DNA, 21 bp, Artificial Sequence
  Description of Artificial Sequence: Synthetic oligonucleotide
accaccggcgtcagccccgcc

SEQ ID NO: 22419 - DNA, 21 bp, Artificial Sequence
  Description of Artificial Sequence: Synthetic oligonucleotide
agcaccgacagcagcaccaaa

SEQ ID NO: 22420 - DNA, 21 bp, Artificial Sequence
  Description of Artificial Sequence: Synthetic oligonucleotide
gacgtccaaacccccaccacc

SEQ ID NO: 22421 - DNA, 21 bp, Artificial Sequence
  Description of Artificial Sequence: Synthetic oligonucleotide
gctacttctgatcgtccggtt

SEQ ID NO: 22422 - DNA, 21 bp, Artificial Sequence
  Description of Artificial Sequence: Synthetic oligonucleotide
agtgcttcgcattcggcttcg

SEQ ID NO: 22423 - DNA, 21 bp, Artificial Sequence
  Description of Artificial Sequence: Synthetic oligonucleotide
atgagcagcaaccccaaaacc

SEQ ID NO: 22424 - DNA, 21 bp, Artificial Sequence
  Description of Artificial Sequence: Synthetic oligonucleotide
gaccaaagaaacggccccacc

SEQ ID NO: 22425 - DNA, 21 bp, Artificial Sequence
  Description of Artificial Sequence: Synthetic oligonucleotide
gagtcgcgtaataatggtcat

SEQ ID NO: 22426 - DNA, 21 bp, Artificial Sequence
  Description of Artificial Sequence: Synthetic oligonucleotide
agttctagtaagggtcatgtt

SEQ ID NO: 22427 - DNA, 21 bp, Artificial Sequence
  Description of Artificial Sequence: Synthetic oligonucleotide
ggcggcacccaacaaaacctc

SEQ ID NO: 22428 - DNA, 21 bp, Artificial Sequence
  Description of Artificial Sequence: Synthetic oligonucleotide
cagcagggtacgaagtcgact

SEQ ID NO: 22429 - DNA, 21 bp, Artificial Sequence
  Description of Artificial Sequence: Synthetic oligonucleotide
aatggtggtgggaaggggggt

SEQ ID NO: 22430 - DNA, 21 bp, Artificial Sequence
  Description of Artificial Sequence: Synthetic oligonucleotide
aacaccagcaacaaagacacc

SEQ ID NO: 22431 - DNA, 21 bp, Artificial Sequence
  Description of Artificial Sequence: Synthetic oligonucleotide
aacagaagcaaacaaggcgac

SEQ ID NO: 22432 - DNA, 21 bp, Artificial Sequence
  Description of Artificial Sequence: Synthetic oligonucleotide
aacagcctcaccgccaacaaa

SEQ ID NO: 22433 - DNA, 21 bp, Artificial Sequence
  Description of Artificial Sequence: Synthetic oligonucleotide
aatttggggactggtggtacg

SEQ ID NO: 22434 - DNA, 21 bp, Artificial Sequence
  Description of Artificial Sequence: Synthetic oligonucleotide
acccaacacggcgaaagaagc

SEQ ID NO: 22435 - DNA, 21 bp, Artificial Sequence
  Description of Artificial Sequence: Synthetic oligonucleotide
agcaaaagcaacggcgccagc

SEQ ID NO: 22436 - DNA, 21 bp, Artificial Sequence
  Description of Artificial Sequence: Synthetic oligonucleotide
agccccaccagcagccccggc

SEQ ID NO: 22437 - DNA, 21 bp, Artificial Sequence
  Description of Artificial Sequence: Synthetic oligonucleotide
agcgaaagcagcagaagcgcc

SEQ ID NO: 22438 - DNA, 21 bp, Artificial Sequence
  Description of Artificial Sequence: Synthetic oligonucleotide
agcgcccccagcggcaaagcc

SEQ ID NO: 22439 - DNA, 21 bp, Artificial Sequence
  Description of Artificial Sequence: Synthetic oligonucleotide
agtggtgggtcggggcctcag

SEQ ID NO: 22440 - DNA, 21 bp, Artificial Sequence
  Description of Artificial Sequence: Synthetic oligonucleotide
agttctaatacgtctgctact

SEQ ID NO: 22441 - DNA, 21 bp, Artificial Sequence
  Description of Artificial Sequence: Synthetic oligonucleotide
atgcgggaggatcaggttagg

SEQ ID NO: 22442 - DNA, 21 bp, Artificial Sequence
  Description of Artificial Sequence: Synthetic oligonucleotide
caaagcacccccgccctcagc

SEQ ID NO: 22443 - DNA, 21 bp, Artificial Sequence
  Description of Artificial Sequence: Synthetic oligonucleotide
ctcagagaaaccaaaatcaac

SEQ ID NO: 22444 - DNA, 21 bp, Artificial Sequence
  Description of Artificial Sequence: Synthetic oligonucleotide
ctcagcagagacaaaatcgaa

SEQ ID NO: 22445 - DNA, 21 bp, Artificial Sequence
  Description of Artificial Sequence: Synthetic oligonucleotide
ctgcgggggggggagggtgcg

SEQ ID NO: 22446 - DNA, 21 bp, Artificial Sequence
  Description of Artificial Sequence: Synthetic oligonucleotide
gataatgggaatgctcggtct

SEQ ID NO: 22447 - DNA, 21 bp, Artificial Sequence
  Description of Artificial Sequence: Synthetic oligonucleotide
gccaacaccggccacatggcc

SEQ ID NO: 22448 - DNA, 21 bp, Artificial Sequence
  Description of Artificial Sequence: Synthetic oligonucleotide
gcccacaccaaagaaaacagc

SEQ ID NO: 22449 - DNA, 21 bp, Artificial Sequence
  Description of Artificial Sequence: Synthetic oligonucleotide
gccgacaaaggcgtcggcggc

SEQ ID NO: 22450 - DNA, 21 bp, Artificial Sequence
  Description of Artificial Sequence: Synthetic oligonucleotide
gccggccacggcaccagcgcc

SEQ ID NO: 22451 - DNA, 21 bp, Artificial Sequence
  Description of Artificial Sequence: Synthetic oligonucleotide
gccgtcgcccaaagcaacaac

SEQ ID NO: 22452 - DNA, 21 bp, Artificial Sequence
  Description of Artificial Sequence: Synthetic oligonucleotide
ggcagcagcggcagcagcacc

SEQ ID NO: 22453 - DNA, 21 bp, Artificial Sequence
  Description of Artificial Sequence: Synthetic oligonucleotide
ggcggcatcgacggcaaaaac

SEQ ID NO: 22454 - DNA, 21 bp, Artificial Sequence
  Description of Artificial Sequence: Synthetic oligonucleotide
ggcgtccccaacagagccggc

SEQ ID NO: 22455 - DNA, 21 bp, Artificial Sequence
  Description of Artificial Sequence: Synthetic oligonucleotide
gggcgtagtgatagtgttcat

SEQ ID NO: 22456 - DNA, 21 bp, Artificial Sequence
  Description of Artificial Sequence: Synthetic oligonucleotide
gtcacccaaggcaccgccagc

SEQ ID NO: 22457 - DNA, 21 bp, Artificial Sequence
  Description of Artificial Sequence: Synthetic oligonucleotide
tacggccaacaacccggcggc

SEQ ID NO: 22458 - DNA, 21 bp, Artificial Sequence
  Description of Artificial Sequence: Synthetic oligonucleotide
tcggctaaggcgaattcggtg

SEQ ID NO: 22459 - DNA, 21 bp, Artificial Sequence
  Description of Artificial Sequence: Synthetic oligonucleotide
tcggctactggtacgcattcg

SEQ ID NO: 22460 - DNA, 21 bp, Artificial Sequence
  Description of Artificial Sequence: Synthetic oligonucleotide
ctcaacagcaccaaacccgcc

SEQ ID NO: 22461 - DNA, 21 bp, Artificial Sequence
  Description of Artificial Sequence: Synthetic oligonucleotide
gctactactacgtctggtggt

SEQ ID NO: 22462 - DNA, 21 bp, Artificial Sequence
  Description of Artificial Sequence: Synthetic oligonucleotide
gacggcctccccaacggcaga

SEQ ID NO: 22463 - DNA, 21 bp, Artificial Sequence
  Description of Artificial Sequence: Synthetic oligonucleotide
cgtacgaatgctactacgtcg

SEQ ID NO: 22464 - DNA, 21 bp, Artificial Sequence
  Description of Artificial Sequence: Synthetic oligonucleotide
gtgcctactggtaatcatggt

SEQ ID NO: 22465 - DNA, 21 bp, Artificial Sequence
  Description of Artificial Sequence: Synthetic oligonucleotide
aacggcagcgcccacaaagtc

SEQ ID NO: 22466 - DNA, 21 bp, Artificial Sequence
  Description of Artificial Sequence: Synthetic oligonucleotide
agtacttctacgacttctagg

SEQ ID NO: 22467 - DNA, 21 bp, Artificial Sequence
  Description of Artificial Sequence: Synthetic oligonucleotide
cacggcatgggcaccaccacc

SEQ ID NO: 22468 - DNA, 21 bp, Artificial Sequence
  Description of Artificial Sequence: Synthetic oligonucleotide
catgggggtactgcgtctcat

SEQ ID NO: 22469 - DNA, 21 bp, Artificial Sequence
  Description of Artificial Sequence: Synthetic oligonucleotide
ggtagtcatggttctactcag

SEQ ID NO: 22470 - DNA, 21 bp, Artificial Sequence
  Description of Artificial Sequence: Synthetic oligonucleotide
cacaccagcgacaaaagcgcc

SEQ ID NO: 22471 - DNA, 21 bp, Artificial Sequence
  Description of Artificial Sequence: Synthetic oligonucleotide
gccgtccacagcaacagcacc

SEQ ID NO: 22472 - DNA, 21 bp, Artificial Sequence
  Description of Artificial Sequence: Synthetic oligonucleotide
ttggctacttctagtacggtt

SEQ ID NO: 22473 - DNA, 21 bp, Artificial Sequence
  Description of Artificial Sequence: Synthetic oligonucleotide
aatgtggatgcgcgtaataat

SEQ ID NO: 22474 - DNA, 21 bp, Artificial Sequence
  Description of Artificial Sequence: Synthetic oligonucleotide
atgaaaagccaaagcgccatc

SEQ ID NO: 22475 - DNA, 21 bp, Artificial Sequence
  Description of Artificial Sequence: Synthetic oligonucleotide
agccccaaccaacaaagcagc

SEQ ID NO: 22476 - DNA, 21 bp, Artificial Sequence
  Description of Artificial Sequence: Synthetic oligonucleotide
aataatggtacgacttctgcg

SEQ ID NO: 22477 - DNA, 21 bp, Artificial Sequence
  Description of Artificial Sequence: Synthetic oligonucleotide
actagtgctcagcctaataat

SEQ ID NO: 22478 - DNA, 21 bp, Artificial Sequence
  Description of Artificial Sequence: Synthetic oligonucleotide
caaaccaccaaaagcagcgtc

SEQ ID NO: 22479 - DNA, 21 bp, Artificial Sequence
  Description of Artificial Sequence: Synthetic oligonucleotide
gacagcgtcaacaaaagagac

SEQ ID NO: 22480 - DNA, 21 bp, Artificial Sequence
  Description of Artificial Sequence: Synthetic oligonucleotide
gccacccccggcaccagcggc

SEQ ID NO: 22481 - DNA, 21 bp, Artificial Sequence
  Description of Artificial Sequence: Synthetic oligonucleotide
ggggttagttctactgcggtg

SEQ ID NO: 22482 - DNA, 21 bp, Artificial Sequence
  Description of Artificial Sequence: Synthetic oligonucleotide
cagcgtggtggtgattctgcg

SEQ ID NO: 22483 - DNA, 21 bp, Artificial Sequence
  Description of Artificial Sequence: Synthetic oligonucleotide
gctacttcgaataatagtcgg

SEQ ID NO: 22484 - DNA, 21 bp, Artificial Sequence
  Description of Artificial Sequence: Synthetic oligonucleotide
accaaagccaacagcagcgaa

SEQ ID NO: 22485 - DNA, 21 bp, Artificial Sequence
  Description of Artificial Sequence: Synthetic oligonucleotide
agcagcggcgaacaaagcaga

SEQ ID NO: 22486 - DNA, 21 bp, Artificial Sequence
  Description of Artificial Sequence: Synthetic oligonucleotide
agcctcaacgacagcagaaga

SEQ ID NO: 22487 - DNA, 21 bp, Artificial Sequence
  Description of Artificial Sequence: Synthetic oligonucleotide
catggttctcaggctccggct

SEQ ID NO: 22488 - DNA, 21 bp, Artificial Sequence
  Description of Artificial Sequence: Synthetic oligonucleotide
tatccggataagtctcctatt

SEQ ID NO: 22489 - DNA, 21 bp, Artificial Sequence
  Description of Artificial Sequence: Synthetic oligonucleotide
aacgccgacagagacaacaaa

SEQ ID NO: 22490 - DNA, 21 bp, Artificial Sequence
  Description of Artificial Sequence: Synthetic oligonucleotide
actaagggtgggacgacgggg

SEQ ID NO: 22491 - DNA, 21 bp, Artificial Sequence
  Description of Artificial Sequence: Synthetic oligonucleotide
agacaactccccgacaaagac

SEQ ID NO: 22492 - DNA, 21 bp, Artificial Sequence
  Description of Artificial Sequence: Synthetic oligonucleotide
tcgacttctactggtaagagt

SEQ ID NO: 22493 - DNA, 21 bp, Artificial Sequence
  Description of Artificial Sequence: Synthetic oligonucleotide
aacagcggcggcaacaaaaac

SEQ ID NO: 22494 - DNA, 21 bp, Artificial Sequence
  Description of Artificial Sequence: Synthetic oligonucleotide
agcagcagaagcagcaccgtc

SEQ ID NO: 22495 - DNA, 21 bp, Artificial Sequence
  Description of Artificial Sequence: Synthetic oligonucleotide
agcagcccccaaggcggcaac

SEQ ID NO: 22496 - DNA, 21 bp, Artificial Sequence
  Description of Artificial Sequence: Synthetic oligonucleotide
agcatcaccggcaaaggcggc

SEQ ID NO: 22497 - DNA, 21 bp, Artificial Sequence
  Description of Artificial Sequence: Synthetic oligonucleotide
atttctggggcggggtcgaag

SEQ ID NO: 22498 - DNA, 21 bp, Artificial Sequence
  Description of Artificial Sequence: Synthetic oligonucleotide
gccagcaccgacagcagaggc

SEQ ID NO: 22499 - DNA, 21 bp, Artificial Sequence
  Description of Artificial Sequence: Synthetic oligonucleotide
gctctggggacgggtaaggag

SEQ ID NO: 22500 - DNA, 21 bp, Artificial Sequence
  Description of Artificial Sequence: Synthetic oligonucleotide
acgggtcatccttctactgcg

SEQ ID NO: 22501 - DNA, 21 bp, Artificial Sequence
  Description of Artificial Sequence: Synthetic oligonucleotide
caaagccacagcgccagcagc

SEQ ID NO: 22502 - DNA, 21 bp, Artificial Sequence
  Description of Artificial Sequence: Synthetic oligonucleotide
gacagccaagtcaaagccatg

SEQ ID NO: 22503 - DNA, 21 bp, Artificial Sequence
  Description of Artificial Sequence: Synthetic oligonucleotide
agtaaggatacgcagctgatt

SEQ ID NO: 22504 - DNA, 21 bp, Artificial Sequence
  Description of Artificial Sequence: Synthetic oligonucleotide
accaacgaccccagaagcagc

SEQ ID NO: 22505 - DNA, 21 bp, Artificial Sequence
  Description of Artificial Sequence: Synthetic oligonucleotide
agtgctactaaggctggtggg

SEQ ID NO: 22506 - DNA, 21 bp, Artificial Sequence
  Description of Artificial Sequence: Synthetic oligonucleotide
agtgggaataagcctgaggtt

SEQ ID NO: 22507 - DNA, 21 bp, Artificial Sequence
  Description of Artificial Sequence: Synthetic oligonucleotide
caagccaacagaaacagcggc

SEQ ID NO: 22508 - DNA, 21 bp, Artificial Sequence
  Description of Artificial Sequence: Synthetic oligonucleotide
gatagtgcggggagtgggaag

SEQ ID NO: 22509 - DNA, 21 bp, Artificial Sequence
  Description of Artificial Sequence: Synthetic oligonucleotide
ggcagcaacaacaacggccaa

SEQ ID NO: 22510 - DNA, 21 bp, Artificial Sequence
  Description of Artificial Sequence: Synthetic oligonucleotide
gggcggtcgggggatactaat

SEQ ID NO: 22511 - DNA, 21 bp, Artificial Sequence
  Description of Artificial Sequence: Synthetic oligonucleotide
tcgaaggcgaatagtcagatg

SEQ ID NO: 22512 - DNA, 21 bp, Artificial Sequence
  Description of Artificial Sequence: Synthetic oligonucleotide
tctagtgggaagtcgggtatg

SEQ ID NO: 22513 - DNA, 21 bp, Artificial Sequence
  Description of Artificial Sequence: Synthetic oligonucleotide
agtagtgctactgcgcagggt

SEQ ID NO: 22514 - DNA, 21 bp, Artificial Sequence
  Description of Artificial Sequence: Synthetic oligonucleotide
acgcggacgaatgcgaatggt

SEQ ID NO: 22515 - DNA, 21 bp, Artificial Sequence
  Description of Artificial Sequence: Synthetic oligonucleotide
ctcaacagcgaaaaagccccc

SEQ ID NO: 22516 - DNA, 21 bp, Artificial Sequence
  Description of Artificial Sequence: Synthetic oligonucleotide
gaaaaaatgagcagcagcagc

SEQ ID NO: 22517 - DNA, 21 bp, Artificial Sequence
  Description of Artificial Sequence: Synthetic oligonucleotide
gcttctatttctggggcgggt

SEQ ID NO: 22518 - DNA, 21 bp, Artificial Sequence
  Description of Artificial Sequence: Synthetic oligonucleotide
ggcaccagaagccaaagccaa

SEQ ID NO: 22519 - DNA, 21 bp, Artificial Sequence
  Description of Artificial Sequence: Synthetic oligonucleotide
gtgtctgggaagactagtgct

SEQ ID NO: 22520 - DNA, 21 bp, Artificial Sequence
  Description of Artificial Sequence: Synthetic oligonucleotide
actggtgtgaataatcatcat

SEQ ID NO: 22521 - DNA, 21 bp, Artificial Sequence
  Description of Artificial Sequence: Synthetic oligonucleotide
agcggcgaccaccacaaaacc

SEQ ID NO: 22522 - DNA, 21 bp, Artificial Sequence
  Description of Artificial Sequence: Synthetic oligonucleotide
ctccccagcggcgtcaccaaa

SEQ ID NO: 22523 - DNA, 21 bp, Artificial Sequence
  Description of Artificial Sequence: Synthetic oligonucleotide
ctttcgggtggtacgatgctt

SEQ ID NO: 22524 - DNA, 21 bp, Artificial Sequence
  Description of Artificial Sequence: Synthetic oligonucleotide
gccagcaccggcagcaccgcc

SEQ ID NO: 22525 - DNA, 21 bp, Artificial Sequence
  Description of Artificial Sequence: Synthetic oligonucleotide
ctccaaagcagcggcaacaga

SEQ ID NO: 22526 - DNA, 21 bp, Artificial Sequence
  Description of Artificial Sequence: Synthetic oligonucleotide
atgtcgacgagtcattctgtg

SEQ ID NO: 22527 - DNA, 21 bp, Artificial Sequence
  Description of Artificial Sequence: Synthetic oligonucleotide
ggcgccggcaaccacgccagc

SEQ ID NO: 22528 - DNA, 21 bp, Artificial Sequence
  Description of Artificial Sequence: Synthetic oligonucleotide
actaagacggagacgaatgcg

SEQ ID NO: 22529 - DNA, 21 bp, Artificial Sequence
  Description of Artificial Sequence: Synthetic oligonucleotide
gacagaggccaaggccaaatg

SEQ ID NO: 22530 - DNA, 21 bp, Artificial Sequence
  Description of Artificial Sequence: Synthetic oligonucleotide
gggtcttctactaataatgtg

SEQ ID NO: 22531 - DNA, 21 bp, Artificial Sequence
  Description of Artificial Sequence: Synthetic oligonucleotide
ttcgccggcaacacccaagcc

SEQ ID NO: 22532 - DNA, 21 bp, Artificial Sequence
  Description of Artificial Sequence: Synthetic oligonucleotide
agcgtcagcaacagcagccaa

SEQ ID NO: 22533 - DNA, 21 bp, Artificial Sequence
  Description of Artificial Sequence: Synthetic oligonucleotide
cagtctacgaagccgtcgggt

SEQ ID NO: 22534 - DNA, 21 bp, Artificial Sequence
  Description of Artificial Sequence: Synthetic oligonucleotide
atccccgccaaaagcaccagc

SEQ ID NO: 22535 - DNA, 21 bp, Artificial Sequence
  Description of Artificial Sequence: Synthetic oligonucleotide
gctgggcgtgattctttgact

SEQ ID NO: 22536 - DNA, 21 bp, Artificial Sequence
  Description of Artificial Sequence: Synthetic oligonucleotide
agcaacagcaaagacaccacc

SEQ ID NO: 22537 - DNA, 21 bp, Artificial Sequence
  Description of Artificial Sequence: Synthetic oligonucleotide
aacaccagaaaccccgccgcc

SEQ ID NO: 22538 - DNA, 21 bp, Artificial Sequence
  Description of Artificial Sequence: Synthetic oligonucleotide
aattatgatgcgaagtctgcg

SEQ ID NO: 22539 - DNA, 21 bp, Artificial Sequence
  Description of Artificial Sequence: Synthetic oligonucleotide
gaaagcagcggcagcagactc

SEQ ID NO: 22540 - DNA, 21 bp, Artificial Sequence
  Description of Artificial Sequence: Synthetic oligonucleotide
actaataatacgccttctggg

SEQ ID NO: 22541 - DNA, 21 bp, Artificial Sequence
  Description of Artificial Sequence: Synthetic oligonucleotide
agccccggcagcaaagtcagc

SEQ ID NO: 22542 - DNA, 21 bp, Artificial Sequence
  Description of Artificial Sequence: Synthetic oligonucleotide
agcggcaccacccccagcgtc

SEQ ID NO: 22543 - DNA, 21 bp, Artificial Sequence
  Description of Artificial Sequence: Synthetic oligonucleotide
tctggtactgttaagttggat

SEQ ID NO: 22544 - DNA, 21 bp, Artificial Sequence
  Description of Artificial Sequence: Synthetic oligonucleotide
aaggaggatcgtaatacttcg

SEQ ID NO: 22545 - DNA, 21 bp, Artificial Sequence
  Description of Artificial Sequence: Synthetic oligonucleotide
agtgggggtggttctcttggt

SEQ ID NO: 22546 - DNA, 21 bp, Artificial Sequence
  Description of Artificial Sequence: Synthetic oligonucleotide
caagccgccgcccacaccagc

SEQ ID NO: 22547 - DNA, 21 bp, Artificial Sequence
  Description of Artificial Sequence: Synthetic oligonucleotide
gacggcggcgccggcgtcgtc

SEQ ID NO: 22548 - DNA, 21 bp, Artificial Sequence
  Description of Artificial Sequence: Synthetic oligonucleotide
ggtagtgggaagatgaatgtt

SEQ ID NO: 22549 - DNA, 21 bp, Artificial Sequence
  Description of Artificial Sequence: Synthetic oligonucleotide
ggtctggtgaatcagcagcag

SEQ ID NO: 22550 - DNA, 21 bp, Artificial Sequence
  Description of Artificial Sequence: Synthetic oligonucleotide
gtcagcggcagcaccaccacc

SEQ ID NO: 22551 - DNA, 21 bp, Artificial Sequence
  Description of Artificial Sequence: Synthetic oligonucleotide
tctagttttaaggggggtggt

SEQ ID NO: 22552 - DNA, 21 bp, Artificial Sequence
  Description of Artificial Sequence: Synthetic oligonucleotide
tctagtgcgcagtcgccgtcg

SEQ ID NO: 22553 - DNA, 21 bp, Artificial Sequence
  Description of Artificial Sequence: Synthetic oligonucleotide
gtcgaaagcaaacccagcaga

SEQ ID NO: 22554 - DNA, 21 bp, Artificial Sequence
  Description of Artificial Sequence: Synthetic oligonucleotide
agcgccagcgaaagaaacctc

SEQ ID NO: 22555 - DNA, 21 bp, Artificial Sequence
  Description of Artificial Sequence: Synthetic oligonucleotide
gatagtaaggagcattcgcag

SEQ ID NO: 22556 - DNA, 21 bp, Artificial Sequence
  Description of Artificial Sequence: Synthetic oligonucleotide
gccagcgacaaagtcagaaac

SEQ ID NO: 22557 - DNA, 21 bp, Artificial Sequence
  Description of Artificial Sequence: Synthetic oligonucleotide
ggcgtcgacagcaacagaaac

SEQ ID NO: 22558 - DNA, 21 bp, Artificial Sequence
  Description of Artificial Sequence: Synthetic oligonucleotide
ttgtcggggcagcgtgttgag

SEQ ID NO: 22559 - DNA, 21 bp, Artificial Sequence
  Description of Artificial Sequence: Synthetic oligonucleotide
tatattacgaaggaggcgggt

SEQ ID NO: 22560 - DNA, 21 bp, Artificial Sequence
  Description of Artificial Sequence: Synthetic oligonucleotide
accagcaacaccacccaccaa

SEQ ID NO: 22561 - DNA, 21 bp, Artificial Sequence
  Description of Artificial Sequence: Synthetic oligonucleotide
agaaaagaagacgtccaaaga

SEQ ID NO: 22562 - DNA, 21 bp, Artificial Sequence
  Description of Artificial Sequence: Synthetic oligonucleotide
atgggcacccaaggcaacggc

SEQ ID NO: 22563 - DNA, 21 bp, Artificial Sequence
  Description of Artificial Sequence: Synthetic oligonucleotide
ctcgccaccgacggccccaaa

SEQ ID NO: 22564 - DNA, 21 bp, Artificial Sequence
  Description of Artificial Sequence: Synthetic oligonucleotide
gtcggcacccccagaagcgaa

SEQ ID NO: 22565 - DNA, 21 bp, Artificial Sequence
  Description of Artificial Sequence: Synthetic oligonucleotide
gggcctaatcatacgacgaag

SEQ ID NO: 22566 - DNA, 21 bp, Artificial Sequence
  Description of Artificial Sequence: Synthetic oligonucleotide
cacgtcggcaccaacaacagc

SEQ ID NO: 22567 - DNA, 21 bp, Artificial Sequence
  Description of Artificial Sequence: Synthetic oligonucleotide
ggcaccggccccggcggcagc

SEQ ID NO: 22568 - DNA, 21 bp, Artificial Sequence
  Description of Artificial Sequence: Synthetic oligonucleotide
aaaaacggcgaaaacaacaga

SEQ ID NO: 22569 - DNA, 21 bp, Artificial Sequence
  Description of Artificial Sequence: Synthetic oligonucleotide
agttctgagaagacgatgtcg

SEQ ID NO: 22570 - DNA, 21 bp, Artificial Sequence
  Description of Artificial Sequence: Synthetic oligonucleotide
ggcggcagcgccagcgccaga

SEQ ID NO: 22571 - DNA, 21 bp, Artificial Sequence
  Description of Artificial Sequence: Synthetic oligonucleotide
gggtctggtgctcggaaggat

SEQ ID NO: 22572 - DNA, 21 bp, Artificial Sequence
  Description of Artificial Sequence: Synthetic oligonucleotide
ggtgcgactggtgcgtcttcg

SEQ ID NO: 22573 - DNA, 21 bp, Artificial Sequence
  Description of Artificial Sequence: Synthetic oligonucleotide
ggtttgggggctcagccgacg

SEQ ID NO: 22574 - DNA, 21 bp, Artificial Sequence
  Description of Artificial Sequence: Synthetic oligonucleotide
gtgcctacgactactgctaag

SEQ ID NO: 22575 - DNA, 21 bp, Artificial Sequence
  Description of Artificial Sequence: Synthetic oligonucleotide
agaagcgacaaaagaaacgaa

SEQ ID NO: 22576 - DNA, 21 bp, Artificial Sequence
  Description of Artificial Sequence: Synthetic oligonucleotide
caaggcgtcagcggcggcagc

SEQ ID NO: 22577 - DNA, 21 bp, Artificial Sequence
  Description of Artificial Sequence: Synthetic oligonucleotide
ctttcttctaaggatgttgcg

SEQ ID NO: 22578 - DNA, 21 bp, Artificial Sequence
  Description of Artificial Sequence: Synthetic oligonucleotide
gacaacctcaacaaaaccaac

SEQ ID NO: 22579 - DNA, 21 bp, Artificial Sequence
  Description of Artificial Sequence: Synthetic oligonucleotide
ggcatcaacaccaaaagcgcc

SEQ ID NO: 22580 - DNA, 21 bp, Artificial Sequence
  Description of Artificial Sequence: Synthetic oligonucleotide
gtcgccaccggcgccgccaaa

SEQ ID NO: 22581 - DNA, 21 bp, Artificial Sequence
  Description of Artificial Sequence: Synthetic oligonucleotide
aaccccaacaaacccggcacc

SEQ ID NO: 22582 - DNA, 21 bp, Artificial Sequence
  Description of Artificial Sequence: Synthetic oligonucleotide
gttgcgacgcaggagacgaag

SEQ ID NO: 22583 - DNA, 21 bp, Artificial Sequence
  Description of Artificial Sequence: Synthetic oligonucleotide
gacatgagcaacaaaaccgtc

SEQ ID NO: 22584 - DNA, 21 bp, Artificial Sequence
  Description of Artificial Sequence: Synthetic oligonucleotide
gctggtggtgctagtaattct

SEQ ID NO: 22585 - DNA, 21 bp, Artificial Sequence
  Description of Artificial Sequence: Synthetic oligonucleotide
gtcaccagcaccaaacccgac

SEQ ID NO: 22586 - DNA, 21 bp, Artificial Sequence
  Description of Artificial Sequence: Synthetic oligonucleotide
ctcagcaccaaaagcgtcagc

SEQ ID NO: 22587 - DNA, 21 bp, Artificial Sequence
  Description of Artificial Sequence: Synthetic oligonucleotide
agcgccggcggcggcagcaga

SEQ ID NO: 22588 - DNA, 21 bp, Artificial Sequence
  Description of Artificial Sequence: Synthetic oligonucleotide
agcggcgtcaccaacagcgtc

SEQ ID NO: 22589 - DNA, 21 bp, Artificial Sequence
  Description of Artificial Sequence: Synthetic oligonucleotide
caacacaacgaccccaaaagc

SEQ ID NO: 22590 - DNA, 21 bp, Artificial Sequence
  Description of Artificial Sequence: Synthetic oligonucleotide
gagaataagaataagtcgacg

SEQ ID NO: 22591 - DNA, 21 bp, Artificial Sequence
  Description of Artificial Sequence: Synthetic oligonucleotide
gaggttccgtctcagactcgt

SEQ ID NO: 22592 - DNA, 21 bp, Artificial Sequence
  Description of Artificial Sequence: Synthetic oligonucleotide
gccaaaaccagagaaaccacc

SEQ ID NO: 22593 - DNA, 21 bp, Artificial Sequence
  Description of Artificial Sequence: Synthetic oligonucleotide
gtcaccggcaccggcagcccc

SEQ ID NO: 22594 - DNA, 21 bp, Artificial Sequence
  Description of Artificial Sequence: Synthetic oligonucleotide
tctgcgcagcagactggtagt

SEQ ID NO: 22595 - DNA, 21 bp, Artificial Sequence
  Description of Artificial Sequence: Synthetic oligonucleotide
agcccccaaagccccagcagc

SEQ ID NO: 22596 - DNA, 21 bp, Artificial Sequence
  Description of Artificial Sequence: Synthetic oligonucleotide
aacagcagcaaaagccccatc

SEQ ID NO: 22597 - DNA, 21 bp, Artificial Sequence
  Description of Artificial Sequence: Synthetic oligonucleotide
gccgtcagcgacaaaggcatc

SEQ ID NO: 22598 - DNA, 21 bp, Artificial Sequence
  Description of Artificial Sequence: Synthetic oligonucleotide
actggtaatgcgtcgacggct

SEQ ID NO: 22599 - DNA, 21 bp, Artificial Sequence
  Description of Artificial Sequence: Synthetic oligonucleotide
accggcgccgccaccgtcatg

SEQ ID NO: 22600 - DNA, 21 bp, Artificial Sequence
  Description of Artificial Sequence: Synthetic oligonucleotide
agccaaaccgactacaaaggc

SEQ ID NO: 22601 - DNA, 21 bp, Artificial Sequence
  Description of Artificial Sequence: Synthetic oligonucleotide
gccagcggccacggcgccagc

SEQ ID NO: 22602 - DNA, 21 bp, Artificial Sequence
  Description of Artificial Sequence: Synthetic oligonucleotide
gcggggactagtgcgccgaat

SEQ ID NO: 22603 - DNA, 21 bp, Artificial Sequence
  Description of Artificial Sequence: Synthetic oligonucleotide
ggccccggcaccagcaacacc

SEQ ID NO: 22604 - DNA, 21 bp, Artificial Sequence
  Description of Artificial Sequence: Synthetic oligonucleotide
tctcagcatactcctccttct

SEQ ID NO: 22605 - DNA, 21 bp, Artificial Sequence
  Description of Artificial Sequence: Synthetic oligonucleotide
gaaaacagaacccaaaacagc

SEQ ID NO: 22606 - DNA, 21 bp, Artificial Sequence
  Description of Artificial Sequence: Synthetic oligonucleotide
accatgagcaaccccggcgtc

SEQ ID NO: 22607 - DNA, 21 bp, Artificial Sequence
  Description of Artificial Sequence: Synthetic oligonucleotide
cagactaataagatttctgtt

SEQ ID NO: 22608 - DNA, 21 bp, Artificial Sequence
  Description of Artificial Sequence: Synthetic oligonucleotide
tcggatggtcagacgcgtagt

SEQ ID NO: 22609 - DNA, 21 bp, Artificial Sequence
  Description of Artificial Sequence: Synthetic oligonucleotide
tcggcgaagccgcagtctaag

SEQ ID NO: 22610 - DNA, 21 bp, Artificial Sequence
  Description of Artificial Sequence: Synthetic oligonucleotide
tttaggactacggctactgag

SEQ ID NO: 22611 - DNA, 21 bp, Artificial Sequence
  Description of Artificial Sequence: Synthetic oligonucleotide
gaaagaagcggcacccccagc

SEQ ID NO: 22612 - DNA, 21 bp, Artificial Sequence
  Description of Artificial Sequence: Synthetic oligonucleotide
gccctcagcgacagcagaagc

SEQ ID NO: 22613 - DNA, 21 bp, Artificial Sequence
  Description of Artificial Sequence: Synthetic oligonucleotide
gctgatacgaagactgggtcg

SEQ ID NO: 22614 - DNA, 21 bp, Artificial Sequence
  Description of Artificial Sequence: Synthetic oligonucleotide
gggactccgtctaataatacg

SEQ ID NO: 22615 - DNA, 21 bp, Artificial Sequence
  Description of Artificial Sequence: Synthetic oligonucleotide
agtacggggtcggctttttct

SEQ ID NO: 22616 - DNA, 21 bp, Artificial Sequence
  Description of Artificial Sequence: Synthetic oligonucleotide
gctacggtttctaagccggct

SEQ ID NO: 22617 - DNA, 21 bp, Artificial Sequence
  Description of Artificial Sequence: Synthetic oligonucleotide
aatatgggtcagaatggggtt

SEQ ID NO: 22618 - DNA, 21 bp, Artificial Sequence
  Description of Artificial Sequence: Synthetic oligonucleotide
agcagcatccccagcgaaaaa

SEQ ID NO: 22619 - DNA, 21 bp, Artificial Sequence
  Description of Artificial Sequence: Synthetic oligonucleotide
agccccgaaagcagagccagc

SEQ ID NO: 22620 - DNA, 21 bp, Artificial Sequence
  Description of Artificial Sequence: Synthetic oligonucleotide
agtaatagtaaggagcagttg

SEQ ID NO: 22621 - DNA, 21 bp, Artificial Sequence
  Description of Artificial Sequence: Synthetic oligonucleotide
agtactaggacgtctactagt

SEQ ID NO: 22622 - DNA, 21 bp, Artificial Sequence
  Description of Artificial Sequence: Synthetic oligonucleotide
agtattcagagtccttctagt

SEQ ID NO: 22623 - DNA, 21 bp, Artificial Sequence
  Description of Artificial Sequence: Synthetic oligonucleotide
ctcgacaacaaaaccgtcatc

SEQ ID NO: 22624 - DNA, 21 bp, Artificial Sequence
  Description of Artificial Sequence: Synthetic oligonucleotide
gagcctagtactatttcgcgt

SEQ ID NO: 22625 - DNA, 21 bp, Artificial Sequence
  Description of Artificial Sequence: Synthetic oligonucleotide
gagggtacgtctgagtcgaag

SEQ ID NO: 22626 - DNA, 21 bp, Artificial Sequence
  Description of Artificial Sequence: Synthetic oligonucleotide
ggtcagtcgacgagtacggcg

SEQ ID NO: 22627 - DNA, 21 bp, Artificial Sequence
  Description of Artificial Sequence: Synthetic oligonucleotide
gtcaacggccccaaccccacc

SEQ ID NO: 22628 - DNA, 21 bp, Artificial Sequence
  Description of Artificial Sequence: Synthetic oligonucleotide
aatgatactcgtggtggtcag

SEQ ID NO: 22629 - DNA, 21 bp, Artificial Sequence
  Description of Artificial Sequence: Synthetic oligonucleotide
cagggggatcgggatgtgcat

SEQ ID NO: 22630 - DNA, 21 bp, Artificial Sequence
  Description of Artificial Sequence: Synthetic oligonucleotide
cttcagaatgcttctcctggg

SEQ ID NO: 22631 - DNA, 21 bp, Artificial Sequence
  Description of Artificial Sequence: Synthetic oligonucleotide
gcggcgcctacgacgcctggg

SEQ ID NO: 22632 - DNA, 21 bp, Artificial Sequence
  Description of Artificial Sequence: Synthetic oligonucleotide
ggggggcaggcttctggtcat

SEQ ID NO: 22633 - DNA, 21 bp, Artificial Sequence
  Description of Artificial Sequence: Synthetic oligonucleotide
accaacctccccaccgtcgcc

SEQ ID NO: 22634 - DNA, 21 bp, Artificial Sequence
  Description of Artificial Sequence: Synthetic oligonucleotide
agcggcagagaagacatgaga

SEQ ID NO: 22635 - DNA, 21 bp, Artificial Sequence
  Description of Artificial Sequence: Synthetic oligonucleotide
ggcaaaagcaacgaaagaggc

SEQ ID NO: 22636 - DNA, 21 bp, Artificial Sequence
  Description of Artificial Sequence: Synthetic oligonucleotide
aacggcagcaccaacagcaga

SEQ ID NO: 22637 - DNA, 21 bp, Artificial Sequence
  Description of Artificial Sequence: Synthetic oligonucleotide
agccaaagcaaaagcttccaa

SEQ ID NO: 22638 - DNA, 21 bp, Artificial Sequence
  Description of Artificial Sequence: Synthetic oligonucleotide
gaaacccccagcaaacaaacc

SEQ ID NO: 22639 - DNA, 21 bp, Artificial Sequence
  Description of Artificial Sequence: Synthetic oligonucleotide
gagtcttctcatacgagtcgg

SEQ ID NO: 22640 - DNA, 21 bp, Artificial Sequence
  Description of Artificial Sequence: Synthetic oligonucleotide
ggggataatgattcgaggaag

SEQ ID NO: 22641 - DNA, 21 bp, Artificial Sequence
  Description of Artificial Sequence: Synthetic oligonucleotide
agaaccgaaaacgccagaagc

SEQ ID NO: 22642 - DNA, 21 bp, Artificial Sequence
  Description of Artificial Sequence: Synthetic oligonucleotide
atgggggggactgctcagggt

SEQ ID NO: 22643 - DNA, 21 bp, Artificial Sequence
  Description of Artificial Sequence: Synthetic oligonucleotide
gctgctaccggtcagcatact

SEQ ID NO: 22644 - DNA, 21 bp, Artificial Sequence
  Description of Artificial Sequence: Synthetic oligonucleotide
ggtacgtctagtgctcctcag

SEQ ID NO: 22645 - DNA, 21 bp, Artificial Sequence
  Description of Artificial Sequence: Synthetic oligonucleotide
agccccaacgccaaaagagac

SEQ ID NO: 22646 - DNA, 21 bp, Artificial Sequence
  Description of Artificial Sequence: Synthetic oligonucleotide
gccgtcggcaacagcggcaaa

SEQ ID NO: 22647 - DNA, 21 bp, Artificial Sequence
  Description of Artificial Sequence: Synthetic oligonucleotide
tcggggagggggtcgcctatg

SEQ ID NO: 22648 - DNA, 21 bp, Artificial Sequence
  Description of Artificial Sequence: Synthetic oligonucleotide
tcgtctcagacgacgtcttcg

SEQ ID NO: 22649 - DNA, 21 bp, Artificial Sequence
  Description of Artificial Sequence: Synthetic oligonucleotide
aacaccggcagcggcagcgcc

SEQ ID NO: 22650 - DNA, 21 bp, Artificial Sequence
  Description of Artificial Sequence: Synthetic oligonucleotide
cagaagattgatacggtgcgg

SEQ ID NO: 22651 - DNA, 21 bp, Artificial Sequence
  Description of Artificial Sequence: Synthetic oligonucleotide
ggcacccacgccaacgccaaa

SEQ ID NO: 22652 - DNA, 21 bp, Artificial Sequence
  Description of Artificial Sequence: Synthetic oligonucleotide
ggcgtcagcaaaagcctcagc

SEQ ID NO: 22653 - DNA, 21 bp, Artificial Sequence
  Description of Artificial Sequence: Synthetic oligonucleotide
ggtactcagtcgtctcggcag

SEQ ID NO: 22654 - DNA, 21 bp, Artificial Sequence
  Description of Artificial Sequence: Synthetic oligonucleotide
aattcgactgggacgtctacg

SEQ ID NO: 22655 - DNA, 21 bp, Artificial Sequence
  Description of Artificial Sequence: Synthetic oligonucleotide
acgcgtaatacggaggttcat

SEQ ID NO: 22656 - DNA, 21 bp, Artificial Sequence
  Description of Artificial Sequence: Synthetic oligonucleotide
actcctagggcgactgctgag

SEQ ID NO: 22657 - DNA, 21 bp, Artificial Sequence
  Description of Artificial Sequence: Synthetic oligonucleotide
aatcagagtaatactaccgtt

SEQ ID NO: 22658 - DNA, 21 bp, Artificial Sequence
  Description of Artificial Sequence: Synthetic oligonucleotide
acgcctattcaggatgctaag

SEQ ID NO: 22659 - DNA, 21 bp, Artificial Sequence
  Description of Artificial Sequence: Synthetic oligonucleotide
agtgctaattcggatcgttcg

SEQ ID NO: 22660 - DNA, 21 bp, Artificial Sequence
  Description of Artificial Sequence: Synthetic oligonucleotide
acgcctaatgctcatcctcag

SEQ ID NO: 22661 - DNA, 21 bp, Artificial Sequence
  Description of Artificial Sequence: Synthetic oligonucleotide
agcctcaccaaaggcagcgtc

SEQ ID NO: 22662 - DNA, 21 bp, Artificial Sequence
  Description of Artificial Sequence: Synthetic oligonucleotide
tctgcggcgaagtcgagtact

SEQ ID NO: 22663 - DNA, 21 bp, Artificial Sequence
  Description of Artificial Sequence: Synthetic oligonucleotide
agcaacagcaccaaaaccgcc

SEQ ID NO: 22664 - DNA, 21 bp, Artificial Sequence
  Description of Artificial Sequence: Synthetic oligonucleotide
accaacagccaaaccagcctc

SEQ ID NO: 22665 - DNA, 21 bp, Artificial Sequence
  Description of Artificial Sequence: Synthetic oligonucleotide
aagaatgagacttctaatggg

SEQ ID NO: 22666 - DNA, 21 bp, Artificial Sequence
  Description of Artificial Sequence: Synthetic oligonucleotide
aatatttctcataagggtgag

SEQ ID NO: 22667 - DNA, 21 bp, Artificial Sequence
  Description of Artificial Sequence: Synthetic oligonucleotide
aatgcgtcgtctaagttgcag

SEQ ID NO: 22668 - DNA, 21 bp, Artificial Sequence
  Description of Artificial Sequence: Synthetic oligonucleotide
aattctggggctgggttgatg

SEQ ID NO: 22669 - DNA, 21 bp, Artificial Sequence
  Description of Artificial Sequence: Synthetic oligonucleotide
accatggcccaaaaccccagc

SEQ ID NO: 22670 - DNA, 21 bp, Artificial Sequence
  Description of Artificial Sequence: Synthetic oligonucleotide
acccaccaaagcggcagcgtc

SEQ ID NO: 22671 - DNA, 21 bp, Artificial Sequence
  Description of Artificial Sequence: Synthetic oligonucleotide
accggccaacaaagcagcatc

SEQ ID NO: 22672 - DNA, 21 bp, Artificial Sequence
  Description of Artificial Sequence: Synthetic oligonucleotide
actgggggtgctcctgggggt

SEQ ID NO: 22673 - DNA, 21 bp, Artificial Sequence
  Description of Artificial Sequence: Synthetic oligonucleotide
agagacggcggcgccagcatg

SEQ ID NO: 22674 - DNA, 21 bp, Artificial Sequence
  Description of Artificial Sequence: Synthetic oligonucleotide
agaggcaacagcaacagcggc

SEQ ID NO: 22675 - DNA, 21 bp, Artificial Sequence
  Description of Artificial Sequence: Synthetic oligonucleotide
agcaaaggcgacaacggcggc

SEQ ID NO: 22676 - DNA, 21 bp, Artificial Sequence
  Description of Artificial Sequence: Synthetic oligonucleotide
agcagacccgaaaaagtcccc

SEQ ID NO: 22677 - DNA, 21 bp, Artificial Sequence
  Description of Artificial Sequence: Synthetic oligonucleotide
agcagcagcagccccgtcagc

SEQ ID NO: 22678 - DNA, 21 bp, Artificial Sequence
  Description of Artificial Sequence: Synthetic oligonucleotide
atcggcaccggcgtcagcagc

SEQ ID NO: 22679 - DNA, 21 bp, Artificial Sequence
  Description of Artificial Sequence: Synthetic oligonucleotide
atgagcggcagcaacccccaa

SEQ ID NO: 22680 - DNA, 21 bp, Artificial Sequence
  Description of Artificial Sequence: Synthetic oligonucleotide
attgcttctcagaaggttccg

SEQ ID NO: 22681 - DNA, 21 bp, Artificial Sequence
  Description of Artificial Sequence: Synthetic oligonucleotide
ctcagcgtcagcagcgccggc

SEQ ID NO: 22682 - DNA, 21 bp, Artificial Sequence
  Description of Artificial Sequence: Synthetic oligonucleotide
ctggctgcgtcttcgaatgcg

SEQ ID NO: 22683 - DNA, 21 bp, Artificial Sequence
  Description of Artificial Sequence: Synthetic oligonucleotide
gacaacaccaaagaactcaga

SEQ ID NO: 22684 - DNA, 21 bp, Artificial Sequence
  Description of Artificial Sequence: Synthetic oligonucleotide
gccagcggcaaacccggcgaa

SEQ ID NO: 22685 - DNA, 21 bp, Artificial Sequence
  Description of Artificial Sequence: Synthetic oligonucleotide
gcgtctaattctcgtgataag

SEQ ID NO: 22686 - DNA, 21 bp, Artificial Sequence
  Description of Artificial Sequence: Synthetic oligonucleotide
ggcatcctcgaaaaaaccaga

SEQ ID NO: 22687 - DNA, 21 bp, Artificial Sequence
  Description of Artificial Sequence: Synthetic oligonucleotide
ggcggcggcagccaccaaagc

SEQ ID NO: 22688 - DNA, 21 bp, Artificial Sequence
  Description of Artificial Sequence: Synthetic oligonucleotide
gggatggataagacttctcgg

SEQ ID NO: 22689 - DNA, 21 bp, Artificial Sequence
  Description of Artificial Sequence: Synthetic oligonucleotide
gggtcggtgcctgatcgtaag

SEQ ID NO: 22690 - DNA, 21 bp, Artificial Sequence
  Description of Artificial Sequence: Synthetic oligonucleotide
ggtagtcatgagaggaatacg

SEQ ID NO: 22691 - DNA, 21 bp, Artificial Sequence
  Description of Artificial Sequence: Synthetic oligonucleotide
ggtattgagaatttgaaggag

SEQ ID NO: 22692 - DNA, 21 bp, Artificial Sequence
  Description of Artificial Sequence: Synthetic oligonucleotide
ggtcctgtgtctggtactggt

SEQ ID NO: 22693 - DNA, 21 bp, Artificial Sequence
  Description of Artificial Sequence: Synthetic oligonucleotide
gtcggcgccgccaacagccaa

SEQ ID NO: 22694 - DNA, 21 bp, Artificial Sequence
  Description of Artificial Sequence: Synthetic oligonucleotide
tcttctactaatactagtgcg

SEQ ID NO: 22695 - DNA, 21 bp, Artificial Sequence
  Description of Artificial Sequence: Synthetic oligonucleotide
ttttctgatagtccggctaag

SEQ ID NO: 22696 - DNA, 21 bp, Artificial Sequence
  Description of Artificial Sequence: Synthetic oligonucleotide
accaacgaccacagcaccagc

SEQ ID NO: 22697 - DNA, 21 bp, Artificial Sequence
  Description of Artificial Sequence: Synthetic oligonucleotide
ggtagtccggatccgcgttcg

SEQ ID NO: 22698 - DNA, 21 bp, Artificial Sequence
  Description of Artificial Sequence: Synthetic oligonucleotide
accaacgacagcagacacgaa

SEQ ID NO: 22699 - DNA, 21 bp, Artificial Sequence
  Description of Artificial Sequence: Synthetic oligonucleotide
agtactgcgagttcgacgctg

SEQ ID NO: 22700 - DNA, 21 bp, Artificial Sequence
  Description of Artificial Sequence: Synthetic oligonucleotide
atggtgaataagcagtcgtcg

SEQ ID NO: 22701 - DNA, 21 bp, Artificial Sequence
  Description of Artificial Sequence: Synthetic oligonucleotide
gaggctcgtagtgcttctacg

SEQ ID NO: 22702 - DNA, 21 bp, Artificial Sequence
  Description of Artificial Sequence: Synthetic oligonucleotide
ggccaaggcagcgccagcgcc

SEQ ID NO: 22703 - DNA, 21 bp, Artificial Sequence
  Description of Artificial Sequence: Synthetic oligonucleotide
gacggcaaaagcaaactcgcc

SEQ ID NO: 22704 - DNA, 21 bp, Artificial Sequence
  Description of Artificial Sequence: Synthetic oligonucleotide
gctgggacgaatgggcttaat

SEQ ID NO: 22705 - DNA, 21 bp, Artificial Sequence
  Description of Artificial Sequence: Synthetic oligonucleotide
tcggttgcggcggcgcctacg

SEQ ID NO: 22706 - DNA, 21 bp, Artificial Sequence
  Description of Artificial Sequence: Synthetic oligonucleotide
agcagcaccaaccccggcacc

SEQ ID NO: 22707 - DNA, 21 bp, Artificial Sequence
  Description of Artificial Sequence: Synthetic oligonucleotide
tgttgtactggtaagagtagt

SEQ ID NO: 22708 - DNA, 21 bp, Artificial Sequence
  Description of Artificial Sequence: Synthetic oligonucleotide
aatagtggtagtacggctagt

SEQ ID NO: 22709 - DNA, 21 bp, Artificial Sequence
  Description of Artificial Sequence: Synthetic oligonucleotide
accgccctcggcagcaacagc

SEQ ID NO: 22710 - DNA, 21 bp, Artificial Sequence
  Description of Artificial Sequence: Synthetic oligonucleotide
agcggcggcggcaccgaaaac

SEQ ID NO: 22711 - DNA, 21 bp, Artificial Sequence
  Description of Artificial Sequence: Synthetic oligonucleotide
gacggcggcagcaacaaagcc

SEQ ID NO: 22712 - DNA, 21 bp, Artificial Sequence
  Description of Artificial Sequence: Synthetic oligonucleotide
gccgccaccaccggcggcgcc

SEQ ID NO: 22713 - DNA, 21 bp, Artificial Sequence
  Description of Artificial Sequence: Synthetic oligonucleotide
ggccccgccaaaaccgacaga

SEQ ID NO: 22714 - DNA, 21 bp, Artificial Sequence
  Description of Artificial Sequence: Synthetic oligonucleotide
ggcaccagcaacaacaaaatc

SEQ ID NO: 22715 - DNA, 21 bp, Artificial Sequence
  Description of Artificial Sequence: Synthetic oligonucleotide
atcaaaaacagcaaagaaggc

SEQ ID NO: 22716 - DNA, 21 bp, Artificial Sequence
  Description of Artificial Sequence: Synthetic oligonucleotide
cagcctgctagtacttctgtt

SEQ ID NO: 22717 - DNA, 21 bp, Artificial Sequence
  Description of Artificial Sequence: Synthetic oligonucleotide
gacagcagcaaaaccgccgtc

SEQ ID NO: 22718 - DNA, 21 bp, Artificial Sequence
  Description of Artificial Sequence: Synthetic oligonucleotide
ggggctcttaatgggcatggg

SEQ ID NO: 22719 - DNA, 21 bp, Artificial Sequence
  Description of Artificial Sequence: Synthetic oligonucleotide
tggggcaacagcaccaacgcc

SEQ ID NO: 22720 - DNA, 21 bp, Artificial Sequence
  Description of Artificial Sequence: Synthetic oligonucleotide
ctcaacggcaaacccagcaac

SEQ ID NO: 22721 - DNA, 21 bp, Artificial Sequence
  Description of Artificial Sequence: Synthetic oligonucleotide
actggggcgtcttcgactctg

SEQ ID NO: 22722 - DNA, 21 bp, Artificial Sequence
  Description of Artificial Sequence: Synthetic oligonucleotide
cagactgcggataggcgtgat

SEQ ID NO: 22723 - DNA, 21 bp, Artificial Sequence
  Description of Artificial Sequence: Synthetic oligonucleotide
aacagcgcccaccccgccacc

SEQ ID NO: 22724 - DNA, 21 bp, Artificial Sequence
  Description of Artificial Sequence: Synthetic oligonucleotide
acgactaatactggtcttgcg

SEQ ID NO: 22725 - DNA, 21 bp, Artificial Sequence
  Description of Artificial Sequence: Synthetic oligonucleotide
gtgagttctggtaaggtgtct

SEQ ID NO: 22726 - DNA, 21 bp, Artificial Sequence
  Description of Artificial Sequence: Synthetic oligonucleotide
agtccgacgtctgatcgtttg

SEQ ID NO: 22727 - DNA, 21 bp, Artificial Sequence
  Description of Artificial Sequence: Synthetic oligonucleotide
ctgagtggtcataatagtggg

SEQ ID NO: 22728 - DNA, 21 bp, Artificial Sequence
  Description of Artificial Sequence: Synthetic oligonucleotide
gccaaaagccccaacagctac

SEQ ID NO: 22729 - DNA, 21 bp, Artificial Sequence
  Description of Artificial Sequence: Synthetic oligonucleotide
tttacgagtgagcatggtcgt

SEQ ID NO: 22730 - DNA, 21 bp, Artificial Sequence
  Description of Artificial Sequence: Synthetic oligonucleotide
cagtcgggtgggcagacggct

SEQ ID NO: 22731 - DNA, 21 bp, Artificial Sequence
  Description of Artificial Sequence: Synthetic oligonucleotide
agccaagccagcaccagcctc

SEQ ID NO: 22732 - DNA, 21 bp, Artificial Sequence
  Description of Artificial Sequence: Synthetic oligonucleotide
gacggcagcagacaaagcatc

SEQ ID NO: 22733 - DNA, 21 bp, Artificial Sequence
  Description of Artificial Sequence: Synthetic oligonucleotide
agccccaacaaacccacccac

SEQ ID NO: 22734 - DNA, 21 bp, Artificial Sequence
  Description of Artificial Sequence: Synthetic oligonucleotide
agcaccaccagcgacagagcc

SEQ ID NO: 22735 - DNA, 21 bp, Artificial Sequence
  Description of Artificial Sequence: Synthetic oligonucleotide
aattctgatgagtcgaatcgt

SEQ ID NO: 22736 - DNA, 21 bp, Artificial Sequence
  Description of Artificial Sequence: Synthetic oligonucleotide
aacaccagcggccaaaacccc

SEQ ID NO: 22737 - DNA, 21 bp, Artificial Sequence
  Description of Artificial Sequence: Synthetic oligonucleotide
aataataattcgtcgactaat

SEQ ID NO: 22738 - DNA, 21 bp, Artificial Sequence
  Description of Artificial Sequence: Synthetic oligonucleotide
accagcggcgacgccagaagc

SEQ ID NO: 22739 - DNA, 21 bp, Artificial Sequence
  Description of Artificial Sequence: Synthetic oligonucleotide
agggataatactcctgcgctg

SEQ ID NO: 22740 - DNA, 21 bp, Artificial Sequence
  Description of Artificial Sequence: Synthetic oligonucleotide
atcgtccaagaaaacagcaaa

SEQ ID NO: 22741 - DNA, 21 bp, Artificial Sequence
  Description of Artificial Sequence: Synthetic oligonucleotide
atgaatagtccgggtacgtcg

SEQ ID NO: 22742 - DNA, 21 bp, Artificial Sequence
  Description of Artificial Sequence: Synthetic oligonucleotide
gaaaccagcagcagagccagc

SEQ ID NO: 22743 - DNA, 21 bp, Artificial Sequence
  Description of Artificial Sequence: Synthetic oligonucleotide
gacctccaagacagcagaaaa

SEQ ID NO: 22744 - DNA, 21 bp, Artificial Sequence
  Description of Artificial Sequence: Synthetic oligonucleotide
gatggtaaggtgagtactaag

SEQ ID NO: 22745 - DNA, 21 bp, Artificial Sequence
  Description of Artificial Sequence: Synthetic oligonucleotide
ggccacgtccaaagcagcaaa

SEQ ID NO: 22746 - DNA, 21 bp, Artificial Sequence
  Description of Artificial Sequence: Synthetic oligonucleotide
ggccccgacagcaacagagtc

SEQ ID NO: 22747 - DNA, 21 bp, Artificial Sequence
  Description of Artificial Sequence: Synthetic oligonucleotide
ttgcagagtggggagcagcgt

SEQ ID NO: 22748 - DNA, 21 bp, Artificial Sequence
  Description of Artificial Sequence: Synthetic oligonucleotide
aattcttcgactaaggcggtt

SEQ ID NO: 22749 - DNA, 21 bp, Artificial Sequence
  Description of Artificial Sequence: Synthetic oligonucleotide
ggcggccaagaaagaaacaac

SEQ ID NO: 22750 - DNA, 21 bp, Artificial Sequence
  Description of Artificial Sequence: Synthetic oligonucleotide
agcatgagcgccacccacgtc

SEQ ID NO: 22751 - DNA, 21 bp, Artificial Sequence
  Description of Artificial Sequence: Synthetic oligonucleotide
gatgcgcgggaggttagtcgg

SEQ ID NO: 22752 - DNA, 21 bp, Artificial Sequence
  Description of Artificial Sequence: Synthetic oligonucleotide
actttggataagactaatagt

SEQ ID NO: 22753 - DNA, 21 bp, Artificial Sequence
  Description of Artificial Sequence: Synthetic oligonucleotide
agcaacaacaaacccaacagc

SEQ ID NO: 22754 - DNA, 21 bp, Artificial Sequence
  Description of Artificial Sequence: Synthetic oligonucleotide
ctcaccagcgaaaaacacctc

SEQ ID NO: 22755 - DNA, 21 bp, Artificial Sequence
  Description of Artificial Sequence: Synthetic oligonucleotide
gaaagcagcagcggcagcatg

SEQ ID NO: 22756 - DNA, 21 bp, Artificial Sequence
  Description of Artificial Sequence: Synthetic oligonucleotide
gacctcaaagaccccagagcc

SEQ ID NO: 22757 - DNA, 21 bp, Artificial Sequence
  Description of Artificial Sequence: Synthetic oligonucleotide
gacgtcagccaaagaaacctc

SEQ ID NO: 22758 - DNA, 21 bp, Artificial Sequence
  Description of Artificial Sequence: Synthetic oligonucleotide
gatcagcttggtacttctcgt

SEQ ID NO: 22759 - DNA, 21 bp, Artificial Sequence
  Description of Artificial Sequence: Synthetic oligonucleotide
tcggttaagaatccgactaat

SEQ ID NO: 22760 - DNA, 21 bp, Artificial Sequence
  Description of Artificial Sequence: Synthetic oligonucleotide
tcttctagtgagtcgaagagt

SEQ ID NO: 22761 - DNA, 21 bp, Artificial Sequence
  Description of Artificial Sequence: Synthetic oligonucleotide
gctggtagtcgtgagacttcg

SEQ ID NO: 22762 - DNA, 21 bp, Artificial Sequence
  Description of Artificial Sequence: Synthetic oligonucleotide
accaacaccggcagcagcgtc

SEQ ID NO: 22763 - DNA, 21 bp, Artificial Sequence
  Description of Artificial Sequence: Synthetic oligonucleotide
agcgaaggcagcggcggcaaa

SEQ ID NO: 22764 - DNA, 21 bp, Artificial Sequence
  Description of Artificial Sequence: Synthetic oligonucleotide
atggtgcctggggataaggtt

SEQ ID NO: 22765 - DNA, 21 bp, Artificial Sequence
  Description of Artificial Sequence: Synthetic oligonucleotide
cacaacggcagcaaaggcatg

SEQ ID NO: 22766 - DNA, 21 bp, Artificial Sequence
  Description of Artificial Sequence: Synthetic oligonucleotide
gaccccagccacgtcaacaga

SEQ ID NO: 22767 - DNA, 21 bp, Artificial Sequence
  Description of Artificial Sequence: Synthetic oligonucleotide
gccgccggcgacagaagcggc

SEQ ID NO: 22768 - DNA, 21 bp, Artificial Sequence
  Description of Artificial Sequence: Synthetic oligonucleotide
gctagtagtggtcagagtggc

SEQ ID NO: 22769 - DNA, 21 bp, Artificial Sequence
  Description of Artificial Sequence: Synthetic oligonucleotide
gtcgaagccagcggcaacaaa

SEQ ID NO: 22770 - DNA, 21 bp, Artificial Sequence
  Description of Artificial Sequence: Synthetic oligonucleotide
ggcaacgcccccaacctcaaa

SEQ ID NO: 22771 - DNA, 21 bp, Artificial Sequence
  Description of Artificial Sequence: Synthetic oligonucleotide
acccacagcagcgacaaccaa

SEQ ID NO: 22772 - DNA, 21 bp, Artificial Sequence
  Description of Artificial Sequence: Synthetic oligonucleotide
tcggtttcgagtcctacgaag

SEQ ID NO: 22773 - DNA, 21 bp, Artificial Sequence
  Description of Artificial Sequence: Synthetic oligonucleotide
acgattaatagtcagccgatt

SEQ ID NO: 22774 - DNA, 21 bp, Artificial Sequence
  Description of Artificial Sequence: Synthetic oligonucleotide
agtcttagtcaggctccgact

SEQ ID NO: 22775 - DNA, 21 bp, Artificial Sequence
  Description of Artificial Sequence: Synthetic oligonucleotide
gaaagcagcggcgccagactc

SEQ ID NO: 22776 - DNA, 21 bp, Artificial Sequence
  Description of Artificial Sequence: Synthetic oligonucleotide
tctcagtctaagcaggttagt

SEQ ID NO: 22777 - DNA, 21 bp, Artificial Sequence
  Description of Artificial Sequence: Synthetic oligonucleotide
tggagttctgagaagactcgt

SEQ ID NO: 22778 - DNA, 21 bp, Artificial Sequence
  Description of Artificial Sequence: Synthetic oligonucleotide
gacagactcggcaaaggcccc

SEQ ID NO: 22779 - DNA, 21 bp, Artificial Sequence
  Description of Artificial Sequence: Synthetic oligonucleotide
agtgttgttcaggcgtcgaag

SEQ ID NO: 22780 - DNA, 21 bp, Artificial Sequence
  Description of Artificial Sequence: Synthetic oligonucleotide
agcagcagcagcagcagcaac

SEQ ID NO: 22781 - DNA, 21 bp, Artificial Sequence
  Description of Artificial Sequence: Synthetic oligonucleotide
atgaattctcagtctagtcgg

SEQ ID NO: 22782 - DNA, 21 bp, Artificial Sequence
  Description of Artificial Sequence: Synthetic oligonucleotide
cagacgtctggtacgcaggtt

SEQ ID NO: 22783 - DNA, 21 bp, Artificial Sequence
  Description of Artificial Sequence: Synthetic oligonucleotide
cagtctaagggtactactggg

SEQ ID NO: 22784 - DNA, 21 bp, Artificial Sequence
  Description of Artificial Sequence: Synthetic oligonucleotide
gatgttccttctaagcagttg

SEQ ID NO: 22785 - DNA, 21 bp, Artificial Sequence
  Description of Artificial Sequence: Synthetic oligonucleotide
ggcgtcagcaaagacagaatg

SEQ ID NO: 22786 - DNA, 21 bp, Artificial Sequence
  Description of Artificial Sequence: Synthetic oligonucleotide
atgggcagcaacagcagcatc

SEQ ID NO: 22787 - DNA, 21 bp, Artificial Sequence
  Description of Artificial Sequence: Synthetic oligonucleotide
ggtactggtcgggatacggct

SEQ ID NO: 22788 - DNA, 21 bp, Artificial Sequence
  Description of Artificial Sequence: Synthetic oligonucleotide
ggcaccggcaccgacctcaaa

SEQ ID NO: 22789 - DNA, 21 bp, Artificial Sequence
  Description of Artificial Sequence: Synthetic oligonucleotide
attgatactaagggggggtct

SEQ ID NO: 22790 - DNA, 21 bp, Artificial Sequence
  Description of Artificial Sequence: Synthetic oligonucleotide
agcagcagccaaagcaaaatg

SEQ ID NO: 22791 - DNA, 21 bp, Artificial Sequence
  Description of Artificial Sequence: Synthetic oligonucleotide
gctgcgggggcgaattcgggt

SEQ ID NO: 22792 - DNA, 21 bp, Artificial Sequence
  Description of Artificial Sequence: Synthetic oligonucleotide
aaaggcagcaacacccacggc

SEQ ID NO: 22793 - DNA, 21 bp, Artificial Sequence
  Description of Artificial Sequence: Synthetic oligonucleotide
aacgcccccggccaacacggc

SEQ ID NO: 22794 - DNA, 21 bp, Artificial Sequence
  Description of Artificial Sequence: Synthetic oligonucleotide
aacgtcagcgaaacccccaaa

SEQ ID NO: 22795 - DNA, 21 bp, Artificial Sequence
  Description of Artificial Sequence: Synthetic oligonucleotide
aatactgatactaggtcgtct

SEQ ID NO: 22796 - DNA, 21 bp, Artificial Sequence
  Description of Artificial Sequence: Synthetic oligonucleotide
agcagaacccccggcagcagc

SEQ ID NO: 22797 - DNA, 21 bp, Artificial Sequence
  Description of Artificial Sequence: Synthetic oligonucleotide
agcggcaaaagcagcaacagc

SEQ ID NO: 22798 - DNA, 21 bp, Artificial Sequence
  Description of Artificial Sequence: Synthetic oligonucleotide
agcggcgtcagccacgccgcc

SEQ ID NO: 22799 - DNA, 21 bp, Artificial Sequence
  Description of Artificial Sequence: Synthetic oligonucleotide
caagccaccaccgccgccaga

SEQ ID NO: 22800 - DNA, 21 bp, Artificial Sequence
  Description of Artificial Sequence: Synthetic oligonucleotide
gaccacgtcaacaaaggcggc

SEQ ID NO: 22801 - DNA, 21 bp, Artificial Sequence
  Description of Artificial Sequence: Synthetic oligonucleotide
gttagtagtggttctttgagt

SEQ ID NO: 22802 - DNA, 21 bp, Artificial Sequence
  Description of Artificial Sequence: Synthetic oligonucleotide
tcgcggggtgctgatctttcg

SEQ ID NO: 22803 - DNA, 21 bp, Artificial Sequence
  Description of Artificial Sequence: Synthetic oligonucleotide
tcgggtactaatactgcgttg

SEQ ID NO: 22804 - DNA, 21 bp, Artificial Sequence
  Description of Artificial Sequence: Synthetic oligonucleotide
tcgtcgactccttcgattggg

SEQ ID NO: 22805 - DNA, 21 bp, Artificial Sequence
  Description of Artificial Sequence: Synthetic oligonucleotide
tttgctgagactaaggggggt

SEQ ID NO: 22806 - DNA, 21 bp, Artificial Sequence
  Description of Artificial Sequence: Synthetic oligonucleotide
aggtcgacgggtgggagtagt

SEQ ID NO: 22807 - DNA, 21 bp, Artificial Sequence
  Description of Artificial Sequence: Synthetic oligonucleotide
gggggtgggtctgggaagact

SEQ ID NO: 22808 - DNA, 21 bp, Artificial Sequence
  Description of Artificial Sequence: Synthetic oligonucleotide
ctcaacaacagcggcagccac

SEQ ID NO: 22809 - DNA, 21 bp, Artificial Sequence
  Description of Artificial Sequence: Synthetic oligonucleotide
accctcagcgccccccacagc

SEQ ID NO: 22810 - DNA, 21 bp, Artificial Sequence
  Description of Artificial Sequence: Synthetic oligonucleotide
aacgccgacagcagcacccac

SEQ ID NO: 22811 - DNA, 21 bp, Artificial Sequence
  Description of Artificial Sequence: Synthetic oligonucleotide
gccagcaacgtcaaaagcctc

SEQ ID NO: 22812 - DNA, 21 bp, Artificial Sequence
  Description of Artificial Sequence: Synthetic oligonucleotide
tcgacttctactccgcatcag

SEQ ID NO: 22813 - DNA, 21 bp, Artificial Sequence
  Description of Artificial Sequence: Synthetic oligonucleotide
ttgaatactccgccttcgaag

SEQ ID NO: 22814 - DNA, 21 bp, Artificial Sequence
  Description of Artificial Sequence: Synthetic oligonucleotide
aacgccagcagagaaaccgtc

SEQ ID NO: 22815 - DNA, 21 bp, Artificial Sequence
  Description of Artificial Sequence: Synthetic oligonucleotide
accgcccccgaaagaatggcc

SEQ ID NO: 22816 - DNA, 21 bp, Artificial Sequence
  Description of Artificial Sequence: Synthetic oligonucleotide
gacaccggcaaaaccagaagc

SEQ ID NO: 22817 - DNA, 21 bp, Artificial Sequence
  Description of Artificial Sequence: Synthetic oligonucleotide
ggcctcctcagcagcaccaaa

SEQ ID NO: 22818 - DNA, 21 bp, Artificial Sequence
  Description of Artificial Sequence: Synthetic oligonucleotide
tcgctgtcggcgacttcgcag

SEQ ID NO: 22819 - DNA, 21 bp, Artificial Sequence
  Description of Artificial Sequence: Synthetic oligonucleotide
tctaatgagcgtactccgaag

SEQ ID NO: 22820 - DNA, 21 bp, Artificial Sequence
  Description of Artificial Sequence: Synthetic oligonucleotide
tttgagaagtcgactcctact

SEQ ID NO: 22821 - DNA, 21 bp, Artificial Sequence
  Description of Artificial Sequence: Synthetic oligonucleotide
aacgccagcgcccaaagcaaa

SEQ ID NO: 22822 - DNA, 21 bp, Artificial Sequence
  Description of Artificial Sequence: Synthetic oligonucleotide
accaccgaaaacagcagaggc

SEQ ID NO: 22823 - DNA, 21 bp, Artificial Sequence
  Description of Artificial Sequence: Synthetic oligonucleotide
agcagcagcaccaaccccaaa

SEQ ID NO: 22824 - DNA, 21 bp, Artificial Sequence
  Description of Artificial Sequence: Synthetic oligonucleotide
agtaatactcaggggctgact

SEQ ID NO: 22825 - DNA, 21 bp, Artificial Sequence
  Description of Artificial Sequence: Synthetic oligonucleotide
agtgctaagcctgaggggagt

SEQ ID NO: 22826 - DNA, 21 bp, Artificial Sequence
  Description of Artificial Sequence: Synthetic oligonucleotide
tctaggagtaagactgatgcg

SEQ ID NO: 22827 - DNA, 21 bp, Artificial Sequence
  Description of Artificial Sequence: Synthetic oligonucleotide
caaggcagcaccaccgccagc

SEQ ID NO: 22828 - DNA, 21 bp, Artificial Sequence
  Description of Artificial Sequence: Synthetic oligonucleotide
ggcaaccccaacagcgccacc

SEQ ID NO: 22829 - DNA, 21 bp, Artificial Sequence
  Description of Artificial Sequence: Synthetic oligonucleotide
accggcagcacccccgtccac

SEQ ID NO: 22830 - DNA, 21 bp, Artificial Sequence
  Description of Artificial Sequence: Synthetic oligonucleotide
agcagccccggcggcagccaa

SEQ ID NO: 22831 - DNA, 21 bp, Artificial Sequence
  Description of Artificial Sequence: Synthetic oligonucleotide
gaaaccaccgccaaaaacggc

SEQ ID NO: 22832 - DNA, 21 bp, Artificial Sequence
  Description of Artificial Sequence: Synthetic oligonucleotide
gcgtcgggtgcgccttcgaag

SEQ ID NO: 22833 - DNA, 21 bp, Artificial Sequence
  Description of Artificial Sequence: Synthetic oligonucleotide
gtcagcagcaaagaaaccgcc

SEQ ID NO: 22834 - DNA, 21 bp, Artificial Sequence
  Description of Artificial Sequence: Synthetic oligonucleotide
tcggagactaaggttggtatt

SEQ ID NO: 22835 - DNA, 21 bp, Artificial Sequence
  Description of Artificial Sequence: Synthetic oligonucleotide
ggtactgcggctgttgcgtct

SEQ ID NO: 22836 - DNA, 21 bp, Artificial Sequence
  Description of Artificial Sequence: Synthetic oligonucleotide
aacaacgccgccagcgtcaaa

SEQ ID NO: 22837 - DNA, 21 bp, Artificial Sequence
  Description of Artificial Sequence: Synthetic oligonucleotide
cacggcgccgccaaaagcagc

SEQ ID NO: 22838 - DNA, 21 bp, Artificial Sequence
  Description of Artificial Sequence: Synthetic oligonucleotide
aacaccgtcagcagcggcggc

SEQ ID NO: 22839 - DNA, 21 bp, Artificial Sequence
  Description of Artificial Sequence: Synthetic oligonucleotide
aagagtaatgatagtagtggg

SEQ ID NO: 22840 - DNA, 21 bp, Artificial Sequence
  Description of Artificial Sequence: Synthetic oligonucleotide
aataatgttcagactacgcat

SEQ ID NO: 22841 - DNA, 21 bp, Artificial Sequence
  Description of Artificial Sequence: Synthetic oligonucleotide
cagggggctagtacgggtagt

SEQ ID NO: 22842 - DNA, 21 bp, Artificial Sequence
  Description of Artificial Sequence: Synthetic oligonucleotide
gaactcggcagcaaaggccac

SEQ ID NO: 22843 - DNA, 21 bp, Artificial Sequence
  Description of Artificial Sequence: Synthetic oligonucleotide
ggtgatcgggcgtctccgaag

SEQ ID NO: 22844 - DNA, 21 bp, Artificial Sequence
  Description of Artificial Sequence: Synthetic oligonucleotide
ggttctagtgggaagagtttt

SEQ ID NO: 22845 - DNA, 21 bp, Artificial Sequence
  Description of Artificial Sequence: Synthetic oligonucleotide
gttaaggcgaatgaggcgtcg

SEQ ID NO: 22846 - DNA, 21 bp, Artificial Sequence
  Description of Artificial Sequence: Synthetic oligonucleotide
tctgagggtgctcgtcatggt

SEQ ID NO: 22847 - DNA, 21 bp, Artificial Sequence
  Description of Artificial Sequence: Synthetic oligonucleotide
caagtcgccaccggcaccagc

SEQ ID NO: 22848 - DNA, 21 bp, Artificial Sequence
  Description of Artificial Sequence: Synthetic oligonucleotide
tcgaatggtgctggtcttacg

SEQ ID NO: 22849 - DNA, 21 bp, Artificial Sequence
  Description of Artificial Sequence: Synthetic oligonucleotide
ctcgaccccaaacccaccagc

SEQ ID NO: 22850 - DNA, 21 bp, Artificial Sequence
  Description of Artificial Sequence: Synthetic oligonucleotide
tcggctagtaagagtagtacg

SEQ ID NO: 22851 - DNA, 21 bp, Artificial Sequence
  Description of Artificial Sequence: Synthetic oligonucleotide
actcagtctcaggttccgatt

SEQ ID NO: 22852 - DNA, 21 bp, Artificial Sequence
  Description of Artificial Sequence: Synthetic oligonucleotide
agcgtcaacgccagaaccagc

SEQ ID NO: 22853 - DNA, 21 bp, Artificial Sequence
  Description of Artificial Sequence: Synthetic oligonucleotide
cacggccccagcagccaaacc

SEQ ID NO: 22854 - DNA, 21 bp, Artificial Sequence
  Description of Artificial Sequence: Synthetic oligonucleotide
agtaatgcgagttctccttcg

SEQ ID NO: 22855 - DNA, 21 bp, Artificial Sequence
  Description of Artificial Sequence: Synthetic oligonucleotide
aaagacaccaaacaacccaac

SEQ ID NO: 22856 - DNA, 21 bp, Artificial Sequence
  Description of Artificial Sequence: Synthetic oligonucleotide
accaacaccagcggcagcggc

SEQ ID NO: 22857 - DNA, 21 bp, Artificial Sequence
  Description of Artificial Sequence: Synthetic oligonucleotide
cttaatacttcgaagtctgtg

SEQ ID NO: 22858 - DNA, 21 bp, Artificial Sequence
  Description of Artificial Sequence: Synthetic oligonucleotide
ggtatgagtactggggagggg

SEQ ID NO: 22859 - DNA, 21 bp, Artificial Sequence
  Description of Artificial Sequence: Synthetic oligonucleotide
ttgcggactccgaatgcgggg

SEQ ID NO: 22860 - DNA, 21 bp, Artificial Sequence
  Description of Artificial Sequence: Synthetic oligonucleotide
agcaaagccgcccaaagcatc

SEQ ID NO: 22861 - DNA, 21 bp, Artificial Sequence
  Description of Artificial Sequence: Synthetic oligonucleotide
atgactgatggttcgtcgaag

SEQ ID NO: 22862 - DNA, 21 bp, Artificial Sequence
  Description of Artificial Sequence: Synthetic oligonucleotide
gatagtactaataaggctgct

SEQ ID NO: 22863 - DNA, 21 bp, Artificial Sequence
  Description of Artificial Sequence: Synthetic oligonucleotide
ggggggagtacgctgtctaag

SEQ ID NO: 22864 - DNA, 21 bp, Artificial Sequence
  Description of Artificial Sequence: Synthetic oligonucleotide
tcgacggctacggggagtaag

SEQ ID NO: 22865 - DNA, 21 bp, Artificial Sequence
  Description of Artificial Sequence: Synthetic oligonucleotide
ttgccgtctaaggttaatact

SEQ ID NO: 22866 - DNA, 21 bp, Artificial Sequence
  Description of Artificial Sequence: Synthetic oligonucleotide
gtgccgagtaataagaatggt

SEQ ID NO: 22867 - DNA, 21 bp, Artificial Sequence
  Description of Artificial Sequence: Synthetic oligonucleotide
aaccccgccagcaaagccaac

SEQ ID NO: 22868 - DNA, 21 bp, Artificial Sequence
  Description of Artificial Sequence: Synthetic oligonucleotide
caggggaatcatccgtcttcg

SEQ ID NO: 22869 - DNA, 21 bp, Artificial Sequence
  Description of Artificial Sequence: Synthetic oligonucleotide
gccagaaccggcagccccagc

SEQ ID NO: 22870 - DNA, 21 bp, Artificial Sequence
  Description of Artificial Sequence: Synthetic oligonucleotide
accaccagcagcaaaaccagc

SEQ ID NO: 22871 - DNA, 21 bp, Artificial Sequence
  Description of Artificial Sequence: Synthetic oligonucleotide
gacatcaaaagccccagccaa

SEQ ID NO: 22872 - DNA, 21 bp, Artificial Sequence
  Description of Artificial Sequence: Synthetic oligonucleotide
acccaagccaccggcaaaggc

SEQ ID NO: 22873 - DNA, 21 bp, Artificial Sequence
  Description of Artificial Sequence: Synthetic oligonucleotide
acgagtggggttagtacgggt

SEQ ID NO: 22874 - DNA, 21 bp, Artificial Sequence
  Description of Artificial Sequence: Synthetic oligonucleotide
actaatacgaatctgaaggcg

SEQ ID NO: 22875 - DNA, 21 bp, Artificial Sequence
  Description of Artificial Sequence: Synthetic oligonucleotide
agcaaagccagcagcggcctc

SEQ ID NO: 22876 - DNA, 21 bp, Artificial Sequence
  Description of Artificial Sequence: Synthetic oligonucleotide
agcaccggcagcagcatcggc

SEQ ID NO: 22877 - DNA, 21 bp, Artificial Sequence
  Description of Artificial Sequence: Synthetic oligonucleotide
agcgtcaaccccagcatggcc

SEQ ID NO: 22878 - DNA, 21 bp, Artificial Sequence
  Description of Artificial Sequence: Synthetic oligonucleotide
cacagagtcagcaaagacggc

SEQ ID NO: 22879 - DNA, 21 bp, Artificial Sequence
  Description of Artificial Sequence: Synthetic oligonucleotide
caccaaagcggcaccagcggc

SEQ ID NO: 22880 - DNA, 21 bp, Artificial Sequence
  Description of Artificial Sequence: Synthetic oligonucleotide
catgagtctgggcagaagagt

SEQ ID NO: 22881 - DNA, 21 bp, Artificial Sequence
  Description of Artificial Sequence: Synthetic oligonucleotide
ctcagcagcgacaaaaacagc

SEQ ID NO: 22882 - DNA, 21 bp, Artificial Sequence
  Description of Artificial Sequence: Synthetic oligonucleotide
gatacggtgaagtcggggact

SEQ ID NO: 22883 - DNA, 21 bp, Artificial Sequence
  Description of Artificial Sequence: Synthetic oligonucleotide
gctacgacgtctgagcagcat

SEQ ID NO: 22884 - DNA, 21 bp, Artificial Sequence
  Description of Artificial Sequence: Synthetic oligonucleotide
tatcgtgggacggagaattcg

SEQ ID NO: 22885 - DNA, 21 bp, Artificial Sequence
  Description of Artificial Sequence: Synthetic oligonucleotide
agcaccaacagcaccgccaga

SEQ ID NO: 22886 - DNA, 21 bp, Artificial Sequence
  Description of Artificial Sequence: Synthetic oligonucleotide
agcaacggcgccagcctcaac

SEQ ID NO: 22887 - DNA, 21 bp, Artificial Sequence
  Description of Artificial Sequence: Synthetic oligonucleotide
catagtacgggtacgccgatg

SEQ ID NO: 22888 - DNA, 21 bp, Artificial Sequence
  Description of Artificial Sequence: Synthetic oligonucleotide
gacgaaaccagagccagaagc

SEQ ID NO: 22889 - DNA, 21 bp, Artificial Sequence
  Description of Artificial Sequence: Synthetic oligonucleotide
gagtcgacttcttcggttcat

SEQ ID NO: 22890 - DNA, 21 bp, Artificial Sequence
  Description of Artificial Sequence: Synthetic oligonucleotide
gccaccgtcgacagaaaccac

SEQ ID NO: 22891 - DNA, 21 bp, Artificial Sequence
  Description of Artificial Sequence: Synthetic oligonucleotide
ggcctcgacgccaaacccatg

SEQ ID NO: 22892 - DNA, 21 bp, Artificial Sequence
  Description of Artificial Sequence: Synthetic oligonucleotide
aacagcagcgacctcaaaacc

SEQ ID NO: 22893 - DNA, 21 bp, Artificial Sequence
  Description of Artificial Sequence: Synthetic oligonucleotide
aacggcagcggccaaatccaa

SEQ ID NO: 22894 - DNA, 21 bp, Artificial Sequence
  Description of Artificial Sequence: Synthetic oligonucleotide
atggcgattgataaggggaag

SEQ ID NO: 22895 - DNA, 21 bp, Artificial Sequence
  Description of Artificial Sequence: Synthetic oligonucleotide
gaaagaagagaacacggcacc

SEQ ID NO: 22896 - DNA, 21 bp, Artificial Sequence
  Description of Artificial Sequence: Synthetic oligonucleotide
gagccggcggataagagttct

SEQ ID NO: 22897 - DNA, 21 bp, Artificial Sequence
  Description of Artificial Sequence: Synthetic oligonucleotide
gctacgacggttactcctaag

SEQ ID NO: 22898 - DNA, 21 bp, Artificial Sequence
  Description of Artificial Sequence: Synthetic oligonucleotide
ggcagcggccccgcccaacaa

SEQ ID NO: 22899 - DNA, 21 bp, Artificial Sequence
  Description of Artificial Sequence: Synthetic oligonucleotide
tcttctgttagttctacgagt

SEQ ID NO: 22900 - DNA, 21 bp, Artificial Sequence
  Description of Artificial Sequence: Synthetic oligonucleotide
aacaccagcagccccaccacc

SEQ ID NO: 22901 - DNA, 21 bp, Artificial Sequence
  Description of Artificial Sequence: Synthetic oligonucleotide
caaaccaccaccgccgccagc

SEQ ID NO: 22902 - DNA, 21 bp, Artificial Sequence
  Description of Artificial Sequence: Synthetic oligonucleotide
gtcagcgaaggcaccaccaaa

SEQ ID NO: 22903 - DNA, 21 bp, Artificial Sequence
  Description of Artificial Sequence: Synthetic oligonucleotide
gagtcgaggggtagttcttct

SEQ ID NO: 22904 - DNA, 21 bp, Artificial Sequence
  Description of Artificial Sequence: Synthetic oligonucleotide
acgatgcatggttctagtgcg

SEQ ID NO: 22905 - DNA, 21 bp, Artificial Sequence
  Description of Artificial Sequence: Synthetic oligonucleotide
agcaacgccaacaccgtccac

SEQ ID NO: 22906 - DNA, 21 bp, Artificial Sequence
  Description of Artificial Sequence: Synthetic oligonucleotide
agcctcggcgaaaaaagacaa

SEQ ID NO: 22907 - DNA, 21 bp, Artificial Sequence
  Description of Artificial Sequence: Synthetic oligonucleotide
cttgggcttaagacgtctaat

SEQ ID NO: 22908 - DNA, 21 bp, Artificial Sequence
  Description of Artificial Sequence: Synthetic oligonucleotide
gacaacgcccccgccaacaga

SEQ ID NO: 22909 - DNA, 21 bp, Artificial Sequence
  Description of Artificial Sequence: Synthetic oligonucleotide
gataatacggctgcggttaag

SEQ ID NO: 22910 - DNA, 21 bp, Artificial Sequence
  Description of Artificial Sequence: Synthetic oligonucleotide
gatcgtacgtctggtgttgcg

SEQ ID NO: 22911 - DNA, 21 bp, Artificial Sequence
  Description of Artificial Sequence: Synthetic oligonucleotide
gcggtttctggtaagtctatt

SEQ ID NO: 22912 - DNA, 21 bp, Artificial Sequence
  Description of Artificial Sequence: Synthetic oligonucleotide
gctatggggtcgagtcctggt

SEQ ID NO: 22913 - DNA, 21 bp, Artificial Sequence
  Description of Artificial Sequence: Synthetic oligonucleotide
ggcagcaaaggcagcccccac

SEQ ID NO: 22914 - DNA, 21 bp, Artificial Sequence
  Description of Artificial Sequence: Synthetic oligonucleotide
ggcggcgacagcgtcaccaaa

SEQ ID NO: 22915 - DNA, 21 bp, Artificial Sequence
  Description of Artificial Sequence: Synthetic oligonucleotide
gggaggacggatcagaattct

SEQ ID NO: 22916 - DNA, 21 bp, Artificial Sequence
  Description of Artificial Sequence: Synthetic oligonucleotide
ggtcaggctccggggtctact

SEQ ID NO: 22917 - DNA, 21 bp, Artificial Sequence
  Description of Artificial Sequence: Synthetic oligonucleotide
gtccaaagcagcaaaagcagc

SEQ ID NO: 22918 - DNA, 21 bp, Artificial Sequence
  Description of Artificial Sequence: Synthetic oligonucleotide
tcgcagggtaagtcgagttct

SEQ ID NO: 22919 - DNA, 21 bp, Artificial Sequence
  Description of Artificial Sequence: Synthetic oligonucleotide
acgcctacgggtgctggtggg

SEQ ID NO: 22920 - DNA, 21 bp, Artificial Sequence
  Description of Artificial Sequence: Synthetic oligonucleotide
agcaacgacgccggcaaaaac

SEQ ID NO: 22921 - DNA, 21 bp, Artificial Sequence
  Description of Artificial Sequence: Synthetic oligonucleotide
gctcctgggcgtgattcttcg

SEQ ID NO: 22922 - DNA, 21 bp, Artificial Sequence
  Description of Artificial Sequence: Synthetic oligonucleotide
ggcaacagcaccagcagcagc

SEQ ID NO: 22923 - DNA, 21 bp, Artificial Sequence
  Description of Artificial Sequence: Synthetic oligonucleotide
agcagcggcagcagcatgggc

SEQ ID NO: 22924 - DNA, 21 bp, Artificial Sequence
  Description of Artificial Sequence: Synthetic oligonucleotide
agtcatgggcagggtcctcag

SEQ ID NO: 22925 - DNA, 21 bp, Artificial Sequence
  Description of Artificial Sequence: Synthetic oligonucleotide
accaacgaaagcaccctcaga

SEQ ID NO: 22926 - DNA, 21 bp, Artificial Sequence
  Description of Artificial Sequence: Synthetic oligonucleotide
agtagtggtcagccgggtcgg

SEQ ID NO: 22927 - DNA, 21 bp, Artificial Sequence
  Description of Artificial Sequence: Synthetic oligonucleotide
cagcagatggataataagact

SEQ ID NO: 22928 - DNA, 21 bp, Artificial Sequence
  Description of Artificial Sequence: Synthetic oligonucleotide
gccgacggccaaagcagcagc

SEQ ID NO: 22929 - DNA, 21 bp, Artificial Sequence
  Description of Artificial Sequence: Synthetic oligonucleotide
ggcggccccagcagcgacaga

SEQ ID NO: 22930 - DNA, 21 bp, Artificial Sequence
  Description of Artificial Sequence: Synthetic oligonucleotide
aaccccgtcgcccaaggcaac

SEQ ID NO: 22931 - DNA, 21 bp, Artificial Sequence
  Description of Artificial Sequence: Synthetic oligonucleotide
aataatgataagtctggtctt

SEQ ID NO: 22932 - DNA, 21 bp, Artificial Sequence
  Description of Artificial Sequence: Synthetic oligonucleotide
actagttcttctgagaaggcg

SEQ ID NO: 22933 - DNA, 21 bp, Artificial Sequence
  Description of Artificial Sequence: Synthetic oligonucleotide
atcaccaacagcgccaccaga

SEQ ID NO: 22934 - DNA, 21 bp, Artificial Sequence
  Description of Artificial Sequence: Synthetic oligonucleotide
caggcggcgaaggatcagcat

SEQ ID NO: 22935 - DNA, 21 bp, Artificial Sequence
  Description of Artificial Sequence: Synthetic oligonucleotide
cattctagtacgggtggttct

SEQ ID NO: 22936 - DNA, 21 bp, Artificial Sequence
  Description of Artificial Sequence: Synthetic oligonucleotide
gaaagcggcagccaaaacaga

SEQ ID NO: 22937 - DNA, 21 bp, Artificial Sequence
  Description of Artificial Sequence: Synthetic oligonucleotide
gcggagggtaagactgctgcg

SEQ ID NO: 22938 - DNA, 21 bp, Artificial Sequence
  Description of Artificial Sequence: Synthetic oligonucleotide
ggcaccggcgccaacaccacc

SEQ ID NO: 22939 - DNA, 21 bp, Artificial Sequence
  Description of Artificial Sequence: Synthetic oligonucleotide
ggcatggccagcgccgacaaa

SEQ ID NO: 22940 - DNA, 21 bp, Artificial Sequence
  Description of Artificial Sequence: Synthetic oligonucleotide
tacaaagccggccaacaacaa

SEQ ID NO: 22941 - DNA, 21 bp, Artificial Sequence
  Description of Artificial Sequence: Synthetic oligonucleotide
tttcaggggagtaaggctggc

SEQ ID NO: 22942 - DNA, 21 bp, Artificial Sequence
  Description of Artificial Sequence: Synthetic oligonucleotide
tctcgtggtcagtcgtcgaat

SEQ ID NO: 22943 - DNA, 21 bp, Artificial Sequence
  Description of Artificial Sequence: Synthetic oligonucleotide
aaaggcagcagcaacagcacc

SEQ ID NO: 22944 - DNA, 21 bp, Artificial Sequence
  Description of Artificial Sequence: Synthetic oligonucleotide
agtccgagctctaagccttct

SEQ ID NO: 22945 - DNA, 21 bp, Artificial Sequence
  Description of Artificial Sequence: Synthetic oligonucleotide
agcagcgccaccgccagcgcc

SEQ ID NO: 22946 - DNA, 21 bp, Artificial Sequence
  Description of Artificial Sequence: Synthetic oligonucleotide
aagacggatacgagtgcgcat

SEQ ID NO: 22947 - DNA, 21 bp, Artificial Sequence
  Description of Artificial Sequence: Synthetic oligonucleotide
ggtaatgcgcctcctacgcgg

SEQ ID NO: 22948 - DNA, 21 bp, Artificial Sequence
  Description of Artificial Sequence: Synthetic oligonucleotide
tctcagaatcatacttcttcg

SEQ ID NO: 22949 - DNA, 21 bp, Artificial Sequence
  Description of Artificial Sequence: Synthetic oligonucleotide
agcgacaacaaaacccacacc

SEQ ID NO: 22950 - DNA, 21 bp, Artificial Sequence
  Description of Artificial Sequence: Synthetic oligonucleotide
ggcgtcgaaaaccccagagcc

SEQ ID NO: 22951 - DNA, 21 bp, Artificial Sequence
  Description of Artificial Sequence: Synthetic oligonucleotide
agccaacccagcagcgtcggc

SEQ ID NO: 22952 - DNA, 21 bp, Artificial Sequence
  Description of Artificial Sequence: Synthetic oligonucleotide
gatagtagtgctactaagttg

SEQ ID NO: 22953 - DNA, 21 bp, Artificial Sequence
  Description of Artificial Sequence: Synthetic oligonucleotide
gttcctaatagttctgcgggg

SEQ ID NO: 22954 - DNA, 21 bp, Artificial Sequence
  Description of Artificial Sequence: Synthetic oligonucleotide
tcgtcttcgaataagcctggg

SEQ ID NO: 22955 - DNA, 21 bp, Artificial Sequence
  Description of Artificial Sequence: Synthetic oligonucleotide
tgcaccggcacccccagcggc

SEQ ID NO: 22956 - DNA, 21 bp, Artificial Sequence
  Description of Artificial Sequence: Synthetic oligonucleotide
ttgactaatacggcttctcag

SEQ ID NO: 22957 - DNA, 21 bp, Artificial Sequence
  Description of Artificial Sequence: Synthetic oligonucleotide
gttagtgggggtgctgcgagg

SEQ ID NO: 22958 - DNA, 21 bp, Artificial Sequence
  Description of Artificial Sequence: Synthetic oligonucleotide
gtcagcaaacaacaaagcgcc

SEQ ID NO: 22959 - DNA, 21 bp, Artificial Sequence
  Description of Artificial Sequence: Synthetic oligonucleotide
ggcgtcaaccccagcgccagc

SEQ ID NO: 22960 - DNA, 21 bp, Artificial Sequence
  Description of Artificial Sequence: Synthetic oligonucleotide
agtgggtcgggggcgcctgct

SEQ ID NO: 22961 - DNA, 21 bp, Artificial Sequence
  Description of Artificial Sequence: Synthetic oligonucleotide
caaagcagcaacagcaacgcc

SEQ ID NO: 22962 - DNA, 21 bp, Artificial Sequence
  Description of Artificial Sequence: Synthetic oligonucleotide
accgccaccgccagcaaccaa

SEQ ID NO: 22963 - DNA, 21 bp, Artificial Sequence
  Description of Artificial Sequence: Synthetic oligonucleotide
ggggatggtcggtctccgaat

SEQ ID NO: 22964 - DNA, 21 bp, Artificial Sequence
  Description of Artificial Sequence: Synthetic oligonucleotide
aagtctgtgcctagtgttagt

SEQ ID NO: 22965 - DNA, 21 bp, Artificial Sequence
  Description of Artificial Sequence: Synthetic oligonucleotide
aatcagtcgtctggtgggtct

SEQ ID NO: 22966 - DNA, 21 bp, Artificial Sequence
  Description of Artificial Sequence: Synthetic oligonucleotide
agcagcgaaaaacccgccagc

SEQ ID NO: 22967 - DNA, 21 bp, Artificial Sequence
  Description of Artificial Sequence: Synthetic oligonucleotide
agtacgaaggctagtaatggt

SEQ ID NO: 22968 - DNA, 21 bp, Artificial Sequence
  Description of Artificial Sequence: Synthetic oligonucleotide
atttcttcgagtaaggttgtg

SEQ ID NO: 22969 - DNA, 21 bp, Artificial Sequence
  Description of Artificial Sequence: Synthetic oligonucleotide
caaagcagcagcagcaccagc

SEQ ID NO: 22970 - DNA, 21 bp, Artificial Sequence
  Description of Artificial Sequence: Synthetic oligonucleotide
gaaagagtccccagcagcggc

SEQ ID NO: 22971 - DNA, 21 bp, Artificial Sequence
  Description of Artificial Sequence: Synthetic oligonucleotide
gataataggagttctaatgcg

SEQ ID NO: 22972 - DNA, 21 bp, Artificial Sequence
  Description of Artificial Sequence: Synthetic oligonucleotide
ggtgctgtggattcggttaag

SEQ ID NO: 22973 - DNA, 21 bp, Artificial Sequence
  Description of Artificial Sequence: Synthetic oligonucleotide
gtcacccaaggcgaaatgaaa

SEQ ID NO: 22974 - DNA, 21 bp, Artificial Sequence
  Description of Artificial Sequence: Synthetic oligonucleotide
gtggcgcagaatgcgccgact

SEQ ID NO: 22975 - DNA, 21 bp, Artificial Sequence
  Description of Artificial Sequence: Synthetic oligonucleotide
gttaataattctccgagtcag

SEQ ID NO: 22976 - DNA, 21 bp, Artificial Sequence
  Description of Artificial Sequence: Synthetic oligonucleotide
ctcagcggcaccgccagcaac

SEQ ID NO: 22977 - DNA, 21 bp, Artificial Sequence
  Description of Artificial Sequence: Synthetic oligonucleotide
gaaggcagagccagcagcgtc

SEQ ID NO: 22978 - DNA, 21 bp, Artificial Sequence
  Description of Artificial Sequence: Synthetic oligonucleotide
gacggcgccgccaccgtcaaa

SEQ ID NO: 22979 - DNA, 21 bp, Artificial Sequence
  Description of Artificial Sequence: Synthetic oligonucleotide
gtccaaggcaaagtcaccaac

SEQ ID NO: 22980 - DNA, 21 bp, Artificial Sequence
  Description of Artificial Sequence: Synthetic oligonucleotide
aatagtactaaggatgggtct

SEQ ID NO: 22981 - DNA, 21 bp, Artificial Sequence
  Description of Artificial Sequence: Synthetic oligonucleotide
agcaacagagaaagcatccaa

SEQ ID NO: 22982 - DNA, 21 bp, Artificial Sequence
  Description of Artificial Sequence: Synthetic oligonucleotide
agcagcagcaaacccaaagac

SEQ ID NO: 22983 - DNA, 21 bp, Artificial Sequence
  Description of Artificial Sequence: Synthetic oligonucleotide
cacgccaaaaacagcaacggc

SEQ ID NO: 22984 - DNA, 21 bp, Artificial Sequence
  Description of Artificial Sequence: Synthetic oligonucleotide
cttgatgggtcgaagatgggt

SEQ ID NO: 22985 - DNA, 21 bp, Artificial Sequence
  Description of Artificial Sequence: Synthetic oligonucleotide
gttagtactggggctacgagg

SEQ ID NO: 22986 - DNA, 21 bp, Artificial Sequence
  Description of Artificial Sequence: Synthetic oligonucleotide
agcagcgacaaaatcagaagc

SEQ ID NO: 22987 - DNA, 21 bp, Artificial Sequence
  Description of Artificial Sequence: Synthetic oligonucleotide
aatgaggttaggcagtctaat

SEQ ID NO: 22988 - DNA, 21 bp, Artificial Sequence
  Description of Artificial Sequence: Synthetic oligonucleotide
ctcaccggcgaccaagtcaaa

SEQ ID NO: 22989 - DNA, 21 bp, Artificial Sequence
  Description of Artificial Sequence: Synthetic oligonucleotide
gaacccggcaccagcgcccaa

SEQ ID NO: 22990 - DNA, 21 bp, Artificial Sequence
  Description of Artificial Sequence: Synthetic oligonucleotide
gctgagatgaagccggttctg

SEQ ID NO: 22991 - DNA, 21 bp, Artificial Sequence
  Description of Artificial Sequence: Synthetic oligonucleotide
acttctactgggacgcttaag

SEQ ID NO: 22992 - DNA, 21 bp, Artificial Sequence
  Description of Artificial Sequence: Synthetic oligonucleotide
agcggcaccagcagccccaac

SEQ ID NO: 22993 - DNA, 21 bp, Artificial Sequence
  Description of Artificial Sequence: Synthetic oligonucleotide
caccaacccgaacccagaggc

SEQ ID NO: 22994 - DNA, 21 bp, Artificial Sequence
  Description of Artificial Sequence: Synthetic oligonucleotide
cattcgggtggtactagtcat

SEQ ID NO: 22995 - DNA, 21 bp, Artificial Sequence
  Description of Artificial Sequence: Synthetic oligonucleotide
ctcagcaaaagcaccagcggc

SEQ ID NO: 22996 - DNA, 21 bp, Artificial Sequence
  Description of Artificial Sequence: Synthetic oligonucleotide
gataaggtgggtagtccgcct

SEQ ID NO: 22997 - DNA, 21 bp, Artificial Sequence
  Description of Artificial Sequence: Synthetic oligonucleotide
gatactcagaagtcttctcat

SEQ ID NO: 22998 - DNA, 21 bp, Artificial Sequence
  Description of Artificial Sequence: Synthetic oligonucleotide
actgataagcctgcgtctcgt

SEQ ID NO: 22999 - DNA, 21 bp, Artificial Sequence
  Description of Artificial Sequence: Synthetic oligonucleotide
agcaacagccccggcggcctc

SEQ ID NO: 23000 - DNA, 21 bp, Artificial Sequence
  Description of Artificial Sequence: Synthetic oligonucleotide
gatagtgcgaatactaaggct

SEQ ID NO: 23001 - DNA, 21 bp, Artificial Sequence
  Description of Artificial Sequence: Synthetic oligonucleotide
ggcctcaacaaaaccaccgaa

SEQ ID NO: 23002 - DNA, 21 bp, Artificial Sequence
  Description of Artificial Sequence: Synthetic oligonucleotide
ggcgtccaaggcgacagcatg

SEQ ID NO: 23003 - DNA, 21 bp, Artificial Sequence
  Description of Artificial Sequence: Synthetic oligonucleotide
gccagcgtcaaaagccaaccc

SEQ ID NO: 23004 - DNA, 21 bp, Artificial Sequence
  Description of Artificial Sequence: Synthetic oligonucleotide
cagggtacgagtcctacggtt

SEQ ID NO: 23005 - DNA, 21 bp, Artificial Sequence
  Description of Artificial Sequence: Synthetic oligonucleotide
accggcctccaaagcagcagc

SEQ ID NO: 23006 - DNA, 21 bp, Artificial Sequence
  Description of Artificial Sequence: Synthetic oligonucleotide
atgcccctcaaaagcggcgtc

SEQ ID NO: 23007 - DNA, 21 bp, Artificial Sequence
  Description of Artificial Sequence: Synthetic oligonucleotide
tctactactagtgctaatgtt

SEQ ID NO: 23008 - DNA, 21 bp, Artificial Sequence
  Description of Artificial Sequence: Synthetic oligonucleotide
gcgacttctggggatcgtact

SEQ ID NO: 23009 - DNA, 21 bp, Artificial Sequence
  Description of Artificial Sequence: Synthetic oligonucleotide
gtgagtggtaatcattctgct

SEQ ID NO: 23010 - DNA, 21 bp, Artificial Sequence
  Description of Artificial Sequence: Synthetic oligonucleotide
gaacccagcagagccgcccaa

SEQ ID NO: 23011 - DNA, 21 bp, Artificial Sequence
  Description of Artificial Sequence: Synthetic oligonucleotide
caagacggcagcaacagaagc

SEQ ID NO: 23012 - DNA, 21 bp, Artificial Sequence
  Description of Artificial Sequence: Synthetic oligonucleotide
aattcgtctcctggtctgaat

SEQ ID NO: 23013 - DNA, 21 bp, Artificial Sequence
  Description of Artificial Sequence: Synthetic oligonucleotide
atgggcagcagccccaacatc

SEQ ID NO: 23014 - DNA, 21 bp, Artificial Sequence
  Description of Artificial Sequence: Synthetic oligonucleotide
catacgcaggataagttgtcg

SEQ ID NO: 23015 - DNA, 21 bp, Artificial Sequence
  Description of Artificial Sequence: Synthetic oligonucleotide
ctcaacagcaccagcaccacc

SEQ ID NO: 23016 - DNA, 21 bp, Artificial Sequence
  Description of Artificial Sequence: Synthetic oligonucleotide
ctgggtgggactactggtaag

SEQ ID NO: 23017 - DNA, 21 bp, Artificial Sequence
  Description of Artificial Sequence: Synthetic oligonucleotide
gatagtggtaatgataggtct

SEQ ID NO: 23018 - DNA, 21 bp, Artificial Sequence
  Description of Artificial Sequence: Synthetic oligonucleotide
gccgccgaaggcaacaaaaaa

SEQ ID NO: 23019 - DNA, 21 bp, Artificial Sequence
  Description of Artificial Sequence: Synthetic oligonucleotide
ggcggcaccaaaagcgccgtc

SEQ ID NO: 23020 - DNA, 21 bp, Artificial Sequence
  Description of Artificial Sequence: Synthetic oligonucleotide
agcgacaaagaaagaggcaga

SEQ ID NO: 23021 - DNA, 21 bp, Artificial Sequence
  Description of Artificial Sequence: Synthetic oligonucleotide
gtcagcagcagcaccgtcagc

SEQ ID NO: 23022 - DNA, 21 bp, Artificial Sequence
  Description of Artificial Sequence: Synthetic oligonucleotide
gaaagcccccaacaaagcgcc

SEQ ID NO: 23023 - DNA, 21 bp, Artificial Sequence
  Description of Artificial Sequence: Synthetic oligonucleotide
cagagtaatggggctgttagt

SEQ ID NO: 23024 - DNA, 21 bp, Artificial Sequence
  Description of Artificial Sequence: Synthetic oligonucleotide
cgtacgggtaatacttctatg

SEQ ID NO: 23025 - DNA, 21 bp, Artificial Sequence
  Description of Artificial Sequence: Synthetic oligonucleotide
gggagttctaagactgctcct

SEQ ID NO: 23026 - DNA, 21 bp, Artificial Sequence
  Description of Artificial Sequence: Synthetic oligonucleotide
agccaaagcgccagccacagc

SEQ ID NO: 23027 - DNA, 21 bp, Artificial Sequence
  Description of Artificial Sequence: Synthetic oligonucleotide
agccacgccagcaacaacgtc

SEQ ID NO: 23028 - DNA, 21 bp, Artificial Sequence
  Description of Artificial Sequence: Synthetic oligonucleotide
agcagcgccaaaggcagcggc

SEQ ID NO: 23029 - DNA, 21 bp, Artificial Sequence
  Description of Artificial Sequence: Synthetic oligonucleotide
agcggcagcaccagcatggtc

SEQ ID NO: 23030 - DNA, 21 bp, Artificial Sequence
  Description of Artificial Sequence: Synthetic oligonucleotide
atccccaaacaaagcgtcggc

SEQ ID NO: 23031 - DNA, 21 bp, Artificial Sequence
  Description of Artificial Sequence: Synthetic oligonucleotide
caaggcaaccaaacccccgtc

SEQ ID NO: 23032 - DNA, 21 bp, Artificial Sequence
  Description of Artificial Sequence: Synthetic oligonucleotide
actgataagggtgctggttct

SEQ ID NO: 23033 - DNA, 21 bp, Artificial Sequence
  Description of Artificial Sequence: Synthetic oligonucleotide
atcagcgaaggcaccgccaga

SEQ ID NO: 23034 - DNA, 21 bp, Artificial Sequence
  Description of Artificial Sequence: Synthetic oligonucleotide
ggcagcctcagccaaagcggc

SEQ ID NO: 23035 - DNA, 21 bp, Artificial Sequence
  Description of Artificial Sequence: Synthetic oligonucleotide
ggccccgacagcgccctcaga

SEQ ID NO: 23036 - DNA, 21 bp, Artificial Sequence
  Description of Artificial Sequence: Synthetic oligonucleotide
ggtagtctgccgcaggatcgt

SEQ ID NO: 23037 - DNA, 21 bp, Artificial Sequence
  Description of Artificial Sequence: Synthetic oligonucleotide
aagattgagacggggggtggg

SEQ ID NO: 23038 - DNA, 21 bp, Artificial Sequence
  Description of Artificial Sequence: Synthetic oligonucleotide
cacggcgaaaacgtccaaggc

SEQ ID NO: 23039 - DNA, 21 bp, Artificial Sequence
  Description of Artificial Sequence: Synthetic oligonucleotide
gacagcgccaacacccacaaa

SEQ ID NO: 23040 - DNA, 21 bp, Artificial Sequence
  Description of Artificial Sequence: Synthetic oligonucleotide
ggcagcgaaaaagaaagacac

SEQ ID NO: 23041 - DNA, 21 bp, Artificial Sequence
  Description of Artificial Sequence: Synthetic oligonucleotide
ggcctcgtcaaagaaggcagc

SEQ ID NO: 23042 - DNA, 21 bp, Artificial Sequence
  Description of Artificial Sequence: Synthetic oligonucleotide
gtcgccagcagaagcaacggc

SEQ ID NO: 23043 - DNA, 21 bp, Artificial Sequence
  Description of Artificial Sequence: Synthetic oligonucleotide
gatgcggctgtggcgcgtagt

SEQ ID NO: 23044 - DNA, 21 bp, Artificial Sequence
  Description of Artificial Sequence: Synthetic oligonucleotide
agcccccaaaacaacggcagc

SEQ ID NO: 23045 - DNA, 21 bp, Artificial Sequence
  Description of Artificial Sequence: Synthetic oligonucleotide
gggtctactcctgggctttct

SEQ ID NO: 23046 - DNA, 21 bp, Artificial Sequence
  Description of Artificial Sequence: Synthetic oligonucleotide
agtgctagtgggtctggtaat

SEQ ID NO: 23047 - DNA, 21 bp, Artificial Sequence
  Description of Artificial Sequence: Synthetic oligonucleotide
cagggtgctcctattaatggt

SEQ ID NO: 23048 - DNA, 21 bp, Artificial Sequence
  Description of Artificial Sequence: Synthetic oligonucleotide
ggcagcaaaagcgccctccaa

SEQ ID NO: 23049 - DNA, 21 bp, Artificial Sequence
  Description of Artificial Sequence: Synthetic oligonucleotide
tcgcttgctgggggtcagggg

SEQ ID NO: 23050 - DNA, 21 bp, Artificial Sequence
  Description of Artificial Sequence: Synthetic oligonucleotide
ctgggtaagcagcagacgggg

SEQ ID NO: 23051 - DNA, 21 bp, Artificial Sequence
  Description of Artificial Sequence: Synthetic oligonucleotide
atcaaaaacagccaaagcacc

SEQ ID NO: 23052 - DNA, 21 bp, Artificial Sequence
  Description of Artificial Sequence: Synthetic oligonucleotide
aacagcctcgacagacccatg

SEQ ID NO: 23053 - DNA, 21 bp, Artificial Sequence
  Description of Artificial Sequence: Synthetic oligonucleotide
accaccggcagcggcgccacc

SEQ ID NO: 23054 - DNA, 21 bp, Artificial Sequence
  Description of Artificial Sequence: Synthetic oligonucleotide
accagcggcagcagaaacggc

SEQ ID NO: 23055 - DNA, 21 bp, Artificial Sequence
  Description of Artificial Sequence: Synthetic oligonucleotide
caacccggcagcgaaagacaa

SEQ ID NO: 23056 - DNA, 21 bp, Artificial Sequence
  Description of Artificial Sequence: Synthetic oligonucleotide
atgcaaagcgcccccagcacc

SEQ ID NO: 23057 - DNA, 21 bp, Artificial Sequence
  Description of Artificial Sequence: Synthetic oligonucleotide
agagaaagcgacagccccaaa

SEQ ID NO: 23058 - DNA, 21 bp, Artificial Sequence
  Description of Artificial Sequence: Synthetic oligonucleotide
caacccgtcagcaaaaccgcc

SEQ ID NO: 23059 - DNA, 21 bp, Artificial Sequence
  Description of Artificial Sequence: Synthetic oligonucleotide
agcggccaacccgtcaaaggc

SEQ ID NO: 23060 - DNA, 21 bp, Artificial Sequence
  Description of Artificial Sequence: Synthetic oligonucleotide
agtgggttgagtagtaagcag

SEQ ID NO: 23061 - DNA, 21 bp, Artificial Sequence
  Description of Artificial Sequence: Synthetic oligonucleotide
cagccgacggatggttcgaag

SEQ ID NO: 23062 - DNA, 21 bp, Artificial Sequence
  Description of Artificial Sequence: Synthetic oligonucleotide
gaggggaattctattcataag

SEQ ID NO: 23063 - DNA, 21 bp, Artificial Sequence
  Description of Artificial Sequence: Synthetic oligonucleotide
accaccacccaagccaaaatg

SEQ ID NO: 23064 - DNA, 21 bp, Artificial Sequence
  Description of Artificial Sequence: Synthetic oligonucleotide
aatgctgcttctaagcctttg

SEQ ID NO: 23065 - DNA, 21 bp, Artificial Sequence
  Description of Artificial Sequence: Synthetic oligonucleotide
ggtgcggggaatcagcctaag

SEQ ID NO: 23066 - DNA, 21 bp, Artificial Sequence
  Description of Artificial Sequence: Synthetic oligonucleotide
ggcaaagtcgacaaagacaaa

SEQ ID NO: 23067 - DNA, 21 bp, Artificial Sequence
  Description of Artificial Sequence: Synthetic oligonucleotide
gctggggtgcagggggctact

SEQ ID NO: 23068 - DNA, 21 bp, Artificial Sequence
  Description of Artificial Sequence: Synthetic oligonucleotide
agccccgacgtcaaagtcgcc

SEQ ID NO: 23069 - DNA, 21 bp, Artificial Sequence
  Description of Artificial Sequence: Synthetic oligonucleotide
atccccagcagcaaagccgtc

SEQ ID NO: 23070 - DNA, 21 bp, Artificial Sequence
  Description of Artificial Sequence: Synthetic oligonucleotide
gatcagggtagtcataatcgc

SEQ ID NO: 23071 - DNA, 21 bp, Artificial Sequence
  Description of Artificial Sequence: Synthetic oligonucleotide
aaagccgaagccaacacccaa

SEQ ID NO: 23072 - DNA, 21 bp, Artificial Sequence
  Description of Artificial Sequence: Synthetic oligonucleotide
aaggatagtgcggggggttct

SEQ ID NO: 23073 - DNA, 21 bp, Artificial Sequence
  Description of Artificial Sequence: Synthetic oligonucleotide
acggctgagaagagtcttgtt

SEQ ID NO: 23074 - DNA, 21 bp, Artificial Sequence
  Description of Artificial Sequence: Synthetic oligonucleotide
agcgtcgcccacaccagcgcc

SEQ ID NO: 23075 - DNA, 21 bp, Artificial Sequence
  Description of Artificial Sequence: Synthetic oligonucleotide
aatcctgaggctaagagtaag

SEQ ID NO: 23076 - DNA, 21 bp, Artificial Sequence
  Description of Artificial Sequence: Synthetic oligonucleotide
caggggacttctgtttcgggt

SEQ ID NO: 23077 - DNA, 21 bp, Artificial Sequence
  Description of Artificial Sequence: Synthetic oligonucleotide
gccaccaacaaagccggcctc

SEQ ID NO: 23078 - DNA, 21 bp, Artificial Sequence
  Description of Artificial Sequence: Synthetic oligonucleotide
agcaccagccaaagcaacctc

SEQ ID NO: 23079 - DNA, 21 bp, Artificial Sequence
  Description of Artificial Sequence: Synthetic oligonucleotide
catgcgggtgagcatcggact

SEQ ID NO: 23080 - DNA, 21 bp, Artificial Sequence
  Description of Artificial Sequence: Synthetic oligonucleotide
ggcagcagcagccaaagcagc

SEQ ID NO: 23081 - DNA, 21 bp, Artificial Sequence
  Description of Artificial Sequence: Synthetic oligonucleotide
accgtcggcagcgaaagaagc

SEQ ID NO: 23082 - DNA, 21 bp, Artificial Sequence
  Description of Artificial Sequence: Synthetic oligonucleotide
catagtagtgggagtaatgct

SEQ ID NO: 23083 - DNA, 21 bp, Artificial Sequence
  Description of Artificial Sequence: Synthetic oligonucleotide
cggtctgggaatgggatttcg

SEQ ID NO: 23084 - DNA, 21 bp, Artificial Sequence
  Description of Artificial Sequence: Synthetic oligonucleotide
gacagccaaagaagcaaccaa

SEQ ID NO: 23085 - DNA, 21 bp, Artificial Sequence
  Description of Artificial Sequence: Synthetic oligonucleotide
gacagccacaaaggcagcaaa

SEQ ID NO: 23086 - DNA, 21 bp, Artificial Sequence
  Description of Artificial Sequence: Synthetic oligonucleotide
ggtacgtcgaagtctgagagg

SEQ ID NO: 23087 - DNA, 21 bp, Artificial Sequence
  Description of Artificial Sequence: Synthetic oligonucleotide
gtggctacgaatactcctaag

SEQ ID NO: 23088 - DNA, 21 bp, Artificial Sequence
  Description of Artificial Sequence: Synthetic oligonucleotide
tctgggggtcagtcggcgcat

SEQ ID NO: 23089 - DNA, 21 bp, Artificial Sequence
  Description of Artificial Sequence: Synthetic oligonucleotide
agcggcgtcgacctcaaaacc

SEQ ID NO: 23090 - DNA, 21 bp, Artificial Sequence
  Description of Artificial Sequence: Synthetic oligonucleotide
accgccggcagccaacacacc

SEQ ID NO: 23091 - DNA, 21 bp, Artificial Sequence
  Description of Artificial Sequence: Synthetic oligonucleotide
caccaaagcggcagcggcagc

SEQ ID NO: 23092 - DNA, 21 bp, Artificial Sequence
  Description of Artificial Sequence: Synthetic oligonucleotide
ggggatggtcctcctactagg

SEQ ID NO: 23093 - DNA, 21 bp, Artificial Sequence
  Description of Artificial Sequence: Synthetic oligonucleotide
aagcagttgtcggctacgacg

SEQ ID NO: 23094 - DNA, 21 bp, Artificial Sequence
  Description of Artificial Sequence: Synthetic oligonucleotide
agcagcgccaaagccagcccc

SEQ ID NO: 23095 - DNA, 21 bp, Artificial Sequence
  Description of Artificial Sequence: Synthetic oligonucleotide
catccgtcgcaggcgtctaag

SEQ ID NO: 23096 - DNA, 21 bp, Artificial Sequence
  Description of Artificial Sequence: Synthetic oligonucleotide
gaaagaaacagcaaactcagc

SEQ ID NO: 23097 - DNA, 21 bp, Artificial Sequence
  Description of Artificial Sequence: Synthetic oligonucleotide
gtgcctgatacgggtcgtaag

SEQ ID NO: 23098 - DNA, 21 bp, Artificial Sequence
  Description of Artificial Sequence: Synthetic oligonucleotide
gagtctaagcctagttcgggt

SEQ ID NO: 23099 - DNA, 21 bp, Artificial Sequence
  Description of Artificial Sequence: Synthetic oligonucleotide
agcatcagcacccccaccagc

SEQ ID NO: 23100 - DNA, 21 bp, Artificial Sequence
  Description of Artificial Sequence: Synthetic oligonucleotide
gcccaaggcagccccatcaac

SEQ ID NO: 23101 - DNA, 21 bp, Artificial Sequence
  Description of Artificial Sequence: Synthetic oligonucleotide
cagcctaattctccgtctgtt

SEQ ID NO: 23102 - DNA, 21 bp, Artificial Sequence
  Description of Artificial Sequence: Synthetic oligonucleotide
ggtgttaattcggcttcgcat

SEQ ID NO: 23103 - DNA, 21 bp, Artificial Sequence
  Description of Artificial Sequence: Synthetic oligonucleotide
acgtcgaatactaagcagggt

SEQ ID NO: 23104 - DNA, 21 bp, Artificial Sequence
  Description of Artificial Sequence: Synthetic oligonucleotide
gaaagcagcagcagcgtcagc

SEQ ID NO: 23105 - DNA, 21 bp, Artificial Sequence
  Description of Artificial Sequence: Synthetic oligonucleotide
gtgaatgcgaagcctagtctt

SEQ ID NO: 23106 - DNA, 21 bp, Artificial Sequence
  Description of Artificial Sequence: Synthetic oligonucleotide
gggagggatgttcctactagg

SEQ ID NO: 23107 - DNA, 21 bp, Artificial Sequence
  Description of Artificial Sequence: Synthetic oligonucleotide
gagggtgtgactaagaataag

SEQ ID NO: 23108 - DNA, 21 bp, Artificial Sequence
  Description of Artificial Sequence: Synthetic oligonucleotide
gcggctagtcctgctacggcg

SEQ ID NO: 23109 - DNA, 21 bp, Artificial Sequence
  Description of Artificial Sequence: Synthetic oligonucleotide
accagagaaggcgcccccagc

SEQ ID NO: 23110 - DNA, 21 bp, Artificial Sequence
  Description of Artificial Sequence: Synthetic oligonucleotide
aacgtcaacaaaatcagagac

SEQ ID NO: 23111 - DNA, 21 bp, Artificial Sequence
  Description of Artificial Sequence: Synthetic oligonucleotide
gctggtggtaaggggctgaat

SEQ ID NO: 23112 - DNA, 21 bp, Artificial Sequence
  Description of Artificial Sequence: Synthetic oligonucleotide
tcgggtcatgggagtaattcg

SEQ ID NO: 23113 - DNA, 21 bp, Artificial Sequence
  Description of Artificial Sequence: Synthetic oligonucleotide
ctcgaaggcaaacccaaccaa

SEQ ID NO: 23114 - DNA, 21 bp, Artificial Sequence
  Description of Artificial Sequence: Synthetic oligonucleotide
aaaaaagccaccaccaacgaa

SEQ ID NO: 23115 - DNA, 21 bp, Artificial Sequence
  Description of Artificial Sequence: Synthetic oligonucleotide
aaaagcgacgacaaaaccaga

SEQ ID NO: 23116 - DNA, 21 bp, Artificial Sequence
  Description of Artificial Sequence: Synthetic oligonucleotide
aacagcaccagcgtcaacgcc

SEQ ID NO: 23117 - DNA, 21 bp, Artificial Sequence
  Description of Artificial Sequence: Synthetic oligonucleotide
aaggaggataagattaattcg

SEQ ID NO: 23118 - DNA, 21 bp, Artificial Sequence
  Description of Artificial Sequence: Synthetic oligonucleotide
aagggttctggttcgaatgtg

SEQ ID NO: 23119 - DNA, 21 bp, Artificial Sequence
  Description of Artificial Sequence: Synthetic oligonucleotide
aatattggttcgcagaagggt

SEQ ID NO: 23120 - DNA, 21 bp, Artificial Sequence
  Description of Artificial Sequence: Synthetic oligonucleotide
aattctgggcaggttgtggcg

SEQ ID NO: 23121 - DNA, 21 bp, Artificial Sequence
  Description of Artificial Sequence: Synthetic oligonucleotide
accacccaaaacagcagcgcc

SEQ ID NO: 23122 - DNA, 21 bp, Artificial Sequence
  Description of Artificial Sequence: Synthetic oligonucleotide
accggccaacacaccagcagc

SEQ ID NO: 23123 - DNA, 21 bp, Artificial Sequence
  Description of Artificial Sequence: Synthetic oligonucleotide
acgaggaatagtcctggtgag

SEQ ID NO: 23124 - DNA, 21 bp, Artificial Sequence
  Description of Artificial Sequence: Synthetic oligonucleotide
acggatgataggagttctcag

SEQ ID NO: 23125 - DNA, 21 bp, Artificial Sequence
  Description of Artificial Sequence: Synthetic oligonucleotide
acttcgagggagaagattact

SEQ ID NO: 23126 - DNA, 21 bp, Artificial Sequence
  Description of Artificial Sequence: Synthetic oligonucleotide
agagacaacaccagaagcagc

SEQ ID NO: 23127 - DNA, 21 bp, Artificial Sequence
  Description of Artificial Sequence: Synthetic oligonucleotide
agcaaagaccaaagcaccggc

SEQ ID NO: 23128 - DNA, 21 bp, Artificial Sequence
  Description of Artificial Sequence: Synthetic oligonucleotide
agcaaccacggcgaaaaaggc

SEQ ID NO: 23129 - DNA, 21 bp, Artificial Sequence
  Description of Artificial Sequence: Synthetic oligonucleotide
agcaccaacagcagccacgcc

SEQ ID NO: 23130 - DNA, 21 bp, Artificial Sequence
  Description of Artificial Sequence: Synthetic oligonucleotide
agcagcgacggcacccacgcc

SEQ ID NO: 23131 - DNA, 21 bp, Artificial Sequence
  Description of Artificial Sequence: Synthetic oligonucleotide
agccaaaaagaacaccccacc

SEQ ID NO: 23132 - DNA, 21 bp, Artificial Sequence
  Description of Artificial Sequence: Synthetic oligonucleotide
agcgccagcagcagcctcaaa

SEQ ID NO: 23133 - DNA, 21 bp, Artificial Sequence
  Description of Artificial Sequence: Synthetic oligonucleotide
atcgccaccggcctcaccaaa

SEQ ID NO: 23134 - DNA, 21 bp, Artificial Sequence
  Description of Artificial Sequence: Synthetic oligonucleotide
atgaaagacacccacgccagc

SEQ ID NO: 23135 - DNA, 21 bp, Artificial Sequence
  Description of Artificial Sequence: Synthetic oligonucleotide
caaaacaccaccagcgtcctc

SEQ ID NO: 23136 - DNA, 21 bp, Artificial Sequence
  Description of Artificial Sequence: Synthetic oligonucleotide
caaaacgccaccagaagcgaa

SEQ ID NO: 23137 - DNA, 21 bp, Artificial Sequence
  Description of Artificial Sequence: Synthetic oligonucleotide
cagcatgggaaggatctgggg

SEQ ID NO: 23138 - DNA, 21 bp, Artificial Sequence
  Description of Artificial Sequence: Synthetic oligonucleotide
caggggcatgatagtgctagg

SEQ ID NO: 23139 - DNA, 21 bp, Artificial Sequence
  Description of Artificial Sequence: Synthetic oligonucleotide
cggaatgagggtggtatgact

SEQ ID NO: 23140 - DNA, 21 bp, Artificial Sequence
  Description of Artificial Sequence: Synthetic oligonucleotide
cggggtgataatcctgctagt

SEQ ID NO: 23141 - DNA, 21 bp, Artificial Sequence
  Description of Artificial Sequence: Synthetic oligonucleotide
ctcgccaccgaaaaaagcacc

SEQ ID NO: 23142 - DNA, 21 bp, Artificial Sequence
  Description of Artificial Sequence: Synthetic oligonucleotide
cttactgagacgcctaagagt

SEQ ID NO: 23143 - DNA, 21 bp, Artificial Sequence
  Description of Artificial Sequence: Synthetic oligonucleotide
gaaaacacccaaggcggcaga

SEQ ID NO: 23144 - DNA, 21 bp, Artificial Sequence
  Description of Artificial Sequence: Synthetic oligonucleotide
gaacccaccgccagcgtcaga

SEQ ID NO: 23145 - DNA, 21 bp, Artificial Sequence
  Description of Artificial Sequence: Synthetic oligonucleotide
gacaacagagccagcgccacc

SEQ ID NO: 23146 - DNA, 21 bp, Artificial Sequence
  Description of Artificial Sequence: Synthetic oligonucleotide
gacaacagcaacaaaatgggc

SEQ ID NO: 23147 - DNA, 21 bp, Artificial Sequence
  Description of Artificial Sequence: Synthetic oligonucleotide
gagagttctaataatttgaag

SEQ ID NO: 23148 - DNA, 21 bp, Artificial Sequence
  Description of Artificial Sequence: Synthetic oligonucleotide
gataatgataggggtaagtcg

SEQ ID NO: 23149 - DNA, 21 bp, Artificial Sequence
  Description of Artificial Sequence: Synthetic oligonucleotide
gattcgcataagggtattagt

SEQ ID NO: 23150 - DNA, 21 bp, Artificial Sequence
  Description of Artificial Sequence: Synthetic oligonucleotide
gccaccggcggcggcggcgcc

SEQ ID NO: 23151 - DNA, 21 bp, Artificial Sequence
  Description of Artificial Sequence: Synthetic oligonucleotide
gccgccaccggccaaatgagc

SEQ ID NO: 23152 - DNA, 21 bp, Artificial Sequence
  Description of Artificial Sequence: Synthetic oligonucleotide
gccgccagcaaaagcagcgaa

SEQ ID NO: 23153 - DNA, 21 bp, Artificial Sequence
  Description of Artificial Sequence: Synthetic oligonucleotide
gccggccccagcagccccacc

SEQ ID NO: 23154 - DNA, 21 bp, Artificial Sequence
  Description of Artificial Sequence: Synthetic oligonucleotide
gccggcgcccccaacaaaacc

SEQ ID NO: 23155 - DNA, 21 bp, Artificial Sequence
  Description of Artificial Sequence: Synthetic oligonucleotide
gcgactaaggaggggattgct

SEQ ID NO: 23156 - DNA, 21 bp, Artificial Sequence
  Description of Artificial Sequence: Synthetic oligonucleotide
gctaatagttctacggagaag

SEQ ID NO: 23157 - DNA, 21 bp, Artificial Sequence
  Description of Artificial Sequence: Synthetic oligonucleotide
gctgataggcctactactgtt

SEQ ID NO: 23158 - DNA, 21 bp, Artificial Sequence
  Description of Artificial Sequence: Synthetic oligonucleotide
ggcaacagccaaagcagcggc

SEQ ID NO: 23159 - DNA, 21 bp, Artificial Sequence
  Description of Artificial Sequence: Synthetic oligonucleotide
ggcaccaccaccgccggcaga

SEQ ID NO: 23160 - DNA, 21 bp, Artificial Sequence
  Description of Artificial Sequence: Synthetic oligonucleotide
ggcaccctcgccgacaccaaa

SEQ ID NO: 23161 - DNA, 21 bp, Artificial Sequence
  Description of Artificial Sequence: Synthetic oligonucleotide
ggcagcaaaaccgacatgaga

SEQ ID NO: 23162 - DNA, 21 bp, Artificial Sequence
  Description of Artificial Sequence: Synthetic oligonucleotide
ggcggcatcagcaacagcgcc

SEQ ID NO: 23163 - DNA, 21 bp, Artificial Sequence
  Description of Artificial Sequence: Synthetic oligonucleotide
ggcgtccccctcagcaccggc

SEQ ID NO: 23164 - DNA, 21 bp, Artificial Sequence
  Description of Artificial Sequence: Synthetic oligonucleotide
ggggtgaatcgtgatgctgcg

SEQ ID NO: 23165 - DNA, 21 bp, Artificial Sequence
  Description of Artificial Sequence: Synthetic oligonucleotide
ggtacgactggacagatggtt

SEQ ID NO: 23166 - DNA, 21 bp, Artificial Sequence
  Description of Artificial Sequence: Synthetic oligonucleotide
ggtactactttgagtgagaag

SEQ ID NO: 23167 - DNA, 21 bp, Artificial Sequence
  Description of Artificial Sequence: Synthetic oligonucleotide
ggtctggatacgcagaaggct

SEQ ID NO: 23168 - DNA, 21 bp, Artificial Sequence
  Description of Artificial Sequence: Synthetic oligonucleotide
ggtgggttgcaggaggttaag

SEQ ID NO: 23169 - DNA, 21 bp, Artificial Sequence
  Description of Artificial Sequence: Synthetic oligonucleotide
gtcggcagcagcggccacgtc

SEQ ID NO: 23170 - DNA, 21 bp, Artificial Sequence
  Description of Artificial Sequence: Synthetic oligonucleotide
gtcggccaaagagacaccggc

SEQ ID NO: 23171 - DNA, 21 bp, Artificial Sequence
  Description of Artificial Sequence: Synthetic oligonucleotide
gtgaataattcgtctacgacg

SEQ ID NO: 23172 - DNA, 21 bp, Artificial Sequence
  Description of Artificial Sequence: Synthetic oligonucleotide
gtgacgcagtctgctaatggt

SEQ ID NO: 23173 - DNA, 21 bp, Artificial Sequence
  Description of Artificial Sequence: Synthetic oligonucleotide
gttacttctaattcgagtgtt

SEQ ID NO: 23174 - DNA, 21 bp, Artificial Sequence
  Description of Artificial Sequence: Synthetic oligonucleotide
tatggggatagtccgaagaat

SEQ ID NO: 23175 - DNA, 21 bp, Artificial Sequence
  Description of Artificial Sequence: Synthetic oligonucleotide
tcgggtagtcaggctgttttg

SEQ ID NO: 23176 - DNA, 21 bp, Artificial Sequence
  Description of Artificial Sequence: Synthetic oligonucleotide
tctcctcctgagcataaggtg

SEQ ID NO: 23177 - DNA, 21 bp, Artificial Sequence
  Description of Artificial Sequence: Synthetic oligonucleotide
ttggcgacgtcgtctacgggt

SEQ ID NO: 23178 - DNA, 21 bp, Artificial Sequence
  Description of Artificial Sequence: Synthetic oligonucleotide
tctcagcgtccgagttcggtt

SEQ ID NO: 23179 - DNA, 21 bp, Artificial Sequence
  Description of Artificial Sequence: Synthetic oligonucleotide
agtagtcgtgattcgaagtct

SEQ ID NO: 23180 - DNA, 21 bp, Artificial Sequence
  Description of Artificial Sequence: Synthetic oligonucleotide
gggatgggtgggcagaatgtg

SEQ ID NO: 23181 - DNA, 21 bp, Artificial Sequence
  Description of Artificial Sequence: Synthetic oligonucleotide
gcgggtcgtagtgataagggt

SEQ ID NO: 23182 - DNA, 21 bp, Artificial Sequence
  Description of Artificial Sequence: Synthetic oligonucleotide
agcgccaccaccagcgaaaga

SEQ ID NO: 23183 - DNA, 21 bp, Artificial Sequence
  Description of Artificial Sequence: Synthetic oligonucleotide
agtgctaatgcggctcgtaat

SEQ ID NO: 23184 - DNA, 21 bp, Artificial Sequence
  Description of Artificial Sequence: Synthetic oligonucleotide
agcggcgccaccccccccaga

SEQ ID NO: 23185 - DNA, 21 bp, Artificial Sequence
  Description of Artificial Sequence: Synthetic oligonucleotide
aaccacgaaggcaaagtccaa

SEQ ID NO: 23186 - DNA, 21 bp, Artificial Sequence
  Description of Artificial Sequence: Synthetic oligonucleotide
gttcgtgatggttctaatgtt

SEQ ID NO: 23187 - DNA, 21 bp, Artificial Sequence
  Description of Artificial Sequence: Synthetic oligonucleotide
agcctcaccagaagcagcgtc

SEQ ID NO: 23188 - DNA, 21 bp, Artificial Sequence
  Description of Artificial Sequence: Synthetic oligonucleotide
cagactcttggtggtagtggt

SEQ ID NO: 23189 - DNA, 21 bp, Artificial Sequence
  Description of Artificial Sequence: Synthetic oligonucleotide
atgtctgatgggcattcgact

SEQ ID NO: 23190 - DNA, 21 bp, Artificial Sequence
  Description of Artificial Sequence: Synthetic oligonucleotide
ctcaccgccggcagcggcacc

SEQ ID NO: 23191 - DNA, 21 bp, Artificial Sequence
  Description of Artificial Sequence: Synthetic oligonucleotide
gatacgacttctaagcgtgct

SEQ ID NO: 23192 - DNA, 21 bp, Artificial Sequence
  Description of Artificial Sequence: Synthetic oligonucleotide
cacaccgccggcaacaacgtc

SEQ ID NO: 23193 - DNA, 21 bp, Artificial Sequence
  Description of Artificial Sequence: Synthetic oligonucleotide
gcccacagcgccaaagacgcc

SEQ ID NO: 23194 - DNA, 21 bp, Artificial Sequence
  Description of Artificial Sequence: Synthetic oligonucleotide
accaccgaaagcaccaccaga

SEQ ID NO: 23195 - DNA, 21 bp, Artificial Sequence
  Description of Artificial Sequence: Synthetic oligonucleotide
accaccgaagccagcaacaga

SEQ ID NO: 23196 - DNA, 21 bp, Artificial Sequence
  Description of Artificial Sequence: Synthetic oligonucleotide
gacagcaaaagcgcccacgcc

SEQ ID NO: 23197 - DNA, 21 bp, Artificial Sequence
  Description of Artificial Sequence: Synthetic oligonucleotide
ggcggcctcgacaaaggcgtc

SEQ ID NO: 23198 - DNA, 21 bp, Artificial Sequence
  Description of Artificial Sequence: Synthetic oligonucleotide
gtcaaagtcggcgaacaacac

SEQ ID NO: 23199 - DNA, 21 bp, Artificial Sequence
  Description of Artificial Sequence: Synthetic oligonucleotide
actaagtctaatggtaatact

SEQ ID NO: 23200 - DNA, 21 bp, Artificial Sequence
  Description of Artificial Sequence: Synthetic oligonucleotide
gttggggcgactccggttcag

SEQ ID NO: 23201 - DNA, 21 bp, Artificial Sequence
  Description of Artificial Sequence: Synthetic oligonucleotide
accaacgacagcaaaagcaaa

SEQ ID NO: 23202 - DNA, 21 bp, Artificial Sequence
  Description of Artificial Sequence: Synthetic oligonucleotide
atggccagcaacagccccgtc

SEQ ID NO: 23203 - DNA, 21 bp, Artificial Sequence
  Description of Artificial Sequence: Synthetic oligonucleotide
gagcctgcggacaagggtacg

SEQ ID NO: 23204 - DNA, 21 bp, Artificial Sequence
  Description of Artificial Sequence: Synthetic oligonucleotide
gtcaccaccgccggcggcagc

SEQ ID NO: 23205 - DNA, 21 bp, Artificial Sequence
  Description of Artificial Sequence: Synthetic oligonucleotide
gttagtactagttcgacgagg

SEQ ID NO: 23206 - DNA, 21 bp, Artificial Sequence
  Description of Artificial Sequence: Synthetic oligonucleotide
gctaattcgactaagacgatg

SEQ ID NO: 23207 - DNA, 21 bp, Artificial Sequence
  Description of Artificial Sequence: Synthetic oligonucleotide
gataaggttagggatactcag

SEQ ID NO: 23208 - DNA, 21 bp, Artificial Sequence
  Description of Artificial Sequence: Synthetic oligonucleotide
ggccccgtcggcagcagccaa

SEQ ID NO: 23209 - DNA, 21 bp, Artificial Sequence
  Description of Artificial Sequence: Synthetic oligonucleotide
atgaaaaccgaaagccaaatg

SEQ ID NO: 23210 - DNA, 21 bp, Artificial Sequence
  Description of Artificial Sequence: Synthetic oligonucleotide
accaccgacaaaggcagagac

SEQ ID NO: 23211 - DNA, 21 bp, Artificial Sequence
  Description of Artificial Sequence: Synthetic oligonucleotide
agacaaggcgacggcggcgtc

SEQ ID NO: 23212 - DNA, 21 bp, Artificial Sequence
  Description of Artificial Sequence: Synthetic oligonucleotide
ggcagcagcaacagcgccagc

SEQ ID NO: 23213 - DNA, 21 bp, Artificial Sequence
  Description of Artificial Sequence: Synthetic oligonucleotide
ggtcaggttggtactcatcct

SEQ ID NO: 23214 - DNA, 21 bp, Artificial Sequence
  Description of Artificial Sequence: Synthetic oligonucleotide
tctgaggtggctcagaagtct

SEQ ID NO: 23215 - DNA, 21 bp, Artificial Sequence
  Description of Artificial Sequence: Synthetic oligonucleotide
catggtactagttcgacttct

SEQ ID NO: 23216 - DNA, 21 bp, Artificial Sequence
  Description of Artificial Sequence: Synthetic oligonucleotide
ggggctgaggggagtattcgg

SEQ ID NO: 23217 - DNA, 21 bp, Artificial Sequence
  Description of Artificial Sequence: Synthetic oligonucleotide
ttcgaacaaggcagcagaagc

SEQ ID NO: 23218 - DNA, 21 bp, Artificial Sequence
  Description of Artificial Sequence: Synthetic oligonucleotide
gccaacaaaagcagcgccatg

SEQ ID NO: 23219 - DNA, 21 bp, Artificial Sequence
  Description of Artificial Sequence: Synthetic oligonucleotide
ctcgacaaaaacggcagcgcc

SEQ ID NO: 23220 - DNA, 21 bp, Artificial Sequence
  Description of Artificial Sequence: Synthetic oligonucleotide
gaaaaaagcaacagcaacggc

SEQ ID NO: 23221 - DNA, 21 bp, Artificial Sequence
  Description of Artificial Sequence: Synthetic oligonucleotide
ggttcgaatcagcggactact

SEQ ID NO: 23222 - DNA, 21 bp, Artificial Sequence
  Description of Artificial Sequence: Synthetic oligonucleotide
agcggcagcagccccttcaaa

SEQ ID NO: 23223 - DNA, 21 bp, Artificial Sequence
  Description of Artificial Sequence: Synthetic oligonucleotide
agaaacgccgaaaaagccgtc

SEQ ID NO: 23224 - DNA, 21 bp, Artificial Sequence
  Description of Artificial Sequence: Synthetic oligonucleotide
agccaagaaaaaaacagcgcc

SEQ ID NO: 23225 - DNA, 21 bp, Artificial Sequence
  Description of Artificial Sequence: Synthetic oligonucleotide
caaaacggcaaacaagccccc

SEQ ID NO: 23226 - DNA, 21 bp, Artificial Sequence
  Description of Artificial Sequence: Synthetic oligonucleotide
cggcagaattctaaggatact

SEQ ID NO: 23227 - DNA, 21 bp, Artificial Sequence
  Description of Artificial Sequence: Synthetic oligonucleotide
gccagcgaaaaagccagcctc

SEQ ID NO: 23228 - DNA, 21 bp, Artificial Sequence
  Description of Artificial Sequence: Synthetic oligonucleotide
ctcggcagcaacagccccacc

SEQ ID NO: 23229 - DNA, 21 bp, Artificial Sequence
  Description of Artificial Sequence: Synthetic oligonucleotide
actagtgagagtaagtcggcg

SEQ ID NO: 23230 - DNA, 21 bp, Artificial Sequence
  Description of Artificial Sequence: Synthetic oligonucleotide
aacgccggcgcccaaaacaga

SEQ ID NO: 23231 - DNA, 21 bp, Artificial Sequence
  Description of Artificial Sequence: Synthetic oligonucleotide
atgagcaccagcggccaccac

SEQ ID NO: 23232 - DNA, 21 bp, Artificial Sequence
  Description of Artificial Sequence: Synthetic oligonucleotide
caaggccccgaaagaggcggc

SEQ ID NO: 23233 - DNA, 21 bp, Artificial Sequence
  Description of Artificial Sequence: Synthetic oligonucleotide
cttggtcatggtaatcatagt

SEQ ID NO: 23234 - DNA, 21 bp, Artificial Sequence
  Description of Artificial Sequence: Synthetic oligonucleotide
gaaagcgtcgacagaagcaga

SEQ ID NO: 23235 - DNA, 21 bp, Artificial Sequence
  Description of Artificial Sequence: Synthetic oligonucleotide
gccagaagccccggcagcggc

SEQ ID NO: 23236 - DNA, 21 bp, Artificial Sequence
  Description of Artificial Sequence: Synthetic oligonucleotide
gtcagcaaccccggcaaccaa

SEQ ID NO: 23237 - DNA, 21 bp, Artificial Sequence
  Description of Artificial Sequence: Synthetic oligonucleotide
ggtactactgattctcgtgct

SEQ ID NO: 23238 - DNA, 21 bp, Artificial Sequence
  Description of Artificial Sequence: Synthetic oligonucleotide
gcggggaataatgatcagaag

SEQ ID NO: 23239 - DNA, 21 bp, Artificial Sequence
  Description of Artificial Sequence: Synthetic oligonucleotide
acgcctgctgttaataatgtt

SEQ ID NO: 23240 - DNA, 21 bp, Artificial Sequence
  Description of Artificial Sequence: Synthetic oligonucleotide
catcgtaatacggatgttagt

SEQ ID NO: 23241 - DNA, 21 bp, Artificial Sequence
  Description of Artificial Sequence: Synthetic oligonucleotide
gatatgaatagtgtgagtaag

SEQ ID NO: 23242 - DNA, 21 bp, Artificial Sequence
  Description of Artificial Sequence: Synthetic oligonucleotide
ggcagcgaaagcggcagccac

SEQ ID NO: 23243 - DNA, 21 bp, Artificial Sequence
  Description of Artificial Sequence: Synthetic oligonucleotide
gccgtcggcgccagcagcagc

SEQ ID NO: 23244 - DNA, 21 bp, Artificial Sequence
  Description of Artificial Sequence: Synthetic oligonucleotide
cagccgtctcagactcctaag

SEQ ID NO: 23245 - DNA, 21 bp, Artificial Sequence
  Description of Artificial Sequence: Synthetic oligonucleotide
tctcctaatcagccgagtgcg

SEQ ID NO: 23246 - DNA, 21 bp, Artificial Sequence
  Description of Artificial Sequence: Synthetic oligonucleotide
gccgacggcggcaaaaccaac

SEQ ID NO: 23247 - DNA, 21 bp, Artificial Sequence
  Description of Artificial Sequence: Synthetic oligonucleotide
aaaggcgccagcgccagcatg

SEQ ID NO: 23248 - DNA, 21 bp, Artificial Sequence
  Description of Artificial Sequence: Synthetic oligonucleotide
aacagccccagcaaaagcacc

SEQ ID NO: 23249 - DNA, 21 bp, Artificial Sequence
  Description of Artificial Sequence: Synthetic oligonucleotide
acgatggatagtaggagggat

SEQ ID NO: 23250 - DNA, 21 bp, Artificial Sequence
  Description of Artificial Sequence: Synthetic oligonucleotide
acttcgggtttgactagtacg

SEQ ID NO: 23251 - DNA, 21 bp, Artificial Sequence
  Description of Artificial Sequence: Synthetic oligonucleotide
agcagcagcagcaccggcggc

SEQ ID NO: 23252 - DNA, 21 bp, Artificial Sequence
  Description of Artificial Sequence: Synthetic oligonucleotide
agcccccccggcagcaaaagc

SEQ ID NO: 23253 - DNA, 21 bp, Artificial Sequence
  Description of Artificial Sequence: Synthetic oligonucleotide
agtggtaatccgactaaggtt

SEQ ID NO: 23254 - DNA, 21 bp, Artificial Sequence
  Description of Artificial Sequence: Synthetic oligonucleotide
gaaggcctcagccaaagcaga

SEQ ID NO: 23255 - DNA, 21 bp, Artificial Sequence
  Description of Artificial Sequence: Synthetic oligonucleotide
gatacgggggtgcagagtagg

SEQ ID NO: 23256 - DNA, 21 bp, Artificial Sequence
  Description of Artificial Sequence: Synthetic oligonucleotide
gatggggttcagacggctaat

SEQ ID NO: 23257 - DNA, 21 bp, Artificial Sequence
  Description of Artificial Sequence: Synthetic oligonucleotide
ggcggcagcgcccaagaaaga

SEQ ID NO: 23258 - DNA, 21 bp, Artificial Sequence
  Description of Artificial Sequence: Synthetic oligonucleotide
ggggctgggtctacttctaag

SEQ ID NO: 23259 - DNA, 21 bp, Artificial Sequence
  Description of Artificial Sequence: Synthetic oligonucleotide
tcttcgtctggttctactcag

SEQ ID NO: 23260 - DNA, 21 bp, Artificial Sequence
  Description of Artificial Sequence: Synthetic oligonucleotide
gccagcgtccccaccagcagc

SEQ ID NO: 23261 - DNA, 21 bp, Artificial Sequence
  Description of Artificial Sequence: Synthetic oligonucleotide
gcggtgagtaagaatacgttg

SEQ ID NO: 23262 - DNA, 21 bp, Artificial Sequence
  Description of Artificial Sequence: Synthetic oligonucleotide
tcgcatactccgcctaatggg

SEQ ID NO: 23263 - DNA, 21 bp, Artificial Sequence
  Description of Artificial Sequence: Synthetic oligonucleotide
accggcgtcgacaccaacaga

SEQ ID NO: 23264 - DNA, 21 bp, Artificial Sequence
  Description of Artificial Sequence: Synthetic oligonucleotide
aatcagggtgggaagggtgat

SEQ ID NO: 23265 - DNA, 21 bp, Artificial Sequence
  Description of Artificial Sequence: Synthetic oligonucleotide
agcaacagcaccgtccacacc

SEQ ID NO: 23266 - DNA, 21 bp, Artificial Sequence
  Description of Artificial Sequence: Synthetic oligonucleotide
agcagcaacaaacccggcctc

SEQ ID NO: 23267 - DNA, 21 bp, Artificial Sequence
  Description of Artificial Sequence: Synthetic oligonucleotide
agcagcggcaaacccaacggc

SEQ ID NO: 23268 - DNA, 21 bp, Artificial Sequence
  Description of Artificial Sequence: Synthetic oligonucleotide
agcagcggccccagcggcaga

SEQ ID NO: 23269 - DNA, 21 bp, Artificial Sequence
  Description of Artificial Sequence: Synthetic oligonucleotide
gagaagttgtctactgcggct

SEQ ID NO: 23270 - DNA, 21 bp, Artificial Sequence
  Description of Artificial Sequence: Synthetic oligonucleotide
gatacgagttctcttgctaag

SEQ ID NO: 23271 - DNA, 21 bp, Artificial Sequence
  Description of Artificial Sequence: Synthetic oligonucleotide
tgcgccagcaaagacagcaga

SEQ ID NO: 23272 - DNA, 21 bp, Artificial Sequence
  Description of Artificial Sequence: Synthetic oligonucleotide
actgcttctgggcataataat

SEQ ID NO: 23273 - DNA, 21 bp, Artificial Sequence
  Description of Artificial Sequence: Synthetic oligonucleotide
agtaattctactccgtcgctg

SEQ ID NO: 23274 - DNA, 21 bp, Artificial Sequence
  Description of Artificial Sequence: Synthetic oligonucleotide
caacccaccaacaccagcaaa

SEQ ID NO: 23275 - DNA, 21 bp, Artificial Sequence
  Description of Artificial Sequence: Synthetic oligonucleotide
gccgaccaaaaaggcagcacc

SEQ ID NO: 23276 - DNA, 21 bp, Artificial Sequence
  Description of Artificial Sequence: Synthetic oligonucleotide
cggagtaatggtacgacgcag

SEQ ID NO: 23277 - DNA, 21 bp, Artificial Sequence
  Description of Artificial Sequence: Synthetic oligonucleotide
agaaccgaaggcagcggcggc

SEQ ID NO: 23278 - DNA, 21 bp, Artificial Sequence
  Description of Artificial Sequence: Synthetic oligonucleotide
agcggcagcgaacccagaaaa

SEQ ID NO: 23279 - DNA, 21 bp, Artificial Sequence
  Description of Artificial Sequence: Synthetic oligonucleotide
gacaccagcgcccaaagaagc

SEQ ID NO: 23280 - DNA, 21 bp, Artificial Sequence
  Description of Artificial Sequence: Synthetic oligonucleotide
gacagaaccaaaaacgtcggc

SEQ ID NO: 23281 - DNA, 21 bp, Artificial Sequence
  Description of Artificial Sequence: Synthetic oligonucleotide
gacgccggcagcagccccaga

SEQ ID NO: 23282 - DNA, 21 bp, Artificial Sequence
  Description of Artificial Sequence: Synthetic oligonucleotide
ggcaccgtcgccagagacggc

SEQ ID NO: 23283 - DNA, 21 bp, Artificial Sequence
  Description of Artificial Sequence: Synthetic oligonucleotide
ggcgtccaaacccccaaccac

SEQ ID NO: 23284 - DNA, 21 bp, Artificial Sequence
  Description of Artificial Sequence: Synthetic oligonucleotide
ggtcttagtaattctaatcgt

SEQ ID NO: 23285 - DNA, 21 bp, Artificial Sequence
  Description of Artificial Sequence: Synthetic oligonucleotide
gttacgtcttcttcggtgttg

SEQ ID NO: 23286 - DNA, 21 bp, Artificial Sequence
  Description of Artificial Sequence: Synthetic oligonucleotide
ttgcattctgatcctcattct

SEQ ID NO: 23287 - DNA, 21 bp, Artificial Sequence
  Description of Artificial Sequence: Synthetic oligonucleotide
tttgggcagcagactgttaag

SEQ ID NO: 23288 - DNA, 21 bp, Artificial Sequence
  Description of Artificial Sequence: Synthetic oligonucleotide
tctaataaggcgcagtctatt

SEQ ID NO: 23289 - DNA, 21 bp, Artificial Sequence
  Description of Artificial Sequence: Synthetic oligonucleotide
gccagcaccagcagcaccgcc

SEQ ID NO: 23290 - DNA, 21 bp, Artificial Sequence
  Description of Artificial Sequence: Synthetic oligonucleotide
tcgccttctcagtctcatggt

SEQ ID NO: 23291 - DNA, 21 bp, Artificial Sequence
  Description of Artificial Sequence: Synthetic oligonucleotide
caaaaccacggcagcagcagc

SEQ ID NO: 23292 - DNA, 21 bp, Artificial Sequence
  Description of Artificial Sequence: Synthetic oligonucleotide
gtcggcggcaaacccagcacc

SEQ ID NO: 23293 - DNA, 21 bp, Artificial Sequence
  Description of Artificial Sequence: Synthetic oligonucleotide
agcagcgccagcaacagcagc

SEQ ID NO: 23294 - DNA, 21 bp, Artificial Sequence
  Description of Artificial Sequence: Synthetic oligonucleotide
ttgaaggatagtgggagtagt

SEQ ID NO: 23295 - DNA, 21 bp, Artificial Sequence
  Description of Artificial Sequence: Synthetic oligonucleotide
accaccgccagagacaccaac

SEQ ID NO: 23296 - DNA, 21 bp, Artificial Sequence
  Description of Artificial Sequence: Synthetic oligonucleotide
accgccgtcccccacagcggc

SEQ ID NO: 23297 - DNA, 21 bp, Artificial Sequence
  Description of Artificial Sequence: Synthetic oligonucleotide
agcaccaccggcagcaccagc

SEQ ID NO: 23298 - DNA, 21 bp, Artificial Sequence
  Description of Artificial Sequence: Synthetic oligonucleotide
atgaacagccaaagccccagc

SEQ ID NO: 23299 - DNA, 21 bp, Artificial Sequence
  Description of Artificial Sequence: Synthetic oligonucleotide
ccccccagcggccccaccaaa

SEQ ID NO: 23300 - DNA, 21 bp, Artificial Sequence
  Description of Artificial Sequence: Synthetic oligonucleotide
tctagtgggggtcagccttct

SEQ ID NO: 23301 - DNA, 21 bp, Artificial Sequence
  Description of Artificial Sequence: Synthetic oligonucleotide
tctagtacttctactcctcgt

SEQ ID NO: 23302 - DNA, 21 bp, Artificial Sequence
  Description of Artificial Sequence: Synthetic oligonucleotide
gtgggtcagaagtcgtctatg

SEQ ID NO: 23303 - DNA, 21 bp, Artificial Sequence
  Description of Artificial Sequence: Synthetic oligonucleotide
gatgagggtggtccgcatagg

SEQ ID NO: 23304 - DNA, 21 bp, Artificial Sequence
  Description of Artificial Sequence: Synthetic oligonucleotide
aacgccaccagaaccagcagc

SEQ ID NO: 23305 - DNA, 21 bp, Artificial Sequence
  Description of Artificial Sequence: Synthetic oligonucleotide
aacagaggcgccaccaaccaa

SEQ ID NO: 23306 - DNA, 21 bp, Artificial Sequence
  Description of Artificial Sequence: Synthetic oligonucleotide
agcaccagaagcagcaccagc

SEQ ID NO: 23307 - DNA, 21 bp, Artificial Sequence
  Description of Artificial Sequence: Synthetic oligonucleotide
gtgggtactccgtctaaggag

SEQ ID NO: 23308 - DNA, 21 bp, Artificial Sequence
  Description of Artificial Sequence: Synthetic oligonucleotide
ctgtcgacggcgaagtcgtcg

SEQ ID NO: 23309 - DNA, 21 bp, Artificial Sequence
  Description of Artificial Sequence: Synthetic oligonucleotide
aagctgagtggtagttcttcg

SEQ ID NO: 23310 - DNA, 21 bp, Artificial Sequence
  Description of Artificial Sequence: Synthetic oligonucleotide
accctcggcggcaaccacatg

SEQ ID NO: 23311 - DNA, 21 bp, Artificial Sequence
  Description of Artificial Sequence: Synthetic oligonucleotide
agcaacggcagcgacagaaac

SEQ ID NO: 23312 - DNA, 21 bp, Artificial Sequence
  Description of Artificial Sequence: Synthetic oligonucleotide
caacaaagcggccaaaacatc

SEQ ID NO: 23313 - DNA, 21 bp, Artificial Sequence
  Description of Artificial Sequence: Synthetic oligonucleotide
gataagagtggtcagagtcgg

SEQ ID NO: 23314 - DNA, 21 bp, Artificial Sequence
  Description of Artificial Sequence: Synthetic oligonucleotide
gccggcaacaccatgggcagc

SEQ ID NO: 23315 - DNA, 21 bp, Artificial Sequence
  Description of Artificial Sequence: Synthetic oligonucleotide
gctatgggtgagcagcgggct

SEQ ID NO: 23316 - DNA, 21 bp, Artificial Sequence
  Description of Artificial Sequence: Synthetic oligonucleotide
gtccacgcccaagaccaacac

SEQ ID NO: 23317 - DNA, 21 bp, Artificial Sequence
  Description of Artificial Sequence: Synthetic oligonucleotide
tttgataatcagcctacgtcg

SEQ ID NO: 23318 - DNA, 21 bp, Artificial Sequence
  Description of Artificial Sequence: Synthetic oligonucleotide
cacagcagcgccgaaagcaga

SEQ ID NO: 23319 - DNA, 21 bp, Artificial Sequence
  Description of Artificial Sequence: Synthetic oligonucleotide
cacggcagcccccaaaacgaa

SEQ ID NO: 23320 - DNA, 21 bp, Artificial Sequence
  Description of Artificial Sequence: Synthetic oligonucleotide
ctttctgatggggcgattaag

SEQ ID NO: 23321 - DNA, 21 bp, Artificial Sequence
  Description of Artificial Sequence: Synthetic oligonucleotide
gacagcggcgacgccagagtc

SEQ ID NO: 23322 - DNA, 21 bp, Artificial Sequence
  Description of Artificial Sequence: Synthetic oligonucleotide
ggtacgggttcgcagaggtcg

SEQ ID NO: 23323 - DNA, 21 bp, Artificial Sequence
  Description of Artificial Sequence: Synthetic oligonucleotide
ggtactgataaggctatgggt

SEQ ID NO: 23324 - DNA, 21 bp, Artificial Sequence
  Description of Artificial Sequence: Synthetic oligonucleotide
ggtctgactactccgaataat

SEQ ID NO: 23325 - DNA, 21 bp, Artificial Sequence
  Description of Artificial Sequence: Synthetic oligonucleotide
gtccccggcgtcagccaaccc

SEQ ID NO: 23326 - DNA, 21 bp, Artificial Sequence
  Description of Artificial Sequence: Synthetic oligonucleotide
tcggggagttcgggtacgagg

SEQ ID NO: 23327 - DNA, 21 bp, Artificial Sequence
  Description of Artificial Sequence: Synthetic oligonucleotide
accatcaacagcggcccccac

SEQ ID NO: 23328 - DNA, 21 bp, Artificial Sequence
  Description of Artificial Sequence: Synthetic oligonucleotide
gagagggcgacgggtactgct

SEQ ID NO: 23329 - DNA, 21 bp, Artificial Sequence
  Description of Artificial Sequence: Synthetic oligonucleotide
ggcatcaccggcaccaacgcc

SEQ ID NO: 23330 - DNA, 21 bp, Artificial Sequence
  Description of Artificial Sequence: Synthetic oligonucleotide
agtacggcgtctggtgtgtcg

SEQ ID NO: 23331 - DNA, 21 bp, Artificial Sequence
  Description of Artificial Sequence: Synthetic oligonucleotide
ggcagccccccccccgtcaaa

SEQ ID NO: 23332 - DNA, 21 bp, Artificial Sequence
  Description of Artificial Sequence: Synthetic oligonucleotide
ggcagcgccggcaaactcagc

SEQ ID NO: 23333 - DNA, 21 bp, Artificial Sequence
  Description of Artificial Sequence: Synthetic oligonucleotide
aagactggtgcggataatgct

SEQ ID NO: 23334 - DNA, 21 bp, Artificial Sequence
  Description of Artificial Sequence: Synthetic oligonucleotide
agagacagcaccaaccccaaa

SEQ ID NO: 23335 - DNA, 21 bp, Artificial Sequence
  Description of Artificial Sequence: Synthetic oligonucleotide
agagtcggcagcagcacccaa

SEQ ID NO: 23336 - DNA, 21 bp, Artificial Sequence
  Description of Artificial Sequence: Synthetic oligonucleotide
agcgccagcagccaacccagc

SEQ ID NO: 23337 - DNA, 21 bp, Artificial Sequence
  Description of Artificial Sequence: Synthetic oligonucleotide
agcggcatcgaacaaaaaaaa

SEQ ID NO: 23338 - DNA, 21 bp, Artificial Sequence
  Description of Artificial Sequence: Synthetic oligonucleotide
aggacgacggatcagcagtct

SEQ ID NO: 23339 - DNA, 21 bp, Artificial Sequence
  Description of Artificial Sequence: Synthetic oligonucleotide
atcgccggcaccagcagcagc

SEQ ID NO: 23340 - DNA, 21 bp, Artificial Sequence
  Description of Artificial Sequence: Synthetic oligonucleotide
cacggcagcgccagccaaggc

SEQ ID NO: 23341 - DNA, 21 bp, Artificial Sequence
  Description of Artificial Sequence: Synthetic oligonucleotide
cagctgggtactaaggaggct

SEQ ID NO: 23342 - DNA, 21 bp, Artificial Sequence
  Description of Artificial Sequence: Synthetic oligonucleotide
cataatggggatcggaatgtg

SEQ ID NO: 23343 - DNA, 21 bp, Artificial Sequence
  Description of Artificial Sequence: Synthetic oligonucleotide
ctcagaagcaccgaaaccaaa

SEQ ID NO: 23344 - DNA, 21 bp, Artificial Sequence
  Description of Artificial Sequence: Synthetic oligonucleotide
ggcagccaaaccagccccatg

SEQ ID NO: 23345 - DNA, 21 bp, Artificial Sequence
  Description of Artificial Sequence: Synthetic oligonucleotide
aacgtcgaccacgccgccaaa

SEQ ID NO: 23346 - DNA, 21 bp, Artificial Sequence
  Description of Artificial Sequence: Synthetic oligonucleotide
accggcgtcaacggcgccacc

SEQ ID NO: 23347 - DNA, 21 bp, Artificial Sequence
  Description of Artificial Sequence: Synthetic oligonucleotide
gatgggcttaagtctactggg

SEQ ID NO: 23348 - DNA, 21 bp, Artificial Sequence
  Description of Artificial Sequence: Synthetic oligonucleotide
gttacgtctaatagtccgaag

SEQ ID NO: 23349 - DNA, 21 bp, Artificial Sequence
  Description of Artificial Sequence: Synthetic oligonucleotide
agcggcaccgaacacagcaga

SEQ ID NO: 23350 - DNA, 21 bp, Artificial Sequence
  Description of Artificial Sequence: Synthetic oligonucleotide
aaccaaagacccagcgtcgaa

SEQ ID NO: 23351 - DNA, 21 bp, Artificial Sequence
  Description of Artificial Sequence: Synthetic oligonucleotide
actacttctagtccgcgtttg

SEQ ID NO: 23352 - DNA, 21 bp, Artificial Sequence
  Description of Artificial Sequence: Synthetic oligonucleotide
gatgctctgaagactaatacg

SEQ ID NO: 23353 - DNA, 21 bp, Artificial Sequence
  Description of Artificial Sequence: Synthetic oligonucleotide
ctcagaaacggcaccagcgcc

SEQ ID NO: 23354 - DNA, 21 bp, Artificial Sequence
  Description of Artificial Sequence: Synthetic oligonucleotide
agcagcaccgaaaaaagcacc

SEQ ID NO: 23355 - DNA, 21 bp, Artificial Sequence
  Description of Artificial Sequence: Synthetic oligonucleotide
agcggcgtcccccccgccgcc

SEQ ID NO: 23356 - DNA, 21 bp, Artificial Sequence
  Description of Artificial Sequence: Synthetic oligonucleotide
agtcggaatggtactttggcg

SEQ ID NO: 23357 - DNA, 21 bp, Artificial Sequence
  Description of Artificial Sequence: Synthetic oligonucleotide
atcgacaaaggcaccaccctc

SEQ ID NO: 23358 - DNA, 21 bp, Artificial Sequence
  Description of Artificial Sequence: Synthetic oligonucleotide
cagcgtcaggatacgactaat

SEQ ID NO: 23359 - DNA, 21 bp, Artificial Sequence
  Description of Artificial Sequence: Synthetic oligonucleotide
gtccaagaacccaaaatgcaa

SEQ ID NO: 23360 - DNA, 21 bp, Artificial Sequence
  Description of Artificial Sequence: Synthetic oligonucleotide
aacgtcgaaaccagcagcaaa

SEQ ID NO: 23361 - DNA, 21 bp, Artificial Sequence
  Description of Artificial Sequence: Synthetic oligonucleotide
agccccgccagccaccccgtc

SEQ ID NO: 23362 - DNA, 21 bp, Artificial Sequence
  Description of Artificial Sequence: Synthetic oligonucleotide
cagaagggttctgatattgct

SEQ ID NO: 23363 - DNA, 21 bp, Artificial Sequence
  Description of Artificial Sequence: Synthetic oligonucleotide
ctcagagacagcaacaacaaa

SEQ ID NO: 23364 - DNA, 21 bp, Artificial Sequence
  Description of Artificial Sequence: Synthetic oligonucleotide
tctggtggtgatcctcagagg

SEQ ID NO: 23365 - DNA, 21 bp, Artificial Sequence
  Description of Artificial Sequence: Synthetic oligonucleotide
ttgtcttctgagaagacgtcg

SEQ ID NO: 23366 - DNA, 21 bp, Artificial Sequence
  Description of Artificial Sequence: Synthetic oligonucleotide
aataagacggatcgtcctacg

SEQ ID NO: 23367 - DNA, 21 bp, Artificial Sequence
  Description of Artificial Sequence: Synthetic oligonucleotide
atgagcaccaacagcccccaa

SEQ ID NO: 23368 - DNA, 21 bp, Artificial Sequence
  Description of Artificial Sequence: Synthetic oligonucleotide
aatggtcagggtgtgcagcag

SEQ ID NO: 23369 - DNA, 21 bp, Artificial Sequence
  Description of Artificial Sequence: Synthetic oligonucleotide
aattcgggtgtgtcgcctgct

SEQ ID NO: 23370 - DNA, 21 bp, Artificial Sequence
  Description of Artificial Sequence: Synthetic oligonucleotide
agcaaagtccaacaagccacc

SEQ ID NO: 23371 - DNA, 21 bp, Artificial Sequence
  Description of Artificial Sequence: Synthetic oligonucleotide
cagtcgaaggttccggtttcg

SEQ ID NO: 23372 - DNA, 21 bp, Artificial Sequence
  Description of Artificial Sequence: Synthetic oligonucleotide
gaaagcaccgcccacgccacc

SEQ ID NO: 23373 - DNA, 21 bp, Artificial Sequence
  Description of Artificial Sequence: Synthetic oligonucleotide
gacggcgccgtcagccacggc

SEQ ID NO: 23374 - DNA, 21 bp, Artificial Sequence
  Description of Artificial Sequence: Synthetic oligonucleotide
gagggggttcaggctaggggt

SEQ ID NO: 23375 - DNA, 21 bp, Artificial Sequence
  Description of Artificial Sequence: Synthetic oligonucleotide
gccctcagcagcagcaaagcc

SEQ ID NO: 23376 - DNA, 21 bp, Artificial Sequence
  Description of Artificial Sequence: Synthetic oligonucleotide
gcttttggtaagagttctgcg

SEQ ID NO: 23377 - DNA, 21 bp, Artificial Sequence
  Description of Artificial Sequence: Synthetic oligonucleotide
ggcagcaaaggcagccaaatg

SEQ ID NO: 23378 - DNA, 21 bp, Artificial Sequence
  Description of Artificial Sequence: Synthetic oligonucleotide
ggggttcatgaggcgaagagg

SEQ ID NO: 23379 - DNA, 21 bp, Artificial Sequence
  Description of Artificial Sequence: Synthetic oligonucleotide
ggtagtaataaggttgttgct

SEQ ID NO: 23380 - DNA, 21 bp, Artificial Sequence
  Description of Artificial Sequence: Synthetic oligonucleotide
tctatgaataaggataggctg

SEQ ID NO: 23381 - DNA, 21 bp, Artificial Sequence
  Description of Artificial Sequence: Synthetic oligonucleotide
accagcgacgtcaaaaccctc

SEQ ID NO: 23382 - DNA, 21 bp, Artificial Sequence
  Description of Artificial Sequence: Synthetic oligonucleotide
aacgccagcaaagacctcaga

SEQ ID NO: 23383 - DNA, 21 bp, Artificial Sequence
  Description of Artificial Sequence: Synthetic oligonucleotide
gtgtcgggtccttctgcgact

SEQ ID NO: 23384 - DNA, 21 bp, Artificial Sequence
  Description of Artificial Sequence: Synthetic oligonucleotide
ggcagcaaagaacacggcagc

SEQ ID NO: 23385 - DNA, 21 bp, Artificial Sequence
  Description of Artificial Sequence: Synthetic oligonucleotide
aatgatgggcttgctaatagt

SEQ ID NO: 23386 - DNA, 21 bp, Artificial Sequence
  Description of Artificial Sequence: Synthetic oligonucleotide
accagccacgcccccagcatg

SEQ ID NO: 23387 - DNA, 21 bp, Artificial Sequence
  Description of Artificial Sequence: Synthetic oligonucleotide
acttctggtccgtctattggg

SEQ ID NO: 23388 - DNA, 21 bp, Artificial Sequence
  Description of Artificial Sequence: Synthetic oligonucleotide
agcgaaaccagaagcgccgtc

SEQ ID NO: 23389 - DNA, 21 bp, Artificial Sequence
  Description of Artificial Sequence: Synthetic oligonucleotide
agtagtactgggtctccgggg

SEQ ID NO: 23390 - DNA, 21 bp, Artificial Sequence
  Description of Artificial Sequence: Synthetic oligonucleotide
gaggcttttaaggatggtggt

SEQ ID NO: 23391 - DNA, 21 bp, Artificial Sequence
  Description of Artificial Sequence: Synthetic oligonucleotide
gcgggtggggcgcctatgact

SEQ ID NO: 23392 - DNA, 21 bp, Artificial Sequence
  Description of Artificial Sequence: Synthetic oligonucleotide
gtccccagcaccagcaccgcc

SEQ ID NO: 23393 - DNA, 21 bp, Artificial Sequence
  Description of Artificial Sequence: Synthetic oligonucleotide
cagggtacggggcatgttgct

SEQ ID NO: 23394 - DNA, 21 bp, Artificial Sequence
  Description of Artificial Sequence: Synthetic oligonucleotide
aaccaaggcgccaccctcggc

SEQ ID NO: 23395 - DNA, 21 bp, Artificial Sequence
  Description of Artificial Sequence: Synthetic oligonucleotide
aacctcggcagcagcgccaac

SEQ ID NO: 23396 - DNA, 21 bp, Artificial Sequence
  Description of Artificial Sequence: Synthetic oligonucleotide
accatcacccccaccagcgcc

SEQ ID NO: 23397 - DNA, 21 bp, Artificial Sequence
  Description of Artificial Sequence: Synthetic oligonucleotide
agcctcggccaagccaccgcc

SEQ ID NO: 23398 - DNA, 21 bp, Artificial Sequence
  Description of Artificial Sequence: Synthetic oligonucleotide
agtgaggggagggctacgggg

SEQ ID NO: 23399 - DNA, 21 bp, Artificial Sequence
  Description of Artificial Sequence: Synthetic oligonucleotide
atgggtaataatactccgatg

SEQ ID NO: 23400 - DNA, 21 bp, Artificial Sequence
  Description of Artificial Sequence: Synthetic oligonucleotide
gaaggccacagcaccgccctc

SEQ ID NO: 23401 - DNA, 21 bp, Artificial Sequence
  Description of Artificial Sequence: Synthetic oligonucleotide
gctcttggtcaggataagaat

SEQ ID NO: 23402 - DNA, 21 bp, Artificial Sequence
  Description of Artificial Sequence: Synthetic oligonucleotide
gggacgattaatacgtcttct

SEQ ID NO: 23403 - DNA, 21 bp, Artificial Sequence
  Description of Artificial Sequence: Synthetic oligonucleotide
tctgctacgtctcagaatcat

SEQ ID NO: 23404 - DNA, 21 bp, Artificial Sequence
  Description of Artificial Sequence: Synthetic oligonucleotide
gaggggaaggcgaataagggt

SEQ ID NO: 23405 - DNA, 21 bp, Artificial Sequence
  Description of Artificial Sequence: Synthetic oligonucleotide
ctgcctgctcagaatgtgact

SEQ ID NO: 23406 - DNA, 21 bp, Artificial Sequence
  Description of Artificial Sequence: Synthetic oligonucleotide
aacacccaaacccacagcaaa

SEQ ID NO: 23407 - DNA, 21 bp, Artificial Sequence
  Description of Artificial Sequence: Synthetic oligonucleotide
agcctcaccaacaacggcaaa

SEQ ID NO: 23408 - DNA, 21 bp, Artificial Sequence
  Description of Artificial Sequence: Synthetic oligonucleotide
agcgcccccaacggcgccgcc

SEQ ID NO: 23409 - DNA, 21 bp, Artificial Sequence
  Description of Artificial Sequence: Synthetic oligonucleotide
cagcattctggttctagtgct

SEQ ID NO: 23410 - DNA, 21 bp, Artificial Sequence
  Description of Artificial Sequence: Synthetic oligonucleotide
ggcagcgccagcacccccacc

SEQ ID NO: 23411 - DNA, 21 bp, Artificial Sequence
  Description of Artificial Sequence: Synthetic oligonucleotide
ggttcttcgaatagtaatgct

SEQ ID NO: 23412 - DNA, 21 bp, Artificial Sequence
  Description of Artificial Sequence: Synthetic oligonucleotide
gtgaatgggggtgcggtgcag

SEQ ID NO: 23413 - DNA, 21 bp, Artificial Sequence
  Description of Artificial Sequence: Synthetic oligonucleotide
tcttcgggtaatcttggggct

SEQ ID NO: 23414 - DNA, 21 bp, Artificial Sequence
  Description of Artificial Sequence: Synthetic oligonucleotide
aattctaagtcggctatgacg

SEQ ID NO: 23415 - DNA, 21 bp, Artificial Sequence
  Description of Artificial Sequence: Synthetic oligonucleotide
aattcgcctaatagttcgtct

SEQ ID NO: 23416 - DNA, 21 bp, Artificial Sequence
  Description of Artificial Sequence: Synthetic oligonucleotide
aacaccctccaaaccagccac

SEQ ID NO: 23417 - DNA, 21 bp, Artificial Sequence
  Description of Artificial Sequence: Synthetic oligonucleotide
acccccagcaccagcagaggc

SEQ ID NO: 23418 - DNA, 21 bp, Artificial Sequence
  Description of Artificial Sequence: Synthetic oligonucleotide
gaaagactccacgaaaccaga

SEQ ID NO: 23419 - DNA, 21 bp, Artificial Sequence
  Description of Artificial Sequence: Synthetic oligonucleotide
gatcagacgacgggtaatcag

SEQ ID NO: 23420 - DNA, 21 bp, Artificial Sequence
  Description of Artificial Sequence: Synthetic oligonucleotide
accaacagcgacagccccaga

SEQ ID NO: 23421 - DNA, 21 bp, Artificial Sequence
  Description of Artificial Sequence: Synthetic oligonucleotide
gatgctgtgaagcagtctagg

SEQ ID NO: 23422 - DNA, 21 bp, Artificial Sequence
  Description of Artificial Sequence: Synthetic oligonucleotide
tttggggatcatggtgctaag

SEQ ID NO: 23423 - DNA, 21 bp, Artificial Sequence
  Description of Artificial Sequence: Synthetic oligonucleotide
aacgccagccccgccagcggc

SEQ ID NO: 23424 - DNA, 21 bp, Artificial Sequence
  Description of Artificial Sequence: Synthetic oligonucleotide
accacccacgccaaagtcggc

SEQ ID NO: 23425 - DNA, 21 bp, Artificial Sequence
  Description of Artificial Sequence: Synthetic oligonucleotide
accagaggcggccacgccgaa

SEQ ID NO: 23426 - DNA, 21 bp, Artificial Sequence
  Description of Artificial Sequence: Synthetic oligonucleotide
agcaccggccaaaaaggcagc

SEQ ID NO: 23427 - DNA, 21 bp, Artificial Sequence
  Description of Artificial Sequence: Synthetic oligonucleotide
agtgaggctaagagtgtgaat

SEQ ID NO: 23428 - DNA, 21 bp, Artificial Sequence
  Description of Artificial Sequence: Synthetic oligonucleotide
agtggggagaatcggtccttg

SEQ ID NO: 23429 - DNA, 21 bp, Artificial Sequence
  Description of Artificial Sequence: Synthetic oligonucleotide
atgcgtggggagacttcgctt

SEQ ID NO: 23430 - DNA, 21 bp, Artificial Sequence
  Description of Artificial Sequence: Synthetic oligonucleotide
caaagcaacggcaaaaccgaa

SEQ ID NO: 23431 - DNA, 21 bp, Artificial Sequence
  Description of Artificial Sequence: Synthetic oligonucleotide
cacggcgaaagcagcagaacc

SEQ ID NO: 23432 - DNA, 21 bp, Artificial Sequence
  Description of Artificial Sequence: Synthetic oligonucleotide
ctcagcggcagcgccagcggc

SEQ ID NO: 23433 - DNA, 21 bp, Artificial Sequence
  Description of Artificial Sequence: Synthetic oligonucleotide
gaaaacaacaacagcggcaga

SEQ ID NO: 23434 - DNA, 21 bp, Artificial Sequence
  Description of Artificial Sequence: Synthetic oligonucleotide
gggcatcagaagaatgagctg

SEQ ID NO: 23435 - DNA, 21 bp, Artificial Sequence
  Description of Artificial Sequence: Synthetic oligonucleotide
ggtaaggagcagagggtgggt

SEQ ID NO: 23436 - DNA, 21 bp, Artificial Sequence
  Description of Artificial Sequence: Synthetic oligonucleotide
ttcggcagcagcagccccacc

SEQ ID NO: 23437 - DNA, 21 bp, Artificial Sequence
  Description of Artificial Sequence: Synthetic oligonucleotide
ctgactagtcaggcgagtacg

SEQ ID NO: 23438 - DNA, 21 bp, Artificial Sequence
  Description of Artificial Sequence: Synthetic oligonucleotide
cgtgcggatggtggtaatggt

SEQ ID NO: 23439 - DNA, 21 bp, Artificial Sequence
  Description of Artificial Sequence: Synthetic oligonucleotide
tctcagccgccgccttctcac

SEQ ID NO: 23440 - DNA, 21 bp, Artificial Sequence
  Description of Artificial Sequence: Synthetic oligonucleotide
aacgccgccgccagccccaaa

SEQ ID NO: 23441 - DNA, 21 bp, Artificial Sequence
  Description of Artificial Sequence: Synthetic oligonucleotide
aacggcaacagcgaccacaga

SEQ ID NO: 23442 - DNA, 21 bp, Artificial Sequence
  Description of Artificial Sequence: Synthetic oligonucleotide
ctcaaagaagtcccccaaagc

SEQ ID NO: 23443 - DNA, 21 bp, Artificial Sequence
  Description of Artificial Sequence: Synthetic oligonucleotide
ggcgccctcggcaaaggcccc

SEQ ID NO: 23444 - DNA, 21 bp, Artificial Sequence
  Description of Artificial Sequence: Synthetic oligonucleotide
accagcggcagcagcgccacc

SEQ ID NO: 23445 - DNA, 21 bp, Artificial Sequence
  Description of Artificial Sequence: Synthetic oligonucleotide
gggactacggcgcctggtacg

SEQ ID NO: 23446 - DNA, 21 bp, Artificial Sequence
  Description of Artificial Sequence: Synthetic oligonucleotide
accagcgccagcaacaacagc

SEQ ID NO: 23447 - DNA, 21 bp, Artificial Sequence
  Description of Artificial Sequence: Synthetic oligonucleotide
agagacaacggcaaacacgac

SEQ ID NO: 23448 - DNA, 21 bp, Artificial Sequence
  Description of Artificial Sequence: Synthetic oligonucleotide
cacaacaacagcggcctcacc

SEQ ID NO: 23449 - DNA, 21 bp, Artificial Sequence
  Description of Artificial Sequence: Synthetic oligonucleotide
gacagacaaaaagccaccaac

SEQ ID NO: 23450 - DNA, 21 bp, Artificial Sequence
  Description of Artificial Sequence: Synthetic oligonucleotide
gcgggtagggatgctgcgagt

SEQ ID NO: 23451 - DNA, 21 bp, Artificial Sequence
  Description of Artificial Sequence: Synthetic oligonucleotide
ggcggcgacggcgcccacaaa

SEQ ID NO: 23452 - DNA, 21 bp, Artificial Sequence
  Description of Artificial Sequence: Synthetic oligonucleotide
acgattacgtcttctccgtct

SEQ ID NO: 23453 - DNA, 21 bp, Artificial Sequence
  Description of Artificial Sequence: Synthetic oligonucleotide
aacgtcggcgccagccccgtc

SEQ ID NO: 23454 - DNA, 21 bp, Artificial Sequence
  Description of Artificial Sequence: Synthetic oligonucleotide
atccagtctggtaattcggct

SEQ ID NO: 23455 - DNA, 21 bp, Artificial Sequence
  Description of Artificial Sequence: Synthetic oligonucleotide
ggtaatgggagtccggtgctt

SEQ ID NO: 23456 - DNA, 21 bp, Artificial Sequence
  Description of Artificial Sequence: Synthetic oligonucleotide
acccaaaacaaaggcctcagc

SEQ ID NO: 23457 - DNA, 21 bp, Artificial Sequence
  Description of Artificial Sequence: Synthetic oligonucleotide
acccacgaagacaaaggctac

SEQ ID NO: 23458 - DNA, 21 bp, Artificial Sequence
  Description of Artificial Sequence: Synthetic oligonucleotide
accggcacccacaacaccgtc

SEQ ID NO: 23459 - DNA, 21 bp, Artificial Sequence
  Description of Artificial Sequence: Synthetic oligonucleotide
agcaccatgcccgccagcaaa

SEQ ID NO: 23460 - DNA, 21 bp, Artificial Sequence
  Description of Artificial Sequence: Synthetic oligonucleotide
agcgacggcaaagtcatggtc

SEQ ID NO: 23461 - DNA, 21 bp, Artificial Sequence
  Description of Artificial Sequence: Synthetic oligonucleotide
atggctaagccgggggagacg

SEQ ID NO: 23462 - DNA, 21 bp, Artificial Sequence
  Description of Artificial Sequence: Synthetic oligonucleotide
cagacgaattcgtctaagggg

SEQ ID NO: 23463 - DNA, 21 bp, Artificial Sequence
  Description of Artificial Sequence: Synthetic oligonucleotide
gcgacttcgtctggttctacg

SEQ ID NO: 23464 - DNA, 21 bp, Artificial Sequence
  Description of Artificial Sequence: Synthetic oligonucleotide
ggggatcaggatcgtactaag

SEQ ID NO: 23465 - DNA, 21 bp, Artificial Sequence
  Description of Artificial Sequence: Synthetic oligonucleotide
tcggcggatgctaaggggagg

SEQ ID NO: 23466 - DNA, 21 bp, Artificial Sequence
  Description of Artificial Sequence: Synthetic oligonucleotide
tcggctggtcctacgggtcat

SEQ ID NO: 23467 - DNA, 21 bp, Artificial Sequence
  Description of Artificial Sequence: Synthetic oligonucleotide
cacagcagcaccacccccgcc

SEQ ID NO: 23468 - DNA, 21 bp, Artificial Sequence
  Description of Artificial Sequence: Synthetic oligonucleotide
gaggcgcgggctccgattacg

SEQ ID NO: 23469 - DNA, 21 bp, Artificial Sequence
  Description of Artificial Sequence: Synthetic oligonucleotide
agcgccaccagaagcggcagc

SEQ ID NO: 23470 - DNA, 21 bp, Artificial Sequence
  Description of Artificial Sequence: Synthetic oligonucleotide
aattcggcgtcgaggccgagt

SEQ ID NO: 23471 - DNA, 21 bp, Artificial Sequence
  Description of Artificial Sequence: Synthetic oligonucleotide
ggcagaggcgaaagaatcagc

SEQ ID NO: 23472 - DNA, 21 bp, Artificial Sequence
  Description of Artificial Sequence: Synthetic oligonucleotide
atgacgaagggttctactctt

SEQ ID NO: 23473 - DNA, 21 bp, Artificial Sequence
  Description of Artificial Sequence: Synthetic oligonucleotide
acgggtactaatactatgagt

SEQ ID NO: 23474 - DNA, 21 bp, Artificial Sequence
  Description of Artificial Sequence: Synthetic oligonucleotide
atgaacagcagcagaagcgtc

SEQ ID NO: 23475 - DNA, 21 bp, Artificial Sequence
  Description of Artificial Sequence: Synthetic oligonucleotide
cagagtgttggtacgacgcgt

SEQ ID NO: 23476 - DNA, 21 bp, Artificial Sequence
  Description of Artificial Sequence: Synthetic oligonucleotide
gaggcgtcgggtaagagtact

SEQ ID NO: 23477 - DNA, 21 bp, Artificial Sequence
  Description of Artificial Sequence: Synthetic oligonucleotide
agcaccagcagcagcccccac

SEQ ID NO: 23478 - DNA, 21 bp, Artificial Sequence
  Description of Artificial Sequence: Synthetic oligonucleotide
gaaagcagcagcgccctcaaa

SEQ ID NO: 23479 - DNA, 21 bp, Artificial Sequence
  Description of Artificial Sequence: Synthetic oligonucleotide
cacccccaaagccaacccaac

SEQ ID NO: 23480 - DNA, 21 bp, Artificial Sequence
  Description of Artificial Sequence: Synthetic oligonucleotide
agcaacagccaaaccggcagc

SEQ ID NO: 23481 - DNA, 21 bp, Artificial Sequence
  Description of Artificial Sequence: Synthetic oligonucleotide
atgaccagcagcaccgccagc

SEQ ID NO: 23482 - DNA, 21 bp, Artificial Sequence
  Description of Artificial Sequence: Synthetic oligonucleotide
aacaccaacaaccaacccgcc

SEQ ID NO: 23483 - DNA, 21 bp, Artificial Sequence
  Description of Artificial Sequence: Synthetic oligonucleotide
ggtaatacttctaagaatttg

SEQ ID NO: 23484 - DNA, 21 bp, Artificial Sequence
  Description of Artificial Sequence: Synthetic oligonucleotide
aaggtggctgataggccgagt

SEQ ID NO: 23485 - DNA, 21 bp, Artificial Sequence
  Description of Artificial Sequence: Synthetic oligonucleotide
aatacttctaagtcgactgat

SEQ ID NO: 23486 - DNA, 21 bp, Artificial Sequence
  Description of Artificial Sequence: Synthetic oligonucleotide
aatagtggtgcgactattacg

SEQ ID NO: 23487 - DNA, 21 bp, Artificial Sequence
  Description of Artificial Sequence: Synthetic oligonucleotide
agagaaaacgccacccccagc

SEQ ID NO: 23488 - DNA, 21 bp, Artificial Sequence
  Description of Artificial Sequence: Synthetic oligonucleotide
agcaacagcggcaacagcaaa

SEQ ID NO: 23489 - DNA, 21 bp, Artificial Sequence
  Description of Artificial Sequence: Synthetic oligonucleotide
agcagcaccaaacaaatcggc

SEQ ID NO: 23490 - DNA, 21 bp, Artificial Sequence
  Description of Artificial Sequence: Synthetic oligonucleotide
agcgccgaaagaagcgtcagc

SEQ ID NO: 23491 - DNA, 21 bp, Artificial Sequence
  Description of Artificial Sequence: Synthetic oligonucleotide
agtgatactaatcgggcttcg

SEQ ID NO: 23492 - DNA, 21 bp, Artificial Sequence
  Description of Artificial Sequence: Synthetic oligonucleotide
atggacaaacccaccgccgcc

SEQ ID NO: 23493 - DNA, 21 bp, Artificial Sequence
  Description of Artificial Sequence: Synthetic oligonucleotide
gaacacaaagacaacaccaaa

SEQ ID NO: 23494 - DNA, 21 bp, Artificial Sequence
  Description of Artificial Sequence: Synthetic oligonucleotide
gacgccaccaccaaaaccgcc

SEQ ID NO: 23495 - DNA, 21 bp, Artificial Sequence
  Description of Artificial Sequence: Synthetic oligonucleotide
gccgccaccgccccccacggc

SEQ ID NO: 23496 - DNA, 21 bp, Artificial Sequence
  Description of Artificial Sequence: Synthetic oligonucleotide
ggtaatcaggagaatcggggt

SEQ ID NO: 23497 - DNA, 21 bp, Artificial Sequence
  Description of Artificial Sequence: Synthetic oligonucleotide
ggtgatttgccgactcagagg

SEQ ID NO: 23498 - DNA, 21 bp, Artificial Sequence
  Description of Artificial Sequence: Synthetic oligonucleotide
gtggtggggacttcgactggg

SEQ ID NO: 23499 - DNA, 21 bp, Artificial Sequence
  Description of Artificial Sequence: Synthetic oligonucleotide
tctagtacggcgccgggtact

SEQ ID NO: 23500 - DNA, 21 bp, Artificial Sequence
  Description of Artificial Sequence: Synthetic oligonucleotide
tctagtgagccgcgtagttcg

SEQ ID NO: 23501 - DNA, 21 bp, Artificial Sequence
  Description of Artificial Sequence: Synthetic oligonucleotide
ttggttgctaatacttctaag

SEQ ID NO: 23502 - DNA, 21 bp, Artificial Sequence
  Description of Artificial Sequence: Synthetic oligonucleotide
ctcgaaggcaaaggcctcaaa

SEQ ID NO: 23503 - DNA, 21 bp, Artificial Sequence
  Description of Artificial Sequence: Synthetic oligonucleotide
gacaccaccgccaaactcagc

SEQ ID NO: 23504 - DNA, 21 bp, Artificial Sequence
  Description of Artificial Sequence: Synthetic oligonucleotide
aaccccgtcgccggcaacaac

SEQ ID NO: 23505 - DNA, 21 bp, Artificial Sequence
  Description of Artificial Sequence: Synthetic oligonucleotide
agcggcgccaccaccgccacc

SEQ ID NO: 23506 - DNA, 21 bp, Artificial Sequence
  Description of Artificial Sequence: Synthetic oligonucleotide
cgttctgaggctgctgtgcat

SEQ ID NO: 23507 - DNA, 21 bp, Artificial Sequence
  Description of Artificial Sequence: Synthetic oligonucleotide
ggcgaaaaccccaccagaacc

SEQ ID NO: 23508 - DNA, 21 bp, Artificial Sequence
  Description of Artificial Sequence: Synthetic oligonucleotide
ggcgcccacgacaaaaccatc

SEQ ID NO: 23509 - DNA, 21 bp, Artificial Sequence
  Description of Artificial Sequence: Synthetic oligonucleotide
ggtagtactaagagtgcttgt

SEQ ID NO: 23510 - DNA, 21 bp, Artificial Sequence
  Description of Artificial Sequence: Synthetic oligonucleotide
gtcagaaacagcagcagcacc

SEQ ID NO: 23511 - DNA, 21 bp, Artificial Sequence
  Description of Artificial Sequence: Synthetic oligonucleotide
gaccaaagaagcgccagcgcc

SEQ ID NO: 23512 - DNA, 21 bp, Artificial Sequence
  Description of Artificial Sequence: Synthetic oligonucleotide
ggcaccaacaccggcaaaggc

SEQ ID NO: 23513 - DNA, 21 bp, Artificial Sequence
  Description of Artificial Sequence: Synthetic oligonucleotide
agcgtcgccaacgccccccac

SEQ ID NO: 23514 - DNA, 21 bp, Artificial Sequence
  Description of Artificial Sequence: Synthetic oligonucleotide
caagccatggaaaaaaccagc

SEQ ID NO: 23515 - DNA, 21 bp, Artificial Sequence
  Description of Artificial Sequence: Synthetic oligonucleotide
gatacgactaataataggcag

SEQ ID NO: 23516 - DNA, 21 bp, Artificial Sequence
  Description of Artificial Sequence: Synthetic oligonucleotide
gtttcgggggttagtaatact

SEQ ID NO: 23517 - DNA, 21 bp, Artificial Sequence
  Description of Artificial Sequence: Synthetic oligonucleotide
acgggtaatccgtcggtgcat

SEQ ID NO: 23518 - DNA, 21 bp, Artificial Sequence
  Description of Artificial Sequence: Synthetic oligonucleotide
cagtcggatagtccgcatacg

SEQ ID NO: 23519 - DNA, 21 bp, Artificial Sequence
  Description of Artificial Sequence: Synthetic oligonucleotide
ctcaacaccagccccaaccaa

SEQ ID NO: 23520 - DNA, 21 bp, Artificial Sequence
  Description of Artificial Sequence: Synthetic oligonucleotide
ggtccgggtaagagtgagggg

SEQ ID NO: 23521 - DNA, 21 bp, Artificial Sequence
  Description of Artificial Sequence: Synthetic oligonucleotide
aacggcgtcagcagcgtcaac

SEQ ID NO: 23522 - DNA, 21 bp, Artificial Sequence
  Description of Artificial Sequence: Synthetic oligonucleotide
aaccaaagcaacgtccaaggc

SEQ ID NO: 23523 - DNA, 21 bp, Artificial Sequence
  Description of Artificial Sequence: Synthetic oligonucleotide
agtagtacttctaatagggct

SEQ ID NO: 23524 - DNA, 21 bp, Artificial Sequence
  Description of Artificial Sequence: Synthetic oligonucleotide
gagcgggagaaggagactggt

SEQ ID NO: 23525 - DNA, 21 bp, Artificial Sequence
  Description of Artificial Sequence: Synthetic oligonucleotide
cagacgggttctacgagtatt

SEQ ID NO: 23526 - DNA, 21 bp, Artificial Sequence
  Description of Artificial Sequence: Synthetic oligonucleotide
ctcagcggccacaaaaccagc

SEQ ID NO: 23527 - DNA, 21 bp, Artificial Sequence
  Description of Artificial Sequence: Synthetic oligonucleotide
caggcttcgacgaaggctgtg

SEQ ID NO: 23528 - DNA, 21 bp, Artificial Sequence
  Description of Artificial Sequence: Synthetic oligonucleotide
gaaggcggccaaaaactcgcc

SEQ ID NO: 23529 - DNA, 21 bp, Artificial Sequence
  Description of Artificial Sequence: Synthetic oligonucleotide
gaccccgaaagaaacggcggc

SEQ ID NO: 23530 - DNA, 21 bp, Artificial Sequence
  Description of Artificial Sequence: Synthetic oligonucleotide
gcgggtaatgctcctgttagt

SEQ ID NO: 23531 - DNA, 21 bp, Artificial Sequence
  Description of Artificial Sequence: Synthetic oligonucleotide
tctgcggtgagtagtgcttct

SEQ ID NO: 23532 - DNA, 21 bp, Artificial Sequence
  Description of Artificial Sequence: Synthetic oligonucleotide
tctggtaaggatagggttatt

SEQ ID NO: 23533 - DNA, 21 bp, Artificial Sequence
  Description of Artificial Sequence: Synthetic oligonucleotide
tctggtaatagtcagactcag

SEQ ID NO: 23534 - DNA, 21 bp, Artificial Sequence
  Description of Artificial Sequence: Synthetic oligonucleotide
gggacttctggtagtgggtct

SEQ ID NO: 23535 - DNA, 21 bp, Artificial Sequence
  Description of Artificial Sequence: Synthetic oligonucleotide
aagccttctccgagtagtggg

SEQ ID NO: 23536 - DNA, 21 bp, Artificial Sequence
  Description of Artificial Sequence: Synthetic oligonucleotide
aacggcatcaacagcccccaa

SEQ ID NO: 23537 - DNA, 21 bp, Artificial Sequence
  Description of Artificial Sequence: Synthetic oligonucleotide
caaggcgtccaaggcctccaa

SEQ ID NO: 23538 - DNA, 21 bp, Artificial Sequence
  Description of Artificial Sequence: Synthetic oligonucleotide
gacagagtcagcagcagcaaa

SEQ ID NO: 23539 - DNA, 21 bp, Artificial Sequence
  Description of Artificial Sequence: Synthetic oligonucleotide
ggtactaataaggttagtttg

SEQ ID NO: 23540 - DNA, 21 bp, Artificial Sequence
  Description of Artificial Sequence: Synthetic oligonucleotide
aaggggacgcctgtttcgtcg

SEQ ID NO: 23541 - DNA, 21 bp, Artificial Sequence
  Description of Artificial Sequence: Synthetic oligonucleotide
acgggttcgagtcgtagtact

SEQ ID NO: 23542 - DNA, 21 bp, Artificial Sequence
  Description of Artificial Sequence: Synthetic oligonucleotide
agcaacaaaggcagcgacagc

SEQ ID NO: 23543 - DNA, 21 bp, Artificial Sequence
  Description of Artificial Sequence: Synthetic oligonucleotide
atgacggagcataggccgcct

SEQ ID NO: 23544 - DNA, 21 bp, Artificial Sequence
  Description of Artificial Sequence: Synthetic oligonucleotide
atttctgggacgactaatact

SEQ ID NO: 23545 - DNA, 21 bp, Artificial Sequence
  Description of Artificial Sequence: Synthetic oligonucleotide
cacagcgcccccagcagcgcc

SEQ ID NO: 23546 - DNA, 21 bp, Artificial Sequence
  Description of Artificial Sequence: Synthetic oligonucleotide
gacaaaagcagcaaacacagc

SEQ ID NO: 23547 - DNA, 21 bp, Artificial Sequence
  Description of Artificial Sequence: Synthetic oligonucleotide
gctggttctcctcagcttggg

SEQ ID NO: 23548 - DNA, 21 bp, Artificial Sequence
  Description of Artificial Sequence: Synthetic oligonucleotide
ggcagaaacaacgaacccctc

SEQ ID NO: 23549 - DNA, 21 bp, Artificial Sequence
  Description of Artificial Sequence: Synthetic oligonucleotide
ctcggcagcagcgtcgtccaa

SEQ ID NO: 23550 - DNA, 21 bp, Artificial Sequence
  Description of Artificial Sequence: Synthetic oligonucleotide
atgcatgagtctccgaatcgg

SEQ ID NO: 23551 - DNA, 21 bp, Artificial Sequence
  Description of Artificial Sequence: Synthetic oligonucleotide
actcagcggcaatctacgggg

SEQ ID NO: 23552 - DNA, 21 bp, Artificial Sequence
  Description of Artificial Sequence: Synthetic oligonucleotide
ggtctggcgacgccggctgtt

SEQ ID NO: 23553 - DNA, 21 bp, Artificial Sequence
  Description of Artificial Sequence: Synthetic oligonucleotide
gtcagcaaaaaagaccaagtc

SEQ ID NO: 23554 - DNA, 21 bp, Artificial Sequence
  Description of Artificial Sequence: Synthetic oligonucleotide
tctacggcgactccgcattcg

SEQ ID NO: 23555 - DNA, 21 bp, Artificial Sequence
  Description of Artificial Sequence: Synthetic oligonucleotide
caaagcaccccccccggcacc

SEQ ID NO: 23556 - DNA, 21 bp, Artificial Sequence
  Description of Artificial Sequence: Synthetic oligonucleotide
cagggggatattactaagggt

SEQ ID NO: 23557 - DNA, 21 bp, Artificial Sequence
  Description of Artificial Sequence: Synthetic oligonucleotide
gggattggtaatgataatatg

SEQ ID NO: 23558 - DNA, 21 bp, Artificial Sequence
  Description of Artificial Sequence: Synthetic oligonucleotide
ggggcggattctaggaagaat

SEQ ID NO: 23559 - DNA, 21 bp, Artificial Sequence
  Description of Artificial Sequence: Synthetic oligonucleotide
tataaggatgagctgcagagg

SEQ ID NO: 23560 - DNA, 21 bp, Artificial Sequence
  Description of Artificial Sequence: Synthetic oligonucleotide
agcagcgacatcaaaatgcaa

SEQ ID NO: 23561 - DNA, 21 bp, Artificial Sequence
  Description of Artificial Sequence: Synthetic oligonucleotide
actgtgggttctaatgcgttg

SEQ ID NO: 23562 - DNA, 21 bp, Artificial Sequence
  Description of Artificial Sequence: Synthetic oligonucleotide
gttgggtcgaattctactcat

SEQ ID NO: 23563 - DNA, 21 bp, Artificial Sequence
  Description of Artificial Sequence: Synthetic oligonucleotide
aagagtgatggttctacgagt

SEQ ID NO: 23564 - DNA, 21 bp, Artificial Sequence
  Description of Artificial Sequence: Synthetic oligonucleotide
acccccagcagcaccaacgtc

SEQ ID NO: 23565 - DNA, 21 bp, Artificial Sequence
  Description of Artificial Sequence: Synthetic oligonucleotide
gctcctacgaagagttctgag

SEQ ID NO: 23566 - DNA, 21 bp, Artificial Sequence
  Description of Artificial Sequence: Synthetic oligonucleotide
ggcagcatgaaaagcagcaac

SEQ ID NO: 23567 - DNA, 21 bp, Artificial Sequence
  Description of Artificial Sequence: Synthetic oligonucleotide
ggtctttcgggtgagaagccg

SEQ ID NO: 23568 - DNA, 21 bp, Artificial Sequence
  Description of Artificial Sequence: Synthetic oligonucleotide
tctgctgctaatacttctagg

SEQ ID NO: 23569 - DNA, 21 bp, Artificial Sequence
  Description of Artificial Sequence: Synthetic oligonucleotide
ggcaccgacagcaccaccaga

SEQ ID NO: 23570 - DNA, 21 bp, Artificial Sequence
  Description of Artificial Sequence: Synthetic oligonucleotide
agaaccaacaccacccccacc

SEQ ID NO: 23571 - DNA, 21 bp, Artificial Sequence
  Description of Artificial Sequence: Synthetic oligonucleotide
agtgctggtgggcatggtcag

SEQ ID NO: 23572 - DNA, 21 bp, Artificial Sequence
  Description of Artificial Sequence: Synthetic oligonucleotide
caacccctcaaaggcaacgcc

SEQ ID NO: 23573 - DNA, 21 bp, Artificial Sequence
  Description of Artificial Sequence: Synthetic oligonucleotide
catagggagaaggcttctggg

SEQ ID NO: 23574 - DNA, 21 bp, Artificial Sequence
  Description of Artificial Sequence: Synthetic oligonucleotide
ctcaccaccagaaccagcacc

SEQ ID NO: 23575 - DNA, 21 bp, Artificial Sequence
  Description of Artificial Sequence: Synthetic oligonucleotide
gctacggatcagggtaagctt

SEQ ID NO: 23576 - DNA, 21 bp, Artificial Sequence
  Description of Artificial Sequence: Synthetic oligonucleotide
gctagtaaggaggcgtctagt

SEQ ID NO: 23577 - DNA, 21 bp, Artificial Sequence
  Description of Artificial Sequence: Synthetic oligonucleotide
ggcgtcgtcggcagccccacc

SEQ ID NO: 23578 - DNA, 21 bp, Artificial Sequence
  Description of Artificial Sequence: Synthetic oligonucleotide
gcgaaggatgggcagtctcgt

SEQ ID NO: 23579 - DNA, 21 bp, Artificial Sequence
  Description of Artificial Sequence: Synthetic oligonucleotide
accagcgaccacagcagcagc

SEQ ID NO: 23580 - DNA, 21 bp, Artificial Sequence
  Description of Artificial Sequence: Synthetic oligonucleotide
ggcggcagccccggcgtccac

SEQ ID NO: 23581 - DNA, 21 bp, Artificial Sequence
  Description of Artificial Sequence: Synthetic oligonucleotide
aagggggaggggagtgttcat

SEQ ID NO: 23582 - DNA, 21 bp, Artificial Sequence
  Description of Artificial Sequence: Synthetic oligonucleotide
aagggttctgggaatacggtt

SEQ ID NO: 23583 - DNA, 21 bp, Artificial Sequence
  Description of Artificial Sequence: Synthetic oligonucleotide
aatagtgggtctactcctacg

SEQ ID NO: 23584 - DNA, 21 bp, Artificial Sequence
  Description of Artificial Sequence: Synthetic oligonucleotide
accaaagccggcagcaccgtc

SEQ ID NO: 23585 - DNA, 21 bp, Artificial Sequence
  Description of Artificial Sequence: Synthetic oligonucleotide
actgataaggctacttcgggg

SEQ ID NO: 23586 - DNA, 21 bp, Artificial Sequence
  Description of Artificial Sequence: Synthetic oligonucleotide
agccaaggcagcagcagcacc

SEQ ID NO: 23587 - DNA, 21 bp, Artificial Sequence
  Description of Artificial Sequence: Synthetic oligonucleotide
agcgccggcaccagcggcggc

SEQ ID NO: 23588 - DNA, 21 bp, Artificial Sequence
  Description of Artificial Sequence: Synthetic oligonucleotide
agcggcagcaccaaccacggc

SEQ ID NO: 23589 - DNA, 21 bp, Artificial Sequence
  Description of Artificial Sequence: Synthetic oligonucleotide
agcggcgccgaaaaagtccac

SEQ ID NO: 23590 - DNA, 21 bp, Artificial Sequence
  Description of Artificial Sequence: Synthetic oligonucleotide
agtcctgcgcattcgggtggt

SEQ ID NO: 23591 - DNA, 21 bp, Artificial Sequence
  Description of Artificial Sequence: Synthetic oligonucleotide
agttctaattcgcggagttcg

SEQ ID NO: 23592 - DNA, 21 bp, Artificial Sequence
  Description of Artificial Sequence: Synthetic oligonucleotide
atgagtacgtctcctgggacg

SEQ ID NO: 23593 - DNA, 21 bp, Artificial Sequence
  Description of Artificial Sequence: Synthetic oligonucleotide
cacagcgaagtcaaaagcggc

SEQ ID NO: 23594 - DNA, 21 bp, Artificial Sequence
  Description of Artificial Sequence: Synthetic oligonucleotide
gaaagaggcggccaaaccacc

SEQ ID NO: 23595 - DNA, 21 bp, Artificial Sequence
  Description of Artificial Sequence: Synthetic oligonucleotide
gacagcgaaagcaaaaacgtc

SEQ ID NO: 23596 - DNA, 21 bp, Artificial Sequence
  Description of Artificial Sequence: Synthetic oligonucleotide
gaggatggggcgtcgagggtg

SEQ ID NO: 23597 - DNA, 21 bp, Artificial Sequence
  Description of Artificial Sequence: Synthetic oligonucleotide
gataggcaggggtctgttgcg

SEQ ID NO: 23598 - DNA, 21 bp, Artificial Sequence
  Description of Artificial Sequence: Synthetic oligonucleotide
gccaccgccaccaaaggcaac

SEQ ID NO: 23599 - DNA, 21 bp, Artificial Sequence
  Description of Artificial Sequence: Synthetic oligonucleotide
gcgaataagagtcctcctgat

SEQ ID NO: 23600 - DNA, 21 bp, Artificial Sequence
  Description of Artificial Sequence: Synthetic oligonucleotide
gctcggggggcgtctactatt

SEQ ID NO: 23601 - DNA, 21 bp, Artificial Sequence
  Description of Artificial Sequence: Synthetic oligonucleotide
ggcaccgccaacggcggcccc

SEQ ID NO: 23602 - DNA, 21 bp, Artificial Sequence
  Description of Artificial Sequence: Synthetic oligonucleotide
ggcggcaccaaagccctcggc

SEQ ID NO: 23603 - DNA, 21 bp, Artificial Sequence
  Description of Artificial Sequence: Synthetic oligonucleotide
ggggttagttcgcctaagcag

SEQ ID NO: 23604 - DNA, 21 bp, Artificial Sequence
  Description of Artificial Sequence: Synthetic oligonucleotide
gttactgagtcgtctagtcgg

SEQ ID NO: 23605 - DNA, 21 bp, Artificial Sequence
  Description of Artificial Sequence: Synthetic oligonucleotide
tcgtctaaggatcatcctaat

SEQ ID NO: 23606 - DNA, 21 bp, Artificial Sequence
  Description of Artificial Sequence: Synthetic oligonucleotide
ttcggcaaaagccccagcaac

SEQ ID NO: 23607 - DNA, 21 bp, Artificial Sequence
  Description of Artificial Sequence: Synthetic oligonucleotide
atgatggcgaatgctaatcag

SEQ ID NO: 23608 - DNA, 21 bp, Artificial Sequence
  Description of Artificial Sequence: Synthetic oligonucleotide
aacggcagcaaacccaccatc

SEQ ID NO: 23609 - DNA, 21 bp, Artificial Sequence
  Description of Artificial Sequence: Synthetic oligonucleotide
cagagggggaatacgcctgag

SEQ ID NO: 23610 - DNA, 21 bp, Artificial Sequence
  Description of Artificial Sequence: Synthetic oligonucleotide
gaaacccaccccaaagccacc

SEQ ID NO: 23611 - DNA, 21 bp, Artificial Sequence
  Description of Artificial Sequence: Synthetic oligonucleotide
ggggttacgtctcataattcg

SEQ ID NO: 23612 - DNA, 21 bp, Artificial Sequence
  Description of Artificial Sequence: Synthetic oligonucleotide
ttgtctgggtcgcaggctgcg

SEQ ID NO: 23613 - DNA, 21 bp, Artificial Sequence
  Description of Artificial Sequence: Synthetic oligonucleotide
aacggcgccagcagccccaac

SEQ ID NO: 23614 - DNA, 21 bp, Artificial Sequence
  Description of Artificial Sequence: Synthetic oligonucleotide
atcagcaacagcaccagcggc

SEQ ID NO: 23615 - DNA, 21 bp, Artificial Sequence
  Description of Artificial Sequence: Synthetic oligonucleotide
cagacggtggataagcctcgt

SEQ ID NO: 23616 - DNA, 21 bp, Artificial Sequence
  Description of Artificial Sequence: Synthetic oligonucleotide
cggaggaatggtacggctgag

SEQ ID NO: 23617 - DNA, 21 bp, Artificial Sequence
  Description of Artificial Sequence: Synthetic oligonucleotide
ggtcttttggattcgaagtcg

SEQ ID NO: 23618 - DNA, 21 bp, Artificial Sequence
  Description of Artificial Sequence: Synthetic oligonucleotide
accagcaaaaccagccaactc

SEQ ID NO: 23619 - DNA, 21 bp, Artificial Sequence
  Description of Artificial Sequence: Synthetic oligonucleotide
agcaacagaagcagcaccgcc

SEQ ID NO: 23620 - DNA, 21 bp, Artificial Sequence
  Description of Artificial Sequence: Synthetic oligonucleotide
agcaacgccaccgccagcgcc

SEQ ID NO: 23621 - DNA, 21 bp, Artificial Sequence
  Description of Artificial Sequence: Synthetic oligonucleotide
caaaacggcggcaaaagcgtc

SEQ ID NO: 23622 - DNA, 21 bp, Artificial Sequence
  Description of Artificial Sequence: Synthetic oligonucleotide
tctagggagtcgaatcatagt

SEQ ID NO: 23623 - DNA, 21 bp, Artificial Sequence
  Description of Artificial Sequence: Synthetic oligonucleotide
actcaggcgacttcttcgtcg

SEQ ID NO: 23624 - DNA, 21 bp, Artificial Sequence
  Description of Artificial Sequence: Synthetic oligonucleotide
agcaccagcaaaaacagcccc

SEQ ID NO: 23625 - DNA, 21 bp, Artificial Sequence
  Description of Artificial Sequence: Synthetic oligonucleotide
agccaaaaagccggcagcgcc

SEQ ID NO: 23626 - DNA, 21 bp, Artificial Sequence
  Description of Artificial Sequence: Synthetic oligonucleotide
agcgcccccggcaacagcggc

SEQ ID NO: 23627 - DNA, 21 bp, Artificial Sequence
  Description of Artificial Sequence: Synthetic oligonucleotide
agtcttcggaaggatgggtct

SEQ ID NO: 23628 - DNA, 21 bp, Artificial Sequence
  Description of Artificial Sequence: Synthetic oligonucleotide
caaaacgaaacccccagaagc

SEQ ID NO: 23629 - DNA, 21 bp, Artificial Sequence
  Description of Artificial Sequence: Synthetic oligonucleotide
gacatccaaaacccccccaga

SEQ ID NO: 23630 - DNA, 21 bp, Artificial Sequence
  Description of Artificial Sequence: Synthetic oligonucleotide
gataataatcatgggaagctg

SEQ ID NO: 23631 - DNA, 21 bp, Artificial Sequence
  Description of Artificial Sequence: Synthetic oligonucleotide
gcgggggctggtcttcagagt

SEQ ID NO: 23632 - DNA, 21 bp, Artificial Sequence
  Description of Artificial Sequence: Synthetic oligonucleotide
gggagtgataaggtttcgaat

SEQ ID NO: 23633 - DNA, 21 bp, Artificial Sequence
  Description of Artificial Sequence: Synthetic oligonucleotide
tctcagacgccggtgggtgtt

SEQ ID NO: 23634 - DNA, 21 bp, Artificial Sequence
  Description of Artificial Sequence: Synthetic oligonucleotide
gataagtctcagcatgcgatg

SEQ ID NO: 23635 - DNA, 21 bp, Artificial Sequence
  Description of Artificial Sequence: Synthetic oligonucleotide
ggtgctagtccgtctaatggt

SEQ ID NO: 23636 - DNA, 21 bp, Artificial Sequence
  Description of Artificial Sequence: Synthetic oligonucleotide
cacgtcagcagcaaagccgac

SEQ ID NO: 23637 - DNA, 21 bp, Artificial Sequence
  Description of Artificial Sequence: Synthetic oligonucleotide
ctcgcccaaaaaagcagcacc

SEQ ID NO: 23638 - DNA, 21 bp, Artificial Sequence
  Description of Artificial Sequence: Synthetic oligonucleotide
attggtaagtctaatttgtcg

SEQ ID NO: 23639 - DNA, 21 bp, Artificial Sequence
  Description of Artificial Sequence: Synthetic oligonucleotide
caagccagcagcagccaaacc

SEQ ID NO: 23640 - DNA, 21 bp, Artificial Sequence
  Description of Artificial Sequence: Synthetic oligonucleotide
agaaccaccaccgacagagcc

SEQ ID NO: 23641 - DNA, 21 bp, Artificial Sequence
  Description of Artificial Sequence: Synthetic oligonucleotide
caagacctcaaaaccccccaa

SEQ ID NO: 23642 - DNA, 21 bp, Artificial Sequence
  Description of Artificial Sequence: Synthetic oligonucleotide
ggggctcctgtttctaatctg

SEQ ID NO: 23643 - DNA, 21 bp, Artificial Sequence
  Description of Artificial Sequence: Synthetic oligonucleotide
gtcaccagaaaagacagcatg

SEQ ID NO: 23644 - DNA, 21 bp, Artificial Sequence
  Description of Artificial Sequence: Synthetic oligonucleotide
gagcgtgctaatcatacgact

SEQ ID NO: 23645 - DNA, 21 bp, Artificial Sequence
  Description of Artificial Sequence: Synthetic oligonucleotide
acgcatgataataagtctatt

SEQ ID NO: 23646 - DNA, 21 bp, Artificial Sequence
  Description of Artificial Sequence: Synthetic oligonucleotide
gagacgagtagtactaatagg

SEQ ID NO: 23647 - DNA, 21 bp, Artificial Sequence
  Description of Artificial Sequence: Synthetic oligonucleotide
gagccggataatccgagtcgt

SEQ ID NO: 23648 - DNA, 21 bp, Artificial Sequence
  Description of Artificial Sequence: Synthetic oligonucleotide
gggactgggcagtctcgtgct

SEQ ID NO: 23649 - DNA, 21 bp, Artificial Sequence
  Description of Artificial Sequence: Synthetic oligonucleotide
tcgggtgtgcgggatacggct

SEQ ID NO: 23650 - DNA, 21 bp, Artificial Sequence
  Description of Artificial Sequence: Synthetic oligonucleotide
gatccgggtgcgaagcctttg

SEQ ID NO: 23651 - DNA, 21 bp, Artificial Sequence
  Description of Artificial Sequence: Synthetic oligonucleotide
ggcgtcctcaacagagacaaa

SEQ ID NO: 23652 - DNA, 21 bp, Artificial Sequence
  Description of Artificial Sequence: Synthetic oligonucleotide
tctcagcatgggacgagtagt

SEQ ID NO: 23653 - DNA, 21 bp, Artificial Sequence
  Description of Artificial Sequence: Synthetic oligonucleotide
actaaggatcatcaggctaat

SEQ ID NO: 23654 - DNA, 21 bp, Artificial Sequence
  Description of Artificial Sequence: Synthetic oligonucleotide
accggcaccaaccacgccctc

SEQ ID NO: 23655 - DNA, 21 bp, Artificial Sequence
  Description of Artificial Sequence: Synthetic oligonucleotide
cagaattcgaagccgagttct

SEQ ID NO: 23656 - DNA, 21 bp, Artificial Sequence
  Description of Artificial Sequence: Synthetic oligonucleotide
agcaccaacggcagccacggc

SEQ ID NO: 23657 - DNA, 21 bp, Artificial Sequence
  Description of Artificial Sequence: Synthetic oligonucleotide
aattctgggactcatggtagt

SEQ ID NO: 23658 - DNA, 21 bp, Artificial Sequence
  Description of Artificial Sequence: Synthetic oligonucleotide
acggggtctgagcatcagaat

SEQ ID NO: 23659 - DNA, 21 bp, Artificial Sequence
  Description of Artificial Sequence: Synthetic oligonucleotide
agcagaaacgacagcaacaaa

SEQ ID NO: 23660 - DNA, 21 bp, Artificial Sequence
  Description of Artificial Sequence: Synthetic oligonucleotide
agcctcaccagcgccaacgtc

SEQ ID NO: 23661 - DNA, 21 bp, Artificial Sequence
  Description of Artificial Sequence: Synthetic oligonucleotide
caccacagcaccgccagccaa

SEQ ID NO: 23662 - DNA, 21 bp, Artificial Sequence
  Description of Artificial Sequence: Synthetic oligonucleotide
gaggagagtcctaagaagggt

SEQ ID NO: 23663 - DNA, 21 bp, Artificial Sequence
  Description of Artificial Sequence: Synthetic oligonucleotide
gccggcgccagcagccaaggc

SEQ ID NO: 23664 - DNA, 21 bp, Artificial Sequence
  Description of Artificial Sequence: Synthetic oligonucleotide
actaatcagggtggtaatcat

SEQ ID NO: 23665 - DNA, 21 bp, Artificial Sequence
  Description of Artificial Sequence: Synthetic oligonucleotide
gccaccaccgccgcccccgtc

SEQ ID NO: 23666 - DNA, 21 bp, Artificial Sequence
  Description of Artificial Sequence: Synthetic oligonucleotide
aacggcatgagcagcagcacc

SEQ ID NO: 23667 - DNA, 21 bp, Artificial Sequence
  Description of Artificial Sequence: Synthetic oligonucleotide
agcaacagcgaaaccgccagc

SEQ ID NO: 23668 - DNA, 21 bp, Artificial Sequence
  Description of Artificial Sequence: Synthetic oligonucleotide
caacccgtcaccagcaaccaa

SEQ ID NO: 23669 - DNA, 21 bp, Artificial Sequence
  Description of Artificial Sequence: Synthetic oligonucleotide
gagggtaggggtacgtctcct

SEQ ID NO: 23670 - DNA, 21 bp, Artificial Sequence
  Description of Artificial Sequence: Synthetic oligonucleotide
gatcttaatgcgcagaagtct

SEQ ID NO: 23671 - DNA, 21 bp, Artificial Sequence
  Description of Artificial Sequence: Synthetic oligonucleotide
ggcgccgccaacgacaccaga

SEQ ID NO: 23672 - DNA, 21 bp, Artificial Sequence
  Description of Artificial Sequence: Synthetic oligonucleotide
ctcaacaacaccagcagcggc

SEQ ID NO: 23673 - DNA, 21 bp, Artificial Sequence
  Description of Artificial Sequence: Synthetic oligonucleotide
aaccaaaccagcaacccccac

SEQ ID NO: 23674 - DNA, 21 bp, Artificial Sequence
  Description of Artificial Sequence: Synthetic oligonucleotide
accagacaaaacagcagcaac

SEQ ID NO: 23675 - DNA, 21 bp, Artificial Sequence
  Description of Artificial Sequence: Synthetic oligonucleotide
agcaacgccggcggcaaaagc

SEQ ID NO: 23676 - DNA, 21 bp, Artificial Sequence
  Description of Artificial Sequence: Synthetic oligonucleotide
agcagcgacaccagcaaaggc

SEQ ID NO: 23677 - DNA, 21 bp, Artificial Sequence
  Description of Artificial Sequence: Synthetic oligonucleotide
agcgaagtcgccaaaagcggc

SEQ ID NO: 23678 - DNA, 21 bp, Artificial Sequence
  Description of Artificial Sequence: Synthetic oligonucleotide
agcgacgtcaaagcccacaac

SEQ ID NO: 23679 - DNA, 21 bp, Artificial Sequence
  Description of Artificial Sequence: Synthetic oligonucleotide
ctcggcgccgacagagtcgcc

SEQ ID NO: 23680 - DNA, 21 bp, Artificial Sequence
  Description of Artificial Sequence: Synthetic oligonucleotide
gacagcagaaccaccagcggc

SEQ ID NO: 23681 - DNA, 21 bp, Artificial Sequence
  Description of Artificial Sequence: Synthetic oligonucleotide
gccagcagcaccagcaccaga

SEQ ID NO: 23682 - DNA, 21 bp, Artificial Sequence
  Description of Artificial Sequence: Synthetic oligonucleotide
tgttctcagcctaaggctggt

SEQ ID NO: 23683 - DNA, 21 bp, Artificial Sequence
  Description of Artificial Sequence: Synthetic oligonucleotide
ggcctcgaaggcgccagcaga

SEQ ID NO: 23684 - DNA, 21 bp, Artificial Sequence
  Description of Artificial Sequence: Synthetic oligonucleotide
acccaaagcgacagacccccc

SEQ ID NO: 23685 - DNA, 21 bp, Artificial Sequence
  Description of Artificial Sequence: Synthetic oligonucleotide
actcagactcagtcggctagt

SEQ ID NO: 23686 - DNA, 21 bp, Artificial Sequence
  Description of Artificial Sequence: Synthetic oligonucleotide
caaggcagcgaaaacggcaga

SEQ ID NO: 23687 - DNA, 21 bp, Artificial Sequence
  Description of Artificial Sequence: Synthetic oligonucleotide
gaaggcaacagcagcagaagc

SEQ ID NO: 23688 - DNA, 21 bp, Artificial Sequence
  Description of Artificial Sequence: Synthetic oligonucleotide
gatacgccggctgctgctaag

SEQ ID NO: 23689 - DNA, 21 bp, Artificial Sequence
  Description of Artificial Sequence: Synthetic oligonucleotide
gcggcgtcgaatgggccgagt

SEQ ID NO: 23690 - DNA, 21 bp, Artificial Sequence
  Description of Artificial Sequence: Synthetic oligonucleotide
ggggctacgtcgagtgcttct

SEQ ID NO: 23691 - DNA, 21 bp, Artificial Sequence
  Description of Artificial Sequence: Synthetic oligonucleotide
agccaaagcacccccagcgtc

SEQ ID NO: 23692 - DNA, 21 bp, Artificial Sequence
  Description of Artificial Sequence: Synthetic oligonucleotide
acgtctaagtctacttcgacg

SEQ ID NO: 23693 - DNA, 21 bp, Artificial Sequence
  Description of Artificial Sequence: Synthetic oligonucleotide
gatgggcctcgtacttctgtt

SEQ ID NO: 23694 - DNA, 21 bp, Artificial Sequence
  Description of Artificial Sequence: Synthetic oligonucleotide
agcaacagcgccagactcggc

SEQ ID NO: 23695 - DNA, 21 bp, Artificial Sequence
  Description of Artificial Sequence: Synthetic oligonucleotide
actccgacggatggtaggtct

SEQ ID NO: 23696 - DNA, 21 bp, Artificial Sequence
  Description of Artificial Sequence: Synthetic oligonucleotide
acccccaacagcagacccgaa

SEQ ID NO: 23697 - DNA, 21 bp, Artificial Sequence
  Description of Artificial Sequence: Synthetic oligonucleotide
acgagtaatgcgcataatgtt

SEQ ID NO: 23698 - DNA, 21 bp, Artificial Sequence
  Description of Artificial Sequence: Synthetic oligonucleotide
agcaccgccgccagcaccgcc

SEQ ID NO: 23699 - DNA, 21 bp, Artificial Sequence
  Description of Artificial Sequence: Synthetic oligonucleotide
agtctggggaatcagggtgcg

SEQ ID NO: 23700 - DNA, 21 bp, Artificial Sequence
  Description of Artificial Sequence: Synthetic oligonucleotide
gaaaacagcagagtcggcacc

SEQ ID NO: 23701 - DNA, 21 bp, Artificial Sequence
  Description of Artificial Sequence: Synthetic oligonucleotide
gaaggcaaagccagcgtcctc

SEQ ID NO: 23702 - DNA, 21 bp, Artificial Sequence
  Description of Artificial Sequence: Synthetic oligonucleotide
gattctaggactgcggggaat

SEQ ID NO: 23703 - DNA, 21 bp, Artificial Sequence
  Description of Artificial Sequence: Synthetic oligonucleotide
ggcagacaaggcaccgacaaa

SEQ ID NO: 23704 - DNA, 21 bp, Artificial Sequence
  Description of Artificial Sequence: Synthetic oligonucleotide
ggccccagcagcaccatcagc

SEQ ID NO: 23705 - DNA, 21 bp, Artificial Sequence
  Description of Artificial Sequence: Synthetic oligonucleotide
ggcgccctccccagccaaacc

SEQ ID NO: 23706 - DNA, 21 bp, Artificial Sequence
  Description of Artificial Sequence: Synthetic oligonucleotide
ggtagtaatgggggtaggtct

SEQ ID NO: 23707 - DNA, 21 bp, Artificial Sequence
  Description of Artificial Sequence: Synthetic oligonucleotide
ggtttgggggaggatcgggtt

SEQ ID NO: 23708 - DNA, 21 bp, Artificial Sequence
  Description of Artificial Sequence: Synthetic oligonucleotide
tcgcagaatactgggcatccg

SEQ ID NO: 23709 - DNA, 21 bp, Artificial Sequence
  Description of Artificial Sequence: Synthetic oligonucleotide
actagtgggtctgctcgggat

SEQ ID NO: 23710 - DNA, 21 bp, Artificial Sequence
  Description of Artificial Sequence: Synthetic oligonucleotide
gctcagggtcaggggcatgct

SEQ ID NO: 23711 - DNA, 21 bp, Artificial Sequence
  Description of Artificial Sequence: Synthetic oligonucleotide
ctcgccgccggcagcagcggc

SEQ ID NO: 23712 - DNA, 21 bp, Artificial Sequence
  Description of Artificial Sequence: Synthetic oligonucleotide
aacctcagcaccgccggcagc

SEQ ID NO: 23713 - DNA, 21 bp, Artificial Sequence
  Description of Artificial Sequence: Synthetic oligonucleotide
accagcaacgccaacaacaaa

SEQ ID NO: 23714 - DNA, 21 bp, Artificial Sequence
  Description of Artificial Sequence: Synthetic oligonucleotide
agaggcaccccccccagcgac

SEQ ID NO: 23715 - DNA, 21 bp, Artificial Sequence
  Description of Artificial Sequence: Synthetic oligonucleotide
agcgccaaccaagccggcagc

SEQ ID NO: 23716 - DNA, 21 bp, Artificial Sequence
  Description of Artificial Sequence: Synthetic oligonucleotide
cagaagggtgagactgtggcg

SEQ ID NO: 23717 - DNA, 21 bp, Artificial Sequence
  Description of Artificial Sequence: Synthetic oligonucleotide
tctcagtcgtctggtgtgagt

SEQ ID NO: 23718 - DNA, 21 bp, Artificial Sequence
  Description of Artificial Sequence: Synthetic oligonucleotide
ctgtctggtaaggctgggggt

SEQ ID NO: 23719 - DNA, 21 bp, Artificial Sequence
  Description of Artificial Sequence: Synthetic oligonucleotide
agcagcggcagcaaccacatc

SEQ ID NO: 23720 - DNA, 21 bp, Artificial Sequence
  Description of Artificial Sequence: Synthetic oligonucleotide
aggcagggttctactcctgct

SEQ ID NO: 23721 - DNA, 21 bp, Artificial Sequence
  Description of Artificial Sequence: Synthetic oligonucleotide
gacgccctcagcaaaaccagc

SEQ ID NO: 23722 - DNA, 21 bp, Artificial Sequence
  Description of Artificial Sequence: Synthetic oligonucleotide
ggcgccagaagccccaccaac

SEQ ID NO: 23723 - DNA, 21 bp, Artificial Sequence
  Description of Artificial Sequence: Synthetic oligonucleotide
ctgcctacgcagcattcttcg

SEQ ID NO: 23724 - DNA, 21 bp, Artificial Sequence
  Description of Artificial Sequence: Synthetic oligonucleotide
gttacttcgtctggttctcag

SEQ ID NO: 23725 - DNA, 21 bp, Artificial Sequence
  Description of Artificial Sequence: Synthetic oligonucleotide
aaaaccgaaagccccatggcc

SEQ ID NO: 23726 - DNA, 21 bp, Artificial Sequence
  Description of Artificial Sequence: Synthetic oligonucleotide
acccccgaccaaaaaatggtc

SEQ ID NO: 23727 - DNA, 21 bp, Artificial Sequence
  Description of Artificial Sequence: Synthetic oligonucleotide
agcaacatggaaagacccagc

SEQ ID NO: 23728 - DNA, 21 bp, Artificial Sequence
  Description of Artificial Sequence: Synthetic oligonucleotide
agcaacgacaaactcaacgcc

SEQ ID NO: 23729 - DNA, 21 bp, Artificial Sequence
  Description of Artificial Sequence: Synthetic oligonucleotide
ctgctgagtaataagtcgggg

SEQ ID NO: 23730 - DNA, 21 bp, Artificial Sequence
  Description of Artificial Sequence: Synthetic oligonucleotide
gccggcgccagccccggcaga

SEQ ID NO: 23731 - DNA, 21 bp, Artificial Sequence
  Description of Artificial Sequence: Synthetic oligonucleotide
tctgggcagggtgagcatagt

SEQ ID NO: 23732 - DNA, 21 bp, Artificial Sequence
  Description of Artificial Sequence: Synthetic oligonucleotide
accggcaaacccagcaccctc

SEQ ID NO: 23733 - DNA, 21 bp, Artificial Sequence
  Description of Artificial Sequence: Synthetic oligonucleotide
tctcctacggagcctgtgagg

SEQ ID NO: 23734 - DNA, 21 bp, Artificial Sequence
  Description of Artificial Sequence: Synthetic oligonucleotide
ggtgcgggtacgcatggtgcg

SEQ ID NO: 23735 - DNA, 21 bp, Artificial Sequence
  Description of Artificial Sequence: Synthetic oligonucleotide
aaccaacaacaaaccaccacc

SEQ ID NO: 23736 - DNA, 21 bp, Artificial Sequence
  Description of Artificial Sequence: Synthetic oligonucleotide
gagggttcgagtccggttatg

SEQ ID NO: 23737 - DNA, 21 bp, Artificial Sequence
  Description of Artificial Sequence: Synthetic oligonucleotide
tcgcgtgagaatgttcctagt

SEQ ID NO: 23738 - DNA, 21 bp, Artificial Sequence
  Description of Artificial Sequence: Synthetic oligonucleotide
tctgggcagactcagcgtgcg

SEQ ID NO: 23739 - DNA, 21 bp, Artificial Sequence
  Description of Artificial Sequence: Synthetic oligonucleotide
actggtgttagtggtcatttg

SEQ ID NO: 23740 - DNA, 21 bp, Artificial Sequence
  Description of Artificial Sequence: Synthetic oligonucleotide
gaggcgcagtcgggttctcgg

SEQ ID NO: 23741 - DNA, 21 bp, Artificial Sequence
  Description of Artificial Sequence: Synthetic oligonucleotide
acgaatgcttcgaagccgtct

SEQ ID NO: 23742 - DNA, 21 bp, Artificial Sequence
  Description of Artificial Sequence: Synthetic oligonucleotide
aacaccggccaaaaaggcctc

SEQ ID NO: 23743 - DNA, 21 bp, Artificial Sequence
  Description of Artificial Sequence: Synthetic oligonucleotide
gtcaaagacgcccccaaaacc

SEQ ID NO: 23744 - DNA, 21 bp, Artificial Sequence
  Description of Artificial Sequence: Synthetic oligonucleotide
caggtgggtaagaatcctctg

SEQ ID NO: 23745 - DNA, 21 bp, Artificial Sequence
  Description of Artificial Sequence: Synthetic oligonucleotide
gacaaacaaaaaagcagctac

SEQ ID NO: 23746 - DNA, 21 bp, Artificial Sequence
  Description of Artificial Sequence: Synthetic oligonucleotide
gatggttcggggaatttgagg

SEQ ID NO: 23747 - DNA, 21 bp, Artificial Sequence
  Description of Artificial Sequence: Synthetic oligonucleotide
gccgaacaaagcgtcaccaaa

SEQ ID NO: 23748 - DNA, 21 bp, Artificial Sequence
  Description of Artificial Sequence: Synthetic oligonucleotide
gcgggtgtgacggggcatagg

SEQ ID NO: 23749 - DNA, 21 bp, Artificial Sequence
  Description of Artificial Sequence: Synthetic oligonucleotide
gttaagggtcaggcgggtcag

SEQ ID NO: 23750 - DNA, 21 bp, Artificial Sequence
  Description of Artificial Sequence: Synthetic oligonucleotide
attggtacgggggcgtctagg

SEQ ID NO: 23751 - DNA, 21 bp, Artificial Sequence
  Description of Artificial Sequence: Synthetic oligonucleotide
tcgagtaagccttctcctgat

SEQ ID NO: 23752 - DNA, 21 bp, Artificial Sequence
  Description of Artificial Sequence: Synthetic oligonucleotide
atccacaacgacagcgtcaaa

SEQ ID NO: 23753 - DNA, 21 bp, Artificial Sequence
  Description of Artificial Sequence: Synthetic oligonucleotide
caaaaccccgccgccaccagc

SEQ ID NO: 23754 - DNA, 21 bp, Artificial Sequence
  Description of Artificial Sequence: Synthetic oligonucleotide
agaaccgaaagcaccgccaga

SEQ ID NO: 23755 - DNA, 21 bp, Artificial Sequence
  Description of Artificial Sequence: Synthetic oligonucleotide
atgaacaccggcagccccacc

SEQ ID NO: 23756 - DNA, 21 bp, Artificial Sequence
  Description of Artificial Sequence: Synthetic oligonucleotide
gccggcgaaggcaaactcagc

SEQ ID NO: 23757 - DNA, 21 bp, Artificial Sequence
  Description of Artificial Sequence: Synthetic oligonucleotide
tcttcttctaatgcgatgaag

SEQ ID NO: 23758 - DNA, 21 bp, Artificial Sequence
  Description of Artificial Sequence: Synthetic oligonucleotide
accgacggcaaacaccaaggc

SEQ ID NO: 23759 - DNA, 21 bp, Artificial Sequence
  Description of Artificial Sequence: Synthetic oligonucleotide
gatgcgagtcctgggcatact

SEQ ID NO: 23760 - DNA, 21 bp, Artificial Sequence
  Description of Artificial Sequence: Synthetic oligonucleotide
tctactggtagtcagagtcct

SEQ ID NO: 23761 - DNA, 21 bp, Artificial Sequence
  Description of Artificial Sequence: Synthetic oligonucleotide
ctgaatggtgctacgacggct

SEQ ID NO: 23762 - DNA, 21 bp, Artificial Sequence
  Description of Artificial Sequence: Synthetic oligonucleotide
aacctcaccagcagcggcggc

SEQ ID NO: 23763 - DNA, 21 bp, Artificial Sequence
  Description of Artificial Sequence: Synthetic oligonucleotide
aacgccagcagcgaaagacac

SEQ ID NO: 23764 - DNA, 21 bp, Artificial Sequence
  Description of Artificial Sequence: Synthetic oligonucleotide
agcctccccagcaacggcggc

SEQ ID NO: 23765 - DNA, 21 bp, Artificial Sequence
  Description of Artificial Sequence: Synthetic oligonucleotide
atggacagcagaaacagcggc

SEQ ID NO: 23766 - DNA, 21 bp, Artificial Sequence
  Description of Artificial Sequence: Synthetic oligonucleotide
ggggctagtaagggtccttat

SEQ ID NO: 23767 - DNA, 21 bp, Artificial Sequence
  Description of Artificial Sequence: Synthetic oligonucleotide
tcgttggctcagacgcctaag

SEQ ID NO: 23768 - DNA, 21 bp, Artificial Sequence
  Description of Artificial Sequence: Synthetic oligonucleotide
cacagcgaaagcaaacaaagc

SEQ ID NO: 23769 - DNA, 21 bp, Artificial Sequence
  Description of Artificial Sequence: Synthetic oligonucleotide
aaagtcaccgacaaaagcctc

SEQ ID NO: 23770 - DNA, 21 bp, Artificial Sequence
  Description of Artificial Sequence: Synthetic oligonucleotide
caaatgcccggcgaacacagc

SEQ ID NO: 23771 - DNA, 21 bp, Artificial Sequence
  Description of Artificial Sequence: Synthetic oligonucleotide
caagacacccaacaacccaga

SEQ ID NO: 23772 - DNA, 21 bp, Artificial Sequence
  Description of Artificial Sequence: Synthetic oligonucleotide
caaggcaaaaccggcagcacc

SEQ ID NO: 23773 - DNA, 21 bp, Artificial Sequence
  Description of Artificial Sequence: Synthetic oligonucleotide
ggcaacagcaccagcgccgtc

SEQ ID NO: 23774 - DNA, 21 bp, Artificial Sequence
  Description of Artificial Sequence: Synthetic oligonucleotide
ggcggcaacagcaaaggcgtc

SEQ ID NO: 23775 - DNA, 21 bp, Artificial Sequence
  Description of Artificial Sequence: Synthetic oligonucleotide
tcgagtgcggggtcttctgcg

SEQ ID NO: 23776 - DNA, 21 bp, Artificial Sequence
  Description of Artificial Sequence: Synthetic oligonucleotide
cagggggatgcggctagggtt

SEQ ID NO: 23777 - DNA, 21 bp, Artificial Sequence
  Description of Artificial Sequence: Synthetic oligonucleotide
catcatgggcagaatgggtcg

SEQ ID NO: 23778 - DNA, 21 bp, Artificial Sequence
  Description of Artificial Sequence: Synthetic oligonucleotide
gccaacgaacccaacctcaga

SEQ ID NO: 23779 - DNA, 21 bp, Artificial Sequence
  Description of Artificial Sequence: Synthetic oligonucleotide
gttaattcggggcatactgtt

SEQ ID NO: 23780 - DNA, 21 bp, Artificial Sequence
  Description of Artificial Sequence: Synthetic oligonucleotide
gttccttcgagtcagagtaag

SEQ ID NO: 23781 - DNA, 21 bp, Artificial Sequence
  Description of Artificial Sequence: Synthetic oligonucleotide
ggcctcagcaccaaagacagc

SEQ ID NO: 23782 - DNA, 21 bp, Artificial Sequence
  Description of Artificial Sequence: Synthetic oligonucleotide
agtactcagccgtcggttaag

SEQ ID NO: 23783 - DNA, 21 bp, Artificial Sequence
  Description of Artificial Sequence: Synthetic oligonucleotide
cagatgtcggagcccaagcag

SEQ ID NO: 23784 - DNA, 21 bp, Artificial Sequence
  Description of Artificial Sequence: Synthetic oligonucleotide
aaccacaacccccccagcggc

SEQ ID NO: 23785 - DNA, 21 bp, Artificial Sequence
  Description of Artificial Sequence: Synthetic oligonucleotide
aagggtcagcttgctaatgtt

SEQ ID NO: 23786 - DNA, 21 bp, Artificial Sequence
  Description of Artificial Sequence: Synthetic oligonucleotide
accgacaccgccaaccccaga

SEQ ID NO: 23787 - DNA, 21 bp, Artificial Sequence
  Description of Artificial Sequence: Synthetic oligonucleotide
agcgtccaaagaaacggcgaa

SEQ ID NO: 23788 - DNA, 21 bp, Artificial Sequence
  Description of Artificial Sequence: Synthetic oligonucleotide
ggcaccaaaagccccacccaa

SEQ ID NO: 23789 - DNA, 21 bp, Artificial Sequence
  Description of Artificial Sequence: Synthetic oligonucleotide
tctagtacgtctactcatggg

SEQ ID NO: 23790 - DNA, 21 bp, Artificial Sequence
  Description of Artificial Sequence: Synthetic oligonucleotide
ggggtgacgaagggttcgtcg

SEQ ID NO: 23791 - DNA, 21 bp, Artificial Sequence
  Description of Artificial Sequence: Synthetic oligonucleotide
aacagcggcagcaacggcggc

SEQ ID NO: 23792 - DNA, 21 bp, Artificial Sequence
  Description of Artificial Sequence: Synthetic oligonucleotide
agcgtcggcagcaccaacggc

SEQ ID NO: 23793 - DNA, 21 bp, Artificial Sequence
  Description of Artificial Sequence: Synthetic oligonucleotide
gatgttgctacttctaatcgt

SEQ ID NO: 23794 - DNA, 21 bp, Artificial Sequence
  Description of Artificial Sequence: Synthetic oligonucleotide
ggtttggtgaagccgaatatg

SEQ ID NO: 23795 - DNA, 21 bp, Artificial Sequence
  Description of Artificial Sequence: Synthetic oligonucleotide
agcaaagccagcgcccccagc

SEQ ID NO: 23796 - DNA, 21 bp, Artificial Sequence
  Description of Artificial Sequence: Synthetic oligonucleotide
agcatgagcagcagcaacacc

SEQ ID NO: 23797 - DNA, 21 bp, Artificial Sequence
  Description of Artificial Sequence: Synthetic oligonucleotide
agcggcgccggcggcaccagc

SEQ ID NO: 23798 - DNA, 21 bp, Artificial Sequence
  Description of Artificial Sequence: Synthetic oligonucleotide
atgagggataatcagacgcag

SEQ ID NO: 23799 - DNA, 21 bp, Artificial Sequence
  Description of Artificial Sequence: Synthetic oligonucleotide
gggaataagcagcagccgctt

SEQ ID NO: 23800 - DNA, 21 bp, Artificial Sequence
  Description of Artificial Sequence: Synthetic oligonucleotide
tcgccgttgagttcgaaggat

SEQ ID NO: 23801 - DNA, 21 bp, Artificial Sequence
  Description of Artificial Sequence: Synthetic oligonucleotide
acgggtagtgatcctcttaag

SEQ ID NO: 23802 - DNA, 21 bp, Artificial Sequence
  Description of Artificial Sequence: Synthetic oligonucleotide
atgactactgggagtactccg

SEQ ID NO: 23803 - DNA, 21 bp, Artificial Sequence
  Description of Artificial Sequence: Synthetic oligonucleotide
cagaatgatggtaatcggcat

SEQ ID NO: 23804 - DNA, 21 bp, Artificial Sequence
  Description of Artificial Sequence: Synthetic oligonucleotide
gatagtggtaatggtaagctg

SEQ ID NO: 23805 - DNA, 21 bp, Artificial Sequence
  Description of Artificial Sequence: Synthetic oligonucleotide
gccagagacaacaacaacatc

SEQ ID NO: 23806 - DNA, 21 bp, Artificial Sequence
  Description of Artificial Sequence: Synthetic oligonucleotide
agcaccaccagccccaacagc

SEQ ID NO: 23807 - DNA, 21 bp, Artificial Sequence
  Description of Artificial Sequence: Synthetic oligonucleotide
aacagaaccaccagcagccaa

SEQ ID NO: 23808 - DNA, 21 bp, Artificial Sequence
  Description of Artificial Sequence: Synthetic oligonucleotide
atcgccaccagccacagcacc

SEQ ID NO: 23809 - DNA, 21 bp, Artificial Sequence
  Description of Artificial Sequence: Synthetic oligonucleotide
caaccccaaaaagacagcgtc

SEQ ID NO: 23810 - DNA, 21 bp, Artificial Sequence
  Description of Artificial Sequence: Synthetic oligonucleotide
cacgccggcaaaaccaccctc

SEQ ID NO: 23811 - DNA, 21 bp, Artificial Sequence
  Description of Artificial Sequence: Synthetic oligonucleotide
ctccaagccgccggcagcacc

SEQ ID NO: 23812 - DNA, 21 bp, Artificial Sequence
  Description of Artificial Sequence: Synthetic oligonucleotide
cagggttctgctccggtgcag

SEQ ID NO: 23813 - DNA, 21 bp, Artificial Sequence
  Description of Artificial Sequence: Synthetic oligonucleotide
acgtcgggtaatacgtcgggt

SEQ ID NO: 23814 - DNA, 21 bp, Artificial Sequence
  Description of Artificial Sequence: Synthetic oligonucleotide
caggtgaagactccgaatgtg

SEQ ID NO: 23815 - DNA, 21 bp, Artificial Sequence
  Description of Artificial Sequence: Synthetic oligonucleotide
agcggcaacacccccagcctc

SEQ ID NO: 23816 - DNA, 21 bp, Artificial Sequence
  Description of Artificial Sequence: Synthetic oligonucleotide
gggaatacgcagggtatttcg

SEQ ID NO: 23817 - DNA, 21 bp, Artificial Sequence
  Description of Artificial Sequence: Synthetic oligonucleotide
aaaggcaccaacggcgccagc

SEQ ID NO: 23818 - DNA, 21 bp, Artificial Sequence
  Description of Artificial Sequence: Synthetic oligonucleotide
aattcggggcagaagattgat

SEQ ID NO: 23819 - DNA, 21 bp, Artificial Sequence
  Description of Artificial Sequence: Synthetic oligonucleotide
accaaaatcagcggcgccacc

SEQ ID NO: 23820 - DNA, 21 bp, Artificial Sequence
  Description of Artificial Sequence: Synthetic oligonucleotide
accatgcccaaaggcgacaac

SEQ ID NO: 23821 - DNA, 21 bp, Artificial Sequence
  Description of Artificial Sequence: Synthetic oligonucleotide
acgcgttcgaattcgaataat

SEQ ID NO: 23822 - DNA, 21 bp, Artificial Sequence
  Description of Artificial Sequence: Synthetic oligonucleotide
acgggtgatagtcctactcat

SEQ ID NO: 23823 - DNA, 21 bp, Artificial Sequence
  Description of Artificial Sequence: Synthetic oligonucleotide
actcctggtacttcgcgggtt

SEQ ID NO: 23824 - DNA, 21 bp, Artificial Sequence
  Description of Artificial Sequence: Synthetic oligonucleotide
acttctccgggtagtcatact

SEQ ID NO: 23825 - DNA, 21 bp, Artificial Sequence
  Description of Artificial Sequence: Synthetic oligonucleotide
agcaaaagcaccctcgccacc

SEQ ID NO: 23826 - DNA, 21 bp, Artificial Sequence
  Description of Artificial Sequence: Synthetic oligonucleotide
agcaccgccagcaaccccgtc

SEQ ID NO: 23827 - DNA, 21 bp, Artificial Sequence
  Description of Artificial Sequence: Synthetic oligonucleotide
agcagcaccaacgcccaaagc

SEQ ID NO: 23828 - DNA, 21 bp, Artificial Sequence
  Description of Artificial Sequence: Synthetic oligonucleotide
agcgccgacaccaaaaccagc

SEQ ID NO: 23829 - DNA, 21 bp, Artificial Sequence
  Description of Artificial Sequence: Synthetic oligonucleotide
agtcctatggcgagtaagggt

SEQ ID NO: 23830 - DNA, 21 bp, Artificial Sequence
  Description of Artificial Sequence: Synthetic oligonucleotide
agtggtgatacggtgcatcgt

SEQ ID NO: 23831 - DNA, 21 bp, Artificial Sequence
  Description of Artificial Sequence: Synthetic oligonucleotide
caaaccggcagagacagcacc

SEQ ID NO: 23832 - DNA, 21 bp, Artificial Sequence
  Description of Artificial Sequence: Synthetic oligonucleotide
cagcctaataatggtactagg

SEQ ID NO: 23833 - DNA, 21 bp, Artificial Sequence
  Description of Artificial Sequence: Synthetic oligonucleotide
cagcctgcgaaggggaatatg

SEQ ID NO: 23834 - DNA, 21 bp, Artificial Sequence
  Description of Artificial Sequence: Synthetic oligonucleotide
cggaatggtcagacggctggt

SEQ ID NO: 23835 - DNA, 21 bp, Artificial Sequence
  Description of Artificial Sequence: Synthetic oligonucleotide
cttaagagttcttcggggggt

SEQ ID NO: 23836 - DNA, 21 bp, Artificial Sequence
  Description of Artificial Sequence: Synthetic oligonucleotide
gaaatcaacaaaagcaacatg

SEQ ID NO: 23837 - DNA, 21 bp, Artificial Sequence
  Description of Artificial Sequence: Synthetic oligonucleotide
gacagaggcggcagcacccac

SEQ ID NO: 23838 - DNA, 21 bp, Artificial Sequence
  Description of Artificial Sequence: Synthetic oligonucleotide
gacagcggccacgaaaaaccc

SEQ ID NO: 23839 - DNA, 21 bp, Artificial Sequence
  Description of Artificial Sequence: Synthetic oligonucleotide
gagacgggtagtgagaggact

SEQ ID NO: 23840 - DNA, 21 bp, Artificial Sequence
  Description of Artificial Sequence: Synthetic oligonucleotide
gaggcgaaggagcctcgttct

SEQ ID NO: 23841 - DNA, 21 bp, Artificial Sequence
  Description of Artificial Sequence: Synthetic oligonucleotide
gaggggggttcgactcaggtg

SEQ ID NO: 23842 - DNA, 21 bp, Artificial Sequence
  Description of Artificial Sequence: Synthetic oligonucleotide
gagggttctcgtaagatggat

SEQ ID NO: 23843 - DNA, 21 bp, Artificial Sequence
  Description of Artificial Sequence: Synthetic oligonucleotide
gatgttaatgatcgtcgtacg

SEQ ID NO: 23844 - DNA, 21 bp, Artificial Sequence
  Description of Artificial Sequence: Synthetic oligonucleotide
gccaaagccgacaaaaacacc

SEQ ID NO: 23845 - DNA, 21 bp, Artificial Sequence
  Description of Artificial Sequence: Synthetic oligonucleotide
gcgggggggcaggttactagg

SEQ ID NO: 23846 - DNA, 21 bp, Artificial Sequence
  Description of Artificial Sequence: Synthetic oligonucleotide
gctggtcattctgcgcctgct

SEQ ID NO: 23847 - DNA, 21 bp, Artificial Sequence
  Description of Artificial Sequence: Synthetic oligonucleotide
ggcatcaccagcagcaacaaa

SEQ ID NO: 23848 - DNA, 21 bp, Artificial Sequence
  Description of Artificial Sequence: Synthetic oligonucleotide
ggtaagggtaatagtacggcg

SEQ ID NO: 23849 - DNA, 21 bp, Artificial Sequence
  Description of Artificial Sequence: Synthetic oligonucleotide
tcgacgaatgctcattcgggt

SEQ ID NO: 23850 - DNA, 21 bp, Artificial Sequence
  Description of Artificial Sequence: Synthetic oligonucleotide
tctgatagtcgggctactgtg

SEQ ID NO: 23851 - DNA, 21 bp, Artificial Sequence
  Description of Artificial Sequence: Synthetic oligonucleotide
tctgtgaattcgccggcgctc

SEQ ID NO: 23852 - DNA, 21 bp, Artificial Sequence
  Description of Artificial Sequence: Synthetic oligonucleotide
ggcagcagcaaaggcagcggc

SEQ ID NO: 23853 - DNA, 21 bp, Artificial Sequence
  Description of Artificial Sequence: Synthetic oligonucleotide
gccggcggcgaaagacccaac

SEQ ID NO: 23854 - DNA, 21 bp, Artificial Sequence
  Description of Artificial Sequence: Synthetic oligonucleotide
agtggtagtgatcgtactcgt

SEQ ID NO: 23855 - DNA, 21 bp, Artificial Sequence
  Description of Artificial Sequence: Synthetic oligonucleotide
gccaccaccagcgacagaagc

SEQ ID NO: 23856 - DNA, 21 bp, Artificial Sequence
  Description of Artificial Sequence: Synthetic oligonucleotide
gagcgtagtcagtcggtgtcg

SEQ ID NO: 23857 - DNA, 21 bp, Artificial Sequence
  Description of Artificial Sequence: Synthetic oligonucleotide
agcagaacccaaagcgtcagc

SEQ ID NO: 23858 - DNA, 21 bp, Artificial Sequence
  Description of Artificial Sequence: Synthetic oligonucleotide
gacggcagcagcacccacatc

SEQ ID NO: 23859 - DNA, 21 bp, Artificial Sequence
  Description of Artificial Sequence: Synthetic oligonucleotide
acggcgacgcaggctagtact

SEQ ID NO: 23860 - DNA, 21 bp, Artificial Sequence
  Description of Artificial Sequence: Synthetic oligonucleotide
gggtctgctactcagcattcg

SEQ ID NO: 23861 - DNA, 21 bp, Artificial Sequence
  Description of Artificial Sequence: Synthetic oligonucleotide
ttcaccgaacccagcagcaaa

SEQ ID NO: 23862 - DNA, 21 bp, Artificial Sequence
  Description of Artificial Sequence: Synthetic oligonucleotide
gatcagactatgaagactggt

SEQ ID NO: 23863 - DNA, 21 bp, Artificial Sequence
  Description of Artificial Sequence: Synthetic oligonucleotide
gacctccaacccaccagcaga

SEQ ID NO: 23864 - DNA, 21 bp, Artificial Sequence
  Description of Artificial Sequence: Synthetic oligonucleotide
gtgcagagtggtaaggggtcg

SEQ ID NO: 23865 - DNA, 21 bp, Artificial Sequence
  Description of Artificial Sequence: Synthetic oligonucleotide
tcgaggtctgatagtgttagt

SEQ ID NO: 23866 - DNA, 21 bp, Artificial Sequence
  Description of Artificial Sequence: Synthetic oligonucleotide
caaaccagcaaacccagcgcc

SEQ ID NO: 23867 - DNA, 21 bp, Artificial Sequence
  Description of Artificial Sequence: Synthetic oligonucleotide
caaaccagcgaaagacccgtc

SEQ ID NO: 23868 - DNA, 21 bp, Artificial Sequence
  Description of Artificial Sequence: Synthetic oligonucleotide
gacagcagcagagtcagcagc

SEQ ID NO: 23869 - DNA, 21 bp, Artificial Sequence
  Description of Artificial Sequence: Synthetic oligonucleotide
ggcatcggcaacgacaccacc

SEQ ID NO: 23870 - DNA, 21 bp, Artificial Sequence
  Description of Artificial Sequence: Synthetic oligonucleotide
tctacggttgttaagtcggag

SEQ ID NO: 23871 - DNA, 21 bp, Artificial Sequence
  Description of Artificial Sequence: Synthetic oligonucleotide
tctccggttactagtgagggg

SEQ ID NO: 23872 - DNA, 21 bp, Artificial Sequence
  Description of Artificial Sequence: Synthetic oligonucleotide
ttcggcagcaccagcgcccac

SEQ ID NO: 23873 - DNA, 21 bp, Artificial Sequence
  Description of Artificial Sequence: Synthetic oligonucleotide
gttggtaaggggccgtctaat

SEQ ID NO: 23874 - DNA, 21 bp, Artificial Sequence
  Description of Artificial Sequence: Synthetic oligonucleotide
ggtgatcgtccgtcggctatg

SEQ ID NO: 23875 - DNA, 21 bp, Artificial Sequence
  Description of Artificial Sequence: Synthetic oligonucleotide
caaagagacgtcggcgccaaa

SEQ ID NO: 23876 - DNA, 21 bp, Artificial Sequence
  Description of Artificial Sequence: Synthetic oligonucleotide
acccaaggcaccacccccgtc

SEQ ID NO: 23877 - DNA, 21 bp, Artificial Sequence
  Description of Artificial Sequence: Synthetic oligonucleotide
gcgaagtctgagcagggtact

SEQ ID NO: 23878 - DNA, 21 bp, Artificial Sequence
  Description of Artificial Sequence: Synthetic oligonucleotide
gcgttgaatagttctaagtcg

SEQ ID NO: 23879 - DNA, 21 bp, Artificial Sequence
  Description of Artificial Sequence: Synthetic oligonucleotide
ggcagcagcggcagcaaaagc

SEQ ID NO: 23880 - DNA, 21 bp, Artificial Sequence
  Description of Artificial Sequence: Synthetic oligonucleotide
tcgagtagttctcaggcgaat

SEQ ID NO: 23881 - DNA, 21 bp, Artificial Sequence
  Description of Artificial Sequence: Synthetic oligonucleotide
gttttgactaagggttctgcg

SEQ ID NO: 23882 - DNA, 21 bp, Artificial Sequence
  Description of Artificial Sequence: Synthetic oligonucleotide
aatagggcgccgaattctgct

SEQ ID NO: 23883 - DNA, 21 bp, Artificial Sequence
  Description of Artificial Sequence: Synthetic oligonucleotide
gaaggcagcagcgccagcggc

SEQ ID NO: 23884 - DNA, 21 bp, Artificial Sequence
  Description of Artificial Sequence: Synthetic oligonucleotide
acgacggcttcgagtccgggt

SEQ ID NO: 23885 - DNA, 21 bp, Artificial Sequence
  Description of Artificial Sequence: Synthetic oligonucleotide
agcgaagccagaggcaacaac

SEQ ID NO: 23886 - DNA, 21 bp, Artificial Sequence
  Description of Artificial Sequence: Synthetic oligonucleotide
aatgagaagggtgcgactaag

SEQ ID NO: 23887 - DNA, 21 bp, Artificial Sequence
  Description of Artificial Sequence: Synthetic oligonucleotide
agtagttctgagaagttgcag

SEQ ID NO: 23888 - DNA, 21 bp, Artificial Sequence
  Description of Artificial Sequence: Synthetic oligonucleotide
gatggtaatcctactaaggag

SEQ ID NO: 23889 - DNA, 21 bp, Artificial Sequence
  Description of Artificial Sequence: Synthetic oligonucleotide
tctggtcgggatactaattct

SEQ ID NO: 23890 - DNA, 21 bp, Artificial Sequence
  Description of Artificial Sequence: Synthetic oligonucleotide
agaaccaccaccgacagcaaa

SEQ ID NO: 23891 - DNA, 21 bp, Artificial Sequence
  Description of Artificial Sequence: Synthetic oligonucleotide
gaaagcagagcccccgtcagc

SEQ ID NO: 23892 - DNA, 21 bp, Artificial Sequence
  Description of Artificial Sequence: Synthetic oligonucleotide
gccagaaacgacagcatgatc

SEQ ID NO: 23893 - DNA, 21 bp, Artificial Sequence
  Description of Artificial Sequence: Synthetic oligonucleotide
tctactaatcaggctcctatg

SEQ ID NO: 23894 - DNA, 21 bp, Artificial Sequence
  Description of Artificial Sequence: Synthetic oligonucleotide
gcggggatgcagaagtttact

SEQ ID NO: 23895 - DNA, 21 bp, Artificial Sequence
  Description of Artificial Sequence: Synthetic oligonucleotide
agcagccaacccagcaacaaa

SEQ ID NO: 23896 - DNA, 21 bp, Artificial Sequence
  Description of Artificial Sequence: Synthetic oligonucleotide
cagcctgggaagattgcgacg

SEQ ID NO: 23897 - DNA, 21 bp, Artificial Sequence
  Description of Artificial Sequence: Synthetic oligonucleotide
cttcagaagtctccgtctatt

SEQ ID NO: 23898 - DNA, 21 bp, Artificial Sequence
  Description of Artificial Sequence: Synthetic oligonucleotide
gcccccacccaaggcagcggc

SEQ ID NO: 23899 - DNA, 21 bp, Artificial Sequence
  Description of Artificial Sequence: Synthetic oligonucleotide
ttgccggatggtctgaagggg

SEQ ID NO: 23900 - DNA, 21 bp, Artificial Sequence
  Description of Artificial Sequence: Synthetic oligonucleotide
acgacggagcagaataggcag

SEQ ID NO: 23901 - DNA, 21 bp, Artificial Sequence
  Description of Artificial Sequence: Synthetic oligonucleotide
gctgcgaatgataagttgcgt

SEQ ID NO: 23902 - DNA, 21 bp, Artificial Sequence
  Description of Artificial Sequence: Synthetic oligonucleotide
acgagtggtgataagcagctt

SEQ ID NO: 23903 - DNA, 21 bp, Artificial Sequence
  Description of Artificial Sequence: Synthetic oligonucleotide
acggtgactcctgcgacttct

SEQ ID NO: 23904 - DNA, 21 bp, Artificial Sequence
  Description of Artificial Sequence: Synthetic oligonucleotide
cacagccaaaaaggcggcatg

SEQ ID NO: 23905 - DNA, 21 bp, Artificial Sequence
  Description of Artificial Sequence: Synthetic oligonucleotide
gatccgggtgtttcggcgcgt

SEQ ID NO: 23906 - DNA, 21 bp, Artificial Sequence
  Description of Artificial Sequence: Synthetic oligonucleotide
ggtacgtcgaagactcagtct

SEQ ID NO: 23907 - DNA, 21 bp, Artificial Sequence
  Description of Artificial Sequence: Synthetic oligonucleotide
actgggagttctcagtctcat

SEQ ID NO: 23908 - DNA, 21 bp, Artificial Sequence
  Description of Artificial Sequence: Synthetic oligonucleotide
gagcttcttcagaagcctact

SEQ ID NO: 23909 - DNA, 21 bp, Artificial Sequence
  Description of Artificial Sequence: Synthetic oligonucleotide
gaggcttcgtctaatcggggt

SEQ ID NO: 23910 - DNA, 21 bp, Artificial Sequence
  Description of Artificial Sequence: Synthetic oligonucleotide
ggccccggccccagcaccaac

SEQ ID NO: 23911 - DNA, 21 bp, Artificial Sequence
  Description of Artificial Sequence: Synthetic oligonucleotide
gggacgggttctaagttgggg

SEQ ID NO: 23912 - DNA, 21 bp, Artificial Sequence
  Description of Artificial Sequence: Synthetic oligonucleotide
gggattcatcagaattcgggg

SEQ ID NO: 23913 - DNA, 21 bp, Artificial Sequence
  Description of Artificial Sequence: Synthetic oligonucleotide
agcaccggcaacccccccaga

SEQ ID NO: 23914 - DNA, 21 bp, Artificial Sequence
  Description of Artificial Sequence: Synthetic oligonucleotide
gatcagcatgatcggcgtgct

SEQ ID NO: 23915 - DNA, 21 bp, Artificial Sequence
  Description of Artificial Sequence: Synthetic oligonucleotide
ggcagcggcgccaacaaaccc

SEQ ID NO: 23916 - DNA, 21 bp, Artificial Sequence
  Description of Artificial Sequence: Synthetic oligonucleotide
caaggcagcagcaacggcatc

SEQ ID NO: 23917 - DNA, 21 bp, Artificial Sequence
  Description of Artificial Sequence: Synthetic oligonucleotide
gacagacccggcgaaaaagcc

SEQ ID NO: 23918 - DNA, 21 bp, Artificial Sequence
  Description of Artificial Sequence: Synthetic oligonucleotide
gagggtgggtctagtggttcg

SEQ ID NO: 23919 - DNA, 21 bp, Artificial Sequence
  Description of Artificial Sequence: Synthetic oligonucleotide
gttcaggggaagcatacgcag

SEQ ID NO: 23920 - DNA, 21 bp, Artificial Sequence
  Description of Artificial Sequence: Synthetic oligonucleotide
aaccccaaaagcaccgtcacc

SEQ ID NO: 23921 - DNA, 21 bp, Artificial Sequence
  Description of Artificial Sequence: Synthetic oligonucleotide
ttggcttcttcttctcagact

SEQ ID NO: 23922 - DNA, 21 bp, Artificial Sequence
  Description of Artificial Sequence: Synthetic oligonucleotide
tcgcctaatggtgcgagtcgg

SEQ ID NO: 23923 - DNA, 21 bp, Artificial Sequence
  Description of Artificial Sequence: Synthetic oligonucleotide
gccggcgacaaaatcagactc

SEQ ID NO: 23924 - DNA, 21 bp, Artificial Sequence
  Description of Artificial Sequence: Synthetic oligonucleotide
aacggcatgaaaaccggcacc

SEQ ID NO: 23925 - DNA, 21 bp, Artificial Sequence
  Description of Artificial Sequence: Synthetic oligonucleotide
agcaacggcagcaaagtcagc

SEQ ID NO: 23926 - DNA, 21 bp, Artificial Sequence
  Description of Artificial Sequence: Synthetic oligonucleotide
aagaatacgtctacttcgcag

SEQ ID NO: 23927 - DNA, 21 bp, Artificial Sequence
  Description of Artificial Sequence: Synthetic oligonucleotide
aagggtcagcctcctaaggag

SEQ ID NO: 23928 - DNA, 21 bp, Artificial Sequence
  Description of Artificial Sequence: Synthetic oligonucleotide
aatgtgcatactgctactgct

SEQ ID NO: 23929 - DNA, 21 bp, Artificial Sequence
  Description of Artificial Sequence: Synthetic oligonucleotide
agcaacagcaaagacaccctc

SEQ ID NO: 23930 - DNA, 21 bp, Artificial Sequence
  Description of Artificial Sequence: Synthetic oligonucleotide
atgccgaatgggtcgaataag

SEQ ID NO: 23931 - DNA, 21 bp, Artificial Sequence
  Description of Artificial Sequence: Synthetic oligonucleotide
gaaagaggcgcccacagcgtc

SEQ ID NO: 23932 - DNA, 21 bp, Artificial Sequence
  Description of Artificial Sequence: Synthetic oligonucleotide
gaaggcagccccctcggccac

SEQ ID NO: 23933 - DNA, 21 bp, Artificial Sequence
  Description of Artificial Sequence: Synthetic oligonucleotide
gataataataatgctcgtcag

SEQ ID NO: 23934 - DNA, 21 bp, Artificial Sequence
  Description of Artificial Sequence: Synthetic oligonucleotide
ggcggcaaaggcaacaacgtc

SEQ ID NO: 23935 - DNA, 21 bp, Artificial Sequence
  Description of Artificial Sequence: Synthetic oligonucleotide
tctcaggcgcagtctaataat

SEQ ID NO: 23936 - DNA, 21 bp, Artificial Sequence
  Description of Artificial Sequence: Synthetic oligonucleotide
acgcatacgtctccgtctatt

SEQ ID NO: 23937 - DNA, 21 bp, Artificial Sequence
  Description of Artificial Sequence: Synthetic oligonucleotide
gagactgctacttctcggggt

SEQ ID NO: 23938 - DNA, 21 bp, Artificial Sequence
  Description of Artificial Sequence: Synthetic oligonucleotide
gctactgaggataatcgtaag

SEQ ID NO: 23939 - DNA, 21 bp, Artificial Sequence
  Description of Artificial Sequence: Synthetic oligonucleotide
aatgcggttggtactcatagt

SEQ ID NO: 23940 - DNA, 21 bp, Artificial Sequence
  Description of Artificial Sequence: Synthetic oligonucleotide
ggcaacaccgaaagaaaaggc

SEQ ID NO: 23941 - DNA, 21 bp, Artificial Sequence
  Description of Artificial Sequence: Synthetic oligonucleotide
ggccacagccaaggcctcgcc

SEQ ID NO: 23942 - DNA, 21 bp, Artificial Sequence
  Description of Artificial Sequence: Synthetic oligonucleotide
gttaagagtacgtctacggag

SEQ ID NO: 23943 - DNA, 21 bp, Artificial Sequence
  Description of Artificial Sequence: Synthetic oligonucleotide
tctcgttcgggtcaggggcct

SEQ ID NO: 23944 - DNA, 21 bp, Artificial Sequence
  Description of Artificial Sequence: Synthetic oligonucleotide
agcgccaccggcagcggcgtc

SEQ ID NO: 23945 - DNA, 21 bp, Artificial Sequence
  Description of Artificial Sequence: Synthetic oligonucleotide
cacagcagcaacggcacccaa

SEQ ID NO: 23946 - DNA, 21 bp, Artificial Sequence
  Description of Artificial Sequence: Synthetic oligonucleotide
accaccgtcagcggcagcacc

SEQ ID NO: 23947 - DNA, 21 bp, Artificial Sequence
  Description of Artificial Sequence: Synthetic oligonucleotide
agcaaagtcagcagccccccc

SEQ ID NO: 23948 - DNA, 21 bp, Artificial Sequence
  Description of Artificial Sequence: Synthetic oligonucleotide
agcaacggcgaaagaagcaac

SEQ ID NO: 23949 - DNA, 21 bp, Artificial Sequence
  Description of Artificial Sequence: Synthetic oligonucleotide
agtaatgcgaagggtgttgtg

SEQ ID NO: 23950 - DNA, 21 bp, Artificial Sequence
  Description of Artificial Sequence: Synthetic oligonucleotide
tttaagaatacgaaggatggg

SEQ ID NO: 23951 - DNA, 21 bp, Artificial Sequence
  Description of Artificial Sequence: Synthetic oligonucleotide
acgacgaatacggctgttgcg

SEQ ID NO: 23952 - DNA, 21 bp, Artificial Sequence
  Description of Artificial Sequence: Synthetic oligonucleotide
accaacggcaacggcggcagc

SEQ ID NO: 23953 - DNA, 21 bp, Artificial Sequence
  Description of Artificial Sequence: Synthetic oligonucleotide
accatcggcagcagcagcacc

SEQ ID NO: 23954 - DNA, 21 bp, Artificial Sequence
  Description of Artificial Sequence: Synthetic oligonucleotide
agcatggccaacctcaaagac

SEQ ID NO: 23955 - DNA, 21 bp, Artificial Sequence
  Description of Artificial Sequence: Synthetic oligonucleotide
gacgtcagcaaagccaccagc

SEQ ID NO: 23956 - DNA, 21 bp, Artificial Sequence
  Description of Artificial Sequence: Synthetic oligonucleotide
gccgtcagcggcgccaaaggc

SEQ ID NO: 23957 - DNA, 21 bp, Artificial Sequence
  Description of Artificial Sequence: Synthetic oligonucleotide
ggcagcatccccagcagcagc

SEQ ID NO: 23958 - DNA, 21 bp, Artificial Sequence
  Description of Artificial Sequence: Synthetic oligonucleotide
ggcagcggcaacaccgccgaa

SEQ ID NO: 23959 - DNA, 21 bp, Artificial Sequence
  Description of Artificial Sequence: Synthetic oligonucleotide
ggttctgggtcggcgaagctg

SEQ ID NO: 23960 - DNA, 21 bp, Artificial Sequence
  Description of Artificial Sequence: Synthetic oligonucleotide
acgactcgttctaagaatgag

SEQ ID NO: 23961 - DNA, 21 bp, Artificial Sequence
  Description of Artificial Sequence: Synthetic oligonucleotide
ggcctcagcgccagcatcaga

SEQ ID NO: 23962 - DNA, 21 bp, Artificial Sequence
  Description of Artificial Sequence: Synthetic oligonucleotide
actcagatgaagccgacgagg

SEQ ID NO: 23963 - DNA, 21 bp, Artificial Sequence
  Description of Artificial Sequence: Synthetic oligonucleotide
agtcagactaatggtgctgtg

SEQ ID NO: 23964 - DNA, 21 bp, Artificial Sequence
  Description of Artificial Sequence: Synthetic oligonucleotide
gccggcgaccaaaccagaatc

SEQ ID NO: 23965 - DNA, 21 bp, Artificial Sequence
  Description of Artificial Sequence: Synthetic oligonucleotide
gcgacgacttcttctcctaag

SEQ ID NO: 23966 - DNA, 21 bp, Artificial Sequence
  Description of Artificial Sequence: Synthetic oligonucleotide
ggcaccatcgccaacgccaga

SEQ ID NO: 23967 - DNA, 21 bp, Artificial Sequence
  Description of Artificial Sequence: Synthetic oligonucleotide
ggcagcggcagccccagcgcc

SEQ ID NO: 23968 - DNA, 21 bp, Artificial Sequence
  Description of Artificial Sequence: Synthetic oligonucleotide
aacagcaacagcagagaaaaa

SEQ ID NO: 23969 - DNA, 21 bp, Artificial Sequence
  Description of Artificial Sequence: Synthetic oligonucleotide
aacagcaccggcaccggcagc

SEQ ID NO: 23970 - DNA, 21 bp, Artificial Sequence
  Description of Artificial Sequence: Synthetic oligonucleotide
aaccaaagcaacgtccccctc

SEQ ID NO: 23971 - DNA, 21 bp, Artificial Sequence
  Description of Artificial Sequence: Synthetic oligonucleotide
acgccggcgaatgctcaggct

SEQ ID NO: 23972 - DNA, 21 bp, Artificial Sequence
  Description of Artificial Sequence: Synthetic oligonucleotide
agcatcggcaacaaaaccctc

SEQ ID NO: 23973 - DNA, 21 bp, Artificial Sequence
  Description of Artificial Sequence: Synthetic oligonucleotide
agtagttataagggtgagggg

SEQ ID NO: 23974 - DNA, 21 bp, Artificial Sequence
  Description of Artificial Sequence: Synthetic oligonucleotide
cttgataaggttaagactact

SEQ ID NO: 23975 - DNA, 21 bp, Artificial Sequence
  Description of Artificial Sequence: Synthetic oligonucleotide
gagtctgatggtggtaagagt

SEQ ID NO: 23976 - DNA, 21 bp, Artificial Sequence
  Description of Artificial Sequence: Synthetic oligonucleotide
gatcggactcaggatgcgcat

SEQ ID NO: 23977 - DNA, 21 bp, Artificial Sequence
  Description of Artificial Sequence: Synthetic oligonucleotide
gccaacaccgacaaaagagtc

SEQ ID NO: 23978 - DNA, 21 bp, Artificial Sequence
  Description of Artificial Sequence: Synthetic oligonucleotide
gccggcaacaccctcgccgcc

SEQ ID NO: 23979 - DNA, 21 bp, Artificial Sequence
  Description of Artificial Sequence: Synthetic oligonucleotide
gccggcaccagcaccatgagc

SEQ ID NO: 23980 - DNA, 21 bp, Artificial Sequence
  Description of Artificial Sequence: Synthetic oligonucleotide
gctatgagtaagaaggaggcg

SEQ ID NO: 23981 - DNA, 21 bp, Artificial Sequence
  Description of Artificial Sequence: Synthetic oligonucleotide
gggcggaaggatgctgctgtg

SEQ ID NO: 23982 - DNA, 21 bp, Artificial Sequence
  Description of Artificial Sequence: Synthetic oligonucleotide
gtcgccggcagcagcaccgtc

SEQ ID NO: 23983 - DNA, 21 bp, Artificial Sequence
  Description of Artificial Sequence: Synthetic oligonucleotide
tacaaagtcggcaccgaaagc

SEQ ID NO: 23984 - DNA, 21 bp, Artificial Sequence
  Description of Artificial Sequence: Synthetic oligonucleotide
acgaatgctaatgtgcctcgt

SEQ ID NO: 23985 - DNA, 21 bp, Artificial Sequence
  Description of Artificial Sequence: Synthetic oligonucleotide
ctcggcagcggcagacccgaa

SEQ ID NO: 23986 - DNA, 21 bp, Artificial Sequence
  Description of Artificial Sequence: Synthetic oligonucleotide
ctcggcaacgccagcaacaac

SEQ ID NO: 23987 - DNA, 21 bp, Artificial Sequence
  Description of Artificial Sequence: Synthetic oligonucleotide
acccccagcacccccgccagc

SEQ ID NO: 23988 - DNA, 21 bp, Artificial Sequence
  Description of Artificial Sequence: Synthetic oligonucleotide
ctcagcggcagcaacagcagc

SEQ ID NO: 23989 - DNA, 21 bp, Artificial Sequence
  Description of Artificial Sequence: Synthetic oligonucleotide
gatttgagtgtgaagacgcag

SEQ ID NO: 23990 - DNA, 21 bp, Artificial Sequence
  Description of Artificial Sequence: Synthetic oligonucleotide
ggcctcgccaccagcagccaa

SEQ ID NO: 23991 - DNA, 21 bp, Artificial Sequence
  Description of Artificial Sequence: Synthetic oligonucleotide
atcggcgccgaaagaagcgtc

SEQ ID NO: 23992 - DNA, 21 bp, Artificial Sequence
  Description of Artificial Sequence: Synthetic oligonucleotide
gggaatctgacgacgactaag

SEQ ID NO: 23993 - DNA, 21 bp, Artificial Sequence
  Description of Artificial Sequence: Synthetic oligonucleotide
gatggttcggctaagcttgtg

SEQ ID NO: 23994 - DNA, 21 bp, Artificial Sequence
  Description of Artificial Sequence: Synthetic oligonucleotide
tcggattcgcgggcggggggg

SEQ ID NO: 23995 - DNA, 21 bp, Artificial Sequence
  Description of Artificial Sequence: Synthetic oligonucleotide
ctcagccacagcaaagccacc

SEQ ID NO: 23996 - DNA, 21 bp, Artificial Sequence
  Description of Artificial Sequence: Synthetic oligonucleotide
agaagcgaaagcgccagcacc

SEQ ID NO: 23997 - DNA, 21 bp, Artificial Sequence
  Description of Artificial Sequence: Synthetic oligonucleotide
agcaccaacagaagcagcggc

SEQ ID NO: 23998 - DNA, 21 bp, Artificial Sequence
  Description of Artificial Sequence: Synthetic oligonucleotide
gctagtgagaagaaggtgctt

SEQ ID NO: 23999 - DNA, 21 bp, Artificial Sequence
  Description of Artificial Sequence: Synthetic oligonucleotide
gggaataaggcggttagtggt

SEQ ID NO: 24000 - DNA, 21 bp, Artificial Sequence
  Description of Artificial Sequence: Synthetic oligonucleotide
ggggggtcgaaggctgtggat

SEQ ID NO: 24001 - DNA, 21 bp, Artificial Sequence
  Description of Artificial Sequence: Synthetic oligonucleotide
ggggttgataagaagtctcct

SEQ ID NO: 24002 - DNA, 21 bp, Artificial Sequence
  Description of Artificial Sequence: Synthetic oligonucleotide
tctgctggtaattcgaagatt

SEQ ID NO: 24003 - DNA, 21 bp, Artificial Sequence
  Description of Artificial Sequence: Synthetic oligonucleotide
cataatggggggtctaataag

SEQ ID NO: 24004 - DNA, 21 bp, Artificial Sequence
  Description of Artificial Sequence: Synthetic oligonucleotide
acgggttctgggcatatttcg

SEQ ID NO: 24005 - DNA, 21 bp, Artificial Sequence
  Description of Artificial Sequence: Synthetic oligonucleotide
ttgcagaagccgagtgggacg

SEQ ID NO: 24006 - DNA, 21 bp, Artificial Sequence
  Description of Artificial Sequence: Synthetic oligonucleotide
atgagcaccagcagcagcaga

SEQ ID NO: 24007 - DNA, 21 bp, Artificial Sequence
  Description of Artificial Sequence: Synthetic oligonucleotide
gccaacagcaccaaccacacc

SEQ ID NO: 24008 - DNA, 21 bp, Artificial Sequence
  Description of Artificial Sequence: Synthetic oligonucleotide
aacagcagccccgtcagcaac

SEQ ID NO: 24009 - DNA, 21 bp, Artificial Sequence
  Description of Artificial Sequence: Synthetic oligonucleotide
accaacaacgccaccgccacc

SEQ ID NO: 24010 - DNA, 21 bp, Artificial Sequence
  Description of Artificial Sequence: Synthetic oligonucleotide
acgggtactaatcctaatggg

SEQ ID NO: 24011 - DNA, 21 bp, Artificial Sequence
  Description of Artificial Sequence: Synthetic oligonucleotide
agaaacggcgaccaagccgcc

SEQ ID NO: 24012 - DNA, 21 bp, Artificial Sequence
  Description of Artificial Sequence: Synthetic oligonucleotide
agcagaggcgaaagcaaaagc

SEQ ID NO: 24013 - DNA, 21 bp, Artificial Sequence
  Description of Artificial Sequence: Synthetic oligonucleotide
gaggtggggaagcattcgtcg

SEQ ID NO: 24014 - DNA, 21 bp, Artificial Sequence
  Description of Artificial Sequence: Synthetic oligonucleotide
gccaacagagaaaaaatcctc

SEQ ID NO: 24015 - DNA, 21 bp, Artificial Sequence
  Description of Artificial Sequence: Synthetic oligonucleotide
gcggggactaatgcgaataag

SEQ ID NO: 24016 - DNA, 21 bp, Artificial Sequence
  Description of Artificial Sequence: Synthetic oligonucleotide
gtccccgacaacaaacaactc

SEQ ID NO: 24017 - DNA, 21 bp, Artificial Sequence
  Description of Artificial Sequence: Synthetic oligonucleotide
gcgggtccgtcggggaagatt

SEQ ID NO: 24018 - DNA, 21 bp, Artificial Sequence
  Description of Artificial Sequence: Synthetic oligonucleotide
gacaccggcagaggcggcaac

SEQ ID NO: 24019 - DNA, 21 bp, Artificial Sequence
  Description of Artificial Sequence: Synthetic oligonucleotide
cgtgatggtacgagtcctgag

SEQ ID NO: 24020 - DNA, 21 bp, Artificial Sequence
  Description of Artificial Sequence: Synthetic oligonucleotide
caaagcgcccaagccagcaaa

SEQ ID NO: 24021 - DNA, 21 bp, Artificial Sequence
  Description of Artificial Sequence: Synthetic oligonucleotide
accaccgacaaaggcggcaga

SEQ ID NO: 24022 - DNA, 21 bp, Artificial Sequence
  Description of Artificial Sequence: Synthetic oligonucleotide
caggctagtacgtcgcctctt

SEQ ID NO: 24023 - DNA, 21 bp, Artificial Sequence
  Description of Artificial Sequence: Synthetic oligonucleotide
gataggagtcctagtgcggtt

SEQ ID NO: 24024 - DNA, 21 bp, Artificial Sequence
  Description of Artificial Sequence: Synthetic oligonucleotide
gccgcccccggcgccggcggc

SEQ ID NO: 24025 - DNA, 21 bp, Artificial Sequence
  Description of Artificial Sequence: Synthetic oligonucleotide
ttgcctaatcagaaggatact

SEQ ID NO: 24026 - DNA, 21 bp, Artificial Sequence
  Description of Artificial Sequence: Synthetic oligonucleotide
tttccgaataataagaatggt

SEQ ID NO: 24027 - DNA, 21 bp, Artificial Sequence
  Description of Artificial Sequence: Synthetic oligonucleotide
ggtcctcttactcgggatggt

SEQ ID NO: 24028 - DNA, 21 bp, Artificial Sequence
  Description of Artificial Sequence: Synthetic oligonucleotide
acgccgaattcttcgaatggc

SEQ ID NO: 24029 - DNA, 21 bp, Artificial Sequence
  Description of Artificial Sequence: Synthetic oligonucleotide
cacaaagaagtcgccaccgcc

SEQ ID NO: 24030 - DNA, 21 bp, Artificial Sequence
  Description of Artificial Sequence: Synthetic oligonucleotide
aaaaccggcagcccccaagac

SEQ ID NO: 24031 - DNA, 21 bp, Artificial Sequence
  Description of Artificial Sequence: Synthetic oligonucleotide
acggatggtaatagtacgagg

SEQ ID NO: 24032 - DNA, 21 bp, Artificial Sequence
  Description of Artificial Sequence: Synthetic oligonucleotide
agaaaagacaccgaaacccac

SEQ ID NO: 24033 - DNA, 21 bp, Artificial Sequence
  Description of Artificial Sequence: Synthetic oligonucleotide
agcagcagcaccaccagagtc

SEQ ID NO: 24034 - DNA, 21 bp, Artificial Sequence
  Description of Artificial Sequence: Synthetic oligonucleotide
cagagtggtggggtttctggt

SEQ ID NO: 24035 - DNA, 21 bp, Artificial Sequence
  Description of Artificial Sequence: Synthetic oligonucleotide
gtgccgtctggtgggtctaat

SEQ ID NO: 24036 - DNA, 21 bp, Artificial Sequence
  Description of Artificial Sequence: Synthetic oligonucleotide
tctaatcagaggggtaattcg

SEQ ID NO: 24037 - DNA, 21 bp, Artificial Sequence
  Description of Artificial Sequence: Synthetic oligonucleotide
agcagcggcaacggcctccac

SEQ ID NO: 24038 - DNA, 21 bp, Artificial Sequence
  Description of Artificial Sequence: Synthetic oligonucleotide
agagacggcagcagcaaagac

SEQ ID NO: 24039 - DNA, 21 bp, Artificial Sequence
  Description of Artificial Sequence: Synthetic oligonucleotide
agtactagtggtaatcatgcg

SEQ ID NO: 24040 - DNA, 21 bp, Artificial Sequence
  Description of Artificial Sequence: Synthetic oligonucleotide
ctccccgccaaaaccgacagc

SEQ ID NO: 24041 - DNA, 21 bp, Artificial Sequence
  Description of Artificial Sequence: Synthetic oligonucleotide
ctcgccgaaaaaaccaccccc

SEQ ID NO: 24042 - DNA, 21 bp, Artificial Sequence
  Description of Artificial Sequence: Synthetic oligonucleotide
gcgcataatgatacgaagaag

SEQ ID NO: 24043 - DNA, 21 bp, Artificial Sequence
  Description of Artificial Sequence: Synthetic oligonucleotide
ggggttacgggtcctcgttcg

SEQ ID NO: 24044 - DNA, 21 bp, Artificial Sequence
  Description of Artificial Sequence: Synthetic oligonucleotide
gtcaccaacgcccacaacagc

SEQ ID NO: 24045 - DNA, 21 bp, Artificial Sequence
  Description of Artificial Sequence: Synthetic oligonucleotide
tcgagtacttcgtcggggggg

SEQ ID NO: 24046 - DNA, 21 bp, Artificial Sequence
  Description of Artificial Sequence: Synthetic oligonucleotide
agccccagcgacaaagtcagc

SEQ ID NO: 24047 - DNA, 21 bp, Artificial Sequence
  Description of Artificial Sequence: Synthetic oligonucleotide
caaaacgccagccccggcaac

SEQ ID NO: 24048 - DNA, 21 bp, Artificial Sequence
  Description of Artificial Sequence: Synthetic oligonucleotide
agcatcgaccaagccagaagc

SEQ ID NO: 24049 - DNA, 21 bp, Artificial Sequence
  Description of Artificial Sequence: Synthetic oligonucleotide
gtcgccagccccggcggcaac

SEQ ID NO: 24050 - DNA, 21 bp, Artificial Sequence
  Description of Artificial Sequence: Synthetic oligonucleotide
accggcacccaaggcagcagc

SEQ ID NO: 24051 - DNA, 21 bp, Artificial Sequence
  Description of Artificial Sequence: Synthetic oligonucleotide
gtcaaactcgacagaagcgtc

SEQ ID NO: 24052 - DNA, 21 bp, Artificial Sequence
  Description of Artificial Sequence: Synthetic oligonucleotide
gtcaccagcaccgccagcgtc

SEQ ID NO: 24053 - DNA, 21 bp, Artificial Sequence
  Description of Artificial Sequence: Synthetic oligonucleotide
agtacggatacttctgcgtct

SEQ ID NO: 24054 - DNA, 21 bp, Artificial Sequence
  Description of Artificial Sequence: Synthetic oligonucleotide
ggtgattcttctcgtgcgagt

SEQ ID NO: 24055 - DNA, 21 bp, Artificial Sequence
  Description of Artificial Sequence: Synthetic oligonucleotide
agtactcagtctcctacgcgg

SEQ ID NO: 24056 - DNA, 21 bp, Artificial Sequence
  Description of Artificial Sequence: Synthetic oligonucleotide
aaagtcggcggcaccaacacc

SEQ ID NO: 24057 - DNA, 21 bp, Artificial Sequence
  Description of Artificial Sequence: Synthetic oligonucleotide
aataggacgtcgggggagaag

SEQ ID NO: 24058 - DNA, 21 bp, Artificial Sequence
  Description of Artificial Sequence: Synthetic oligonucleotide
accctcgccagcccccacggc

SEQ ID NO: 24059 - DNA, 21 bp, Artificial Sequence
  Description of Artificial Sequence: Synthetic oligonucleotide
accggcctcaacaaccccagc

SEQ ID NO: 24060 - DNA, 21 bp, Artificial Sequence
  Description of Artificial Sequence: Synthetic oligonucleotide
acgaaggataatgttcataag

SEQ ID NO: 24061 - DNA, 21 bp, Artificial Sequence
  Description of Artificial Sequence: Synthetic oligonucleotide
agcaccagcagcgccccctac

SEQ ID NO: 24062 - DNA, 21 bp, Artificial Sequence
  Description of Artificial Sequence: Synthetic oligonucleotide
aggcatgatgcgacttcgcag

SEQ ID NO: 24063 - DNA, 21 bp, Artificial Sequence
  Description of Artificial Sequence: Synthetic oligonucleotide
agtcctaatccgactgggagt

SEQ ID NO: 24064 - DNA, 21 bp, Artificial Sequence
  Description of Artificial Sequence: Synthetic oligonucleotide
agtggtagtgcgcatggtttg

SEQ ID NO: 24065 - DNA, 21 bp, Artificial Sequence
  Description of Artificial Sequence: Synthetic oligonucleotide
agttctggttcggggattggg

SEQ ID NO: 24066 - DNA, 21 bp, Artificial Sequence
  Description of Artificial Sequence: Synthetic oligonucleotide
atgaattcgagtggtgggaag

SEQ ID NO: 24067 - DNA, 21 bp, Artificial Sequence
  Description of Artificial Sequence: Synthetic oligonucleotide
caaaacgacagaaccagcacc

SEQ ID NO: 24068 - DNA, 21 bp, Artificial Sequence
  Description of Artificial Sequence: Synthetic oligonucleotide
caaggccaagaacccaaaaga

SEQ ID NO: 24069 - DNA, 21 bp, Artificial Sequence
  Description of Artificial Sequence: Synthetic oligonucleotide
catagtagtcctcctaattcg

SEQ ID NO: 24070 - DNA, 21 bp, Artificial Sequence
  Description of Artificial Sequence: Synthetic oligonucleotide
gaaatcagcagcagcaaactc

SEQ ID NO: 24071 - DNA, 21 bp, Artificial Sequence
  Description of Artificial Sequence: Synthetic oligonucleotide
gaacaaagaagcaccagcagc

SEQ ID NO: 24072 - DNA, 21 bp, Artificial Sequence
  Description of Artificial Sequence: Synthetic oligonucleotide
gacgccaccagccccaaagtc

SEQ ID NO: 24073 - DNA, 21 bp, Artificial Sequence
  Description of Artificial Sequence: Synthetic oligonucleotide
gaggatgggcggtcgtctgcg

SEQ ID NO: 24074 - DNA, 21 bp, Artificial Sequence
  Description of Artificial Sequence: Synthetic oligonucleotide
gcccaaagccaaaccaacacc

SEQ ID NO: 24075 - DNA, 21 bp, Artificial Sequence
  Description of Artificial Sequence: Synthetic oligonucleotide
gcggggcagaagcaggggatg

SEQ ID NO: 24076 - DNA, 21 bp, Artificial Sequence
  Description of Artificial Sequence: Synthetic oligonucleotide
ggcaccgccggcaccaacacc

SEQ ID NO: 24077 - DNA, 21 bp, Artificial Sequence
  Description of Artificial Sequence: Synthetic oligonucleotide
ggcggccacagcgaaagaaga

SEQ ID NO: 24078 - DNA, 21 bp, Artificial Sequence
  Description of Artificial Sequence: Synthetic oligonucleotide
gggacgattggtgttcataag

SEQ ID NO: 24079 - DNA, 21 bp, Artificial Sequence
  Description of Artificial Sequence: Synthetic oligonucleotide
ggttcgccttcgaatcagggt

SEQ ID NO: 24080 - DNA, 21 bp, Artificial Sequence
  Description of Artificial Sequence: Synthetic oligonucleotide
gtcaaccaaagccacagcatg

SEQ ID NO: 24081 - DNA, 21 bp, Artificial Sequence
  Description of Artificial Sequence: Synthetic oligonucleotide
tcgccgcagggttcgcttggt

SEQ ID NO: 24082 - DNA, 21 bp, Artificial Sequence
  Description of Artificial Sequence: Synthetic oligonucleotide
tctactcagcctcgtagtcag

SEQ ID NO: 24083 - DNA, 21 bp, Artificial Sequence
  Description of Artificial Sequence: Synthetic oligonucleotide
tttaaggagtctgggggtggg

SEQ ID NO: 24084 - DNA, 21 bp, Artificial Sequence
  Description of Artificial Sequence: Synthetic oligonucleotide
gacagaaacagagacaccacc

SEQ ID NO: 24085 - DNA, 21 bp, Artificial Sequence
  Description of Artificial Sequence: Synthetic oligonucleotide
ctcaacaacagccaacacgcc

SEQ ID NO: 24086 - DNA, 21 bp, Artificial Sequence
  Description of Artificial Sequence: Synthetic oligonucleotide
cattcgggttctggtctttcg

SEQ ID NO: 24087 - DNA, 21 bp, Artificial Sequence
  Description of Artificial Sequence: Synthetic oligonucleotide
acgacgggtggtactatgcag

SEQ ID NO: 24088 - DNA, 21 bp, Artificial Sequence
  Description of Artificial Sequence: Synthetic oligonucleotide
actggtcagcggtcggctagt

SEQ ID NO: 24089 - DNA, 21 bp, Artificial Sequence
  Description of Artificial Sequence: Synthetic oligonucleotide
atggatactggtcctcgtgag

SEQ ID NO: 24090 - DNA, 21 bp, Artificial Sequence
  Description of Artificial Sequence: Synthetic oligonucleotide
gaacccctcagcagccccaaa

SEQ ID NO: 24091 - DNA, 21 bp, Artificial Sequence
  Description of Artificial Sequence: Synthetic oligonucleotide
tctattgagagtaagtcggcg

SEQ ID NO: 24092 - DNA, 21 bp, Artificial Sequence
  Description of Artificial Sequence: Synthetic oligonucleotide
tctggttctaatgcttcttct

SEQ ID NO: 24093 - DNA, 21 bp, Artificial Sequence
  Description of Artificial Sequence: Synthetic oligonucleotide
agagtcaacggcggcagcggc

SEQ ID NO: 24094 - DNA, 21 bp, Artificial Sequence
  Description of Artificial Sequence: Synthetic oligonucleotide
agcggcatggaaagcagagtc

SEQ ID NO: 24095 - DNA, 21 bp, Artificial Sequence
  Description of Artificial Sequence: Synthetic oligonucleotide
gaaggcggcaacggccaaatg

SEQ ID NO: 24096 - DNA, 21 bp, Artificial Sequence
  Description of Artificial Sequence: Synthetic oligonucleotide
gggcagactaaggagaggcct

SEQ ID NO: 24097 - DNA, 21 bp, Artificial Sequence
  Description of Artificial Sequence: Synthetic oligonucleotide
ggggatttgcctagttctggg

SEQ ID NO: 24098 - DNA, 21 bp, Artificial Sequence
  Description of Artificial Sequence: Synthetic oligonucleotide
agcggcaaaggcggcaccgtc

SEQ ID NO: 24099 - DNA, 21 bp, Artificial Sequence
  Description of Artificial Sequence: Synthetic oligonucleotide
atgaataatagtccgacgaag

SEQ ID NO: 24100 - DNA, 21 bp, Artificial Sequence
  Description of Artificial Sequence: Synthetic oligonucleotide
gttagtgctggtgctccgtct

SEQ ID NO: 24101 - DNA, 21 bp, Artificial Sequence
  Description of Artificial Sequence: Synthetic oligonucleotide
acccaaggcgtcagcagagaa

SEQ ID NO: 24102 - DNA, 21 bp, Artificial Sequence
  Description of Artificial Sequence: Synthetic oligonucleotide
agcagcaccagccccagcaga

SEQ ID NO: 24103 - DNA, 21 bp, Artificial Sequence
  Description of Artificial Sequence: Synthetic oligonucleotide
cacaaccaaggcaaaagcgcc

SEQ ID NO: 24104 - DNA, 21 bp, Artificial Sequence
  Description of Artificial Sequence: Synthetic oligonucleotide
gctgggattaaggatgttcgg

SEQ ID NO: 24105 - DNA, 21 bp, Artificial Sequence
  Description of Artificial Sequence: Synthetic oligonucleotide
accacccacaaagccaccgtc

SEQ ID NO: 24106 - DNA, 21 bp, Artificial Sequence
  Description of Artificial Sequence: Synthetic oligonucleotide
acccccgaaaaaggcaccgtc

SEQ ID NO: 24107 - DNA, 21 bp, Artificial Sequence
  Description of Artificial Sequence: Synthetic oligonucleotide
agcaccggcagcaccctcggc

SEQ ID NO: 24108 - DNA, 21 bp, Artificial Sequence
  Description of Artificial Sequence: Synthetic oligonucleotide
gaccccgtcagcgaaagaaaa

SEQ ID NO: 24109 - DNA, 21 bp, Artificial Sequence
  Description of Artificial Sequence: Synthetic oligonucleotide
gccggcaacagcggcctcggc

SEQ ID NO: 24110 - DNA, 21 bp, Artificial Sequence
  Description of Artificial Sequence: Synthetic oligonucleotide
gctaatgggagtactcgggcg

SEQ ID NO: 24111 - DNA, 21 bp, Artificial Sequence
  Description of Artificial Sequence: Synthetic oligonucleotide
gacagcagaaaaggcagcaac

SEQ ID NO: 24112 - DNA, 21 bp, Artificial Sequence
  Description of Artificial Sequence: Synthetic oligonucleotide
ctgccgtcggataagcagtct

SEQ ID NO: 24113 - DNA, 21 bp, Artificial Sequence
  Description of Artificial Sequence: Synthetic oligonucleotide
gagcgtgatcgggtgactgct

SEQ ID NO: 24114 - DNA, 21 bp, Artificial Sequence
  Description of Artificial Sequence: Synthetic oligonucleotide
gctgctactgcgcctaatcgt

SEQ ID NO: 24115 - DNA, 21 bp, Artificial Sequence
  Description of Artificial Sequence: Synthetic oligonucleotide
agcaccggcaacggccccagc

SEQ ID NO: 24116 - DNA, 21 bp, Artificial Sequence
  Description of Artificial Sequence: Synthetic oligonucleotide
aatggggttacggggaatcat

SEQ ID NO: 24117 - DNA, 21 bp, Artificial Sequence
  Description of Artificial Sequence: Synthetic oligonucleotide
ggcaaccccagcgccgccacc

SEQ ID NO: 24118 - DNA, 21 bp, Artificial Sequence
  Description of Artificial Sequence: Synthetic oligonucleotide
tcggggggtgataatgcgcgg

SEQ ID NO: 24119 - DNA, 21 bp, Artificial Sequence
  Description of Artificial Sequence: Synthetic oligonucleotide
agcagcagcagcaaaaccttc

SEQ ID NO: 24120 - DNA, 21 bp, Artificial Sequence
  Description of Artificial Sequence: Synthetic oligonucleotide
attgggacgggttcgccgcct

SEQ ID NO: 24121 - DNA, 21 bp, Artificial Sequence
  Description of Artificial Sequence: Synthetic oligonucleotide
gtccccagcggccaacccgtc

SEQ ID NO: 24122 - DNA, 21 bp, Artificial Sequence
  Description of Artificial Sequence: Synthetic oligonucleotide
tcggatgctaggtcttcgact

SEQ ID NO: 24123 - DNA, 21 bp, Artificial Sequence
  Description of Artificial Sequence: Synthetic oligonucleotide
aagcagcagccttctccgacg

SEQ ID NO: 24124 - DNA, 21 bp, Artificial Sequence
  Description of Artificial Sequence: Synthetic oligonucleotide
agcagcgtcaaaagcaacgcc

SEQ ID NO: 24125 - DNA, 21 bp, Artificial Sequence
  Description of Artificial Sequence: Synthetic oligonucleotide
accctcagcagaagcagcagc

SEQ ID NO: 24126 - DNA, 21 bp, Artificial Sequence
  Description of Artificial Sequence: Synthetic oligonucleotide
agtcggactaatacgtctttg

SEQ ID NO: 24127 - DNA, 21 bp, Artificial Sequence
  Description of Artificial Sequence: Synthetic oligonucleotide
cagcagggtgagagttcgcat

SEQ ID NO: 24128 - DNA, 21 bp, Artificial Sequence
  Description of Artificial Sequence: Synthetic oligonucleotide
cggcaggattctagtagtggg

SEQ ID NO: 24129 - DNA, 21 bp, Artificial Sequence
  Description of Artificial Sequence: Synthetic oligonucleotide
ctcgccaccagcgacaccaaa

SEQ ID NO: 24130 - DNA, 21 bp, Artificial Sequence
  Description of Artificial Sequence: Synthetic oligonucleotide
gaagtcgccagcggcggcaaa

SEQ ID NO: 24131 - DNA, 21 bp, Artificial Sequence
  Description of Artificial Sequence: Synthetic oligonucleotide
ggcagcaacgacctcagaacc

SEQ ID NO: 24132 - DNA, 21 bp, Artificial Sequence
  Description of Artificial Sequence: Synthetic oligonucleotide
gtcaccggcagcaccctcggc

SEQ ID NO: 24133 - DNA, 21 bp, Artificial Sequence
  Description of Artificial Sequence: Synthetic oligonucleotide
gtcaccggcggcagcggcgtc

SEQ ID NO: 24134 - DNA, 21 bp, Artificial Sequence
  Description of Artificial Sequence: Synthetic oligonucleotide
accatcggcagccaccccacc

SEQ ID NO: 24135 - DNA, 21 bp, Artificial Sequence
  Description of Artificial Sequence: Synthetic oligonucleotide
aacaacaccccccaaagcggc

SEQ ID NO: 24136 - DNA, 21 bp, Artificial Sequence
  Description of Artificial Sequence: Synthetic oligonucleotide
agttcttcgaagagtgatggg

SEQ ID NO: 24137 - DNA, 21 bp, Artificial Sequence
  Description of Artificial Sequence: Synthetic oligonucleotide
atgagggaggggcagatgatg

SEQ ID NO: 24138 - DNA, 21 bp, Artificial Sequence
  Description of Artificial Sequence: Synthetic oligonucleotide
cagaagggtgagtctagtact

SEQ ID NO: 24139 - DNA, 21 bp, Artificial Sequence
  Description of Artificial Sequence: Synthetic oligonucleotide
catggtggtccgacgtcttcg

SEQ ID NO: 24140 - DNA, 21 bp, Artificial Sequence
  Description of Artificial Sequence: Synthetic oligonucleotide
gatgttcgtactacttcgtcg

SEQ ID NO: 24141 - DNA, 21 bp, Artificial Sequence
  Description of Artificial Sequence: Synthetic oligonucleotide
ggcatcgaaagccacaaaatg

SEQ ID NO: 24142 - DNA, 21 bp, Artificial Sequence
  Description of Artificial Sequence: Synthetic oligonucleotide
tatggtaatccgactccgggt

SEQ ID NO: 24143 - DNA, 21 bp, Artificial Sequence
  Description of Artificial Sequence: Synthetic oligonucleotide
tctccgaatgggcatcttaag

SEQ ID NO: 24144 - DNA, 21 bp, Artificial Sequence
  Description of Artificial Sequence: Synthetic oligonucleotide
ttgaggagtgattctcagagt

SEQ ID NO: 24145 - DNA, 21 bp, Artificial Sequence
  Description of Artificial Sequence: Synthetic oligonucleotide
caacaaggcaacaacatcacc

SEQ ID NO: 24146 - DNA, 21 bp, Artificial Sequence
  Description of Artificial Sequence: Synthetic oligonucleotide
gacagaaccaacgccaaaggc

SEQ ID NO: 24147 - DNA, 21 bp, Artificial Sequence
  Description of Artificial Sequence: Synthetic oligonucleotide
aacggcagcggccaaaaccac

SEQ ID NO: 24148 - DNA, 21 bp, Artificial Sequence
  Description of Artificial Sequence: Synthetic oligonucleotide
atgagcagccacagcagcacc

SEQ ID NO: 24149 - DNA, 21 bp, Artificial Sequence
  Description of Artificial Sequence: Synthetic oligonucleotide
caagccgtcagcagcaacagc

SEQ ID NO: 24150 - DNA, 21 bp, Artificial Sequence
  Description of Artificial Sequence: Synthetic oligonucleotide
gggacgagtggtaatctgaat

SEQ ID NO: 24151 - DNA, 21 bp, Artificial Sequence
  Description of Artificial Sequence: Synthetic oligonucleotide
tcgactaaggagagggctgat

SEQ ID NO: 24152 - DNA, 21 bp, Artificial Sequence
  Description of Artificial Sequence: Synthetic oligonucleotide
tcgcctagtgtgaatccggcg

SEQ ID NO: 24153 - DNA, 21 bp, Artificial Sequence
  Description of Artificial Sequence: Synthetic oligonucleotide
tcggcgggtcgggagcatgct

SEQ ID NO: 24154 - DNA, 21 bp, Artificial Sequence
  Description of Artificial Sequence: Synthetic oligonucleotide
caaagcggcgccgccagcaaa

SEQ ID NO: 24155 - DNA, 21 bp, Artificial Sequence
  Description of Artificial Sequence: Synthetic oligonucleotide
accagagccgacagcagcagc

SEQ ID NO: 24156 - DNA, 21 bp, Artificial Sequence
  Description of Artificial Sequence: Synthetic oligonucleotide
agtgtttctactagttcttct

SEQ ID NO: 24157 - DNA, 21 bp, Artificial Sequence
  Description of Artificial Sequence: Synthetic oligonucleotide
gaaggcatggacagaggcagc

SEQ ID NO: 24158 - DNA, 21 bp, Artificial Sequence
  Description of Artificial Sequence: Synthetic oligonucleotide
gcggctgggccttctgctggg

SEQ ID NO: 24159 - DNA, 21 bp, Artificial Sequence
  Description of Artificial Sequence: Synthetic oligonucleotide
agcgaaaaaagcagacccaac

SEQ ID NO: 24160 - DNA, 21 bp, Artificial Sequence
  Description of Artificial Sequence: Synthetic oligonucleotide
ggcaccatggacaccaaagtc

SEQ ID NO: 24161 - DNA, 21 bp, Artificial Sequence
  Description of Artificial Sequence: Synthetic oligonucleotide
ggtactgtgattggggataag

SEQ ID NO: 24162 - DNA, 21 bp, Artificial Sequence
  Description of Artificial Sequence: Synthetic oligonucleotide
aacaaagtcgaaagacaagaa

SEQ ID NO: 24163 - DNA, 21 bp, Artificial Sequence
  Description of Artificial Sequence: Synthetic oligonucleotide
acgccggctattagtggtagt

SEQ ID NO: 24164 - DNA, 21 bp, Artificial Sequence
  Description of Artificial Sequence: Synthetic oligonucleotide
atgggcacccaaagcagagaa

SEQ ID NO: 24165 - DNA, 21 bp, Artificial Sequence
  Description of Artificial Sequence: Synthetic oligonucleotide
caaaacggcagcggcgtcagc

SEQ ID NO: 24166 - DNA, 21 bp, Artificial Sequence
  Description of Artificial Sequence: Synthetic oligonucleotide
ctcggcgacaaaggcgccaga

SEQ ID NO: 24167 - DNA, 21 bp, Artificial Sequence
  Description of Artificial Sequence: Synthetic oligonucleotide
gaagccgtccaaagaggcacc

SEQ ID NO: 24168 - DNA, 21 bp, Artificial Sequence
  Description of Artificial Sequence: Synthetic oligonucleotide
gcgaatgcttcgggttctaag

SEQ ID NO: 24169 - DNA, 21 bp, Artificial Sequence
  Description of Artificial Sequence: Synthetic oligonucleotide
ggcagcaccgtcaaaagcggc

SEQ ID NO: 24170 - DNA, 21 bp, Artificial Sequence
  Description of Artificial Sequence: Synthetic oligonucleotide
ggtgttaatgatgttaataag

SEQ ID NO: 24171 - DNA, 21 bp, Artificial Sequence
  Description of Artificial Sequence: Synthetic oligonucleotide
gtgactaataagggtactact

SEQ ID NO: 24172 - DNA, 21 bp, Artificial Sequence
  Description of Artificial Sequence: Synthetic oligonucleotide
aacagcgtcaacggcatcacc

SEQ ID NO: 24173 - DNA, 21 bp, Artificial Sequence
  Description of Artificial Sequence: Synthetic oligonucleotide
aaccacggcgacgtccaaaaa

SEQ ID NO: 24174 - DNA, 21 bp, Artificial Sequence
  Description of Artificial Sequence: Synthetic oligonucleotide
agccaaagcagcagcgtcagc

SEQ ID NO: 24175 - DNA, 21 bp, Artificial Sequence
  Description of Artificial Sequence: Synthetic oligonucleotide
gcgggtagtggtcaggctcgg

SEQ ID NO: 24176 - DNA, 21 bp, Artificial Sequence
  Description of Artificial Sequence: Synthetic oligonucleotide
acccaaagccaaagcgtcacc

SEQ ID NO: 24177 - DNA, 21 bp, Artificial Sequence
  Description of Artificial Sequence: Synthetic oligonucleotide
accgccgacgccgtccccaaa

SEQ ID NO: 24178 - DNA, 21 bp, Artificial Sequence
  Description of Artificial Sequence: Synthetic oligonucleotide
caggcgacgaatactcctctg

SEQ ID NO: 24179 - DNA, 21 bp, Artificial Sequence
  Description of Artificial Sequence: Synthetic oligonucleotide
ggtactacgtctcggaatgtt

SEQ ID NO: 24180 - DNA, 21 bp, Artificial Sequence
  Description of Artificial Sequence: Synthetic oligonucleotide
gagaattctactcggagtggt

SEQ ID NO: 24181 - DNA, 21 bp, Artificial Sequence
  Description of Artificial Sequence: Synthetic oligonucleotide
gattcgggtaagtctagggag

SEQ ID NO: 24182 - DNA, 21 bp, Artificial Sequence
  Description of Artificial Sequence: Synthetic oligonucleotide
ggcaccagcggcgccctcacc

SEQ ID NO: 24183 - DNA, 21 bp, Artificial Sequence
  Description of Artificial Sequence: Synthetic oligonucleotide
ggcagaaccgaaaacagaacc

SEQ ID NO: 24184 - DNA, 21 bp, Artificial Sequence
  Description of Artificial Sequence: Synthetic oligonucleotide
caccccaccaacaacggcctc

SEQ ID NO: 24185 - DNA, 21 bp, Artificial Sequence
  Description of Artificial Sequence: Synthetic oligonucleotide
aacaccagccccgtcggcaac

SEQ ID NO: 24186 - DNA, 21 bp, Artificial Sequence
  Description of Artificial Sequence: Synthetic oligonucleotide
aaccacagcaaagacaccagc

SEQ ID NO: 24187 - DNA, 21 bp, Artificial Sequence
  Description of Artificial Sequence: Synthetic oligonucleotide
accggcaccggcggcatgacc

SEQ ID NO: 24188 - DNA, 21 bp, Artificial Sequence
  Description of Artificial Sequence: Synthetic oligonucleotide
acgtcgaatcagcggaatagt

SEQ ID NO: 24189 - DNA, 21 bp, Artificial Sequence
  Description of Artificial Sequence: Synthetic oligonucleotide
actacggggaattctacgggt

SEQ ID NO: 24190 - DNA, 21 bp, Artificial Sequence
  Description of Artificial Sequence: Synthetic oligonucleotide
agagtcgccgccagcggcggc

SEQ ID NO: 24191 - DNA, 21 bp, Artificial Sequence
  Description of Artificial Sequence: Synthetic oligonucleotide
atcaccggcgacaaacccatc

SEQ ID NO: 24192 - DNA, 21 bp, Artificial Sequence
  Description of Artificial Sequence: Synthetic oligonucleotide
caaaaacaaggccccaccgcc

SEQ ID NO: 24193 - DNA, 21 bp, Artificial Sequence
  Description of Artificial Sequence: Synthetic oligonucleotide
caggctaagggggcgcagcag

SEQ ID NO: 24194 - DNA, 21 bp, Artificial Sequence
  Description of Artificial Sequence: Synthetic oligonucleotide
catacgcagactactagtagt

SEQ ID NO: 24195 - DNA, 21 bp, Artificial Sequence
  Description of Artificial Sequence: Synthetic oligonucleotide
catactgcggcgggggttact

SEQ ID NO: 24196 - DNA, 21 bp, Artificial Sequence
  Description of Artificial Sequence: Synthetic oligonucleotide
ctcaaaaccgaacacaccacc

SEQ ID NO: 24197 - DNA, 21 bp, Artificial Sequence
  Description of Artificial Sequence: Synthetic oligonucleotide
ctcgccagcagcagcgtccaa

SEQ ID NO: 24198 - DNA, 21 bp, Artificial Sequence
  Description of Artificial Sequence: Synthetic oligonucleotide
ctcggcaacaaaagcaacagc

SEQ ID NO: 24199 - DNA, 21 bp, Artificial Sequence
  Description of Artificial Sequence: Synthetic oligonucleotide
ggcagcaccggcagccacaaa

SEQ ID NO: 24200 - DNA, 21 bp, Artificial Sequence
  Description of Artificial Sequence: Synthetic oligonucleotide
ggtaatactggtactacgttt

SEQ ID NO: 24201 - DNA, 21 bp, Artificial Sequence
  Description of Artificial Sequence: Synthetic oligonucleotide
gtccacaccagcagcaccacc

SEQ ID NO: 24202 - DNA, 21 bp, Artificial Sequence
  Description of Artificial Sequence: Synthetic oligonucleotide
ttgaatgctcagcagacggcg

SEQ ID NO: 24203 - DNA, 21 bp, Artificial Sequence
  Description of Artificial Sequence: Synthetic oligonucleotide
acgagtggggattctcgtaat

SEQ ID NO: 24204 - DNA, 21 bp, Artificial Sequence
  Description of Artificial Sequence: Synthetic oligonucleotide
gtcggcaacagcacccaccaa

SEQ ID NO: 24205 - DNA, 21 bp, Artificial Sequence
  Description of Artificial Sequence: Synthetic oligonucleotide
caagtcagcaccacccccgcc

SEQ ID NO: 24206 - DNA, 21 bp, Artificial Sequence
  Description of Artificial Sequence: Synthetic oligonucleotide
catacggctgggactaatggt

SEQ ID NO: 24207 - DNA, 21 bp, Artificial Sequence
  Description of Artificial Sequence: Synthetic oligonucleotide
ctcggcaacagcagcagcaga

SEQ ID NO: 24208 - DNA, 21 bp, Artificial Sequence
  Description of Artificial Sequence: Synthetic oligonucleotide
ggtgatcggagttctcagcat

SEQ ID NO: 24209 - DNA, 21 bp, Artificial Sequence
  Description of Artificial Sequence: Synthetic oligonucleotide
ggtttggcttcggctcgggag

SEQ ID NO: 24210 - DNA, 21 bp, Artificial Sequence
  Description of Artificial Sequence: Synthetic oligonucleotide
agcggcaacgcccccagaacc

SEQ ID NO: 24211 - DNA, 21 bp, Artificial Sequence
  Description of Artificial Sequence: Synthetic oligonucleotide
aacggcatcaaaagcagcatg

SEQ ID NO: 24212 - DNA, 21 bp, Artificial Sequence
  Description of Artificial Sequence: Synthetic oligonucleotide
accatcaaacccaacagcggc

SEQ ID NO: 24213 - DNA, 21 bp, Artificial Sequence
  Description of Artificial Sequence: Synthetic oligonucleotide
tcggctgagcgtgctacgacg

SEQ ID NO: 24214 - DNA, 21 bp, Artificial Sequence
  Description of Artificial Sequence: Synthetic oligonucleotide
aatgggactggttctggtcgt

SEQ ID NO: 24215 - DNA, 21 bp, Artificial Sequence
  Description of Artificial Sequence: Synthetic oligonucleotide
aatggtactaatacggggggt

SEQ ID NO: 24216 - DNA, 21 bp, Artificial Sequence
  Description of Artificial Sequence: Synthetic oligonucleotide
atgaatacgaagggtcctatt

SEQ ID NO: 24217 - DNA, 21 bp, Artificial Sequence
  Description of Artificial Sequence: Synthetic oligonucleotide
gagcatactggttcgaagctt

SEQ ID NO: 24218 - DNA, 21 bp, Artificial Sequence
  Description of Artificial Sequence: Synthetic oligonucleotide
gggcagaatcgggagactgtg

SEQ ID NO: 24219 - DNA, 21 bp, Artificial Sequence
  Description of Artificial Sequence: Synthetic oligonucleotide
aacagcaacagaagccccgcc

SEQ ID NO: 24220 - DNA, 21 bp, Artificial Sequence
  Description of Artificial Sequence: Synthetic oligonucleotide
acgaaggctgctgctactatt

SEQ ID NO: 24221 - DNA, 21 bp, Artificial Sequence
  Description of Artificial Sequence: Synthetic oligonucleotide
ggcgtcagcaacggcgcccaa

SEQ ID NO: 24222 - DNA, 21 bp, Artificial Sequence
  Description of Artificial Sequence: Synthetic oligonucleotide
aaccccgccgccacccccgcc

SEQ ID NO: 24223 - DNA, 21 bp, Artificial Sequence
  Description of Artificial Sequence: Synthetic oligonucleotide
aatccgggtgataataggttg

SEQ ID NO: 24224 - DNA, 21 bp, Artificial Sequence
  Description of Artificial Sequence: Synthetic oligonucleotide
accggcagccacaaccccagc

SEQ ID NO: 24225 - DNA, 21 bp, Artificial Sequence
  Description of Artificial Sequence: Synthetic oligonucleotide
agcagcctcaacaccaccagc

SEQ ID NO: 24226 - DNA, 21 bp, Artificial Sequence
  Description of Artificial Sequence: Synthetic oligonucleotide
caacccggcaacaccagactc

SEQ ID NO: 24227 - DNA, 21 bp, Artificial Sequence
  Description of Artificial Sequence: Synthetic oligonucleotide
cagacgtctcgtgagtctggg

SEQ ID NO: 24228 - DNA, 21 bp, Artificial Sequence
  Description of Artificial Sequence: Synthetic oligonucleotide
ctgccgcgggagcatagtgtt

SEQ ID NO: 24229 - DNA, 21 bp, Artificial Sequence
  Description of Artificial Sequence: Synthetic oligonucleotide
gacagactcagccaaaccaac

SEQ ID NO: 24230 - DNA, 21 bp, Artificial Sequence
  Description of Artificial Sequence: Synthetic oligonucleotide
gatactggtactaagaatagt

SEQ ID NO: 24231 - DNA, 21 bp, Artificial Sequence
  Description of Artificial Sequence: Synthetic oligonucleotide
gcccacgaacaaagaaacgcc

SEQ ID NO: 24232 - DNA, 21 bp, Artificial Sequence
  Description of Artificial Sequence: Synthetic oligonucleotide
ggcagcagccccggccccaac

SEQ ID NO: 24233 - DNA, 21 bp, Artificial Sequence
  Description of Artificial Sequence: Synthetic oligonucleotide
ggccccagcagcggcaccccc

SEQ ID NO: 24234 - DNA, 21 bp, Artificial Sequence
  Description of Artificial Sequence: Synthetic oligonucleotide
accagcggcaacgccaacaac

SEQ ID NO: 24235 - DNA, 21 bp, Artificial Sequence
  Description of Artificial Sequence: Synthetic oligonucleotide
gctggtatttcttcgacgtct

SEQ ID NO: 24236 - DNA, 21 bp, Artificial Sequence
  Description of Artificial Sequence: Synthetic oligonucleotide
tctggtggtaatttgaatgcg

SEQ ID NO: 24237 - DNA, 21 bp, Artificial Sequence
  Description of Artificial Sequence: Synthetic oligonucleotide
accagcgccagcaaaggcacc

SEQ ID NO: 24238 - DNA, 21 bp, Artificial Sequence
  Description of Artificial Sequence: Synthetic oligonucleotide
agcgtcaccggcaacagcaaa

SEQ ID NO: 24239 - DNA, 21 bp, Artificial Sequence
  Description of Artificial Sequence: Synthetic oligonucleotide
gaaggcaaaagccaaggcaga

SEQ ID NO: 24240 - DNA, 21 bp, Artificial Sequence
  Description of Artificial Sequence: Synthetic oligonucleotide
gctgcgaataagtctaaggag

SEQ ID NO: 24241 - DNA, 21 bp, Artificial Sequence
  Description of Artificial Sequence: Synthetic oligonucleotide
gttagtactgggccgactact

SEQ ID NO: 24242 - DNA, 21 bp, Artificial Sequence
  Description of Artificial Sequence: Synthetic oligonucleotide
ttgctgcaggggtctggtgct

SEQ ID NO: 24243 - DNA, 21 bp, Artificial Sequence
  Description of Artificial Sequence: Synthetic oligonucleotide
aacgcccacagcgccggcggc

SEQ ID NO: 24244 - DNA, 21 bp, Artificial Sequence
  Description of Artificial Sequence: Synthetic oligonucleotide
accagagccagccccgccagc

SEQ ID NO: 24245 - DNA, 21 bp, Artificial Sequence
  Description of Artificial Sequence: Synthetic oligonucleotide
accctcgacgtcggcggcaaa

SEQ ID NO: 24246 - DNA, 21 bp, Artificial Sequence
  Description of Artificial Sequence: Synthetic oligonucleotide
acggttgggagtgctcagggt

SEQ ID NO: 24247 - DNA, 21 bp, Artificial Sequence
  Description of Artificial Sequence: Synthetic oligonucleotide
actcctattccttctaagggg

SEQ ID NO: 24248 - DNA, 21 bp, Artificial Sequence
  Description of Artificial Sequence: Synthetic oligonucleotide
gacagagtcagcgccagcagc

SEQ ID NO: 24249 - DNA, 21 bp, Artificial Sequence
  Description of Artificial Sequence: Synthetic oligonucleotide
ggcgcccaaagcaacagagcc

SEQ ID NO: 24250 - DNA, 21 bp, Artificial Sequence
  Description of Artificial Sequence: Synthetic oligonucleotide
cggtctgcgggtacgtctgct

SEQ ID NO: 24251 - DNA, 21 bp, Artificial Sequence
  Description of Artificial Sequence: Synthetic oligonucleotide
cgtaatggtgtttcgccggct

SEQ ID NO: 24252 - DNA, 21 bp, Artificial Sequence
  Description of Artificial Sequence: Synthetic oligonucleotide
gaccaaagcagcagccacgtc

SEQ ID NO: 24253 - DNA, 21 bp, Artificial Sequence
  Description of Artificial Sequence: Synthetic oligonucleotide
ggcagcggcaaccaaagaacc

SEQ ID NO: 24254 - DNA, 21 bp, Artificial Sequence
  Description of Artificial Sequence: Synthetic oligonucleotide
atgagagacgccaaaacccaa

SEQ ID NO: 24255 - DNA, 21 bp, Artificial Sequence
  Description of Artificial Sequence: Synthetic oligonucleotide
accacccacacccccaaccaa

SEQ ID NO: 24256 - DNA, 21 bp, Artificial Sequence
  Description of Artificial Sequence: Synthetic oligonucleotide
aaagtcgacagcagaggcgaa

SEQ ID NO: 24257 - DNA, 21 bp, Artificial Sequence
  Description of Artificial Sequence: Synthetic oligonucleotide
aatggtgatcagaagttggtt

SEQ ID NO: 24258 - DNA, 21 bp, Artificial Sequence
  Description of Artificial Sequence: Synthetic oligonucleotide
aatggttcgaatcatggtacg

SEQ ID NO: 24259 - DNA, 21 bp, Artificial Sequence
  Description of Artificial Sequence: Synthetic oligonucleotide
acccccagcaaaaccaacacc

SEQ ID NO: 24260 - DNA, 21 bp, Artificial Sequence
  Description of Artificial Sequence: Synthetic oligonucleotide
acggatgctgggactcagagt

SEQ ID NO: 24261 - DNA, 21 bp, Artificial Sequence
  Description of Artificial Sequence: Synthetic oligonucleotide
agtgttgttacttctcagggt

SEQ ID NO: 24262 - DNA, 21 bp, Artificial Sequence
  Description of Artificial Sequence: Synthetic oligonucleotide
atgaaccaaaaaagcacctac

SEQ ID NO: 24263 - DNA, 21 bp, Artificial Sequence
  Description of Artificial Sequence: Synthetic oligonucleotide
caccccagccaaggcggcagc

SEQ ID NO: 24264 - DNA, 21 bp, Artificial Sequence
  Description of Artificial Sequence: Synthetic oligonucleotide
catccttctgctagtgttggg

SEQ ID NO: 24265 - DNA, 21 bp, Artificial Sequence
  Description of Artificial Sequence: Synthetic oligonucleotide
gaggctgggtcgaagagtgtt

SEQ ID NO: 24266 - DNA, 21 bp, Artificial Sequence
  Description of Artificial Sequence: Synthetic oligonucleotide
gccagagacagaaacaacacc

SEQ ID NO: 24267 - DNA, 21 bp, Artificial Sequence
  Description of Artificial Sequence: Synthetic oligonucleotide
gccagcaaagacagcaccgcc

SEQ ID NO: 24268 - DNA, 21 bp, Artificial Sequence
  Description of Artificial Sequence: Synthetic oligonucleotide
gccagcaacagccccatcggc

SEQ ID NO: 24269 - DNA, 21 bp, Artificial Sequence
  Description of Artificial Sequence: Synthetic oligonucleotide
gcgatgtctgagactagtcgg

SEQ ID NO: 24270 - DNA, 21 bp, Artificial Sequence
  Description of Artificial Sequence: Synthetic oligonucleotide
ggcgccagcaacagcaaactc

SEQ ID NO: 24271 - DNA, 21 bp, Artificial Sequence
  Description of Artificial Sequence: Synthetic oligonucleotide
ggggcgaataagactgctccg

SEQ ID NO: 24272 - DNA, 21 bp, Artificial Sequence
  Description of Artificial Sequence: Synthetic oligonucleotide
tcgaattctgagcggagtaat

SEQ ID NO: 24273 - DNA, 21 bp, Artificial Sequence
  Description of Artificial Sequence: Synthetic oligonucleotide
tctagtaatcagtcttctgct

SEQ ID NO: 24274 - DNA, 21 bp, Artificial Sequence
  Description of Artificial Sequence: Synthetic oligonucleotide
ctccccgccaccagcgccaga

SEQ ID NO: 24275 - DNA, 21 bp, Artificial Sequence
  Description of Artificial Sequence: Synthetic oligonucleotide
actcctgatcgtacgtctatt

SEQ ID NO: 24276 - DNA, 21 bp, Artificial Sequence
  Description of Artificial Sequence: Synthetic oligonucleotide
gacaccctccaagccaccaaa

SEQ ID NO: 24277 - DNA, 21 bp, Artificial Sequence
  Description of Artificial Sequence: Synthetic oligonucleotide
gacagcaacagcgtcagcaaa

SEQ ID NO: 24278 - DNA, 21 bp, Artificial Sequence
  Description of Artificial Sequence: Synthetic oligonucleotide
acccccaccagccacgcccaa

SEQ ID NO: 24279 - DNA, 21 bp, Artificial Sequence
  Description of Artificial Sequence: Synthetic oligonucleotide
acgagtgatgtgacggctact

SEQ ID NO: 24280 - DNA, 21 bp, Artificial Sequence
  Description of Artificial Sequence: Synthetic oligonucleotide
gctagtaattcgcatgctggg

SEQ ID NO: 24281 - DNA, 21 bp, Artificial Sequence
  Description of Artificial Sequence: Synthetic oligonucleotide
gtgacggagcagaaggttggt

SEQ ID NO: 24282 - DNA, 21 bp, Artificial Sequence
  Description of Artificial Sequence: Synthetic oligonucleotide
gttgggtctactggtaatcat

SEQ ID NO: 24283 - DNA, 21 bp, Artificial Sequence
  Description of Artificial Sequence: Synthetic oligonucleotide
gtttctcagtctggtccgact

SEQ ID NO: 24284 - DNA, 21 bp, Artificial Sequence
  Description of Artificial Sequence: Synthetic oligonucleotide
tctcctcatggtgggtcgaat

SEQ ID NO: 24285 - DNA, 21 bp, Artificial Sequence
  Description of Artificial Sequence: Synthetic oligonucleotide
aaacccatggcccaagccgaa

SEQ ID NO: 24286 - DNA, 21 bp, Artificial Sequence
  Description of Artificial Sequence: Synthetic oligonucleotide
acccaaagcggccaccccacc

SEQ ID NO: 24287 - DNA, 21 bp, Artificial Sequence
  Description of Artificial Sequence: Synthetic oligonucleotide
atcagcggccaagtcaacagc

SEQ ID NO: 24288 - DNA, 21 bp, Artificial Sequence
  Description of Artificial Sequence: Synthetic oligonucleotide
gagactgtgtctaagcagagt

SEQ ID NO: 24289 - DNA, 21 bp, Artificial Sequence
  Description of Artificial Sequence: Synthetic oligonucleotide
gatccgacgggtggttctggt

SEQ ID NO: 24290 - DNA, 21 bp, Artificial Sequence
  Description of Artificial Sequence: Synthetic oligonucleotide
ggcagcagcaacggcagccac

SEQ ID NO: 24291 - DNA, 21 bp, Artificial Sequence
  Description of Artificial Sequence: Synthetic oligonucleotide
tacaaaaacgccgccaccagc

SEQ ID NO: 24292 - DNA, 21 bp, Artificial Sequence
  Description of Artificial Sequence: Synthetic oligonucleotide
gccaacgccacccccctcaaa

SEQ ID NO: 24293 - DNA, 21 bp, Artificial Sequence
  Description of Artificial Sequence: Synthetic oligonucleotide
aacaccagcgaagtcgccaga

SEQ ID NO: 24294 - DNA, 21 bp, Artificial Sequence
  Description of Artificial Sequence: Synthetic oligonucleotide
aatgggacgggtaatggtatt

SEQ ID NO: 24295 - DNA, 21 bp, Artificial Sequence
  Description of Artificial Sequence: Synthetic oligonucleotide
agaaccggcaccgaaaccaga

SEQ ID NO: 24296 - DNA, 21 bp, Artificial Sequence
  Description of Artificial Sequence: Synthetic oligonucleotide
agcgaaaccaacaaaagcagc

SEQ ID NO: 24297 - DNA, 21 bp, Artificial Sequence
  Description of Artificial Sequence: Synthetic oligonucleotide
atgaaggatacggggcctgtt

SEQ ID NO: 24298 - DNA, 21 bp, Artificial Sequence
  Description of Artificial Sequence: Synthetic oligonucleotide
gaccccagcagcggcaacgtc

SEQ ID NO: 24299 - DNA, 21 bp, Artificial Sequence
  Description of Artificial Sequence: Synthetic oligonucleotide
gctgtgactggtagtacgaat

SEQ ID NO: 24300 - DNA, 21 bp, Artificial Sequence
  Description of Artificial Sequence: Synthetic oligonucleotide
gagtctggtacgcagggtaag

SEQ ID NO: 24301 - DNA, 21 bp, Artificial Sequence
  Description of Artificial Sequence: Synthetic oligonucleotide
agtggtggtgcgaatcatttg

SEQ ID NO: 24302 - DNA, 21 bp, Artificial Sequence
  Description of Artificial Sequence: Synthetic oligonucleotide
gataggcagggttctgcgagg

SEQ ID NO: 24303 - DNA, 21 bp, Artificial Sequence
  Description of Artificial Sequence: Synthetic oligonucleotide
ggcagcaaaggcaacggcagc

SEQ ID NO: 24304 - DNA, 21 bp, Artificial Sequence
  Description of Artificial Sequence: Synthetic oligonucleotide
caggttagtgggcataatgag

SEQ ID NO: 24305 - DNA, 21 bp, Artificial Sequence
  Description of Artificial Sequence: Synthetic oligonucleotide
ggcaccagcaaaagcatcggc

SEQ ID NO: 24306 - DNA, 21 bp, Artificial Sequence
  Description of Artificial Sequence: Synthetic oligonucleotide
tacgccaccgaaagaacccaa

SEQ ID NO: 24307 - DNA, 21 bp, Artificial Sequence
  Description of Artificial Sequence: Synthetic oligonucleotide
gcgtctactacgcgtacgggt

SEQ ID NO: 24308 - DNA, 21 bp, Artificial Sequence
  Description of Artificial Sequence: Synthetic oligonucleotide
ggtagtcagggttcgcatgct

SEQ ID NO: 24309 - DNA, 21 bp, Artificial Sequence
  Description of Artificial Sequence: Synthetic oligonucleotide
tctcagtctacgtctcatctt

SEQ ID NO: 24310 - DNA, 21 bp, Artificial Sequence
  Description of Artificial Sequence: Synthetic oligonucleotide
gacggcgccagaagcagcgcc

SEQ ID NO: 24311 - DNA, 21 bp, Artificial Sequence
  Description of Artificial Sequence: Synthetic oligonucleotide
attcgtgagtctccggctaag

SEQ ID NO: 24312 - DNA, 21 bp, Artificial Sequence
  Description of Artificial Sequence: Synthetic oligonucleotide
agcagccaacccgccctcgtc

SEQ ID NO: 24313 - DNA, 21 bp, Artificial Sequence
  Description of Artificial Sequence: Synthetic oligonucleotide
aacatcagcaaagccaccatc

SEQ ID NO: 24314 - DNA, 21 bp, Artificial Sequence
  Description of Artificial Sequence: Synthetic oligonucleotide
aacggcagcggccaaaacctc

SEQ ID NO: 24315 - DNA, 21 bp, Artificial Sequence
  Description of Artificial Sequence: Synthetic oligonucleotide
acgaggaatgatacgagtaat

SEQ ID NO: 24316 - DNA, 21 bp, Artificial Sequence
  Description of Artificial Sequence: Synthetic oligonucleotide
actcctagtgataatacgcgg

SEQ ID NO: 24317 - DNA, 21 bp, Artificial Sequence
  Description of Artificial Sequence: Synthetic oligonucleotide
agcgacaccgccagaaccgcc

SEQ ID NO: 24318 - DNA, 21 bp, Artificial Sequence
  Description of Artificial Sequence: Synthetic oligonucleotide
agcggcaccagcgccaccgtc

SEQ ID NO: 24319 - DNA, 21 bp, Artificial Sequence
  Description of Artificial Sequence: Synthetic oligonucleotide
cattcggggggtagtacttcg

SEQ ID NO: 24320 - DNA, 21 bp, Artificial Sequence
  Description of Artificial Sequence: Synthetic oligonucleotide
gacagagccagcagcagcacc

SEQ ID NO: 24321 - DNA, 21 bp, Artificial Sequence
  Description of Artificial Sequence: Synthetic oligonucleotide
gatacgtctttgagtccgcat

SEQ ID NO: 24322 - DNA, 21 bp, Artificial Sequence
  Description of Artificial Sequence: Synthetic oligonucleotide
gtggattctgatcgggcgaag

SEQ ID NO: 24323 - DNA, 21 bp, Artificial Sequence
  Description of Artificial Sequence: Synthetic oligonucleotide
ggtcctactcgggatactacg

SEQ ID NO: 24324 - DNA, 21 bp, Artificial Sequence
  Description of Artificial Sequence: Synthetic oligonucleotide
accaacgacgcccccggcaga

SEQ ID NO: 24325 - DNA, 21 bp, Artificial Sequence
  Description of Artificial Sequence: Synthetic oligonucleotide
atcagagacaaaagcagcgtc

SEQ ID NO: 24326 - DNA, 21 bp, Artificial Sequence
  Description of Artificial Sequence: Synthetic oligonucleotide
gcgcagaatggtgcgggtacg

SEQ ID NO: 24327 - DNA, 21 bp, Artificial Sequence
  Description of Artificial Sequence: Synthetic oligonucleotide
gcgggtcagtcgactcatgcg

SEQ ID NO: 24328 - DNA, 21 bp, Artificial Sequence
  Description of Artificial Sequence: Synthetic oligonucleotide
gctcaggtgaagacgccgatt

SEQ ID NO: 24329 - DNA, 21 bp, Artificial Sequence
  Description of Artificial Sequence: Synthetic oligonucleotide
acccaagccagcaacccccac

SEQ ID NO: 24330 - DNA, 21 bp, Artificial Sequence
  Description of Artificial Sequence: Synthetic oligonucleotide
aatccgaagaatggttcgagt

SEQ ID NO: 24331 - DNA, 21 bp, Artificial Sequence
  Description of Artificial Sequence: Synthetic oligonucleotide
accagcaccagcggcaacgcc

SEQ ID NO: 24332 - DNA, 21 bp, Artificial Sequence
  Description of Artificial Sequence: Synthetic oligonucleotide
agcagcagcagccccaaaatg

SEQ ID NO: 24333 - DNA, 21 bp, Artificial Sequence
  Description of Artificial Sequence: Synthetic oligonucleotide
agcagcgccaacagaagcgaa

SEQ ID NO: 24334 - DNA, 21 bp, Artificial Sequence
  Description of Artificial Sequence: Synthetic oligonucleotide
agtgtgagtaaggataagtat

SEQ ID NO: 24335 - DNA, 21 bp, Artificial Sequence
  Description of Artificial Sequence: Synthetic oligonucleotide
catctgggtaagaatggtgag

SEQ ID NO: 24336 - DNA, 21 bp, Artificial Sequence
  Description of Artificial Sequence: Synthetic oligonucleotide
gaagccggcagaggccccagc

SEQ ID NO: 24337 - DNA, 21 bp, Artificial Sequence
  Description of Artificial Sequence: Synthetic oligonucleotide
gagcagcataataattcgggg

SEQ ID NO: 24338 - DNA, 21 bp, Artificial Sequence
  Description of Artificial Sequence: Synthetic oligonucleotide
gccagcagcggcgaacaaaga

SEQ ID NO: 24339 - DNA, 21 bp, Artificial Sequence
  Description of Artificial Sequence: Synthetic oligonucleotide
tctgagtctcctaagctggcg

SEQ ID NO: 24340 - DNA, 21 bp, Artificial Sequence
  Description of Artificial Sequence: Synthetic oligonucleotide
tctggttctccgtcgattgtt

SEQ ID NO: 24341 - DNA, 21 bp, Artificial Sequence
  Description of Artificial Sequence: Synthetic oligonucleotide
actagtactaagccgtatgat

SEQ ID NO: 24342 - DNA, 21 bp, Artificial Sequence
  Description of Artificial Sequence: Synthetic oligonucleotide
agcaacgacggccccctcaaa

SEQ ID NO: 24343 - DNA, 21 bp, Artificial Sequence
  Description of Artificial Sequence: Synthetic oligonucleotide
agtacgctgaagactggtagt

SEQ ID NO: 24344 - DNA, 21 bp, Artificial Sequence
  Description of Artificial Sequence: Synthetic oligonucleotide
ctcccccacgacaaacccaga

SEQ ID NO: 24345 - DNA, 21 bp, Artificial Sequence
  Description of Artificial Sequence: Synthetic oligonucleotide
atgtcgtcgacttcgagtact

SEQ ID NO: 24346 - DNA, 21 bp, Artificial Sequence
  Description of Artificial Sequence: Synthetic oligonucleotide
aaacacagcagccccgtcgaa

SEQ ID NO: 24347 - DNA, 21 bp, Artificial Sequence
  Description of Artificial Sequence: Synthetic oligonucleotide
agaagcgacggcgacaaacaa

SEQ ID NO: 24348 - DNA, 21 bp, Artificial Sequence
  Description of Artificial Sequence: Synthetic oligonucleotide
agcaaagaaggcaaatacgaa

SEQ ID NO: 24349 - DNA, 21 bp, Artificial Sequence
  Description of Artificial Sequence: Synthetic oligonucleotide
gacagaaccggccaaagaggc

SEQ ID NO: 24350 - DNA, 21 bp, Artificial Sequence
  Description of Artificial Sequence: Synthetic oligonucleotide
gacagcgtccccaccagcgcc

SEQ ID NO: 24351 - DNA, 21 bp, Artificial Sequence
  Description of Artificial Sequence: Synthetic oligonucleotide
gacctcagcacccccaccaaa

SEQ ID NO: 24352 - DNA, 21 bp, Artificial Sequence
  Description of Artificial Sequence: Synthetic oligonucleotide
gccagaggcgccaacagcatg

SEQ ID NO: 24353 - DNA, 21 bp, Artificial Sequence
  Description of Artificial Sequence: Synthetic oligonucleotide
gccgtcgacaaccaaagaatc

SEQ ID NO: 24354 - DNA, 21 bp, Artificial Sequence
  Description of Artificial Sequence: Synthetic oligonucleotide
gtccaagccagcagcaacgcc

SEQ ID NO: 24355 - DNA, 21 bp, Artificial Sequence
  Description of Artificial Sequence: Synthetic oligonucleotide
tctgcttcttcggagcggaat

SEQ ID NO: 24356 - DNA, 21 bp, Artificial Sequence
  Description of Artificial Sequence: Synthetic oligonucleotide
ggcaacggcagccccgtcgtc

SEQ ID NO: 24357 - DNA, 21 bp, Artificial Sequence
  Description of Artificial Sequence: Synthetic oligonucleotide
ggcgccaccggcaaacaagcc

SEQ ID NO: 24358 - DNA, 21 bp, Artificial Sequence
  Description of Artificial Sequence: Synthetic oligonucleotide
accaccagcaaaggcaacagc

SEQ ID NO: 24359 - DNA, 21 bp, Artificial Sequence
  Description of Artificial Sequence: Synthetic oligonucleotide
actcgggatacgggtcattcg

SEQ ID NO: 24360 - DNA, 21 bp, Artificial Sequence
  Description of Artificial Sequence: Synthetic oligonucleotide
ggcagaaccccccccagcgcc

SEQ ID NO: 24361 - DNA, 21 bp, Artificial Sequence
  Description of Artificial Sequence: Synthetic oligonucleotide
agcgacgacaaaagcctcaaa

SEQ ID NO: 24362 - DNA, 21 bp, Artificial Sequence
  Description of Artificial Sequence: Synthetic oligonucleotide
cgtcagaatgataagtctgtt

SEQ ID NO: 24363 - DNA, 21 bp, Artificial Sequence
  Description of Artificial Sequence: Synthetic oligonucleotide
ctgaataatagttcttcgggt

SEQ ID NO: 24364 - DNA, 21 bp, Artificial Sequence
  Description of Artificial Sequence: Synthetic oligonucleotide
gctagttcggtgccgacgaag

SEQ ID NO: 24365 - DNA, 21 bp, Artificial Sequence
  Description of Artificial Sequence: Synthetic oligonucleotide
gggagttctacgacgatgaag

SEQ ID NO: 24366 - DNA, 21 bp, Artificial Sequence
  Description of Artificial Sequence: Synthetic oligonucleotide
cagagtgggtcgggtcagggg

SEQ ID NO: 24367 - DNA, 21 bp, Artificial Sequence
  Description of Artificial Sequence: Synthetic oligonucleotide
aacagcagcgacagagccacc

SEQ ID NO: 24368 - DNA, 21 bp, Artificial Sequence
  Description of Artificial Sequence: Synthetic oligonucleotide
gacagcgtcaacgccagaacc

SEQ ID NO: 24369 - DNA, 21 bp, Artificial Sequence
  Description of Artificial Sequence: Synthetic oligonucleotide
accagcagcggcagcaacctc

SEQ ID NO: 24370 - DNA, 21 bp, Artificial Sequence
  Description of Artificial Sequence: Synthetic oligonucleotide
caaatgaccaccaaagccaac

SEQ ID NO: 24371 - DNA, 21 bp, Artificial Sequence
  Description of Artificial Sequence: Synthetic oligonucleotide
ggttatgatagtgagcggagg

SEQ ID NO: 24372 - DNA, 21 bp, Artificial Sequence
  Description of Artificial Sequence: Synthetic oligonucleotide
ggttctgctcagaaggctttt

SEQ ID NO: 24373 - DNA, 21 bp, Artificial Sequence
  Description of Artificial Sequence: Synthetic oligonucleotide
gttggggttcagtctgtttct

SEQ ID NO: 24374 - DNA, 21 bp, Artificial Sequence
  Description of Artificial Sequence: Synthetic oligonucleotide
agaagcggcacccccgacaga

SEQ ID NO: 24375 - DNA, 21 bp, Artificial Sequence
  Description of Artificial Sequence: Synthetic oligonucleotide
ggccaacccaacctcaacaaa

SEQ ID NO: 24376 - DNA, 21 bp, Artificial Sequence
  Description of Artificial Sequence: Synthetic oligonucleotide
gaacccgtcagcaaaaacatg

SEQ ID NO: 24377 - DNA, 21 bp, Artificial Sequence
  Description of Artificial Sequence: Synthetic oligonucleotide
gacaccagaagccccagcacc

SEQ ID NO: 24378 - DNA, 21 bp, Artificial Sequence
  Description of Artificial Sequence: Synthetic oligonucleotide
gctgctgggactgggactact

SEQ ID NO: 24379 - DNA, 21 bp, Artificial Sequence
  Description of Artificial Sequence: Synthetic oligonucleotide
ggtgagagtaagagtgggaag

SEQ ID NO: 24380 - DNA, 21 bp, Artificial Sequence
  Description of Artificial Sequence: Synthetic oligonucleotide
accggcaacagcgccctcacc

SEQ ID NO: 24381 - DNA, 21 bp, Artificial Sequence
  Description of Artificial Sequence: Synthetic oligonucleotide
gcgcgtactgaggctagtcgg

SEQ ID NO: 24382 - DNA, 21 bp, Artificial Sequence
  Description of Artificial Sequence: Synthetic oligonucleotide
agccccagcaaacccggcagc

SEQ ID NO: 24383 - DNA, 21 bp, Artificial Sequence
  Description of Artificial Sequence: Synthetic oligonucleotide
agcgtcggcggcaaaggcgcc

SEQ ID NO: 24384 - DNA, 21 bp, Artificial Sequence
  Description of Artificial Sequence: Synthetic oligonucleotide
acgcaggcgagtacggctcag

SEQ ID NO: 24385 - DNA, 21 bp, Artificial Sequence
  Description of Artificial Sequence: Synthetic oligonucleotide
caggggggtcatgggtctgct

SEQ ID NO: 24386 - DNA, 21 bp, Artificial Sequence
  Description of Artificial Sequence: Synthetic oligonucleotide
ctccccaaccccaccagcggc

SEQ ID NO: 24387 - DNA, 21 bp, Artificial Sequence
  Description of Artificial Sequence: Synthetic oligonucleotide
gattcgattggggggaagaat

SEQ ID NO: 24388 - DNA, 21 bp, Artificial Sequence
  Description of Artificial Sequence: Synthetic oligonucleotide
gccaaaagcagcgaaaccagc

SEQ ID NO: 24389 - DNA, 21 bp, Artificial Sequence
  Description of Artificial Sequence: Synthetic oligonucleotide
tcggcttctgggtcgatgaag

SEQ ID NO: 24390 - DNA, 21 bp, Artificial Sequence
  Description of Artificial Sequence: Synthetic oligonucleotide
tctgggagtcagactatgaag

SEQ ID NO: 24391 - DNA, 21 bp, Artificial Sequence
  Description of Artificial Sequence: Synthetic oligonucleotide
cttctgaagagtcctccgact

SEQ ID NO: 24392 - DNA, 21 bp, Artificial Sequence
  Description of Artificial Sequence: Synthetic oligonucleotide
aacagcatcagcaacgtcaaa

SEQ ID NO: 24393 - DNA, 21 bp, Artificial Sequence
  Description of Artificial Sequence: Synthetic oligonucleotide
gccatgggcggcagcaaacaa

SEQ ID NO: 24394 - DNA, 21 bp, Artificial Sequence
  Description of Artificial Sequence: Synthetic oligonucleotide
aacagcgccgacagaggcgcc

SEQ ID NO: 24395 - DNA, 21 bp, Artificial Sequence
  Description of Artificial Sequence: Synthetic oligonucleotide
agcgccggcagcgccgcccaa

SEQ ID NO: 24396 - DNA, 21 bp, Artificial Sequence
  Description of Artificial Sequence: Synthetic oligonucleotide
cttgtgaattctacggggggg

SEQ ID NO: 24397 - DNA, 21 bp, Artificial Sequence
  Description of Artificial Sequence: Synthetic oligonucleotide
gatagtgggaaggggcatgag

SEQ ID NO: 24398 - DNA, 21 bp, Artificial Sequence
  Description of Artificial Sequence: Synthetic oligonucleotide
gatccgttgcagaataggaat

SEQ ID NO: 24399 - DNA, 21 bp, Artificial Sequence
  Description of Artificial Sequence: Synthetic oligonucleotide
ggcaaagaagccctcccccaa

SEQ ID NO: 24400 - DNA, 21 bp, Artificial Sequence
  Description of Artificial Sequence: Synthetic oligonucleotide
ggcaacggcaaaaccaaagac

SEQ ID NO: 24401 - DNA, 21 bp, Artificial Sequence
  Description of Artificial Sequence: Synthetic oligonucleotide
ggcaccgccgccagccaactc

SEQ ID NO: 24402 - DNA, 21 bp, Artificial Sequence
  Description of Artificial Sequence: Synthetic oligonucleotide
caaatggacacccccaccaaa

SEQ ID NO: 24403 - DNA, 21 bp, Artificial Sequence
  Description of Artificial Sequence: Synthetic oligonucleotide
gatagtgttcctacggctgct

SEQ ID NO: 24404 - DNA, 21 bp, Artificial Sequence
  Description of Artificial Sequence: Synthetic oligonucleotide
gatcgtgtttcttctccgatg

SEQ ID NO: 24405 - DNA, 21 bp, Artificial Sequence
  Description of Artificial Sequence: Synthetic oligonucleotide
gctaatggggcgcctcagaag

SEQ ID NO: 24406 - DNA, 21 bp, Artificial Sequence
  Description of Artificial Sequence: Synthetic oligonucleotide
agtacgagtgatggtaatcgt

SEQ ID NO: 24407 - DNA, 21 bp, Artificial Sequence
  Description of Artificial Sequence: Synthetic oligonucleotide
accaccggcagcaacacccac

SEQ ID NO: 24408 - DNA, 21 bp, Artificial Sequence
  Description of Artificial Sequence: Synthetic oligonucleotide
aggtcgagtaaggagcttgat

SEQ ID NO: 24409 - DNA, 21 bp, Artificial Sequence
  Description of Artificial Sequence: Synthetic oligonucleotide
cagaagactgatagtttgaag

SEQ ID NO: 24410 - DNA, 21 bp, Artificial Sequence
  Description of Artificial Sequence: Synthetic oligonucleotide
gacgccgccaccaaacccaac

SEQ ID NO: 24411 - DNA, 21 bp, Artificial Sequence
  Description of Artificial Sequence: Synthetic oligonucleotide
aatgcgaatcctgagaggggt

SEQ ID NO: 24412 - DNA, 21 bp, Artificial Sequence
  Description of Artificial Sequence: Synthetic oligonucleotide
accagcaacaacggccccaga

SEQ ID NO: 24413 - DNA, 21 bp, Artificial Sequence
  Description of Artificial Sequence: Synthetic oligonucleotide
cacagagacgtcaaacccgac

SEQ ID NO: 24414 - DNA, 21 bp, Artificial Sequence
  Description of Artificial Sequence: Synthetic oligonucleotide
ctcaccggcagcggcatcagc

SEQ ID NO: 24415 - DNA, 21 bp, Artificial Sequence
  Description of Artificial Sequence: Synthetic oligonucleotide
agccacaacgccaccaacacc

SEQ ID NO: 24416 - DNA, 21 bp, Artificial Sequence
  Description of Artificial Sequence: Synthetic oligonucleotide
cagtcggatgctagggcgaag

SEQ ID NO: 24417 - DNA, 21 bp, Artificial Sequence
  Description of Artificial Sequence: Synthetic oligonucleotide
tacagagaaagcgaagccaga

SEQ ID NO: 24418 - DNA, 21 bp, Artificial Sequence
  Description of Artificial Sequence: Synthetic oligonucleotide
cacaccaccaaagaaagctac

SEQ ID NO: 24419 - DNA, 21 bp, Artificial Sequence
  Description of Artificial Sequence: Synthetic oligonucleotide
agcgccaccggcaaccacagc

SEQ ID NO: 24420 - DNA, 21 bp, Artificial Sequence
  Description of Artificial Sequence: Synthetic oligonucleotide
gacctccccaccaaacacacc

SEQ ID NO: 24421 - DNA, 21 bp, Artificial Sequence
  Description of Artificial Sequence: Synthetic oligonucleotide
ggcctcggcaccaacaaactc

SEQ ID NO: 24422 - DNA, 21 bp, Artificial Sequence
  Description of Artificial Sequence: Synthetic oligonucleotide
acttcggatagtaaggttggt

SEQ ID NO: 24423 - DNA, 21 bp, Artificial Sequence
  Description of Artificial Sequence: Synthetic oligonucleotide
atggggcagaatgcgccgcag

SEQ ID NO: 24424 - DNA, 21 bp, Artificial Sequence
  Description of Artificial Sequence: Synthetic oligonucleotide
ctccccagccacgaaaccaga

SEQ ID NO: 24425 - DNA, 21 bp, Artificial Sequence
  Description of Artificial Sequence: Synthetic oligonucleotide
ggcagcgaaagcgccctcaga

SEQ ID NO: 24426 - DNA, 21 bp, Artificial Sequence
  Description of Artificial Sequence: Synthetic oligonucleotide
tctcatagtccttctaatatg

SEQ ID NO: 24427 - DNA, 21 bp, Artificial Sequence
  Description of Artificial Sequence: Synthetic oligonucleotide
tttgttgagaagccgaattct

SEQ ID NO: 24428 - DNA, 21 bp, Artificial Sequence
  Description of Artificial Sequence: Synthetic oligonucleotide
gccaacagccaaggcaacctc

SEQ ID NO: 24429 - DNA, 21 bp, Artificial Sequence
  Description of Artificial Sequence: Synthetic oligonucleotide
tctactagtcgtactcctgtt

SEQ ID NO: 24430 - DNA, 21 bp, Artificial Sequence
  Description of Artificial Sequence: Synthetic oligonucleotide
cgtgatagtggggcgaagaat

SEQ ID NO: 24431 - DNA, 21 bp, Artificial Sequence
  Description of Artificial Sequence: Synthetic oligonucleotide
acccaagccggcgaccacaga

SEQ ID NO: 24432 - DNA, 21 bp, Artificial Sequence
  Description of Artificial Sequence: Synthetic oligonucleotide
gctagtggggtgcagggtcag

SEQ ID NO: 24433 - DNA, 21 bp, Artificial Sequence
  Description of Artificial Sequence: Synthetic oligonucleotide
ggggctaatggtcgtgggtct

SEQ ID NO: 24434 - DNA, 21 bp, Artificial Sequence
  Description of Artificial Sequence: Synthetic oligonucleotide
tatgcgacgaaggagcctcgt

SEQ ID NO: 24435 - DNA, 21 bp, Artificial Sequence
  Description of Artificial Sequence: Synthetic oligonucleotide
aacgtcaccaccagcacccaa

SEQ ID NO: 24436 - DNA, 21 bp, Artificial Sequence
  Description of Artificial Sequence: Synthetic oligonucleotide
gatgggcagcctcgttctgcg

SEQ ID NO: 24437 - DNA, 21 bp, Artificial Sequence
  Description of Artificial Sequence: Synthetic oligonucleotide
ggggatcgtaatcagcctcat

SEQ ID NO: 24438 - DNA, 21 bp, Artificial Sequence
  Description of Artificial Sequence: Synthetic oligonucleotide
gacggcgccagaacccccacc

SEQ ID NO: 24439 - DNA, 21 bp, Artificial Sequence
  Description of Artificial Sequence: Synthetic oligonucleotide
aaaagccacgacaaaagcagc

SEQ ID NO: 24440 - DNA, 21 bp, Artificial Sequence
  Description of Artificial Sequence: Synthetic oligonucleotide
catttgggttctgataagagt

SEQ ID NO: 24441 - DNA, 21 bp, Artificial Sequence
  Description of Artificial Sequence: Synthetic oligonucleotide
acttcttcgaagccttatacg

SEQ ID NO: 24442 - DNA, 21 bp, Artificial Sequence
  Description of Artificial Sequence: Synthetic oligonucleotide
agcaaaaccaacaccgccagc

SEQ ID NO: 24443 - DNA, 21 bp, Artificial Sequence
  Description of Artificial Sequence: Synthetic oligonucleotide
agcctcagcaaaagccacgaa

SEQ ID NO: 24444 - DNA, 21 bp, Artificial Sequence
  Description of Artificial Sequence: Synthetic oligonucleotide
gaaagcagcgccaaagtcccc

SEQ ID NO: 24445 - DNA, 21 bp, Artificial Sequence
  Description of Artificial Sequence: Synthetic oligonucleotide
gccggcgacggcagagtcaac

SEQ ID NO: 24446 - DNA, 21 bp, Artificial Sequence
  Description of Artificial Sequence: Synthetic oligonucleotide
ggcctcaccaaacccaccgcc

SEQ ID NO: 24447 - DNA, 21 bp, Artificial Sequence
  Description of Artificial Sequence: Synthetic oligonucleotide
gtcggcaaaggccaagccccc

SEQ ID NO: 24448 - DNA, 21 bp, Artificial Sequence
  Description of Artificial Sequence: Synthetic oligonucleotide
tcgacttctactcatcagggg

SEQ ID NO: 24449 - DNA, 21 bp, Artificial Sequence
  Description of Artificial Sequence: Synthetic oligonucleotide
tctgctattggtgctaatacg

SEQ ID NO: 24450 - DNA, 21 bp, Artificial Sequence
  Description of Artificial Sequence: Synthetic oligonucleotide
accagcaccaacgtcaaagaa

SEQ ID NO: 24451 - DNA, 21 bp, Artificial Sequence
  Description of Artificial Sequence: Synthetic oligonucleotide
acgcatcaggagcataattct

SEQ ID NO: 24452 - DNA, 21 bp, Artificial Sequence
  Description of Artificial Sequence: Synthetic oligonucleotide
agcagaagccccgacaccacc

SEQ ID NO: 24453 - DNA, 21 bp, Artificial Sequence
  Description of Artificial Sequence: Synthetic oligonucleotide
aggaatgctgatccgcagcag

SEQ ID NO: 24454 - DNA, 21 bp, Artificial Sequence
  Description of Artificial Sequence: Synthetic oligonucleotide
ggccccaacaacgaacccaga

SEQ ID NO: 24455 - DNA, 21 bp, Artificial Sequence
  Description of Artificial Sequence: Synthetic oligonucleotide
ttgccgtcgaagtctacgggg

SEQ ID NO: 24456 - DNA, 21 bp, Artificial Sequence
  Description of Artificial Sequence: Synthetic oligonucleotide
ggcaccagcggcgacagccac

SEQ ID NO: 24457 - DNA, 21 bp, Artificial Sequence
  Description of Artificial Sequence: Synthetic oligonucleotide
actgcgaatgggacgaattct

SEQ ID NO: 24458 - DNA, 21 bp, Artificial Sequence
  Description of Artificial Sequence: Synthetic oligonucleotide
accaacagcaacatgcacacc

SEQ ID NO: 24459 - DNA, 21 bp, Artificial Sequence
  Description of Artificial Sequence: Synthetic oligonucleotide
accagccccggcgccggcaga

SEQ ID NO: 24460 - DNA, 21 bp, Artificial Sequence
  Description of Artificial Sequence: Synthetic oligonucleotide
actgggaggtcttcgatgtcg

SEQ ID NO: 24461 - DNA, 21 bp, Artificial Sequence
  Description of Artificial Sequence: Synthetic oligonucleotide
actggtatggcggataagggt

SEQ ID NO: 24462 - DNA, 21 bp, Artificial Sequence
  Description of Artificial Sequence: Synthetic oligonucleotide
acttctgggacttcgtctctg

SEQ ID NO: 24463 - DNA, 21 bp, Artificial Sequence
  Description of Artificial Sequence: Synthetic oligonucleotide
agccaaaccagccacaccgtc

SEQ ID NO: 24464 - DNA, 21 bp, Artificial Sequence
  Description of Artificial Sequence: Synthetic oligonucleotide
ggcctcatgggcgccagcaaa

SEQ ID NO: 24465 - DNA, 21 bp, Artificial Sequence
  Description of Artificial Sequence: Synthetic oligonucleotide
gtgcctaataattcgcctaat

SEQ ID NO: 24466 - DNA, 21 bp, Artificial Sequence
  Description of Artificial Sequence: Synthetic oligonucleotide
ggccacagcaaaagccccatc

SEQ ID NO: 24467 - DNA, 21 bp, Artificial Sequence
  Description of Artificial Sequence: Synthetic oligonucleotide
accgacgtcaaaaccccccac

SEQ ID NO: 24468 - DNA, 21 bp, Artificial Sequence
  Description of Artificial Sequence: Synthetic oligonucleotide
accgccagcagaagcaacagc

SEQ ID NO: 24469 - DNA, 21 bp, Artificial Sequence
  Description of Artificial Sequence: Synthetic oligonucleotide
cataatggtgatattaagggt

SEQ ID NO: 24470 - DNA, 21 bp, Artificial Sequence
  Description of Artificial Sequence: Synthetic oligonucleotide
gctggttcgagtcatacgggt

SEQ ID NO: 24471 - DNA, 21 bp, Artificial Sequence
  Description of Artificial Sequence: Synthetic oligonucleotide
ggcagcctcggcaacgaaaga

SEQ ID NO: 24472 - DNA, 21 bp, Artificial Sequence
  Description of Artificial Sequence: Synthetic oligonucleotide
aacagaacccacaccaacgtc

SEQ ID NO: 24473 - DNA, 21 bp, Artificial Sequence
  Description of Artificial Sequence: Synthetic oligonucleotide
accgaaagagccgccagcgtc

SEQ ID NO: 24474 - DNA, 21 bp, Artificial Sequence
  Description of Artificial Sequence: Synthetic oligonucleotide
attaatcagactaagcctgag

SEQ ID NO: 24475 - DNA, 21 bp, Artificial Sequence
  Description of Artificial Sequence: Synthetic oligonucleotide
agaaccagcaacggcaccagc

SEQ ID NO: 24476 - DNA, 21 bp, Artificial Sequence
  Description of Artificial Sequence: Synthetic oligonucleotide
ggtagggctaatggtgttgct

SEQ ID NO: 24477 - DNA, 21 bp, Artificial Sequence
  Description of Artificial Sequence: Synthetic oligonucleotide
agcaccaaccccgtcaacgtc

SEQ ID NO: 24478 - DNA, 21 bp, Artificial Sequence
  Description of Artificial Sequence: Synthetic oligonucleotide
gatggtaagtcttctccggtg

SEQ ID NO: 24479 - DNA, 21 bp, Artificial Sequence
  Description of Artificial Sequence: Synthetic oligonucleotide
atgcaacaaaccagcaccgcc

SEQ ID NO: 24480 - DNA, 21 bp, Artificial Sequence
  Description of Artificial Sequence: Synthetic oligonucleotide
ctgggtgctagtagtgcggcg

SEQ ID NO: 24481 - DNA, 21 bp, Artificial Sequence
  Description of Artificial Sequence: Synthetic oligonucleotide
gcgaagactacttcgctggct

SEQ ID NO: 24482 - DNA, 21 bp, Artificial Sequence
  Description of Artificial Sequence: Synthetic oligonucleotide
agcagcagcaccaccaacacc

SEQ ID NO: 24483 - DNA, 21 bp, Artificial Sequence
  Description of Artificial Sequence: Synthetic oligonucleotide
aacaccggcagcggcaacagc

SEQ ID NO: 24484 - DNA, 21 bp, Artificial Sequence
  Description of Artificial Sequence: Synthetic oligonucleotide
accaccgccaccaacttcgcc

SEQ ID NO: 24485 - DNA, 21 bp, Artificial Sequence
  Description of Artificial Sequence: Synthetic oligonucleotide
caaagccccggcgcccacaac

SEQ ID NO: 24486 - DNA, 21 bp, Artificial Sequence
  Description of Artificial Sequence: Synthetic oligonucleotide
tctgttgcttcggatcgtatt

SEQ ID NO: 24487 - DNA, 21 bp, Artificial Sequence
  Description of Artificial Sequence: Synthetic oligonucleotide
ctcgccgacagaagcaacacc

SEQ ID NO: 24488 - DNA, 21 bp, Artificial Sequence
  Description of Artificial Sequence: Synthetic oligonucleotide
agccaagccaccgtcagcaga

SEQ ID NO: 24489 - DNA, 21 bp, Artificial Sequence
  Description of Artificial Sequence: Synthetic oligonucleotide
aacggcagaggcaccgtcgtc

SEQ ID NO: 24490 - DNA, 21 bp, Artificial Sequence
  Description of Artificial Sequence: Synthetic oligonucleotide
gtttcgtctgcgtcgcctact

SEQ ID NO: 24491 - DNA, 21 bp, Artificial Sequence
  Description of Artificial Sequence: Synthetic oligonucleotide
tctggttctgatgtttcgcgt

SEQ ID NO: 24492 - DNA, 21 bp, Artificial Sequence
  Description of Artificial Sequence: Synthetic oligonucleotide
accaacgtcgccgcccaaggc

SEQ ID NO: 24493 - DNA, 21 bp, Artificial Sequence
  Description of Artificial Sequence: Synthetic oligonucleotide
gtcaccagcagccccaccctc

SEQ ID NO: 24494 - DNA, 21 bp, Artificial Sequence
  Description of Artificial Sequence: Synthetic oligonucleotide
agtacgactacgccttctact

SEQ ID NO: 24495 - DNA, 21 bp, Artificial Sequence
  Description of Artificial Sequence: Synthetic oligonucleotide
ggcgacggcaccagacccaaa

SEQ ID NO: 24496 - DNA, 21 bp, Artificial Sequence
  Description of Artificial Sequence: Synthetic oligonucleotide
tcttcgactactcattctaag

SEQ ID NO: 24497 - DNA, 21 bp, Artificial Sequence
  Description of Artificial Sequence: Synthetic oligonucleotide
gccagccaacccaaaggcggc

SEQ ID NO: 24498 - DNA, 21 bp, Artificial Sequence
  Description of Artificial Sequence: Synthetic oligonucleotide
tcggctagtagttcgccggtt

SEQ ID NO: 24499 - DNA, 21 bp, Artificial Sequence
  Description of Artificial Sequence: Synthetic oligonucleotide
caccaaaacggcccccaaaaa

SEQ ID NO: 24500 - DNA, 21 bp, Artificial Sequence
  Description of Artificial Sequence: Synthetic oligonucleotide
ggcaacggcgaacaaagaggc

SEQ ID NO: 24501 - DNA, 21 bp, Artificial Sequence
  Description of Artificial Sequence: Synthetic oligonucleotide
ggcacccaaaacagcaaactc

SEQ ID NO: 24502 - DNA, 21 bp, Artificial Sequence
  Description of Artificial Sequence: Synthetic oligonucleotide
aatcgtcttccgagtgctagt

SEQ ID NO: 24503 - DNA, 21 bp, Artificial Sequence
  Description of Artificial Sequence: Synthetic oligonucleotide
ttgcctacggcgccgcgggat

SEQ ID NO: 24504 - DNA, 21 bp, Artificial Sequence
  Description of Artificial Sequence: Synthetic oligonucleotide
caaggcgacaaccaattcaaa

SEQ ID NO: 24505 - DNA, 21 bp, Artificial Sequence
  Description of Artificial Sequence: Synthetic oligonucleotide
tcgactgggtctactactggt

SEQ ID NO: 24506 - DNA, 21 bp, Artificial Sequence
  Description of Artificial Sequence: Synthetic oligonucleotide
acgggtgcttcgtctggtaat

SEQ ID NO: 24507 - DNA, 21 bp, Artificial Sequence
  Description of Artificial Sequence: Synthetic oligonucleotide
gaccacggcaaaaccagcgtc

SEQ ID NO: 24508 - DNA, 21 bp, Artificial Sequence
  Description of Artificial Sequence: Synthetic oligonucleotide
gagtcggatcgtgctaagcat

SEQ ID NO: 24509 - DNA, 21 bp, Artificial Sequence
  Description of Artificial Sequence: Synthetic oligonucleotide
aacaacggccacgccgacaga

SEQ ID NO: 24510 - DNA, 21 bp, Artificial Sequence
  Description of Artificial Sequence: Synthetic oligonucleotide
aacagcgccaccaacagcctc

SEQ ID NO: 24511 - DNA, 21 bp, Artificial Sequence
  Description of Artificial Sequence: Synthetic oligonucleotide
aagcagagtccgcctgataag

SEQ ID NO: 24512 - DNA, 21 bp, Artificial Sequence
  Description of Artificial Sequence: Synthetic oligonucleotide
aagggtacggagcagccgcat

SEQ ID NO: 24513 - DNA, 21 bp, Artificial Sequence
  Description of Artificial Sequence: Synthetic oligonucleotide
aatgcgacttctaatccgcat

SEQ ID NO: 24514 - DNA, 21 bp, Artificial Sequence
  Description of Artificial Sequence: Synthetic oligonucleotide
accacccaaaaagccaccatg

SEQ ID NO: 24515 - DNA, 21 bp, Artificial Sequence
  Description of Artificial Sequence: Synthetic oligonucleotide
accaccctcgacggcgccaaa

SEQ ID NO: 24516 - DNA, 21 bp, Artificial Sequence
  Description of Artificial Sequence: Synthetic oligonucleotide
accaccgacatgaaactcggc

SEQ ID NO: 24517 - DNA, 21 bp, Artificial Sequence
  Description of Artificial Sequence: Synthetic oligonucleotide
accagcagagaaagccccccc

SEQ ID NO: 24518 - DNA, 21 bp, Artificial Sequence
  Description of Artificial Sequence: Synthetic oligonucleotide
accctcagcaaaagcagcatc

SEQ ID NO: 24519 - DNA, 21 bp, Artificial Sequence
  Description of Artificial Sequence: Synthetic oligonucleotide
acggatgctacttctagtggg

SEQ ID NO: 24520 - DNA, 21 bp, Artificial Sequence
  Description of Artificial Sequence: Synthetic oligonucleotide
acgggtacgacttctactatg

SEQ ID NO: 24521 - DNA, 21 bp, Artificial Sequence
  Description of Artificial Sequence: Synthetic oligonucleotide
agcaaagtcagcagccaagaa

SEQ ID NO: 24522 - DNA, 21 bp, Artificial Sequence
  Description of Artificial Sequence: Synthetic oligonucleotide
agcagcatgcccgccgccggc

SEQ ID NO: 24523 - DNA, 21 bp, Artificial Sequence
  Description of Artificial Sequence: Synthetic oligonucleotide
agcagcggcagcgcccaaccc

SEQ ID NO: 24524 - DNA, 21 bp, Artificial Sequence
  Description of Artificial Sequence: Synthetic oligonucleotide
agccaagcccacgtcaccaaa

SEQ ID NO: 24525 - DNA, 21 bp, Artificial Sequence
  Description of Artificial Sequence: Synthetic oligonucleotide
agccccgccaccaacaaaatc

SEQ ID NO: 24526 - DNA, 21 bp, Artificial Sequence
  Description of Artificial Sequence: Synthetic oligonucleotide
agcgaaagcaccagaaccacc

SEQ ID NO: 24527 - DNA, 21 bp, Artificial Sequence
  Description of Artificial Sequence: Synthetic oligonucleotide
agcggccacagcaaactcccc

SEQ ID NO: 24528 - DNA, 21 bp, Artificial Sequence
  Description of Artificial Sequence: Synthetic oligonucleotide
agcgtcagcgccgccaaaggc

SEQ ID NO: 24529 - DNA, 21 bp, Artificial Sequence
  Description of Artificial Sequence: Synthetic oligonucleotide
aggactgagcaggggtcgaat

SEQ ID NO: 24530 - DNA, 21 bp, Artificial Sequence
  Description of Artificial Sequence: Synthetic oligonucleotide
agttcttcgagtaggaatacg

SEQ ID NO: 24531 - DNA, 21 bp, Artificial Sequence
  Description of Artificial Sequence: Synthetic oligonucleotide
atggccggccaaagagacagc

SEQ ID NO: 24532 - DNA, 21 bp, Artificial Sequence
  Description of Artificial Sequence: Synthetic oligonucleotide
caaagcacccccaacctcaaa

SEQ ID NO: 24533 - DNA, 21 bp, Artificial Sequence
  Description of Artificial Sequence: Synthetic oligonucleotide
cagggtgttcaggcggcttcg

SEQ ID NO: 24534 - DNA, 21 bp, Artificial Sequence
  Description of Artificial Sequence: Synthetic oligonucleotide
cagtcgtcgcattcttctgct

SEQ ID NO: 24535 - DNA, 21 bp, Artificial Sequence
  Description of Artificial Sequence: Synthetic oligonucleotide
cagttgggtaagcctgatagt

SEQ ID NO: 24536 - DNA, 21 bp, Artificial Sequence
  Description of Artificial Sequence: Synthetic oligonucleotide
ctccaacccggcagcgccggc

SEQ ID NO: 24537 - DNA, 21 bp, Artificial Sequence
  Description of Artificial Sequence: Synthetic oligonucleotide
ctgacggatactaagggggct

SEQ ID NO: 24538 - DNA, 21 bp, Artificial Sequence
  Description of Artificial Sequence: Synthetic oligonucleotide
ctgtcggtgaagcctatgagt

SEQ ID NO: 24539 - DNA, 21 bp, Artificial Sequence
  Description of Artificial Sequence: Synthetic oligonucleotide
gaagacagcgccagaagcaac

SEQ ID NO: 24540 - DNA, 21 bp, Artificial Sequence
  Description of Artificial Sequence: Synthetic oligonucleotide
gaaggcaacggcgtccacaac

SEQ ID NO: 24541 - DNA, 21 bp, Artificial Sequence
  Description of Artificial Sequence: Synthetic oligonucleotide
gacagcaaagacagaagcatc

SEQ ID NO: 24542 - DNA, 21 bp, Artificial Sequence
  Description of Artificial Sequence: Synthetic oligonucleotide
gacccccccaaaaccagcccc

SEQ ID NO: 24543 - DNA, 21 bp, Artificial Sequence
  Description of Artificial Sequence: Synthetic oligonucleotide
gagaagggggcgtcttcggct

SEQ ID NO: 24544 - DNA, 21 bp, Artificial Sequence
  Description of Artificial Sequence: Synthetic oligonucleotide
gagcctggtacgtctcctaat

SEQ ID NO: 24545 - DNA, 21 bp, Artificial Sequence
  Description of Artificial Sequence: Synthetic oligonucleotide
gataatcattcgtctaagtcg

SEQ ID NO: 24546 - DNA, 21 bp, Artificial Sequence
  Description of Artificial Sequence: Synthetic oligonucleotide
gatagttctaagtcgatggtg

SEQ ID NO: 24547 - DNA, 21 bp, Artificial Sequence
  Description of Artificial Sequence: Synthetic oligonucleotide
gccagcaccggcgacaaaaga

SEQ ID NO: 24548 - DNA, 21 bp, Artificial Sequence
  Description of Artificial Sequence: Synthetic oligonucleotide
gccatgaacaccgccagcagc

SEQ ID NO: 24549 - DNA, 21 bp, Artificial Sequence
  Description of Artificial Sequence: Synthetic oligonucleotide
gccgaccaacaacccaccaga

SEQ ID NO: 24550 - DNA, 21 bp, Artificial Sequence
  Description of Artificial Sequence: Synthetic oligonucleotide
gccggcgacgtcgccagacaa

SEQ ID NO: 24551 - DNA, 21 bp, Artificial Sequence
  Description of Artificial Sequence: Synthetic oligonucleotide
gccggcggcagcaccagcaaa

SEQ ID NO: 24552 - DNA, 21 bp, Artificial Sequence
  Description of Artificial Sequence: Synthetic oligonucleotide
gcgatggctagtggttcgagt

SEQ ID NO: 24553 - DNA, 21 bp, Artificial Sequence
  Description of Artificial Sequence: Synthetic oligonucleotide
ggcaaccccaccgaccaaaaa

SEQ ID NO: 24554 - DNA, 21 bp, Artificial Sequence
  Description of Artificial Sequence: Synthetic oligonucleotide
ggcagcacccccagcaccctc

SEQ ID NO: 24555 - DNA, 21 bp, Artificial Sequence
  Description of Artificial Sequence: Synthetic oligonucleotide
gggcctcagacttctaagagt

SEQ ID NO: 24556 - DNA, 21 bp, Artificial Sequence
  Description of Artificial Sequence: Synthetic oligonucleotide
ggggggactaatggtattcag

SEQ ID NO: 24557 - DNA, 21 bp, Artificial Sequence
  Description of Artificial Sequence: Synthetic oligonucleotide
ggttctaagggtgatttgact

SEQ ID NO: 24558 - DNA, 21 bp, Artificial Sequence
  Description of Artificial Sequence: Synthetic oligonucleotide
ggttctgagaaggatcggcat

SEQ ID NO: 24559 - DNA, 21 bp, Artificial Sequence
  Description of Artificial Sequence: Synthetic oligonucleotide
gtcagcgccaaaggcgtcatg

SEQ ID NO: 24560 - DNA, 21 bp, Artificial Sequence
  Description of Artificial Sequence: Synthetic oligonucleotide
gtggagagtaagattaattcg

SEQ ID NO: 24561 - DNA, 21 bp, Artificial Sequence
  Description of Artificial Sequence: Synthetic oligonucleotide
gttggtgcgtctagtattgct

SEQ ID NO: 24562 - DNA, 21 bp, Artificial Sequence
  Description of Artificial Sequence: Synthetic oligonucleotide
tctactaaggctccgtctggt

SEQ ID NO: 24563 - DNA, 21 bp, Artificial Sequence
  Description of Artificial Sequence: Synthetic oligonucleotide
tctagtaagtctcagccttcg

SEQ ID NO: 24564 - DNA, 21 bp, Artificial Sequence
  Description of Artificial Sequence: Synthetic oligonucleotide
tctggtaggggttcttcggag

SEQ ID NO: 24565 - DNA, 21 bp, Artificial Sequence
  Description of Artificial Sequence: Synthetic oligonucleotide
ttgaagactacgggttctggg

SEQ ID NO: 24566 - DNA, 21 bp, Artificial Sequence
  Description of Artificial Sequence: Synthetic oligonucleotide
ttgccgagtggtaaggatccg

SEQ ID NO: 24567 - DNA, 21 bp, Artificial Sequence
  Description of Artificial Sequence: Synthetic oligonucleotide
actgggaatcctggtaatact

SEQ ID NO: 24568 - DNA, 21 bp, Artificial Sequence
  Description of Artificial Sequence: Synthetic oligonucleotide
atgggccaaaccagcctcagc

SEQ ID NO: 24569 - DNA, 21 bp, Artificial Sequence
  Description of Artificial Sequence: Synthetic oligonucleotide
acccccagcgcccccagcaac

SEQ ID NO: 24570 - DNA, 21 bp, Artificial Sequence
  Description of Artificial Sequence: Synthetic oligonucleotide
agcagcagcaaccaccccacc

SEQ ID NO: 24571 - DNA, 21 bp, Artificial Sequence
  Description of Artificial Sequence: Synthetic oligonucleotide
gctagtgagcagtcggctaag

SEQ ID NO: 24572 - DNA, 21 bp, Artificial Sequence
  Description of Artificial Sequence: Synthetic oligonucleotide
tcgggtacgtctcatgtgctt

SEQ ID NO: 24573 - DNA, 21 bp, Artificial Sequence
  Description of Artificial Sequence: Synthetic oligonucleotide
gttggttctccttctgcgtcg

SEQ ID NO: 24574 - DNA, 21 bp, Artificial Sequence
  Description of Artificial Sequence: Synthetic oligonucleotide
aacatcaacagcgcccacagc

SEQ ID NO: 24575 - DNA, 21 bp, Artificial Sequence
  Description of Artificial Sequence: Synthetic oligonucleotide
ctcaccggcaccagcaccccc

SEQ ID NO: 24576 - DNA, 21 bp, Artificial Sequence
  Description of Artificial Sequence: Synthetic oligonucleotide
agcggcggccaacccctcaac

SEQ ID NO: 24577 - DNA, 21 bp, Artificial Sequence
  Description of Artificial Sequence: Synthetic oligonucleotide
gaaaacaccagcaccgtccac

SEQ ID NO: 24578 - DNA, 21 bp, Artificial Sequence
  Description of Artificial Sequence: Synthetic oligonucleotide
aatggtggtgatgtttctcgg

SEQ ID NO: 24579 - DNA, 21 bp, Artificial Sequence
  Description of Artificial Sequence: Synthetic oligonucleotide
gattttggtaagacgtctacg

SEQ ID NO: 24580 - DNA, 21 bp, Artificial Sequence
  Description of Artificial Sequence: Synthetic oligonucleotide
ggcatcgtccacagcgaaaga

SEQ ID NO: 24581 - DNA, 21 bp, Artificial Sequence
  Description of Artificial Sequence: Synthetic oligonucleotide
agaggcagcgaacccgtcaac

SEQ ID NO: 24582 - DNA, 21 bp, Artificial Sequence
  Description of Artificial Sequence: Synthetic oligonucleotide
agcaccaccagcagcagcaga

SEQ ID NO: 24583 - DNA, 21 bp, Artificial Sequence
  Description of Artificial Sequence: Synthetic oligonucleotide
ggtggggtggatacgagtcgt

SEQ ID NO: 24584 - DNA, 21 bp, Artificial Sequence
  Description of Artificial Sequence: Synthetic oligonucleotide
ggcagcggcggcgtcagaggc

SEQ ID NO: 24585 - DNA, 21 bp, Artificial Sequence
  Description of Artificial Sequence: Synthetic oligonucleotide
aaccaaagcaccagacccgac

SEQ ID NO: 24586 - DNA, 21 bp, Artificial Sequence
  Description of Artificial Sequence: Synthetic oligonucleotide
actcgtgatagtactaagtct

SEQ ID NO: 24587 - DNA, 21 bp, Artificial Sequence
  Description of Artificial Sequence: Synthetic oligonucleotide
agcaacaccacccacagcgcc

SEQ ID NO: 24588 - DNA, 21 bp, Artificial Sequence
  Description of Artificial Sequence: Synthetic oligonucleotide
agcagaaacgccaccagcgcc

SEQ ID NO: 24589 - DNA, 21 bp, Artificial Sequence
  Description of Artificial Sequence: Synthetic oligonucleotide
agcggcagcggcaccgtcaga

SEQ ID NO: 24590 - DNA, 21 bp, Artificial Sequence
  Description of Artificial Sequence: Synthetic oligonucleotide
agtaggacggtgtctagtacg

SEQ ID NO: 24591 - DNA, 21 bp, Artificial Sequence
  Description of Artificial Sequence: Synthetic oligonucleotide
gctcctggggaggctcagtcg

SEQ ID NO: 24592 - DNA, 21 bp, Artificial Sequence
  Description of Artificial Sequence: Synthetic oligonucleotide
gaacccagcaacaacagcaaa

SEQ ID NO: 24593 - DNA, 21 bp, Artificial Sequence
  Description of Artificial Sequence: Synthetic oligonucleotide
gaccaacaaagcaccaacaga

SEQ ID NO: 24594 - DNA, 21 bp, Artificial Sequence
  Description of Artificial Sequence: Synthetic oligonucleotide
ggcctcaccaaacaagaaacc

SEQ ID NO: 24595 - DNA, 21 bp, Artificial Sequence
  Description of Artificial Sequence: Synthetic oligonucleotide
agcgacaaaagcggcatcgtc

SEQ ID NO: 24596 - DNA, 21 bp, Artificial Sequence
  Description of Artificial Sequence: Synthetic oligonucleotide
gagggtcagaagacggagtcg

SEQ ID NO: 24597 - DNA, 21 bp, Artificial Sequence
  Description of Artificial Sequence: Synthetic oligonucleotide
gccagagacagccacaccacc

SEQ ID NO: 24598 - DNA, 21 bp, Artificial Sequence
  Description of Artificial Sequence: Synthetic oligonucleotide
tcgaatcctcagagtatgggg

SEQ ID NO: 24599 - DNA, 21 bp, Artificial Sequence
  Description of Artificial Sequence: Synthetic oligonucleotide
cagaataaggagtcgtataag

SEQ ID NO: 24600 - DNA, 21 bp, Artificial Sequence
  Description of Artificial Sequence: Synthetic oligonucleotide
ggcaacagaggcggcaccagc

SEQ ID NO: 24601 - DNA, 21 bp, Artificial Sequence
  Description of Artificial Sequence: Synthetic oligonucleotide
aaccccatggtcaacggcaaa

SEQ ID NO: 24602 - DNA, 21 bp, Artificial Sequence
  Description of Artificial Sequence: Synthetic oligonucleotide
aacgtccaagccgccaccaaa

SEQ ID NO: 24603 - DNA, 21 bp, Artificial Sequence
  Description of Artificial Sequence: Synthetic oligonucleotide
agttcgtctagtaagggggtt

SEQ ID NO: 24604 - DNA, 21 bp, Artificial Sequence
  Description of Artificial Sequence: Synthetic oligonucleotide
atcagaaccaaagaaagccac

SEQ ID NO: 24605 - DNA, 21 bp, Artificial Sequence
  Description of Artificial Sequence: Synthetic oligonucleotide
caaagcagcccccccaaaacc

SEQ ID NO: 24606 - DNA, 21 bp, Artificial Sequence
  Description of Artificial Sequence: Synthetic oligonucleotide
gacaccagaggcaaaggcatc

SEQ ID NO: 24607 - DNA, 21 bp, Artificial Sequence
  Description of Artificial Sequence: Synthetic oligonucleotide
gaggttaattctgcgagggct

SEQ ID NO: 24608 - DNA, 21 bp, Artificial Sequence
  Description of Artificial Sequence: Synthetic oligonucleotide
gaggttggtaagcattctaat

SEQ ID NO: 24609 - DNA, 21 bp, Artificial Sequence
  Description of Artificial Sequence: Synthetic oligonucleotide
tctattggtggtactaatggg

SEQ ID NO: 24610 - DNA, 21 bp, Artificial Sequence
  Description of Artificial Sequence: Synthetic oligonucleotide
acccccaccaccaaaagagaa

SEQ ID NO: 24611 - DNA, 21 bp, Artificial Sequence
  Description of Artificial Sequence: Synthetic oligonucleotide
caggttgcttcggctaatccg

SEQ ID NO: 24612 - DNA, 21 bp, Artificial Sequence
  Description of Artificial Sequence: Synthetic oligonucleotide
gaccaagccaaaagcatcaga

SEQ ID NO: 24613 - DNA, 21 bp, Artificial Sequence
  Description of Artificial Sequence: Synthetic oligonucleotide
ggcagcatgggcaccgccaaa

SEQ ID NO: 24614 - DNA, 21 bp, Artificial Sequence
  Description of Artificial Sequence: Synthetic oligonucleotide
gtgaatgggggtcatggtaag

SEQ ID NO: 24615 - DNA, 21 bp, Artificial Sequence
  Description of Artificial Sequence: Synthetic oligonucleotide
gtcagcagcggcggcaccgcc

SEQ ID NO: 24616 - DNA, 21 bp, Artificial Sequence
  Description of Artificial Sequence: Synthetic oligonucleotide
agtttgggtcagtctacggcg

SEQ ID NO: 24617 - DNA, 21 bp, Artificial Sequence
  Description of Artificial Sequence: Synthetic oligonucleotide
cagggtgtgactaataagtct

SEQ ID NO: 24618 - DNA, 21 bp, Artificial Sequence
  Description of Artificial Sequence: Synthetic oligonucleotide
gagggtgtgactacggggtcg

SEQ ID NO: 24619 - DNA, 21 bp, Artificial Sequence
  Description of Artificial Sequence: Synthetic oligonucleotide
agtcagtctgcgcagaatcag

SEQ ID NO: 24620 - DNA, 21 bp, Artificial Sequence
  Description of Artificial Sequence: Synthetic oligonucleotide
agcagcgccaacggcaccaga

SEQ ID NO: 24621 - DNA, 21 bp, Artificial Sequence
  Description of Artificial Sequence: Synthetic oligonucleotide
gaggttaatgctccgcgtaag

SEQ ID NO: 24622 - DNA, 21 bp, Artificial Sequence
  Description of Artificial Sequence: Synthetic oligonucleotide
actatgacgtcttcggcggcg

SEQ ID NO: 24623 - DNA, 21 bp, Artificial Sequence
  Description of Artificial Sequence: Synthetic oligonucleotide
agagacccccccagcagcagc

SEQ ID NO: 24624 - DNA, 21 bp, Artificial Sequence
  Description of Artificial Sequence: Synthetic oligonucleotide
agagtcaacaaaagcagcgaa

SEQ ID NO: 24625 - DNA, 21 bp, Artificial Sequence
  Description of Artificial Sequence: Synthetic oligonucleotide
caaagcgacaaagaacccaga

SEQ ID NO: 24626 - DNA, 21 bp, Artificial Sequence
  Description of Artificial Sequence: Synthetic oligonucleotide
gtgagtgttccgcctagtaat

SEQ ID NO: 24627 - DNA, 21 bp, Artificial Sequence
  Description of Artificial Sequence: Synthetic oligonucleotide
aacagcgacggcaaagtcaga

SEQ ID NO: 24628 - DNA, 21 bp, Artificial Sequence
  Description of Artificial Sequence: Synthetic oligonucleotide
agtggtaataatgggaatgct

SEQ ID NO: 24629 - DNA, 21 bp, Artificial Sequence
  Description of Artificial Sequence: Synthetic oligonucleotide
caagtcaacaccaacggcggc

SEQ ID NO: 24630 - DNA, 21 bp, Artificial Sequence
  Description of Artificial Sequence: Synthetic oligonucleotide
gcccacaaagccaccaacgtc

SEQ ID NO: 24631 - DNA, 21 bp, Artificial Sequence
  Description of Artificial Sequence: Synthetic oligonucleotide
gccgccagccaagccaccgtc

SEQ ID NO: 24632 - DNA, 21 bp, Artificial Sequence
  Description of Artificial Sequence: Synthetic oligonucleotide
gtcggcggcagccccaacagc

SEQ ID NO: 24633 - DNA, 21 bp, Artificial Sequence
  Description of Artificial Sequence: Synthetic oligonucleotide
gttggggggtctagtaagggt

SEQ ID NO: 24634 - DNA, 21 bp, Artificial Sequence
  Description of Artificial Sequence: Synthetic oligonucleotide
ggtacgacgactgtggctggt

SEQ ID NO: 24635 - DNA, 21 bp, Artificial Sequence
  Description of Artificial Sequence: Synthetic oligonucleotide
acccaagtcaccagccccgcc

SEQ ID NO: 24636 - DNA, 21 bp, Artificial Sequence
  Description of Artificial Sequence: Synthetic oligonucleotide
ggtactgagagtcagcgtttg

SEQ ID NO: 24637 - DNA, 21 bp, Artificial Sequence
  Description of Artificial Sequence: Synthetic oligonucleotide
accggcgccgccgccaaccac

SEQ ID NO: 24638 - DNA, 21 bp, Artificial Sequence
  Description of Artificial Sequence: Synthetic oligonucleotide
agcaacaacaacggcagcacc

SEQ ID NO: 24639 - DNA, 21 bp, Artificial Sequence
  Description of Artificial Sequence: Synthetic oligonucleotide
agcagcgaccaaagaaacggc

SEQ ID NO: 24640 - DNA, 21 bp, Artificial Sequence
  Description of Artificial Sequence: Synthetic oligonucleotide
agcggcctcaacaaaagcggc

SEQ ID NO: 24641 - DNA, 21 bp, Artificial Sequence
  Description of Artificial Sequence: Synthetic oligonucleotide
caggttaatgcgcctaatagt

SEQ ID NO: 24642 - DNA, 21 bp, Artificial Sequence
  Description of Artificial Sequence: Synthetic oligonucleotide
agtgggcatgatcgttctggt

SEQ ID NO: 24643 - DNA, 21 bp, Artificial Sequence
  Description of Artificial Sequence: Synthetic oligonucleotide
tcgactcgttctggtgagggt

SEQ ID NO: 24644 - DNA, 21 bp, Artificial Sequence
  Description of Artificial Sequence: Synthetic oligonucleotide
agcaccagcagccaccccatc

SEQ ID NO: 24645 - DNA, 21 bp, Artificial Sequence
  Description of Artificial Sequence: Synthetic oligonucleotide
gccaccgacagacaaggcgcc

SEQ ID NO: 24646 - DNA, 21 bp, Artificial Sequence
  Description of Artificial Sequence: Synthetic oligonucleotide
tctccggttgagcgtaagtcg

SEQ ID NO: 24647 - DNA, 21 bp, Artificial Sequence
  Description of Artificial Sequence: Synthetic oligonucleotide
tctccttcgaatagtaggacg

SEQ ID NO: 24648 - DNA, 21 bp, Artificial Sequence
  Description of Artificial Sequence: Synthetic oligonucleotide
gctgataatcagaagtcgcag

SEQ ID NO: 24649 - DNA, 21 bp, Artificial Sequence
  Description of Artificial Sequence: Synthetic oligonucleotide
aatgctactactactggtcat

SEQ ID NO: 24650 - DNA, 21 bp, Artificial Sequence
  Description of Artificial Sequence: Synthetic oligonucleotide
accagcgacaaacaattcccc

SEQ ID NO: 24651 - DNA, 21 bp, Artificial Sequence
  Description of Artificial Sequence: Synthetic oligonucleotide
actccggaggggaggacgagt

SEQ ID NO: 24652 - DNA, 21 bp, Artificial Sequence
  Description of Artificial Sequence: Synthetic oligonucleotide
agcaacaacaaagccatgctc

SEQ ID NO: 24653 - DNA, 21 bp, Artificial Sequence
  Description of Artificial Sequence: Synthetic oligonucleotide
agtgatagtcgtaaggatggg

SEQ ID NO: 24654 - DNA, 21 bp, Artificial Sequence
  Description of Artificial Sequence: Synthetic oligonucleotide
ctcaccagccaaggcaaaaac

SEQ ID NO: 24655 - DNA, 21 bp, Artificial Sequence
  Description of Artificial Sequence: Synthetic oligonucleotide
ggtagtaagacttctttgacg

SEQ ID NO: 24656 - DNA, 21 bp, Artificial Sequence
  Description of Artificial Sequence: Synthetic oligonucleotide
tatggtacggggagtgtggtg

SEQ ID NO: 24657 - DNA, 21 bp, Artificial Sequence
  Description of Artificial Sequence: Synthetic oligonucleotide
tcgacgggtagtggtgctaat

SEQ ID NO: 24658 - DNA, 21 bp, Artificial Sequence
  Description of Artificial Sequence: Synthetic oligonucleotide
atccccaacgccaaagaacaa

SEQ ID NO: 24659 - DNA, 21 bp, Artificial Sequence
  Description of Artificial Sequence: Synthetic oligonucleotide
tctgcggataagtcgttgtcg

SEQ ID NO: 24660 - DNA, 21 bp, Artificial Sequence
  Description of Artificial Sequence: Synthetic oligonucleotide
gatccgggtattccgaagtct

SEQ ID NO: 24661 - DNA, 21 bp, Artificial Sequence
  Description of Artificial Sequence: Synthetic oligonucleotide
gggttgtcggtgcctcctaat

SEQ ID NO: 24662 - DNA, 21 bp, Artificial Sequence
  Description of Artificial Sequence: Synthetic oligonucleotide
agcgtcgacaacaaaggcctc

SEQ ID NO: 24663 - DNA, 21 bp, Artificial Sequence
  Description of Artificial Sequence: Synthetic oligonucleotide
cacaccgacgccagcagaagc

SEQ ID NO: 24664 - DNA, 21 bp, Artificial Sequence
  Description of Artificial Sequence: Synthetic oligonucleotide
agcagcaacagcagcaccgtc

SEQ ID NO: 24665 - DNA, 21 bp, Artificial Sequence
  Description of Artificial Sequence: Synthetic oligonucleotide
gctcagcgtgctgagatgaag

SEQ ID NO: 24666 - DNA, 21 bp, Artificial Sequence
  Description of Artificial Sequence: Synthetic oligonucleotide
accagcgccaacgccagcacc

SEQ ID NO: 24667 - DNA, 21 bp, Artificial Sequence
  Description of Artificial Sequence: Synthetic oligonucleotide
agcaacagaacccccaccacc

SEQ ID NO: 24668 - DNA, 21 bp, Artificial Sequence
  Description of Artificial Sequence: Synthetic oligonucleotide
agtggggattcgcattcgcgg

SEQ ID NO: 24669 - DNA, 21 bp, Artificial Sequence
  Description of Artificial Sequence: Synthetic oligonucleotide
gaccaaaccagcaccgccaga

SEQ ID NO: 24670 - DNA, 21 bp, Artificial Sequence
  Description of Artificial Sequence: Synthetic oligonucleotide
gatagtcattcgccgggtagt

SEQ ID NO: 24671 - DNA, 21 bp, Artificial Sequence
  Description of Artificial Sequence: Synthetic oligonucleotide
gccagcagcagcagcaccctc

SEQ ID NO: 24672 - DNA, 21 bp, Artificial Sequence
  Description of Artificial Sequence: Synthetic oligonucleotide
gctgagcattcgaagattcag

SEQ ID NO: 24673 - DNA, 21 bp, Artificial Sequence
  Description of Artificial Sequence: Synthetic oligonucleotide
tcggcggcgactagtaatatt

SEQ ID NO: 24674 - DNA, 21 bp, Artificial Sequence
  Description of Artificial Sequence: Synthetic oligonucleotide
tcttctgatactcggccttcg

SEQ ID NO: 24675 - DNA, 21 bp, Artificial Sequence
  Description of Artificial Sequence: Synthetic oligonucleotide
ctgccgtctacgagtggttcg

SEQ ID NO: 24676 - DNA, 21 bp, Artificial Sequence
  Description of Artificial Sequence: Synthetic oligonucleotide
aatactgatacttctaggaat

SEQ ID NO: 24677 - DNA, 21 bp, Artificial Sequence
  Description of Artificial Sequence: Synthetic oligonucleotide
acccccaccaacgacagaagc

SEQ ID NO: 24678 - DNA, 21 bp, Artificial Sequence
  Description of Artificial Sequence: Synthetic oligonucleotide
acgggtggtagtgcgttgggt

SEQ ID NO: 24679 - DNA, 21 bp, Artificial Sequence
  Description of Artificial Sequence: Synthetic oligonucleotide
agcagcaacaccagccaaggc

SEQ ID NO: 24680 - DNA, 21 bp, Artificial Sequence
  Description of Artificial Sequence: Synthetic oligonucleotide
agcggcgtcggcagcatgaac

SEQ ID NO: 24681 - DNA, 21 bp, Artificial Sequence
  Description of Artificial Sequence: Synthetic oligonucleotide
agttcttctcagtcttctcat

SEQ ID NO: 24682 - DNA, 21 bp, Artificial Sequence
  Description of Artificial Sequence: Synthetic oligonucleotide
cacgaactcagcggcaccaaa

SEQ ID NO: 24683 - DNA, 21 bp, Artificial Sequence
  Description of Artificial Sequence: Synthetic oligonucleotide
cagatggctactgggaatgtt

SEQ ID NO: 24684 - DNA, 21 bp, Artificial Sequence
  Description of Artificial Sequence: Synthetic oligonucleotide
gacgaaagcgtcaaaccccaa

SEQ ID NO: 24685 - DNA, 21 bp, Artificial Sequence
  Description of Artificial Sequence: Synthetic oligonucleotide
gattcggttaatactcggact

SEQ ID NO: 24686 - DNA, 21 bp, Artificial Sequence
  Description of Artificial Sequence: Synthetic oligonucleotide
gattctgtgacgaagcgtgcg

SEQ ID NO: 24687 - DNA, 21 bp, Artificial Sequence
  Description of Artificial Sequence: Synthetic oligonucleotide
ggtactgggactagtgttctt

SEQ ID NO: 24688 - DNA, 21 bp, Artificial Sequence
  Description of Artificial Sequence: Synthetic oligonucleotide
tcgttgagtaattcgagtggt

SEQ ID NO: 24689 - DNA, 21 bp, Artificial Sequence
  Description of Artificial Sequence: Synthetic oligonucleotide
acccaagccagcagagtcagc

SEQ ID NO: 24690 - DNA, 21 bp, Artificial Sequence
  Description of Artificial Sequence: Synthetic oligonucleotide
atcagcaacaccgccaccccc

SEQ ID NO: 24691 - DNA, 21 bp, Artificial Sequence
  Description of Artificial Sequence: Synthetic oligonucleotide
ctcagagacagcgccacccac

SEQ ID NO: 24692 - DNA, 21 bp, Artificial Sequence
  Description of Artificial Sequence: Synthetic oligonucleotide
aacgacgccaaaagcggcaac

SEQ ID NO: 24693 - DNA, 21 bp, Artificial Sequence
  Description of Artificial Sequence: Synthetic oligonucleotide
accgaccccacccccagcaaa

SEQ ID NO: 24694 - DNA, 21 bp, Artificial Sequence
  Description of Artificial Sequence: Synthetic oligonucleotide
gctgatactcctaggaatcag

SEQ ID NO: 24695 - DNA, 21 bp, Artificial Sequence
  Description of Artificial Sequence: Synthetic oligonucleotide
gctgggaataatgctccgtcg

SEQ ID NO: 24696 - DNA, 21 bp, Artificial Sequence
  Description of Artificial Sequence: Synthetic oligonucleotide
gggtcgactaatagtcataat

SEQ ID NO: 24697 - DNA, 21 bp, Artificial Sequence
  Description of Artificial Sequence: Synthetic oligonucleotide
ttggctgctggggctggtgct

SEQ ID NO: 24698 - DNA, 21 bp, Artificial Sequence
  Description of Artificial Sequence: Synthetic oligonucleotide
agtggttctgggaagatggtt

SEQ ID NO: 24699 - DNA, 21 bp, Artificial Sequence
  Description of Artificial Sequence: Synthetic oligonucleotide
cgtcctaagccgtcggatggg

SEQ ID NO: 24700 - DNA, 21 bp, Artificial Sequence
  Description of Artificial Sequence: Synthetic oligonucleotide
tcggcgactaatagtaagttg

SEQ ID NO: 24701 - DNA, 21 bp, Artificial Sequence
  Description of Artificial Sequence: Synthetic oligonucleotide
aattctgatacgcggactgct

SEQ ID NO: 24702 - DNA, 21 bp, Artificial Sequence
  Description of Artificial Sequence: Synthetic oligonucleotide
accacccccgcccaacacgcc

SEQ ID NO: 24703 - DNA, 21 bp, Artificial Sequence
  Description of Artificial Sequence: Synthetic oligonucleotide
accagaagcagccccagcatg

SEQ ID NO: 24704 - DNA, 21 bp, Artificial Sequence
  Description of Artificial Sequence: Synthetic oligonucleotide
accggcggcaacaacatgcaa

SEQ ID NO: 24705 - DNA, 21 bp, Artificial Sequence
  Description of Artificial Sequence: Synthetic oligonucleotide
agcaaagaccaccaaaacgcc

SEQ ID NO: 24706 - DNA, 21 bp, Artificial Sequence
  Description of Artificial Sequence: Synthetic oligonucleotide
caaagcagcggcaccaacctc

SEQ ID NO: 24707 - DNA, 21 bp, Artificial Sequence
  Description of Artificial Sequence: Synthetic oligonucleotide
ctcgtcagcgaaaacggcaga

SEQ ID NO: 24708 - DNA, 21 bp, Artificial Sequence
  Description of Artificial Sequence: Synthetic oligonucleotide
cttcaggggacgggtgggagt

SEQ ID NO: 24709 - DNA, 21 bp, Artificial Sequence
  Description of Artificial Sequence: Synthetic oligonucleotide
gacagcgtcagcgccagaacc

SEQ ID NO: 24710 - DNA, 21 bp, Artificial Sequence
  Description of Artificial Sequence: Synthetic oligonucleotide
gctactcaggggtcttcggtt

SEQ ID NO: 24711 - DNA, 21 bp, Artificial Sequence
  Description of Artificial Sequence: Synthetic oligonucleotide
aatttgaaggcgtctagtggg

SEQ ID NO: 24712 - DNA, 21 bp, Artificial Sequence
  Description of Artificial Sequence: Synthetic oligonucleotide
tcgggtaagtcgtcgagtcag

SEQ ID NO: 24713 - DNA, 21 bp, Artificial Sequence
  Description of Artificial Sequence: Synthetic oligonucleotide
aaccccagcaccccccaccac

SEQ ID NO: 24714 - DNA, 21 bp, Artificial Sequence
  Description of Artificial Sequence: Synthetic oligonucleotide
agcaccaaaacccaaagcagc

SEQ ID NO: 24715 - DNA, 21 bp, Artificial Sequence
  Description of Artificial Sequence: Synthetic oligonucleotide
agtctggatagttcgcgtaat

SEQ ID NO: 24716 - DNA, 21 bp, Artificial Sequence
  Description of Artificial Sequence: Synthetic oligonucleotide
atcagcagcaacagcagcagc

SEQ ID NO: 24717 - DNA, 21 bp, Artificial Sequence
  Description of Artificial Sequence: Synthetic oligonucleotide
caaggcaacagccaattcacc

SEQ ID NO: 24718 - DNA, 21 bp, Artificial Sequence
  Description of Artificial Sequence: Synthetic oligonucleotide
gacaccggcagcagcagccac

SEQ ID NO: 24719 - DNA, 21 bp, Artificial Sequence
  Description of Artificial Sequence: Synthetic oligonucleotide
ggggttaatgggggttcgaat

SEQ ID NO: 24720 - DNA, 21 bp, Artificial Sequence
  Description of Artificial Sequence: Synthetic oligonucleotide
gggtctggggataaggttctt

SEQ ID NO: 24721 - DNA, 21 bp, Artificial Sequence
  Description of Artificial Sequence: Synthetic oligonucleotide
gatggtaagactaagaatggt

SEQ ID NO: 24722 - DNA, 21 bp, Artificial Sequence
  Description of Artificial Sequence: Synthetic oligonucleotide
agaaccagcgacaccagcgtc

SEQ ID NO: 24723 - DNA, 21 bp, Artificial Sequence
  Description of Artificial Sequence: Synthetic oligonucleotide
agccaacccgacaaagccaac

SEQ ID NO: 24724 - DNA, 21 bp, Artificial Sequence
  Description of Artificial Sequence: Synthetic oligonucleotide
agccaagcccaacccgtcagc

SEQ ID NO: 24725 - DNA, 21 bp, Artificial Sequence
  Description of Artificial Sequence: Synthetic oligonucleotide
atgcagcagactagtgcgctt

SEQ ID NO: 24726 - DNA, 21 bp, Artificial Sequence
  Description of Artificial Sequence: Synthetic oligonucleotide
ggtgttaagtcgcctcatcag

SEQ ID NO: 24727 - DNA, 21 bp, Artificial Sequence
  Description of Artificial Sequence: Synthetic oligonucleotide
agaaacggcccccccagccaa

SEQ ID NO: 24728 - DNA, 21 bp, Artificial Sequence
  Description of Artificial Sequence: Synthetic oligonucleotide
aacagcagcgaaaaagtcaaa

SEQ ID NO: 24729 - DNA, 21 bp, Artificial Sequence
  Description of Artificial Sequence: Synthetic oligonucleotide
actggtaatcatgggccgtct

SEQ ID NO: 24730 - DNA, 21 bp, Artificial Sequence
  Description of Artificial Sequence: Synthetic oligonucleotide
agcggcatggacggcaaacac

SEQ ID NO: 24731 - DNA, 21 bp, Artificial Sequence
  Description of Artificial Sequence: Synthetic oligonucleotide
atcctcgacagcaaaagcgcc

SEQ ID NO: 24732 - DNA, 21 bp, Artificial Sequence
  Description of Artificial Sequence: Synthetic oligonucleotide
gacagaagcgccagcgacaaa

SEQ ID NO: 24733 - DNA, 21 bp, Artificial Sequence
  Description of Artificial Sequence: Synthetic oligonucleotide
tcttctactagtagtaagact

SEQ ID NO: 24734 - DNA, 21 bp, Artificial Sequence
  Description of Artificial Sequence: Synthetic oligonucleotide
ttggagggcaggacgaatagt

SEQ ID NO: 24735 - DNA, 21 bp, Artificial Sequence
  Description of Artificial Sequence: Synthetic oligonucleotide
agacaagcccccgccctcagc

SEQ ID NO: 24736 - DNA, 21 bp, Artificial Sequence
  Description of Artificial Sequence: Synthetic oligonucleotide
agtaaggttactgctgaggcg

SEQ ID NO: 24737 - DNA, 21 bp, Artificial Sequence
  Description of Artificial Sequence: Synthetic oligonucleotide
caaagcaccagcaccagcgcc

SEQ ID NO: 24738 - DNA, 21 bp, Artificial Sequence
  Description of Artificial Sequence: Synthetic oligonucleotide
caaggcctcaccgacaaaaac

SEQ ID NO: 24739 - DNA, 21 bp, Artificial Sequence
  Description of Artificial Sequence: Synthetic oligonucleotide
ggcctcaacaacaccaccacc

SEQ ID NO: 24740 - DNA, 21 bp, Artificial Sequence
  Description of Artificial Sequence: Synthetic oligonucleotide
gtcagcgacaaaaacctcccc

SEQ ID NO: 24741 - DNA, 21 bp, Artificial Sequence
  Description of Artificial Sequence: Synthetic oligonucleotide
agcagcggcggcgacagcaga

SEQ ID NO: 24742 - DNA, 21 bp, Artificial Sequence
  Description of Artificial Sequence: Synthetic oligonucleotide
aatggtgcttctaatgcgcgt

SEQ ID NO: 24743 - DNA, 21 bp, Artificial Sequence
  Description of Artificial Sequence: Synthetic oligonucleotide
agcggcgtccccagcatgaac

SEQ ID NO: 24744 - DNA, 21 bp, Artificial Sequence
  Description of Artificial Sequence: Synthetic oligonucleotide
gctccggctgtgtcttctggt

SEQ ID NO: 24745 - DNA, 21 bp, Artificial Sequence
  Description of Artificial Sequence: Synthetic oligonucleotide
aaagccgccggccccaacggc

SEQ ID NO: 24746 - DNA, 21 bp, Artificial Sequence
  Description of Artificial Sequence: Synthetic oligonucleotide
aagactagtggtggtacggag

SEQ ID NO: 24747 - DNA, 21 bp, Artificial Sequence
  Description of Artificial Sequence: Synthetic oligonucleotide
agcgccaacagcagcaacacc

SEQ ID NO: 24748 - DNA, 21 bp, Artificial Sequence
  Description of Artificial Sequence: Synthetic oligonucleotide
agcggcagcacccaagccccc

SEQ ID NO: 24749 - DNA, 21 bp, Artificial Sequence
  Description of Artificial Sequence: Synthetic oligonucleotide
cacgccggcagcagcagcgcc

SEQ ID NO: 24750 - DNA, 21 bp, Artificial Sequence
  Description of Artificial Sequence: Synthetic oligonucleotide
caggagaagacgggtacttct

SEQ ID NO: 24751 - DNA, 21 bp, Artificial Sequence
  Description of Artificial Sequence: Synthetic oligonucleotide
caggggtcttctactggggtt

SEQ ID NO: 24752 - DNA, 21 bp, Artificial Sequence
  Description of Artificial Sequence: Synthetic oligonucleotide
ggcctcgaaggcaacagcaaa

SEQ ID NO: 24753 - DNA, 21 bp, Artificial Sequence
  Description of Artificial Sequence: Synthetic oligonucleotide
gggactccggagagggcgaat

SEQ ID NO: 24754 - DNA, 21 bp, Artificial Sequence
  Description of Artificial Sequence: Synthetic oligonucleotide
ggtgttacgaataagtcgttt

SEQ ID NO: 24755 - DNA, 21 bp, Artificial Sequence
  Description of Artificial Sequence: Synthetic oligonucleotide
gtcagcgacaaacccctcatg

SEQ ID NO: 24756 - DNA, 21 bp, Artificial Sequence
  Description of Artificial Sequence: Synthetic oligonucleotide
gtgcaggcgcctacgcttggg

SEQ ID NO: 24757 - DNA, 21 bp, Artificial Sequence
  Description of Artificial Sequence: Synthetic oligonucleotide
gacagcaaaacccccaccgtc

SEQ ID NO: 24758 - DNA, 21 bp, Artificial Sequence
  Description of Artificial Sequence: Synthetic oligonucleotide
ggcaacagcaccgccatcaaa

SEQ ID NO: 24759 - DNA, 21 bp, Artificial Sequence
  Description of Artificial Sequence: Synthetic oligonucleotide
acgaaggagactcagacgatt

SEQ ID NO: 24760 - DNA, 21 bp, Artificial Sequence
  Description of Artificial Sequence: Synthetic oligonucleotide
ctccaaagaggcacccaaggc

SEQ ID NO: 24761 - DNA, 21 bp, Artificial Sequence
  Description of Artificial Sequence: Synthetic oligonucleotide
ctttctggttcggggagtagt

SEQ ID NO: 24762 - DNA, 21 bp, Artificial Sequence
  Description of Artificial Sequence: Synthetic oligonucleotide
ggcagcagcaacaaaaccctc

SEQ ID NO: 24763 - DNA, 21 bp, Artificial Sequence
  Description of Artificial Sequence: Synthetic oligonucleotide
gacaccgacgccagagcccac

SEQ ID NO: 24764 - DNA, 21 bp, Artificial Sequence
  Description of Artificial Sequence: Synthetic oligonucleotide
agcaaaatcagaagcagcgaa

SEQ ID NO: 24765 - DNA, 21 bp, Artificial Sequence
  Description of Artificial Sequence: Synthetic oligonucleotide
ggcatgaccagcaaacccatc

SEQ ID NO: 24766 - DNA, 21 bp, Artificial Sequence
  Description of Artificial Sequence: Synthetic oligonucleotide
gtcctcagcagcaacaacagc

SEQ ID NO: 24767 - DNA, 21 bp, Artificial Sequence
  Description of Artificial Sequence: Synthetic oligonucleotide
tcggctagtaagggtagtcag

SEQ ID NO: 24768 - DNA, 21 bp, Artificial Sequence
  Description of Artificial Sequence: Synthetic oligonucleotide
aatacgtcgagtaagagtcag

SEQ ID NO: 24769 - DNA, 21 bp, Artificial Sequence
  Description of Artificial Sequence: Synthetic oligonucleotide
agcacccccagcagcaaaacc

SEQ ID NO: 24770 - DNA, 21 bp, Artificial Sequence
  Description of Artificial Sequence: Synthetic oligonucleotide
agcctcggcagcaaaggcacc

SEQ ID NO: 24771 - DNA, 21 bp, Artificial Sequence
  Description of Artificial Sequence: Synthetic oligonucleotide
agcgtcagcagcagcgtcggc

SEQ ID NO: 24772 - DNA, 21 bp, Artificial Sequence
  Description of Artificial Sequence: Synthetic oligonucleotide
gacgtcgccggcaacagactc

SEQ ID NO: 24773 - DNA, 21 bp, Artificial Sequence
  Description of Artificial Sequence: Synthetic oligonucleotide
ggcggcggccaaagcagcttc

SEQ ID NO: 24774 - DNA, 21 bp, Artificial Sequence
  Description of Artificial Sequence: Synthetic oligonucleotide
cataatacgcctccgtcgggg

SEQ ID NO: 24775 - DNA, 21 bp, Artificial Sequence
  Description of Artificial Sequence: Synthetic oligonucleotide
ttgccgaatagttctactact

SEQ ID NO: 24776 - DNA, 21 bp, Artificial Sequence
  Description of Artificial Sequence: Synthetic oligonucleotide
caaggcaccggcaaattcatc

SEQ ID NO: 24777 - DNA, 21 bp, Artificial Sequence
  Description of Artificial Sequence: Synthetic oligonucleotide
gggacgactgctagtcatggt

SEQ ID NO: 24778 - DNA, 21 bp, Artificial Sequence
  Description of Artificial Sequence: Synthetic oligonucleotide
accgtcagcagcaaccccgcc

SEQ ID NO: 24779 - DNA, 21 bp, Artificial Sequence
  Description of Artificial Sequence: Synthetic oligonucleotide
agcagcgacaaagtcagagac

SEQ ID NO: 24780 - DNA, 21 bp, Artificial Sequence
  Description of Artificial Sequence: Synthetic oligonucleotide
atcggcatcggcaccagccac

SEQ ID NO: 24781 - DNA, 21 bp, Artificial Sequence
  Description of Artificial Sequence: Synthetic oligonucleotide
caacccagcagcaccagcgtc

SEQ ID NO: 24782 - DNA, 21 bp, Artificial Sequence
  Description of Artificial Sequence: Synthetic oligonucleotide
gaaagcgccagcggcgtcagc

SEQ ID NO: 24783 - DNA, 21 bp, Artificial Sequence
  Description of Artificial Sequence: Synthetic oligonucleotide
gacatgagcgcccacggcaaa

SEQ ID NO: 24784 - DNA, 21 bp, Artificial Sequence
  Description of Artificial Sequence: Synthetic oligonucleotide
ggcaacggcaacaccatgcaa

SEQ ID NO: 24785 - DNA, 21 bp, Artificial Sequence
  Description of Artificial Sequence: Synthetic oligonucleotide
ggcgaaagcaacaaaatgacc

SEQ ID NO: 24786 - DNA, 21 bp, Artificial Sequence
  Description of Artificial Sequence: Synthetic oligonucleotide
gggtcgacttcggctagggat

SEQ ID NO: 24787 - DNA, 21 bp, Artificial Sequence
  Description of Artificial Sequence: Synthetic oligonucleotide
gtggggctgaagagtgggggg

SEQ ID NO: 24788 - DNA, 21 bp, Artificial Sequence
  Description of Artificial Sequence: Synthetic oligonucleotide
tacggcgacagcgtcgtcaga

SEQ ID NO: 24789 - DNA, 21 bp, Artificial Sequence
  Description of Artificial Sequence: Synthetic oligonucleotide
caaggcagccccagccaccac

SEQ ID NO: 24790 - DNA, 21 bp, Artificial Sequence
  Description of Artificial Sequence: Synthetic oligonucleotide
aaccaagccgcccacagcgcc

SEQ ID NO: 24791 - DNA, 21 bp, Artificial Sequence
  Description of Artificial Sequence: Synthetic oligonucleotide
aaaagcaccggcagcagcgtc

SEQ ID NO: 24792 - DNA, 21 bp, Artificial Sequence
  Description of Artificial Sequence: Synthetic oligonucleotide
aacccccaaagcagcagcagc

SEQ ID NO: 24793 - DNA, 21 bp, Artificial Sequence
  Description of Artificial Sequence: Synthetic oligonucleotide
actccggctcaggattctcgt

SEQ ID NO: 24794 - DNA, 21 bp, Artificial Sequence
  Description of Artificial Sequence: Synthetic oligonucleotide
gataaggctcagcatacgctg

SEQ ID NO: 24795 - DNA, 21 bp, Artificial Sequence
  Description of Artificial Sequence: Synthetic oligonucleotide
ggtaatactcaggctttgggg

SEQ ID NO: 24796 - DNA, 21 bp, Artificial Sequence
  Description of Artificial Sequence: Synthetic oligonucleotide
acttctaatagtccttcgctt

SEQ ID NO: 24797 - DNA, 21 bp, Artificial Sequence
  Description of Artificial Sequence: Synthetic oligonucleotide
agcggcatcggcagcggccaa

SEQ ID NO: 24798 - DNA, 21 bp, Artificial Sequence
  Description of Artificial Sequence: Synthetic oligonucleotide
cttggtactaagaatggtcag

SEQ ID NO: 24799 - DNA, 21 bp, Artificial Sequence
  Description of Artificial Sequence: Synthetic oligonucleotide
tcgacgtctggtactcagcat

SEQ ID NO: 24800 - DNA, 21 bp, Artificial Sequence
  Description of Artificial Sequence: Synthetic oligonucleotide
accaccagcaacagcaacctc

SEQ ID NO: 24801 - DNA, 21 bp, Artificial Sequence
  Description of Artificial Sequence: Synthetic oligonucleotide
acttcgcagcctacgcatgtt

SEQ ID NO: 24802 - DNA, 21 bp, Artificial Sequence
  Description of Artificial Sequence: Synthetic oligonucleotide
cagcaggcttcgggggcgatg

SEQ ID NO: 24803 - DNA, 21 bp, Artificial Sequence
  Description of Artificial Sequence: Synthetic oligonucleotide
cattctaagcctcaggttacg

SEQ ID NO: 24804 - DNA, 21 bp, Artificial Sequence
  Description of Artificial Sequence: Synthetic oligonucleotide
aacggcagcagcagcatcagc

SEQ ID NO: 24805 - DNA, 21 bp, Artificial Sequence
  Description of Artificial Sequence: Synthetic oligonucleotide
acgagtgcgactgctgcggtt

SEQ ID NO: 24806 - DNA, 21 bp, Artificial Sequence
  Description of Artificial Sequence: Synthetic oligonucleotide
acggagtctagtaagttgggg

SEQ ID NO: 24807 - DNA, 21 bp, Artificial Sequence
  Description of Artificial Sequence: Synthetic oligonucleotide
atcagagaaacccccacccac

SEQ ID NO: 24808 - DNA, 21 bp, Artificial Sequence
  Description of Artificial Sequence: Synthetic oligonucleotide
cacggccaaagcagcctcgcc

SEQ ID NO: 24809 - DNA, 21 bp, Artificial Sequence
  Description of Artificial Sequence: Synthetic oligonucleotide
cagtcgacttcgaaggctggt

SEQ ID NO: 24810 - DNA, 21 bp, Artificial Sequence
  Description of Artificial Sequence: Synthetic oligonucleotide
gataatgatcagaagagggcg

SEQ ID NO: 24811 - DNA, 21 bp, Artificial Sequence
  Description of Artificial Sequence: Synthetic oligonucleotide
tcgtcgggtgataagagttct

SEQ ID NO: 24812 - DNA, 21 bp, Artificial Sequence
  Description of Artificial Sequence: Synthetic oligonucleotide
tctgagtcgaaggattatacg

SEQ ID NO: 24813 - DNA, 21 bp, Artificial Sequence
  Description of Artificial Sequence: Synthetic oligonucleotide
agcatcagcgacagaaacaga

SEQ ID NO: 24814 - DNA, 21 bp, Artificial Sequence
  Description of Artificial Sequence: Synthetic oligonucleotide
cacgccagcgccacccccctc

SEQ ID NO: 24815 - DNA, 21 bp, Artificial Sequence
  Description of Artificial Sequence: Synthetic oligonucleotide
gcgtcgcatgggacgaatact

SEQ ID NO: 24816 - DNA, 21 bp, Artificial Sequence
  Description of Artificial Sequence: Synthetic oligonucleotide
ggccaaacccccagcgccaac

SEQ ID NO: 24817 - DNA, 21 bp, Artificial Sequence
  Description of Artificial Sequence: Synthetic oligonucleotide
gttcgtactggtaaggagcag

SEQ ID NO: 24818 - DNA, 21 bp, Artificial Sequence
  Description of Artificial Sequence: Synthetic oligonucleotide
ttgaaggatcgttcgtctacg

SEQ ID NO: 24819 - DNA, 21 bp, Artificial Sequence
  Description of Artificial Sequence: Synthetic oligonucleotide
aacgccagaagccccagcagc

SEQ ID NO: 24820 - DNA, 21 bp, Artificial Sequence
  Description of Artificial Sequence: Synthetic oligonucleotide
aagagtgatggtagtactggt

SEQ ID NO: 24821 - DNA, 21 bp, Artificial Sequence
  Description of Artificial Sequence: Synthetic oligonucleotide
agcaaaaacagcagccccagc

SEQ ID NO: 24822 - DNA, 21 bp, Artificial Sequence
  Description of Artificial Sequence: Synthetic oligonucleotide
caaaccgaaggcaccctcaga

SEQ ID NO: 24823 - DNA, 21 bp, Artificial Sequence
  Description of Artificial Sequence: Synthetic oligonucleotide
cgtacggggactaatccttct

SEQ ID NO: 24824 - DNA, 21 bp, Artificial Sequence
  Description of Artificial Sequence: Synthetic oligonucleotide
gctgggtctaggtctccggct

SEQ ID NO: 24825 - DNA, 21 bp, Artificial Sequence
  Description of Artificial Sequence: Synthetic oligonucleotide
tcgcctcagattgcggagaag

SEQ ID NO: 24826 - DNA, 21 bp, Artificial Sequence
  Description of Artificial Sequence: Synthetic oligonucleotide
aagcagtcgactgcttcgttg

SEQ ID NO: 24827 - DNA, 21 bp, Artificial Sequence
  Description of Artificial Sequence: Synthetic oligonucleotide
agaaccgacggccccgtcaaa

SEQ ID NO: 24828 - DNA, 21 bp, Artificial Sequence
  Description of Artificial Sequence: Synthetic oligonucleotide
cacagcggcagcaaagaaacc

SEQ ID NO: 24829 - DNA, 21 bp, Artificial Sequence
  Description of Artificial Sequence: Synthetic oligonucleotide
cagaccagtcagcatacgtcg

SEQ ID NO: 24830 - DNA, 21 bp, Artificial Sequence
  Description of Artificial Sequence: Synthetic oligonucleotide
gataagggtgctggggcgccg

SEQ ID NO: 24831 - DNA, 21 bp, Artificial Sequence
  Description of Artificial Sequence: Synthetic oligonucleotide
gcccccgacaacaccagcaaa

SEQ ID NO: 24832 - DNA, 21 bp, Artificial Sequence
  Description of Artificial Sequence: Synthetic oligonucleotide
agcaccagcagccccgccacc

SEQ ID NO: 24833 - DNA, 21 bp, Artificial Sequence
  Description of Artificial Sequence: Synthetic oligonucleotide
catggtagtgagcagcctcgg

SEQ ID NO: 24834 - DNA, 21 bp, Artificial Sequence
  Description of Artificial Sequence: Synthetic oligonucleotide
cattctgatgcgaagggtaag

SEQ ID NO: 24835 - DNA, 21 bp, Artificial Sequence
  Description of Artificial Sequence: Synthetic oligonucleotide
ggcgacaccacccccgtcaga

SEQ ID NO: 24836 - DNA, 21 bp, Artificial Sequence
  Description of Artificial Sequence: Synthetic oligonucleotide
gaaggccaaagcagcagaggc

SEQ ID NO: 24837 - DNA, 21 bp, Artificial Sequence
  Description of Artificial Sequence: Synthetic oligonucleotide
gacatggccaaaagcaccaaa

SEQ ID NO: 24838 - DNA, 21 bp, Artificial Sequence
  Description of Artificial Sequence: Synthetic oligonucleotide
gatgggcattctagtagggtt

SEQ ID NO: 24839 - DNA, 21 bp, Artificial Sequence
  Description of Artificial Sequence: Synthetic oligonucleotide
agcaccggcgtcgccaccaaa

SEQ ID NO: 24840 - DNA, 21 bp, Artificial Sequence
  Description of Artificial Sequence: Synthetic oligonucleotide
gttggtgggagtcggtctcag

SEQ ID NO: 24841 - DNA, 21 bp, Artificial Sequence
  Description of Artificial Sequence: Synthetic oligonucleotide
agccaagccagcgcccccaga

SEQ ID NO: 24842 - DNA, 21 bp, Artificial Sequence
  Description of Artificial Sequence: Synthetic oligonucleotide
aacaccggcggcgacctcaga

SEQ ID NO: 24843 - DNA, 21 bp, Artificial Sequence
  Description of Artificial Sequence: Synthetic oligonucleotide
aataaggtttctgcgcctagt

SEQ ID NO: 24844 - DNA, 21 bp, Artificial Sequence
  Description of Artificial Sequence: Synthetic oligonucleotide
aatgcgacggtgactccgcgt

SEQ ID NO: 24845 - DNA, 21 bp, Artificial Sequence
  Description of Artificial Sequence: Synthetic oligonucleotide
acgcaggctggtccgaaggag

SEQ ID NO: 24846 - DNA, 21 bp, Artificial Sequence
  Description of Artificial Sequence: Synthetic oligonucleotide
actaaggagggttcgattgtt

SEQ ID NO: 24847 - DNA, 21 bp, Artificial Sequence
  Description of Artificial Sequence: Synthetic oligonucleotide
actggttcgcctacttctggg

SEQ ID NO: 24848 - DNA, 21 bp, Artificial Sequence
  Description of Artificial Sequence: Synthetic oligonucleotide
agcgaaaccaaaggccacccc

SEQ ID NO: 24849 - DNA, 21 bp, Artificial Sequence
  Description of Artificial Sequence: Synthetic oligonucleotide
agcggccccggcagccaagtc

SEQ ID NO: 24850 - DNA, 21 bp, Artificial Sequence
  Description of Artificial Sequence: Synthetic oligonucleotide
agcgtcaccagcgccacccaa

SEQ ID NO: 24851 - DNA, 21 bp, Artificial Sequence
  Description of Artificial Sequence: Synthetic oligonucleotide
gaaagaaccagcggcagctac

SEQ ID NO: 24852 - DNA, 21 bp, Artificial Sequence
  Description of Artificial Sequence: Synthetic oligonucleotide
gacaccctcaaagacagattc

SEQ ID NO: 24853 - DNA, 21 bp, Artificial Sequence
  Description of Artificial Sequence: Synthetic oligonucleotide
gacagagccggcagccacacc

SEQ ID NO: 24854 - DNA, 21 bp, Artificial Sequence
  Description of Artificial Sequence: Synthetic oligonucleotide
gagcaggggcagaatcgtatt

SEQ ID NO: 24855 - DNA, 21 bp, Artificial Sequence
  Description of Artificial Sequence: Synthetic oligonucleotide
gcgagtggttctactagtact

SEQ ID NO: 24856 - DNA, 21 bp, Artificial Sequence
  Description of Artificial Sequence: Synthetic oligonucleotide
ggccacaccgccgaagtcggc

SEQ ID NO: 24857 - DNA, 21 bp, Artificial Sequence
  Description of Artificial Sequence: Synthetic oligonucleotide
ggtgcgtcggataatccgagg

SEQ ID NO: 24858 - DNA, 21 bp, Artificial Sequence
  Description of Artificial Sequence: Synthetic oligonucleotide
gtttcgacggctaagcttgcg

SEQ ID NO: 24859 - DNA, 21 bp, Artificial Sequence
  Description of Artificial Sequence: Synthetic oligonucleotide
tcgttgaatggggcttcgggt

SEQ ID NO: 24860 - DNA, 21 bp, Artificial Sequence
  Description of Artificial Sequence: Synthetic oligonucleotide
tctagtgagatgggtagtaag

SEQ ID NO: 24861 - DNA, 21 bp, Artificial Sequence
  Description of Artificial Sequence: Synthetic oligonucleotide
tctgatgcgcaggcttcttct

SEQ ID NO: 24862 - DNA, 21 bp, Artificial Sequence
  Description of Artificial Sequence: Synthetic oligonucleotide
tgttcggggtcgtcgcctggt

SEQ ID NO: 24863 - DNA, 21 bp, Artificial Sequence
  Description of Artificial Sequence: Synthetic oligonucleotide
aatcgtggggagaatagtgtg

SEQ ID NO: 24864 - DNA, 21 bp, Artificial Sequence
  Description of Artificial Sequence: Synthetic oligonucleotide
gggggtaagtctaatgcgggt

SEQ ID NO: 24865 - DNA, 21 bp, Artificial Sequence
  Description of Artificial Sequence: Synthetic oligonucleotide
tctaattctactaagtctggg

SEQ ID NO: 24866 - DNA, 21 bp, Artificial Sequence
  Description of Artificial Sequence: Synthetic oligonucleotide
aacaccagcggcagcaaagcc

SEQ ID NO: 24867 - DNA, 21 bp, Artificial Sequence
  Description of Artificial Sequence: Synthetic oligonucleotide
accgtcagccaaacccccatc

SEQ ID NO: 24868 - DNA, 21 bp, Artificial Sequence
  Description of Artificial Sequence: Synthetic oligonucleotide
actggtctgaatggggtgggt

SEQ ID NO: 24869 - DNA, 21 bp, Artificial Sequence
  Description of Artificial Sequence: Synthetic oligonucleotide
agcagccaaggcagcggcagc

SEQ ID NO: 24870 - DNA, 21 bp, Artificial Sequence
  Description of Artificial Sequence: Synthetic oligonucleotide
gatcgtgttaaggatgtgaag

SEQ ID NO: 24871 - DNA, 21 bp, Artificial Sequence
  Description of Artificial Sequence: Synthetic oligonucleotide
gcggagactcgggcggcgtct

SEQ ID NO: 24872 - DNA, 21 bp, Artificial Sequence
  Description of Artificial Sequence: Synthetic oligonucleotide
ggtcatggtcagtctatgcat

SEQ ID NO: 24873 - DNA, 21 bp, Artificial Sequence
  Description of Artificial Sequence: Synthetic oligonucleotide
accagcagcgaaagacccccc

SEQ ID NO: 24874 - DNA, 21 bp, Artificial Sequence
  Description of Artificial Sequence: Synthetic oligonucleotide
ctcagaaccaccaaagaaagc

SEQ ID NO: 24875 - DNA, 21 bp, Artificial Sequence
  Description of Artificial Sequence: Synthetic oligonucleotide
accaccgaaaaaaacatgcac

SEQ ID NO: 24876 - DNA, 21 bp, Artificial Sequence
  Description of Artificial Sequence: Synthetic oligonucleotide
acccccagcacccacgtcacc

SEQ ID NO: 24877 - DNA, 21 bp, Artificial Sequence
  Description of Artificial Sequence: Synthetic oligonucleotide
gggcattcgcctcctggtggt

SEQ ID NO: 24878 - DNA, 21 bp, Artificial Sequence
  Description of Artificial Sequence: Synthetic oligonucleotide
ggggcttctcctgtgaattcg

SEQ ID NO: 24879 - DNA, 21 bp, Artificial Sequence
  Description of Artificial Sequence: Synthetic oligonucleotide
gtccaaggccaaaaaatggaa

SEQ ID NO: 24880 - DNA, 21 bp, Artificial Sequence
  Description of Artificial Sequence: Synthetic oligonucleotide
gttaagaattcttctacgcat

SEQ ID NO: 24881 - DNA, 21 bp, Artificial Sequence
  Description of Artificial Sequence: Synthetic oligonucleotide
catgaggatccgcgtactaag

SEQ ID NO: 24882 - DNA, 21 bp, Artificial Sequence
  Description of Artificial Sequence: Synthetic oligonucleotide
atgaccggcaaaaccaccacc

SEQ ID NO: 24883 - DNA, 21 bp, Artificial Sequence
  Description of Artificial Sequence: Synthetic oligonucleotide
catacggataatgctaagggg

SEQ ID NO: 24884 - DNA, 21 bp, Artificial Sequence
  Description of Artificial Sequence: Synthetic oligonucleotide
gaggggattaatcgtaatact

SEQ ID NO: 24885 - DNA, 21 bp, Artificial Sequence
  Description of Artificial Sequence: Synthetic oligonucleotide
gccggcgacgcccacaaaagc

SEQ ID NO: 24886 - DNA, 21 bp, Artificial Sequence
  Description of Artificial Sequence: Synthetic oligonucleotide
tatggtgataggaataatctg

SEQ ID NO: 24887 - DNA, 21 bp, Artificial Sequence
  Description of Artificial Sequence: Synthetic oligonucleotide
tctgatggttctcatcatggt

SEQ ID NO: 24888 - DNA, 21 bp, Artificial Sequence
  Description of Artificial Sequence: Synthetic oligonucleotide
tcttctgcggcggttcctact

SEQ ID NO: 24889 - DNA, 21 bp, Artificial Sequence
  Description of Artificial Sequence: Synthetic oligonucleotide
ggtcctgcgaattctgcgacg

SEQ ID NO: 24890 - DNA, 21 bp, Artificial Sequence
  Description of Artificial Sequence: Synthetic oligonucleotide
aatggttctcagactggtcag

SEQ ID NO: 24891 - DNA, 21 bp, Artificial Sequence
  Description of Artificial Sequence: Synthetic oligonucleotide
accaaaggcgaaagcatgaac

SEQ ID NO: 24892 - DNA, 21 bp, Artificial Sequence
  Description of Artificial Sequence: Synthetic oligonucleotide
cacaccaccggcagcagagac

SEQ ID NO: 24893 - DNA, 21 bp, Artificial Sequence
  Description of Artificial Sequence: Synthetic oligonucleotide
ctccccagacccgacagcacc

SEQ ID NO: 24894 - DNA, 21 bp, Artificial Sequence
  Description of Artificial Sequence: Synthetic oligonucleotide
ggtaatcttaatgggtcgcct

SEQ ID NO: 24895 - DNA, 21 bp, Artificial Sequence
  Description of Artificial Sequence: Synthetic oligonucleotide
ggtgatcatgatcggaagatg

SEQ ID NO: 24896 - DNA, 21 bp, Artificial Sequence
  Description of Artificial Sequence: Synthetic oligonucleotide
accacccaaagcagcgccctc

SEQ ID NO: 24897 - DNA, 21 bp, Artificial Sequence
  Description of Artificial Sequence: Synthetic oligonucleotide
ctcgcccaaacccaaccccaa

SEQ ID NO: 24898 - DNA, 21 bp, Artificial Sequence
  Description of Artificial Sequence: Synthetic oligonucleotide
ctcgccaccagcagccaaagc

SEQ ID NO: 24899 - DNA, 21 bp, Artificial Sequence
  Description of Artificial Sequence: Synthetic oligonucleotide
accaccacccaacccgtcctc

SEQ ID NO: 24900 - DNA, 21 bp, Artificial Sequence
  Description of Artificial Sequence: Synthetic oligonucleotide
agcggcatccccagcggccac

SEQ ID NO: 24901 - DNA, 21 bp, Artificial Sequence
  Description of Artificial Sequence: Synthetic oligonucleotide
caaagcgccggcagcagacaa

SEQ ID NO: 24902 - DNA, 21 bp, Artificial Sequence
  Description of Artificial Sequence: Synthetic oligonucleotide
gatagggtgggttcgtctgct

SEQ ID NO: 24903 - DNA, 21 bp, Artificial Sequence
  Description of Artificial Sequence: Synthetic oligonucleotide
gccatcggcaaagacaacacc

SEQ ID NO: 24904 - DNA, 21 bp, Artificial Sequence
  Description of Artificial Sequence: Synthetic oligonucleotide
ggcagcgaaaaaaaactcccc

SEQ ID NO: 24905 - DNA, 21 bp, Artificial Sequence
  Description of Artificial Sequence: Synthetic oligonucleotide
gttcagggtggtaataattcg

SEQ ID NO: 24906 - DNA, 21 bp, Artificial Sequence
  Description of Artificial Sequence: Synthetic oligonucleotide
accagcaaagacagcaccacc

SEQ ID NO: 24907 - DNA, 21 bp, Artificial Sequence
  Description of Artificial Sequence: Synthetic oligonucleotide
gctagtgttcctgcttcttcg

SEQ ID NO: 24908 - DNA, 21 bp, Artificial Sequence
  Description of Artificial Sequence: Synthetic oligonucleotide
gagtctgctcgtagtgctcct

SEQ ID NO: 24909 - DNA, 21 bp, Artificial Sequence
  Description of Artificial Sequence: Synthetic oligonucleotide
atgggccaaagcacccccagc

SEQ ID NO: 24910 - DNA, 21 bp, Artificial Sequence
  Description of Artificial Sequence: Synthetic oligonucleotide
gggactgctaagtcgatttcg

SEQ ID NO: 24911 - DNA, 21 bp, Artificial Sequence
  Description of Artificial Sequence: Synthetic oligonucleotide
agccccgacagcaaaatccac

SEQ ID NO: 24912 - DNA, 21 bp, Artificial Sequence
  Description of Artificial Sequence: Synthetic oligonucleotide
cataataatacgacgtcgcag

SEQ ID NO: 24913 - DNA, 21 bp, Artificial Sequence
  Description of Artificial Sequence: Synthetic oligonucleotide
catccgcagacttctccggtt

SEQ ID NO: 24914 - DNA, 21 bp, Artificial Sequence
  Description of Artificial Sequence: Synthetic oligonucleotide
gaaaccaccaaaggcagcgcc

SEQ ID NO: 24915 - DNA, 21 bp, Artificial Sequence
  Description of Artificial Sequence: Synthetic oligonucleotide
gagtctccgcagaaggctagt

SEQ ID NO: 24916 - DNA, 21 bp, Artificial Sequence
  Description of Artificial Sequence: Synthetic oligonucleotide
ggcgacgtcagccaaagaaac

SEQ ID NO: 24917 - DNA, 21 bp, Artificial Sequence
  Description of Artificial Sequence: Synthetic oligonucleotide
catgcgtctactccggctcgt

SEQ ID NO: 24918 - DNA, 21 bp, Artificial Sequence
  Description of Artificial Sequence: Synthetic oligonucleotide
gacagcggcacccacgccgtc

SEQ ID NO: 24919 - DNA, 21 bp, Artificial Sequence
  Description of Artificial Sequence: Synthetic oligonucleotide
gttagtggtacgcctcctgct

SEQ ID NO: 24920 - DNA, 21 bp, Artificial Sequence
  Description of Artificial Sequence: Synthetic oligonucleotide
agcagaggcgaagccgtcagc

SEQ ID NO: 24921 - DNA, 21 bp, Artificial Sequence
  Description of Artificial Sequence: Synthetic oligonucleotide
agcggcgccgaagtcaaacaa

SEQ ID NO: 24922 - DNA, 21 bp, Artificial Sequence
  Description of Artificial Sequence: Synthetic oligonucleotide
agtcagtctggggttaataat

SEQ ID NO: 24923 - DNA, 21 bp, Artificial Sequence
  Description of Artificial Sequence: Synthetic oligonucleotide
atgggcaacaccagcctcagc

SEQ ID NO: 24924 - DNA, 21 bp, Artificial Sequence
  Description of Artificial Sequence: Synthetic oligonucleotide
cgtgagactgcgaagggtgat

SEQ ID NO: 24925 - DNA, 21 bp, Artificial Sequence
  Description of Artificial Sequence: Synthetic oligonucleotide
ctcaacgccagcgcccccccc

SEQ ID NO: 24926 - DNA, 21 bp, Artificial Sequence
  Description of Artificial Sequence: Synthetic oligonucleotide
ctcagaggcaacagcaacggc

SEQ ID NO: 24927 - DNA, 21 bp, Artificial Sequence
  Description of Artificial Sequence: Synthetic oligonucleotide
gaaagaaccgccgaagtcaaa

SEQ ID NO: 24928 - DNA, 21 bp, Artificial Sequence
  Description of Artificial Sequence: Synthetic oligonucleotide
agcagcaacagaagcaacgcc

SEQ ID NO: 24929 - DNA, 21 bp, Artificial Sequence
  Description of Artificial Sequence: Synthetic oligonucleotide
agcagcgtccccagccccaaa

SEQ ID NO: 24930 - DNA, 21 bp, Artificial Sequence
  Description of Artificial Sequence: Synthetic oligonucleotide
ctcaccgaccaaaaaggcttc

SEQ ID NO: 24931 - DNA, 21 bp, Artificial Sequence
  Description of Artificial Sequence: Synthetic oligonucleotide
caagtcagcgaccccaaaacc

SEQ ID NO: 24932 - DNA, 21 bp, Artificial Sequence
  Description of Artificial Sequence: Synthetic oligonucleotide
ctcaccgtcggcacccacccc

SEQ ID NO: 24933 - DNA, 21 bp, Artificial Sequence
  Description of Artificial Sequence: Synthetic oligonucleotide
gatcgtgataaggctaatacg

SEQ ID NO: 24934 - DNA, 21 bp, Artificial Sequence
  Description of Artificial Sequence: Synthetic oligonucleotide
agtagtggggttgctagtgtt

SEQ ID NO: 24935 - DNA, 21 bp, Artificial Sequence
  Description of Artificial Sequence: Synthetic oligonucleotide
aatactcatggggataagggt

SEQ ID NO: 24936 - DNA, 21 bp, Artificial Sequence
  Description of Artificial Sequence: Synthetic oligonucleotide
accaccctccaaagacccgaa

SEQ ID NO: 24937 - DNA, 21 bp, Artificial Sequence
  Description of Artificial Sequence: Synthetic oligonucleotide
agccaaaacctcgccagcggc

SEQ ID NO: 24938 - DNA, 21 bp, Artificial Sequence
  Description of Artificial Sequence: Synthetic oligonucleotide
agtactggtagtcagaatcag

SEQ ID NO: 24939 - DNA, 21 bp, Artificial Sequence
  Description of Artificial Sequence: Synthetic oligonucleotide
atcgccggcaacgtccccacc

SEQ ID NO: 24940 - DNA, 21 bp, Artificial Sequence
  Description of Artificial Sequence: Synthetic oligonucleotide
atggacagcgcccaaatcaaa

SEQ ID NO: 24941 - DNA, 21 bp, Artificial Sequence
  Description of Artificial Sequence: Synthetic oligonucleotide
gagtcggggggtaagcatccg

SEQ ID NO: 24942 - DNA, 21 bp, Artificial Sequence
  Description of Artificial Sequence: Synthetic oligonucleotide
gctactacgacgcagaatcat

SEQ ID NO: 24943 - DNA, 21 bp, Artificial Sequence
  Description of Artificial Sequence: Synthetic oligonucleotide
ggccccagcagagaaggcacc

SEQ ID NO: 24944 - DNA, 21 bp, Artificial Sequence
  Description of Artificial Sequence: Synthetic oligonucleotide
ggtgggattcctaagaagggt

SEQ ID NO: 24945 - DNA, 21 bp, Artificial Sequence
  Description of Artificial Sequence: Synthetic oligonucleotide
ttgcctgagaggtcggcgagt

SEQ ID NO: 24946 - DNA, 21 bp, Artificial Sequence
  Description of Artificial Sequence: Synthetic oligonucleotide
gacaaagtccccagcggcacc

SEQ ID NO: 24947 - DNA, 21 bp, Artificial Sequence
  Description of Artificial Sequence: Synthetic oligonucleotide
aacagcagcggcacccaaatc

SEQ ID NO: 24948 - DNA, 21 bp, Artificial Sequence
  Description of Artificial Sequence: Synthetic oligonucleotide
aaggtgggttcgaatagtggt

SEQ ID NO: 24949 - DNA, 21 bp, Artificial Sequence
  Description of Artificial Sequence: Synthetic oligonucleotide
aatcggacggatcggtctctg

SEQ ID NO: 24950 - DNA, 21 bp, Artificial Sequence
  Description of Artificial Sequence: Synthetic oligonucleotide
accatggacgccagaagcggc

SEQ ID NO: 24951 - DNA, 21 bp, Artificial Sequence
  Description of Artificial Sequence: Synthetic oligonucleotide
acgacgggggattcgaggtcg

SEQ ID NO: 24952 - DNA, 21 bp, Artificial Sequence
  Description of Artificial Sequence: Synthetic oligonucleotide
ggcagccacggcaccgccacc

SEQ ID NO: 24953 - DNA, 21 bp, Artificial Sequence
  Description of Artificial Sequence: Synthetic oligonucleotide
acgacgaatgagagtcgtgct

SEQ ID NO: 24954 - DNA, 21 bp, Artificial Sequence
  Description of Artificial Sequence: Synthetic oligonucleotide
acgattgataatgttcctaag

SEQ ID NO: 24955 - DNA, 21 bp, Artificial Sequence
  Description of Artificial Sequence: Synthetic oligonucleotide
ctcgtcggcgacaaaggcaac

SEQ ID NO: 24956 - DNA, 21 bp, Artificial Sequence
  Description of Artificial Sequence: Synthetic oligonucleotide
agcaacaccaaagtcgccgtc

SEQ ID NO: 24957 - DNA, 21 bp, Artificial Sequence
  Description of Artificial Sequence: Synthetic oligonucleotide
ctcagcagcagcagcaccctc

SEQ ID NO: 24958 - DNA, 21 bp, Artificial Sequence
  Description of Artificial Sequence: Synthetic oligonucleotide
gtcaaaaccagcagcaacaac

SEQ ID NO: 24959 - DNA, 21 bp, Artificial Sequence
  Description of Artificial Sequence: Synthetic oligonucleotide
catcctattagtcagccgacg

SEQ ID NO: 24960 - DNA, 21 bp, Artificial Sequence
  Description of Artificial Sequence: Synthetic oligonucleotide
gaggcgaatgggcagtcgcgt

SEQ ID NO: 24961 - DNA, 21 bp, Artificial Sequence
  Description of Artificial Sequence: Synthetic oligonucleotide
tctactatgtcgcctacttct

SEQ ID NO: 24962 - DNA, 21 bp, Artificial Sequence
  Description of Artificial Sequence: Synthetic oligonucleotide
actggtcttaattctccggtg

SEQ ID NO: 24963 - DNA, 21 bp, Artificial Sequence
  Description of Artificial Sequence: Synthetic oligonucleotide
gggaataattctcctgttgct

SEQ ID NO: 24964 - DNA, 21 bp, Artificial Sequence
  Description of Artificial Sequence: Synthetic oligonucleotide
aaagaaggcagcagaagcgtc

SEQ ID NO: 24965 - DNA, 21 bp, Artificial Sequence
  Description of Artificial Sequence: Synthetic oligonucleotide
aagcgggagtcttctacgttg

SEQ ID NO: 24966 - DNA, 21 bp, Artificial Sequence
  Description of Artificial Sequence: Synthetic oligonucleotide
aatcagacgtcgtcgaagtct

SEQ ID NO: 24967 - DNA, 21 bp, Artificial Sequence
  Description of Artificial Sequence: Synthetic oligonucleotide
aatgattcgtcgagggtgacg

SEQ ID NO: 24968 - DNA, 21 bp, Artificial Sequence
  Description of Artificial Sequence: Synthetic oligonucleotide
accagaaccgaaaccacccaa

SEQ ID NO: 24969 - DNA, 21 bp, Artificial Sequence
  Description of Artificial Sequence: Synthetic oligonucleotide
accagcaacaccagccccacc

SEQ ID NO: 24970 - DNA, 21 bp, Artificial Sequence
  Description of Artificial Sequence: Synthetic oligonucleotide
agcagaaccagcagcagcggc

SEQ ID NO: 24971 - DNA, 21 bp, Artificial Sequence
  Description of Artificial Sequence: Synthetic oligonucleotide
agccccgacacccacctcaaa

SEQ ID NO: 24972 - DNA, 21 bp, Artificial Sequence
  Description of Artificial Sequence: Synthetic oligonucleotide
agcgaaatccaaagcaaaggc

SEQ ID NO: 24973 - DNA, 21 bp, Artificial Sequence
  Description of Artificial Sequence: Synthetic oligonucleotide
atggattcgaaggggggtcct

SEQ ID NO: 24974 - DNA, 21 bp, Artificial Sequence
  Description of Artificial Sequence: Synthetic oligonucleotide
caaagccacaacggcagcctc

SEQ ID NO: 24975 - DNA, 21 bp, Artificial Sequence
  Description of Artificial Sequence: Synthetic oligonucleotide
caaagcggcagcgacaaagtc

SEQ ID NO: 24976 - DNA, 21 bp, Artificial Sequence
  Description of Artificial Sequence: Synthetic oligonucleotide
caaatgcaagtcagcaaccaa

SEQ ID NO: 24977 - DNA, 21 bp, Artificial Sequence
  Description of Artificial Sequence: Synthetic oligonucleotide
caccaacaaaaaacccccacc

SEQ ID NO: 24978 - DNA, 21 bp, Artificial Sequence
  Description of Artificial Sequence: Synthetic oligonucleotide
cgtgttcagggtaattcgggg

SEQ ID NO: 24979 - DNA, 21 bp, Artificial Sequence
  Description of Artificial Sequence: Synthetic oligonucleotide
cttgctgataatactaggggt

SEQ ID NO: 24980 - DNA, 21 bp, Artificial Sequence
  Description of Artificial Sequence: Synthetic oligonucleotide
gaaagcggcagcaacagcagc

SEQ ID NO: 24981 - DNA, 21 bp, Artificial Sequence
  Description of Artificial Sequence: Synthetic oligonucleotide
gacaaaggcaaagccgccgcc

SEQ ID NO: 24982 - DNA, 21 bp, Artificial Sequence
  Description of Artificial Sequence: Synthetic oligonucleotide
gagttgactaagccgaatgag

SEQ ID NO: 24983 - DNA, 21 bp, Artificial Sequence
  Description of Artificial Sequence: Synthetic oligonucleotide
gccagcgaccaccccagcaga

SEQ ID NO: 24984 - DNA, 21 bp, Artificial Sequence
  Description of Artificial Sequence: Synthetic oligonucleotide
gccagcggccccgccagaagc

SEQ ID NO: 24985 - DNA, 21 bp, Artificial Sequence
  Description of Artificial Sequence: Synthetic oligonucleotide
gctcaggctgagcatagtcag

SEQ ID NO: 24986 - DNA, 21 bp, Artificial Sequence
  Description of Artificial Sequence: Synthetic oligonucleotide
gctgagaagccgggtagtctt

SEQ ID NO: 24987 - DNA, 21 bp, Artificial Sequence
  Description of Artificial Sequence: Synthetic oligonucleotide
ggcagcaccaacgacgccaga

SEQ ID NO: 24988 - DNA, 21 bp, Artificial Sequence
  Description of Artificial Sequence: Synthetic oligonucleotide
gttggtacgagtcatattcag

SEQ ID NO: 24989 - DNA, 21 bp, Artificial Sequence
  Description of Artificial Sequence: Synthetic oligonucleotide
tatgggacgagtaatgttggg

SEQ ID NO: 24990 - DNA, 21 bp, Artificial Sequence
  Description of Artificial Sequence: Synthetic oligonucleotide
gttacgcagtctcctcctctt

SEQ ID NO: 24991 - DNA, 21 bp, Artificial Sequence
  Description of Artificial Sequence: Synthetic oligonucleotide
agcggcagccaacacgtcacc

SEQ ID NO: 24992 - DNA, 21 bp, Artificial Sequence
  Description of Artificial Sequence: Synthetic oligonucleotide
accgccatcagcaaacccgcc

SEQ ID NO: 24993 - DNA, 21 bp, Artificial Sequence
  Description of Artificial Sequence: Synthetic oligonucleotide
gccgccagcgccaaccccctc

SEQ ID NO: 24994 - DNA, 21 bp, Artificial Sequence
  Description of Artificial Sequence: Synthetic oligonucleotide
gcgaatgcttcgccgaatgtt

SEQ ID NO: 24995 - DNA, 21 bp, Artificial Sequence
  Description of Artificial Sequence: Synthetic oligonucleotide
aatgttagtccttcgtctctt

SEQ ID NO: 24996 - DNA, 21 bp, Artificial Sequence
  Description of Artificial Sequence: Synthetic oligonucleotide
agtggtgggagtgcttctgct

SEQ ID NO: 24997 - DNA, 21 bp, Artificial Sequence
  Description of Artificial Sequence: Synthetic oligonucleotide
ctccccctcgcccaaagccaa

SEQ ID NO: 24998 - DNA, 21 bp, Artificial Sequence
  Description of Artificial Sequence: Synthetic oligonucleotide
gaagccagcagcaaccccacc

SEQ ID NO: 24999 - DNA, 21 bp, Artificial Sequence
  Description of Artificial Sequence: Synthetic oligonucleotide
ggcctcggcggcgacatgaaa

SEQ ID NO: 25000 - DNA, 21 bp, Artificial Sequence
  Description of Artificial Sequence: Synthetic oligonucleotide
gggcatcttacgggtgggtct

SEQ ID NO: 25001 - DNA, 21 bp, Artificial Sequence
  Description of Artificial Sequence: Synthetic oligonucleotide
ggtccttctgctaagtcggcg

SEQ ID NO: 25002 - DNA, 21 bp, Artificial Sequence
  Description of Artificial Sequence: Synthetic oligonucleotide
tctcagacgaatactgggact

SEQ ID NO: 25003 - DNA, 21 bp, Artificial Sequence
  Description of Artificial Sequence: Synthetic oligonucleotide
ggtgttagtaaggcgaatgct

SEQ ID NO: 25004 - DNA, 21 bp, Artificial Sequence
  Description of Artificial Sequence: Synthetic oligonucleotide
aaaaccgccccccacaccacc

SEQ ID NO: 25005 - DNA, 21 bp, Artificial Sequence
  Description of Artificial Sequence: Synthetic oligonucleotide
actccttctgatcatgctgtg

SEQ ID NO: 25006 - DNA, 21 bp, Artificial Sequence
  Description of Artificial Sequence: Synthetic oligonucleotide
agtattgcgagtagtggtagt

SEQ ID NO: 25007 - DNA, 21 bp, Artificial Sequence
  Description of Artificial Sequence: Synthetic oligonucleotide
cttggttctagtgctggtggt

SEQ ID NO: 25008 - DNA, 21 bp, Artificial Sequence
  Description of Artificial Sequence: Synthetic oligonucleotide
gacagcagaaacgtcagcggc

SEQ ID NO: 25009 - DNA, 21 bp, Artificial Sequence
  Description of Artificial Sequence: Synthetic oligonucleotide
gatcatcgttctgagaagtct

SEQ ID NO: 25010 - DNA, 21 bp, Artificial Sequence
  Description of Artificial Sequence: Synthetic oligonucleotide
gatgttgataatcagaagaag

SEQ ID NO: 25011 - DNA, 21 bp, Artificial Sequence
  Description of Artificial Sequence: Synthetic oligonucleotide
gccgaaggcaccggcagagtc

SEQ ID NO: 25012 - DNA, 21 bp, Artificial Sequence
  Description of Artificial Sequence: Synthetic oligonucleotide
atgtcgggtcaggatcagaag

SEQ ID NO: 25013 - DNA, 21 bp, Artificial Sequence
  Description of Artificial Sequence: Synthetic oligonucleotide
acgacgaatgggtcgatgact

SEQ ID NO: 25014 - DNA, 21 bp, Artificial Sequence
  Description of Artificial Sequence: Synthetic oligonucleotide
aatgttaagagtggttcgggg

SEQ ID NO: 25015 - DNA, 21 bp, Artificial Sequence
  Description of Artificial Sequence: Synthetic oligonucleotide
gccgccggcgcccacgccagc

SEQ ID NO: 25016 - DNA, 21 bp, Artificial Sequence
  Description of Artificial Sequence: Synthetic oligonucleotide
agtacgaataatagtaatgtt

SEQ ID NO: 25017 - DNA, 21 bp, Artificial Sequence
  Description of Artificial Sequence: Synthetic oligonucleotide
cacacccaaagcagcagcggc

SEQ ID NO: 25018 - DNA, 21 bp, Artificial Sequence
  Description of Artificial Sequence: Synthetic oligonucleotide
gagggtgtggggccgcttcgt

SEQ ID NO: 25019 - DNA, 21 bp, Artificial Sequence
  Description of Artificial Sequence: Synthetic oligonucleotide
gccgccaacggcaccaacggc

SEQ ID NO: 25020 - DNA, 21 bp, Artificial Sequence
  Description of Artificial Sequence: Synthetic oligonucleotide
ggttctgataggacgaggttg

SEQ ID NO: 25021 - DNA, 21 bp, Artificial Sequence
  Description of Artificial Sequence: Synthetic oligonucleotide
aaagccagcggcaacagcagc

SEQ ID NO: 25022 - DNA, 21 bp, Artificial Sequence
  Description of Artificial Sequence: Synthetic oligonucleotide
gaaagacacaaagtcaccgaa

SEQ ID NO: 25023 - DNA, 21 bp, Artificial Sequence
  Description of Artificial Sequence: Synthetic oligonucleotide
gagagtggtcctaatgggtcg

SEQ ID NO: 25024 - DNA, 21 bp, Artificial Sequence
  Description of Artificial Sequence: Synthetic oligonucleotide
aacaccgccacccaaggcacc

SEQ ID NO: 25025 - DNA, 21 bp, Artificial Sequence
  Description of Artificial Sequence: Synthetic oligonucleotide
agcgtcaacggcagcaacgcc

SEQ ID NO: 25026 - DNA, 21 bp, Artificial Sequence
  Description of Artificial Sequence: Synthetic oligonucleotide
gccgccaacgaagccgtcaga

SEQ ID NO: 25027 - DNA, 21 bp, Artificial Sequence
  Description of Artificial Sequence: Synthetic oligonucleotide
caaagcaaccacaaaaacacc

SEQ ID NO: 25028 - DNA, 21 bp, Artificial Sequence
  Description of Artificial Sequence: Synthetic oligonucleotide
agtgctcatactggttcgagt

SEQ ID NO: 25029 - DNA, 21 bp, Artificial Sequence
  Description of Artificial Sequence: Synthetic oligonucleotide
atgggtaattctcagggtatg

SEQ ID NO: 25030 - DNA, 21 bp, Artificial Sequence
  Description of Artificial Sequence: Synthetic oligonucleotide
aacaaagaaaccaaagccacc

SEQ ID NO: 25031 - DNA, 21 bp, Artificial Sequence
  Description of Artificial Sequence: Synthetic oligonucleotide
agccacggcaccagcagcgaa

SEQ ID NO: 25032 - DNA, 21 bp, Artificial Sequence
  Description of Artificial Sequence: Synthetic oligonucleotide
agccacggcagcaccagcgcc

SEQ ID NO: 25033 - DNA, 21 bp, Artificial Sequence
  Description of Artificial Sequence: Synthetic oligonucleotide
agcctcggccaacccagcacc

SEQ ID NO: 25034 - DNA, 21 bp, Artificial Sequence
  Description of Artificial Sequence: Synthetic oligonucleotide
agcgaagccagcgccaacaga

SEQ ID NO: 25035 - DNA, 21 bp, Artificial Sequence
  Description of Artificial Sequence: Synthetic oligonucleotide
atcaacagcgacagaagcgcc

SEQ ID NO: 25036 - DNA, 21 bp, Artificial Sequence
  Description of Artificial Sequence: Synthetic oligonucleotide
caccccaaaagccaaggcgaa

SEQ ID NO: 25037 - DNA, 21 bp, Artificial Sequence
  Description of Artificial Sequence: Synthetic oligonucleotide
gacgaccacacccccagaaaa

SEQ ID NO: 25038 - DNA, 21 bp, Artificial Sequence
  Description of Artificial Sequence: Synthetic oligonucleotide
gatcgggtggtgaagagtgat

SEQ ID NO: 25039 - DNA, 21 bp, Artificial Sequence
  Description of Artificial Sequence: Synthetic oligonucleotide
ggcagagaaagcgccgtcacc

SEQ ID NO: 25040 - DNA, 21 bp, Artificial Sequence
  Description of Artificial Sequence: Synthetic oligonucleotide
ggccccaacagcagcccccaa

SEQ ID NO: 25041 - DNA, 21 bp, Artificial Sequence
  Description of Artificial Sequence: Synthetic oligonucleotide
aacgtcaccaaaagcagcggc

SEQ ID NO: 25042 - DNA, 21 bp, Artificial Sequence
  Description of Artificial Sequence: Synthetic oligonucleotide
gtgcagtcgactaatactaag

SEQ ID NO: 25043 - DNA, 21 bp, Artificial Sequence
  Description of Artificial Sequence: Synthetic oligonucleotide
agcgccagcggcagcaccacc

SEQ ID NO: 25044 - DNA, 21 bp, Artificial Sequence
  Description of Artificial Sequence: Synthetic oligonucleotide
ggcgtcaaagccagcatgggc

SEQ ID NO: 25045 - DNA, 21 bp, Artificial Sequence
  Description of Artificial Sequence: Synthetic oligonucleotide
tctacggttcagaagtctggg

SEQ ID NO: 25046 - DNA, 21 bp, Artificial Sequence
  Description of Artificial Sequence: Synthetic oligonucleotide
ggcaacaaccccagcagcgtc

SEQ ID NO: 25047 - DNA, 21 bp, Artificial Sequence
  Description of Artificial Sequence: Synthetic oligonucleotide
cagaggactagttctcctgag

SEQ ID NO: 25048 - DNA, 21 bp, Artificial Sequence
  Description of Artificial Sequence: Synthetic oligonucleotide
accagcgccaaaagcgacggc

SEQ ID NO: 25049 - DNA, 21 bp, Artificial Sequence
  Description of Artificial Sequence: Synthetic oligonucleotide
agttcggctcctaatgggggt

SEQ ID NO: 25050 - DNA, 21 bp, Artificial Sequence
  Description of Artificial Sequence: Synthetic oligonucleotide
ctcgaaggcagcaacgccaaa

SEQ ID NO: 25051 - DNA, 21 bp, Artificial Sequence
  Description of Artificial Sequence: Synthetic oligonucleotide
ggcttcgaaaaagaaagaggc

SEQ ID NO: 25052 - DNA, 21 bp, Artificial Sequence
  Description of Artificial Sequence: Synthetic oligonucleotide
tctactgggagtgctttgaag

SEQ ID NO: 25053 - DNA, 21 bp, Artificial Sequence
  Description of Artificial Sequence: Synthetic oligonucleotide
aaaagcagcgaaggcaccaac

SEQ ID NO: 25054 - DNA, 21 bp, Artificial Sequence
  Description of Artificial Sequence: Synthetic oligonucleotide
accggcggccccaccaacaga

SEQ ID NO: 25055 - DNA, 21 bp, Artificial Sequence
  Description of Artificial Sequence: Synthetic oligonucleotide
caggcgactacgccgagtcag

SEQ ID NO: 25056 - DNA, 21 bp, Artificial Sequence
  Description of Artificial Sequence: Synthetic oligonucleotide
ctgaatggtgcttcgtctcat

SEQ ID NO: 25057 - DNA, 21 bp, Artificial Sequence
  Description of Artificial Sequence: Synthetic oligonucleotide
gacctcaccgaaaaaagaacc

SEQ ID NO: 25058 - DNA, 21 bp, Artificial Sequence
  Description of Artificial Sequence: Synthetic oligonucleotide
aacaacggcagcagcgtcagc

SEQ ID NO: 25059 - DNA, 21 bp, Artificial Sequence
  Description of Artificial Sequence: Synthetic oligonucleotide
accagccacgcccccaacacc

SEQ ID NO: 25060 - DNA, 21 bp, Artificial Sequence
  Description of Artificial Sequence: Synthetic oligonucleotide
ggcagcgccaaagccgtcgcc

SEQ ID NO: 25061 - DNA, 21 bp, Artificial Sequence
  Description of Artificial Sequence: Synthetic oligonucleotide
agcggcaacaaaccctacacc

SEQ ID NO: 25062 - DNA, 21 bp, Artificial Sequence
  Description of Artificial Sequence: Synthetic oligonucleotide
gataagattgataagcaggtt

SEQ ID NO: 25063 - DNA, 21 bp, Artificial Sequence
  Description of Artificial Sequence: Synthetic oligonucleotide
aatgagaggagtccggtgcat

SEQ ID NO: 25064 - DNA, 21 bp, Artificial Sequence
  Description of Artificial Sequence: Synthetic oligonucleotide
agcaacagcccccaaaaaatg

SEQ ID NO: 25065 - DNA, 21 bp, Artificial Sequence
  Description of Artificial Sequence: Synthetic oligonucleotide
agtgcgatgaatgggactgct

SEQ ID NO: 25066 - DNA, 21 bp, Artificial Sequence
  Description of Artificial Sequence: Synthetic oligonucleotide
ctcgacggccacaaaagcagc

SEQ ID NO: 25067 - DNA, 21 bp, Artificial Sequence
  Description of Artificial Sequence: Synthetic oligonucleotide
ctcgacggccacggccaagcc

SEQ ID NO: 25068 - DNA, 21 bp, Artificial Sequence
  Description of Artificial Sequence: Synthetic oligonucleotide
gagagtcttacgaagtctaat

SEQ ID NO: 25069 - DNA, 21 bp, Artificial Sequence
  Description of Artificial Sequence: Synthetic oligonucleotide
gcgatgagtagtgggggtggg

SEQ ID NO: 25070 - DNA, 21 bp, Artificial Sequence
  Description of Artificial Sequence: Synthetic oligonucleotide
ggcaacgacaaacaaatgggc

SEQ ID NO: 25071 - DNA, 21 bp, Artificial Sequence
  Description of Artificial Sequence: Synthetic oligonucleotide
ggcgccagcaacagcaccaga

SEQ ID NO: 25072 - DNA, 21 bp, Artificial Sequence
  Description of Artificial Sequence: Synthetic oligonucleotide
gggcaggtggcgggtcaggct

SEQ ID NO: 25073 - DNA, 21 bp, Artificial Sequence
  Description of Artificial Sequence: Synthetic oligonucleotide
gggggtacgcagacgccgcct

SEQ ID NO: 25074 - DNA, 21 bp, Artificial Sequence
  Description of Artificial Sequence: Synthetic oligonucleotide
ggtgagacgaattcgaggaat

SEQ ID NO: 25075 - DNA, 21 bp, Artificial Sequence
  Description of Artificial Sequence: Synthetic oligonucleotide
gtcagcacccccagcgccgcc

SEQ ID NO: 25076 - DNA, 21 bp, Artificial Sequence
  Description of Artificial Sequence: Synthetic oligonucleotide
gtcggcggcagcagcgtcgcc

SEQ ID NO: 25077 - DNA, 21 bp, Artificial Sequence
  Description of Artificial Sequence: Synthetic oligonucleotide
tacggcaacagcacccccagc

SEQ ID NO: 25078 - DNA, 21 bp, Artificial Sequence
  Description of Artificial Sequence: Synthetic oligonucleotide
tcggaggcggagaagactaag

SEQ ID NO: 25079 - DNA, 21 bp, Artificial Sequence
  Description of Artificial Sequence: Synthetic oligonucleotide
tgtacggggaattcgaataat

SEQ ID NO: 25080 - DNA, 21 bp, Artificial Sequence
  Description of Artificial Sequence: Synthetic oligonucleotide
gacgccaccacccccagaagc

SEQ ID NO: 25081 - DNA, 21 bp, Artificial Sequence
  Description of Artificial Sequence: Synthetic oligonucleotide
caagtcaaagaccacaccctc

SEQ ID NO: 25082 - DNA, 21 bp, Artificial Sequence
  Description of Artificial Sequence: Synthetic oligonucleotide
attgggtcgcctaatgctcgg

SEQ ID NO: 25083 - DNA, 21 bp, Artificial Sequence
  Description of Artificial Sequence: Synthetic oligonucleotide
cttcaggggtctccgcataat

SEQ ID NO: 25084 - DNA, 21 bp, Artificial Sequence
  Description of Artificial Sequence: Synthetic oligonucleotide
ggggtggcttcttctcagact

SEQ ID NO: 25085 - DNA, 21 bp, Artificial Sequence
  Description of Artificial Sequence: Synthetic oligonucleotide
acggctctgtctgggccgaag

SEQ ID NO: 25086 - DNA, 21 bp, Artificial Sequence
  Description of Artificial Sequence: Synthetic oligonucleotide
agcggcgccaacaccaacagc

SEQ ID NO: 25087 - DNA, 21 bp, Artificial Sequence
  Description of Artificial Sequence: Synthetic oligonucleotide
gatacgaaggagggtgttggg

SEQ ID NO: 25088 - DNA, 21 bp, Artificial Sequence
  Description of Artificial Sequence: Synthetic oligonucleotide
gatactaagaatcatcctgcg

SEQ ID NO: 25089 - DNA, 21 bp, Artificial Sequence
  Description of Artificial Sequence: Synthetic oligonucleotide
atccaaaacgacagaagccaa

SEQ ID NO: 25090 - DNA, 21 bp, Artificial Sequence
  Description of Artificial Sequence: Synthetic oligonucleotide
atggcgtctccggggagtaag

SEQ ID NO: 25091 - DNA, 21 bp, Artificial Sequence
  Description of Artificial Sequence: Synthetic oligonucleotide
cagcgggggcatgatcagtcg

SEQ ID NO: 25092 - DNA, 21 bp, Artificial Sequence
  Description of Artificial Sequence: Synthetic oligonucleotide
gacggcggcagccacatcaga

SEQ ID NO: 25093 - DNA, 21 bp, Artificial Sequence
  Description of Artificial Sequence: Synthetic oligonucleotide
gaggtgactcctcgttcgact

SEQ ID NO: 25094 - DNA, 21 bp, Artificial Sequence
  Description of Artificial Sequence: Synthetic oligonucleotide
ggcaacaaccccggcagcacc

SEQ ID NO: 25095 - DNA, 21 bp, Artificial Sequence
  Description of Artificial Sequence: Synthetic oligonucleotide
tttggtaatagtgctgcgaag

SEQ ID NO: 25096 - DNA, 21 bp, Artificial Sequence
  Description of Artificial Sequence: Synthetic oligonucleotide
agcagcgtcaacggcaacaaa

SEQ ID NO: 25097 - DNA, 21 bp, Artificial Sequence
  Description of Artificial Sequence: Synthetic oligonucleotide
cagagtagtccgagttcgcgt

SEQ ID NO: 25098 - DNA, 21 bp, Artificial Sequence
  Description of Artificial Sequence: Synthetic oligonucleotide
acccaaccccaaaaacaaagc

SEQ ID NO: 25099 - DNA, 21 bp, Artificial Sequence
  Description of Artificial Sequence: Synthetic oligonucleotide
cgggcggataagcctagtctg

SEQ ID NO: 25100 - DNA, 21 bp, Artificial Sequence
  Description of Artificial Sequence: Synthetic oligonucleotide
gcccaacccagccacagccaa

SEQ ID NO: 25101 - DNA, 21 bp, Artificial Sequence
  Description of Artificial Sequence: Synthetic oligonucleotide
cttacggggactcattcggcg

SEQ ID NO: 25102 - DNA, 21 bp, Artificial Sequence
  Description of Artificial Sequence: Synthetic oligonucleotide
gctgcggtttcgactcctgct

SEQ ID NO: 25103 - DNA, 21 bp, Artificial Sequence
  Description of Artificial Sequence: Synthetic oligonucleotide
actgttggtgataatcggtct

SEQ ID NO: 25104 - DNA, 21 bp, Artificial Sequence
  Description of Artificial Sequence: Synthetic oligonucleotide
agcgacagcagcaaagccgcc

SEQ ID NO: 25105 - DNA, 21 bp, Artificial Sequence
  Description of Artificial Sequence: Synthetic oligonucleotide
gaaagaggccacgaaaacggc

SEQ ID NO: 25106 - DNA, 21 bp, Artificial Sequence
  Description of Artificial Sequence: Synthetic oligonucleotide
gacaacgtcggcgtcagcaga

SEQ ID NO: 25107 - DNA, 21 bp, Artificial Sequence
  Description of Artificial Sequence: Synthetic oligonucleotide
ggggaggggcgggttacgact

SEQ ID NO: 25108 - DNA, 21 bp, Artificial Sequence
  Description of Artificial Sequence: Synthetic oligonucleotide
tcgaagaatacgccgacggcg

SEQ ID NO: 25109 - DNA, 21 bp, Artificial Sequence
  Description of Artificial Sequence: Synthetic oligonucleotide
gattcgggtgcgagtaagatg

SEQ ID NO: 25110 - DNA, 21 bp, Artificial Sequence
  Description of Artificial Sequence: Synthetic oligonucleotide
gggcaggctaagacgcttacg

SEQ ID NO: 25111 - DNA, 21 bp, Artificial Sequence
  Description of Artificial Sequence: Synthetic oligonucleotide
gattctggtaatactacgcgt

SEQ ID NO: 25112 - DNA, 21 bp, Artificial Sequence
  Description of Artificial Sequence: Synthetic oligonucleotide
aacctcagcaccaacaaagac

SEQ ID NO: 25113 - DNA, 21 bp, Artificial Sequence
  Description of Artificial Sequence: Synthetic oligonucleotide
aacggcagcagccaagccaac

SEQ ID NO: 25114 - DNA, 21 bp, Artificial Sequence
  Description of Artificial Sequence: Synthetic oligonucleotide
accatgagcgacagacccacc

SEQ ID NO: 25115 - DNA, 21 bp, Artificial Sequence
  Description of Artificial Sequence: Synthetic oligonucleotide
gggaataatccttcggctcgg

SEQ ID NO: 25116 - DNA, 21 bp, Artificial Sequence
  Description of Artificial Sequence: Synthetic oligonucleotide
gttggtaatccgggtgcgggt

SEQ ID NO: 25117 - DNA, 21 bp, Artificial Sequence
  Description of Artificial Sequence: Synthetic oligonucleotide
tatcgggagagtagttctgtt

SEQ ID NO: 25118 - DNA, 21 bp, Artificial Sequence
  Description of Artificial Sequence: Synthetic oligonucleotide
accagcagcggccaaaactgc

SEQ ID NO: 25119 - DNA, 21 bp, Artificial Sequence
  Description of Artificial Sequence: Synthetic oligonucleotide
acccccagccccaacaccaaa

SEQ ID NO: 25120 - DNA, 21 bp, Artificial Sequence
  Description of Artificial Sequence: Synthetic oligonucleotide
actcagaggaagccgacggag

SEQ ID NO: 25121 - DNA, 21 bp, Artificial Sequence
  Description of Artificial Sequence: Synthetic oligonucleotide
agcagcaacagcagccccaga

SEQ ID NO: 25122 - DNA, 21 bp, Artificial Sequence
  Description of Artificial Sequence: Synthetic oligonucleotide
actagtgcggcgacgtataat

SEQ ID NO: 25123 - DNA, 21 bp, Artificial Sequence
  Description of Artificial Sequence: Synthetic oligonucleotide
ttgacggagtctaagcctcgt

SEQ ID NO: 25124 - DNA, 21 bp, Artificial Sequence
  Description of Artificial Sequence: Synthetic oligonucleotide
ggcagcctccccaacggcagc

SEQ ID NO: 25125 - DNA, 21 bp, Artificial Sequence
  Description of Artificial Sequence: Synthetic oligonucleotide
accaccagcgaccccgccaga

SEQ ID NO: 25126 - DNA, 21 bp, Artificial Sequence
  Description of Artificial Sequence: Synthetic oligonucleotide
atccccagcaacagccccagc

SEQ ID NO: 25127 - DNA, 21 bp, Artificial Sequence
  Description of Artificial Sequence: Synthetic oligonucleotide
gtcagcagcggcaccaccatc

SEQ ID NO: 25128 - DNA, 21 bp, Artificial Sequence
  Description of Artificial Sequence: Synthetic oligonucleotide
aataatctgggttcgcagtct

SEQ ID NO: 25129 - DNA, 21 bp, Artificial Sequence
  Description of Artificial Sequence: Synthetic oligonucleotide
agcgacgccagaaaccccacc

SEQ ID NO: 25130 - DNA, 21 bp, Artificial Sequence
  Description of Artificial Sequence: Synthetic oligonucleotide
ctcgacgacagcaaaatcaga

SEQ ID NO: 25131 - DNA, 21 bp, Artificial Sequence
  Description of Artificial Sequence: Synthetic oligonucleotide
gctacgtctaatcaggcttcg

SEQ ID NO: 25132 - DNA, 21 bp, Artificial Sequence
  Description of Artificial Sequence: Synthetic oligonucleotide
gctccttctcagtcggtgaag

SEQ ID NO: 25133 - DNA, 21 bp, Artificial Sequence
  Description of Artificial Sequence: Synthetic oligonucleotide
ggcagagccaacgaccaaagc

SEQ ID NO: 25134 - DNA, 21 bp, Artificial Sequence
  Description of Artificial Sequence: Synthetic oligonucleotide
ggtattgatgctaatcagagg

SEQ ID NO: 25135 - DNA, 21 bp, Artificial Sequence
  Description of Artificial Sequence: Synthetic oligonucleotide
gccaacaccagcaacgccacc

SEQ ID NO: 25136 - DNA, 21 bp, Artificial Sequence
  Description of Artificial Sequence: Synthetic oligonucleotide
gacaccccccccctcaaaaac

SEQ ID NO: 25137 - DNA, 21 bp, Artificial Sequence
  Description of Artificial Sequence: Synthetic oligonucleotide
aaccccggccccgccatgaac

SEQ ID NO: 25138 - DNA, 21 bp, Artificial Sequence
  Description of Artificial Sequence: Synthetic oligonucleotide
accggcaccaacagcctcggc

SEQ ID NO: 25139 - DNA, 21 bp, Artificial Sequence
  Description of Artificial Sequence: Synthetic oligonucleotide
agcgtcggcaccagccccccc

SEQ ID NO: 25140 - DNA, 21 bp, Artificial Sequence
  Description of Artificial Sequence: Synthetic oligonucleotide
aggcatgatgcttctgcgggt

SEQ ID NO: 25141 - DNA, 21 bp, Artificial Sequence
  Description of Artificial Sequence: Synthetic oligonucleotide
accacccaacccacccccagc

SEQ ID NO: 25142 - DNA, 21 bp, Artificial Sequence
  Description of Artificial Sequence: Synthetic oligonucleotide
agcggcatgggcagccccaaa

SEQ ID NO: 25143 - DNA, 21 bp, Artificial Sequence
  Description of Artificial Sequence: Synthetic oligonucleotide
cacgccagcgaacccagaacc

SEQ ID NO: 25144 - DNA, 21 bp, Artificial Sequence
  Description of Artificial Sequence: Synthetic oligonucleotide
gctgggaatgataggcgggtt

SEQ ID NO: 25145 - DNA, 21 bp, Artificial Sequence
  Description of Artificial Sequence: Synthetic oligonucleotide
tctgatgtgaagtcggagaag

SEQ ID NO: 25146 - DNA, 21 bp, Artificial Sequence
  Description of Artificial Sequence: Synthetic oligonucleotide
gagagtagggtttctcaggcg

SEQ ID NO: 25147 - DNA, 21 bp, Artificial Sequence
  Description of Artificial Sequence: Synthetic oligonucleotide
accaccgtcaaccaaagcggc

SEQ ID NO: 25148 - DNA, 21 bp, Artificial Sequence
  Description of Artificial Sequence: Synthetic oligonucleotide
agccacgccgaaagacccagc

SEQ ID NO: 25149 - DNA, 21 bp, Artificial Sequence
  Description of Artificial Sequence: Synthetic oligonucleotide
agcggcgcccaaggcatgcac

SEQ ID NO: 25150 - DNA, 21 bp, Artificial Sequence
  Description of Artificial Sequence: Synthetic oligonucleotide
agtatgtcggttaagacggag

SEQ ID NO: 25151 - DNA, 21 bp, Artificial Sequence
  Description of Artificial Sequence: Synthetic oligonucleotide
caaatcgaaggcagaggcgcc

SEQ ID NO: 25152 - DNA, 21 bp, Artificial Sequence
  Description of Artificial Sequence: Synthetic oligonucleotide
gatcagcagggtcatgagaag

SEQ ID NO: 25153 - DNA, 21 bp, Artificial Sequence
  Description of Artificial Sequence: Synthetic oligonucleotide
ggcagagccaacacccccacc

SEQ ID NO: 25154 - DNA, 21 bp, Artificial Sequence
  Description of Artificial Sequence: Synthetic oligonucleotide
gtcaacagccaaagcgcccaa

SEQ ID NO: 25155 - DNA, 21 bp, Artificial Sequence
  Description of Artificial Sequence: Synthetic oligonucleotide
tgtcctcctggtgagaagtct

SEQ ID NO: 25156 - DNA, 21 bp, Artificial Sequence
  Description of Artificial Sequence: Synthetic oligonucleotide
aatcctagtagtcattctacg

SEQ ID NO: 25157 - DNA, 21 bp, Artificial Sequence
  Description of Artificial Sequence: Synthetic oligonucleotide
agcaacagcgccggcagcctc

SEQ ID NO: 25158 - DNA, 21 bp, Artificial Sequence
  Description of Artificial Sequence: Synthetic oligonucleotide
caaggcagcagagaccccgcc

SEQ ID NO: 25159 - DNA, 21 bp, Artificial Sequence
  Description of Artificial Sequence: Synthetic oligonucleotide
gaaagaggcgacagcgcctac

SEQ ID NO: 25160 - DNA, 21 bp, Artificial Sequence
  Description of Artificial Sequence: Synthetic oligonucleotide
gccaacaccatgaccaccaaa

SEQ ID NO: 25161 - DNA, 21 bp, Artificial Sequence
  Description of Artificial Sequence: Synthetic oligonucleotide
ctcggcaccaacaaagaccaa

SEQ ID NO: 25162 - DNA, 21 bp, Artificial Sequence
  Description of Artificial Sequence: Synthetic oligonucleotide
tctgggcagcctacggttctt

SEQ ID NO: 25163 - DNA, 21 bp, Artificial Sequence
  Description of Artificial Sequence: Synthetic oligonucleotide
accaccgccagcagaggcctc

SEQ ID NO: 25164 - DNA, 21 bp, Artificial Sequence
  Description of Artificial Sequence: Synthetic oligonucleotide
cataatggttctcatactatt

SEQ ID NO: 25165 - DNA, 21 bp, Artificial Sequence
  Description of Artificial Sequence: Synthetic oligonucleotide
gccaacggcgccaccgtcgcc

SEQ ID NO: 25166 - DNA, 21 bp, Artificial Sequence
  Description of Artificial Sequence: Synthetic oligonucleotide
ggcgccaaaaccggcagcgtc

SEQ ID NO: 25167 - DNA, 21 bp, Artificial Sequence
  Description of Artificial Sequence: Synthetic oligonucleotide
tctggtagtacgagtcctcgt

SEQ ID NO: 25168 - DNA, 21 bp, Artificial Sequence
  Description of Artificial Sequence: Synthetic oligonucleotide
gccagccaacccaacggcatc

SEQ ID NO: 25169 - DNA, 21 bp, Artificial Sequence
  Description of Artificial Sequence: Synthetic oligonucleotide
ggtaatacgcgtacgccgcct

SEQ ID NO: 25170 - DNA, 21 bp, Artificial Sequence
  Description of Artificial Sequence: Synthetic oligonucleotide
ggtcataatgggtctaaggtt

SEQ ID NO: 25171 - DNA, 21 bp, Artificial Sequence
  Description of Artificial Sequence: Synthetic oligonucleotide
tatggtgataagtctggggct

SEQ ID NO: 25172 - DNA, 21 bp, Artificial Sequence
  Description of Artificial Sequence: Synthetic oligonucleotide
aatggtcagccttcggctctt

SEQ ID NO: 25173 - DNA, 21 bp, Artificial Sequence
  Description of Artificial Sequence: Synthetic oligonucleotide
aacggcagaagcaccagcagc

SEQ ID NO: 25174 - DNA, 21 bp, Artificial Sequence
  Description of Artificial Sequence: Synthetic oligonucleotide
aacggcagcggcggccccagc

SEQ ID NO: 25175 - DNA, 21 bp, Artificial Sequence
  Description of Artificial Sequence: Synthetic oligonucleotide
aacggccacagcagcacccaa

SEQ ID NO: 25176 - DNA, 21 bp, Artificial Sequence
  Description of Artificial Sequence: Synthetic oligonucleotide
aataatcaggcgagtaataag

SEQ ID NO: 25177 - DNA, 21 bp, Artificial Sequence
  Description of Artificial Sequence: Synthetic oligonucleotide
aataatgataagaatcagcag

SEQ ID NO: 25178 - DNA, 21 bp, Artificial Sequence
  Description of Artificial Sequence: Synthetic oligonucleotide
aatacggcgaggtctagtgcg

SEQ ID NO: 25179 - DNA, 21 bp, Artificial Sequence
  Description of Artificial Sequence: Synthetic oligonucleotide
accggcgccagcaccggcagc

SEQ ID NO: 25180 - DNA, 21 bp, Artificial Sequence
  Description of Artificial Sequence: Synthetic oligonucleotide
accgtcggcgccacccccatc

SEQ ID NO: 25181 - DNA, 21 bp, Artificial Sequence
  Description of Artificial Sequence: Synthetic oligonucleotide
acgaaggcgaagggggatcat

SEQ ID NO: 25182 - DNA, 21 bp, Artificial Sequence
  Description of Artificial Sequence: Synthetic oligonucleotide
actggtactgataagcctggt

SEQ ID NO: 25183 - DNA, 21 bp, Artificial Sequence
  Description of Artificial Sequence: Synthetic oligonucleotide
agcaccagccccgacagcaaa

SEQ ID NO: 25184 - DNA, 21 bp, Artificial Sequence
  Description of Artificial Sequence: Synthetic oligonucleotide
agccaaagcagcggccacctc

SEQ ID NO: 25185 - DNA, 21 bp, Artificial Sequence
  Description of Artificial Sequence: Synthetic oligonucleotide
agcccccaaagcgccatcaaa

SEQ ID NO: 25186 - DNA, 21 bp, Artificial Sequence
  Description of Artificial Sequence: Synthetic oligonucleotide
agcgacagccccaaactcggc

SEQ ID NO: 25187 - DNA, 21 bp, Artificial Sequence
  Description of Artificial Sequence: Synthetic oligonucleotide
agcggcgtcgccaacaccgcc

SEQ ID NO: 25188 - DNA, 21 bp, Artificial Sequence
  Description of Artificial Sequence: Synthetic oligonucleotide
agtggggttagtgctcagaat

SEQ ID NO: 25189 - DNA, 21 bp, Artificial Sequence
  Description of Artificial Sequence: Synthetic oligonucleotide
attcctaataagagtgggggg

SEQ ID NO: 25190 - DNA, 21 bp, Artificial Sequence
  Description of Artificial Sequence: Synthetic oligonucleotide
attgctagggatgcgcagcag

SEQ ID NO: 25191 - DNA, 21 bp, Artificial Sequence
  Description of Artificial Sequence: Synthetic oligonucleotide
caaagagaagaccacagcaaa

SEQ ID NO: 25192 - DNA, 21 bp, Artificial Sequence
  Description of Artificial Sequence: Synthetic oligonucleotide
cacaccgcccaaacccccggc

SEQ ID NO: 25193 - DNA, 21 bp, Artificial Sequence
  Description of Artificial Sequence: Synthetic oligonucleotide
ctcggccacaacaaaagcgcc

SEQ ID NO: 25194 - DNA, 21 bp, Artificial Sequence
  Description of Artificial Sequence: Synthetic oligonucleotide
gaaagcagaagcagcgtcctc

SEQ ID NO: 25195 - DNA, 21 bp, Artificial Sequence
  Description of Artificial Sequence: Synthetic oligonucleotide
gacaaccaacccagcagcaac

SEQ ID NO: 25196 - DNA, 21 bp, Artificial Sequence
  Description of Artificial Sequence: Synthetic oligonucleotide
gaccacagagaaaccagcaaa

SEQ ID NO: 25197 - DNA, 21 bp, Artificial Sequence
  Description of Artificial Sequence: Synthetic oligonucleotide
gaggttccgaagactcctagt

SEQ ID NO: 25198 - DNA, 21 bp, Artificial Sequence
  Description of Artificial Sequence: Synthetic oligonucleotide
gatccgaaggggtcgcagggt

SEQ ID NO: 25199 - DNA, 21 bp, Artificial Sequence
  Description of Artificial Sequence: Synthetic oligonucleotide
gatgggcgggggtcttcgctg

SEQ ID NO: 25200 - DNA, 21 bp, Artificial Sequence
  Description of Artificial Sequence: Synthetic oligonucleotide
gccggccccagagacctccaa

SEQ ID NO: 25201 - DNA, 21 bp, Artificial Sequence
  Description of Artificial Sequence: Synthetic oligonucleotide
gcttctagttcgtctccgggt

SEQ ID NO: 25202 - DNA, 21 bp, Artificial Sequence
  Description of Artificial Sequence: Synthetic oligonucleotide
ggcaacaccggcacccccccc

SEQ ID NO: 25203 - DNA, 21 bp, Artificial Sequence
  Description of Artificial Sequence: Synthetic oligonucleotide
ggcagccaaaaaaccgtcggc

SEQ ID NO: 25204 - DNA, 21 bp, Artificial Sequence
  Description of Artificial Sequence: Synthetic oligonucleotide
ggcgtcagcagccaaccccaa

SEQ ID NO: 25205 - DNA, 21 bp, Artificial Sequence
  Description of Artificial Sequence: Synthetic oligonucleotide
ggtcaggggtcgtctgttgtg

SEQ ID NO: 25206 - DNA, 21 bp, Artificial Sequence
  Description of Artificial Sequence: Synthetic oligonucleotide
gtcaacagcacccccgtcaaa

SEQ ID NO: 25207 - DNA, 21 bp, Artificial Sequence
  Description of Artificial Sequence: Synthetic oligonucleotide
gtcagcaacacccaaggccaa

SEQ ID NO: 25208 - DNA, 21 bp, Artificial Sequence
  Description of Artificial Sequence: Synthetic oligonucleotide
gtcggccaccccaccgccatg

SEQ ID NO: 25209 - DNA, 21 bp, Artificial Sequence
  Description of Artificial Sequence: Synthetic oligonucleotide
tcgatgaatcagtcgtctaag

SEQ ID NO: 25210 - DNA, 21 bp, Artificial Sequence
  Description of Artificial Sequence: Synthetic oligonucleotide
tctactctggctggggttaat

SEQ ID NO: 25211 - DNA, 21 bp, Artificial Sequence
  Description of Artificial Sequence: Synthetic oligonucleotide
tcttcgcaggcggatattcgg

SEQ ID NO: 25212 - DNA, 21 bp, Artificial Sequence
  Description of Artificial Sequence: Synthetic oligonucleotide
aatagtgtggggtcgatgatg

SEQ ID NO: 25213 - DNA, 21 bp, Artificial Sequence
  Description of Artificial Sequence: Synthetic oligonucleotide
agaaccgacagaggcagcggc

SEQ ID NO: 25214 - DNA, 21 bp, Artificial Sequence
  Description of Artificial Sequence: Synthetic oligonucleotide
ctggggggtcagcatcctagt

SEQ ID NO: 25215 - DNA, 21 bp, Artificial Sequence
  Description of Artificial Sequence: Synthetic oligonucleotide
caaggcaacggcagcgtcgtc

SEQ ID NO: 25216 - DNA, 21 bp, Artificial Sequence
  Description of Artificial Sequence: Synthetic oligonucleotide
cacaaagacaccagcaccgcc

SEQ ID NO: 25217 - DNA, 21 bp, Artificial Sequence
  Description of Artificial Sequence: Synthetic oligonucleotide
gacaccgccaaaatcaacgtc

SEQ ID NO: 25218 - DNA, 21 bp, Artificial Sequence
  Description of Artificial Sequence: Synthetic oligonucleotide
gttgctagtcaggctaatgcg

SEQ ID NO: 25219 - DNA, 21 bp, Artificial Sequence
  Description of Artificial Sequence: Synthetic oligonucleotide
gtttcgtcgcagacggttcgg

SEQ ID NO: 25220 - DNA, 21 bp, Artificial Sequence
  Description of Artificial Sequence: Synthetic oligonucleotide
aaccaaaccaaactcggccaa

SEQ ID NO: 25221 - DNA, 21 bp, Artificial Sequence
  Description of Artificial Sequence: Synthetic oligonucleotide
agcgacagcgtcaaagacagc

SEQ ID NO: 25222 - DNA, 21 bp, Artificial Sequence
  Description of Artificial Sequence: Synthetic oligonucleotide
gcgtcggctggtactcatacg

SEQ ID NO: 25223 - DNA, 21 bp, Artificial Sequence
  Description of Artificial Sequence: Synthetic oligonucleotide
ggcgaaaaaaccggcgtcgcc

SEQ ID NO: 25224 - DNA, 21 bp, Artificial Sequence
  Description of Artificial Sequence: Synthetic oligonucleotide
acccaaagcaaagccatggcc

SEQ ID NO: 25225 - DNA, 21 bp, Artificial Sequence
  Description of Artificial Sequence: Synthetic oligonucleotide
agcaacgacaccagaagaacc

SEQ ID NO: 25226 - DNA, 21 bp, Artificial Sequence
  Description of Artificial Sequence: Synthetic oligonucleotide
atgggcagcagagaagtcatg

SEQ ID NO: 25227 - DNA, 21 bp, Artificial Sequence
  Description of Artificial Sequence: Synthetic oligonucleotide
cattcgagtgggactttgagt

SEQ ID NO: 25228 - DNA, 21 bp, Artificial Sequence
  Description of Artificial Sequence: Synthetic oligonucleotide
ctccaaggcagcaacgccagc

SEQ ID NO: 25229 - DNA, 21 bp, Artificial Sequence
  Description of Artificial Sequence: Synthetic oligonucleotide
gaccccggcaacagcctcaga

SEQ ID NO: 25230 - DNA, 21 bp, Artificial Sequence
  Description of Artificial Sequence: Synthetic oligonucleotide
gacgtccaaaccccccccaga

SEQ ID NO: 25231 - DNA, 21 bp, Artificial Sequence
  Description of Artificial Sequence: Synthetic oligonucleotide
gagcgtatgaatactcagggt

SEQ ID NO: 25232 - DNA, 21 bp, Artificial Sequence
  Description of Artificial Sequence: Synthetic oligonucleotide
gatgggggtgaggcgcagagg

SEQ ID NO: 25233 - DNA, 21 bp, Artificial Sequence
  Description of Artificial Sequence: Synthetic oligonucleotide
ggtacgaatgattctcgtgtt

SEQ ID NO: 25234 - DNA, 21 bp, Artificial Sequence
  Description of Artificial Sequence: Synthetic oligonucleotide
gaaagcctcagcaccagcaga

SEQ ID NO: 25235 - DNA, 21 bp, Artificial Sequence
  Description of Artificial Sequence: Synthetic oligonucleotide
actacgaggacgcctacggct

SEQ ID NO: 25236 - DNA, 21 bp, Artificial Sequence
  Description of Artificial Sequence: Synthetic oligonucleotide
gggggggataagcctacgtcg

SEQ ID NO: 25237 - DNA, 21 bp, Artificial Sequence
  Description of Artificial Sequence: Synthetic oligonucleotide
aaggagctgtctggtactact

SEQ ID NO: 25238 - DNA, 21 bp, Artificial Sequence
  Description of Artificial Sequence: Synthetic oligonucleotide
accaacagcggccaccccccc

SEQ ID NO: 25239 - DNA, 21 bp, Artificial Sequence
  Description of Artificial Sequence: Synthetic oligonucleotide
actgagcagtcgcggtctgtg

SEQ ID NO: 25240 - DNA, 21 bp, Artificial Sequence
  Description of Artificial Sequence: Synthetic oligonucleotide
agcagcgacggcggcaacaga

SEQ ID NO: 25241 - DNA, 21 bp, Artificial Sequence
  Description of Artificial Sequence: Synthetic oligonucleotide
gaactccccaaaaccggcaga

SEQ ID NO: 25242 - DNA, 21 bp, Artificial Sequence
  Description of Artificial Sequence: Synthetic oligonucleotide
ggcgacaccacccccagaggc

SEQ ID NO: 25243 - DNA, 21 bp, Artificial Sequence
  Description of Artificial Sequence: Synthetic oligonucleotide
gtcaccagcgacaaagccgcc

SEQ ID NO: 25244 - DNA, 21 bp, Artificial Sequence
  Description of Artificial Sequence: Synthetic oligonucleotide
gtgggttctacggcgaatgag

SEQ ID NO: 25245 - DNA, 21 bp, Artificial Sequence
  Description of Artificial Sequence: Synthetic oligonucleotide
tctcttaattcgactgggggg

SEQ ID NO: 25246 - DNA, 21 bp, Artificial Sequence
  Description of Artificial Sequence: Synthetic oligonucleotide
tcttcgggtgggtcgatgcgg

SEQ ID NO: 25247 - DNA, 21 bp, Artificial Sequence
  Description of Artificial Sequence: Synthetic oligonucleotide
tttgttgaggatcggacgaag

SEQ ID NO: 25248 - DNA, 21 bp, Artificial Sequence
  Description of Artificial Sequence: Synthetic oligonucleotide
aacgacgccagacccggcatc

SEQ ID NO: 25249 - DNA, 21 bp, Artificial Sequence
  Description of Artificial Sequence: Synthetic oligonucleotide
ggcgcccccaccgccgccacc

SEQ ID NO: 25250 - DNA, 21 bp, Artificial Sequence
  Description of Artificial Sequence: Synthetic oligonucleotide
ggtattggtgagcgtcgtggt

SEQ ID NO: 25251 - DNA, 21 bp, Artificial Sequence
  Description of Artificial Sequence: Synthetic oligonucleotide
aatccgagtactaatagtccg

SEQ ID NO: 25252 - DNA, 21 bp, Artificial Sequence
  Description of Artificial Sequence: Synthetic oligonucleotide
acccacgccggcagcagaggc

SEQ ID NO: 25253 - DNA, 21 bp, Artificial Sequence
  Description of Artificial Sequence: Synthetic oligonucleotide
acgttggataatactaatcgt

SEQ ID NO: 25254 - DNA, 21 bp, Artificial Sequence
  Description of Artificial Sequence: Synthetic oligonucleotide
cgtagtgatacgaaccagggg

SEQ ID NO: 25255 - DNA, 21 bp, Artificial Sequence
  Description of Artificial Sequence: Synthetic oligonucleotide
gctttgaagtcgggtaatgcg

SEQ ID NO: 25256 - DNA, 21 bp, Artificial Sequence
  Description of Artificial Sequence: Synthetic oligonucleotide
aatgctgggcagcgttcgtcg

SEQ ID NO: 25257 - DNA, 21 bp, Artificial Sequence
  Description of Artificial Sequence: Synthetic oligonucleotide
catccggggcctacgcagggg

SEQ ID NO: 25258 - DNA, 21 bp, Artificial Sequence
  Description of Artificial Sequence: Synthetic oligonucleotide
tcgcgtactgcttcgacggag

SEQ ID NO: 25259 - DNA, 21 bp, Artificial Sequence
  Description of Artificial Sequence: Synthetic oligonucleotide
acccccggcagcaccgtcctc

SEQ ID NO: 25260 - DNA, 21 bp, Artificial Sequence
  Description of Artificial Sequence: Synthetic oligonucleotide
aatttggggcagtcgaataag

SEQ ID NO: 25261 - DNA, 21 bp, Artificial Sequence
  Description of Artificial Sequence: Synthetic oligonucleotide
accgccggcaaaaacagcggc

SEQ ID NO: 25262 - DNA, 21 bp, Artificial Sequence
  Description of Artificial Sequence: Synthetic oligonucleotide
agccccggcggcagcgtcagc

SEQ ID NO: 25263 - DNA, 21 bp, Artificial Sequence
  Description of Artificial Sequence: Synthetic oligonucleotide
agcgtcagcgccgccaccaac

SEQ ID NO: 25264 - DNA, 21 bp, Artificial Sequence
  Description of Artificial Sequence: Synthetic oligonucleotide
agcgtcggcggcaacgccctc

SEQ ID NO: 25265 - DNA, 21 bp, Artificial Sequence
  Description of Artificial Sequence: Synthetic oligonucleotide
atggctaatactgcggttgcg

SEQ ID NO: 25266 - DNA, 21 bp, Artificial Sequence
  Description of Artificial Sequence: Synthetic oligonucleotide
caagaagccggcagcaaagcc

SEQ ID NO: 25267 - DNA, 21 bp, Artificial Sequence
  Description of Artificial Sequence: Synthetic oligonucleotide
cttgtgcagaaggataatagt

SEQ ID NO: 25268 - DNA, 21 bp, Artificial Sequence
  Description of Artificial Sequence: Synthetic oligonucleotide
gatactacgggtaataggaat

SEQ ID NO: 25269 - DNA, 21 bp, Artificial Sequence
  Description of Artificial Sequence: Synthetic oligonucleotide
gggacggaggggactcatagg

SEQ ID NO: 25270 - DNA, 21 bp, Artificial Sequence
  Description of Artificial Sequence: Synthetic oligonucleotide
ggtacggtgtcgagtggtggt

SEQ ID NO: 25271 - DNA, 21 bp, Artificial Sequence
  Description of Artificial Sequence: Synthetic oligonucleotide
gtggagggtaataagggttat

SEQ ID NO: 25272 - DNA, 21 bp, Artificial Sequence
  Description of Artificial Sequence: Synthetic oligonucleotide
ttgatgacttcttcgccggcg

SEQ ID NO: 25273 - DNA, 21 bp, Artificial Sequence
  Description of Artificial Sequence: Synthetic oligonucleotide
gagaagtctactccgtcgtct

SEQ ID NO: 25274 - DNA, 21 bp, Artificial Sequence
  Description of Artificial Sequence: Synthetic oligonucleotide
gccgacgccagcagagccagc

SEQ ID NO: 25275 - DNA, 21 bp, Artificial Sequence
  Description of Artificial Sequence: Synthetic oligonucleotide
gctgggacttcgccttctgtt

SEQ ID NO: 25276 - DNA, 21 bp, Artificial Sequence
  Description of Artificial Sequence: Synthetic oligonucleotide
accaaagaaggcgccggcgcc

SEQ ID NO: 25277 - DNA, 21 bp, Artificial Sequence
  Description of Artificial Sequence: Synthetic oligonucleotide
agcagcggccaacccagccac

SEQ ID NO: 25278 - DNA, 21 bp, Artificial Sequence
  Description of Artificial Sequence: Synthetic oligonucleotide
agtgggagtcctagggatggg

SEQ ID NO: 25279 - DNA, 21 bp, Artificial Sequence
  Description of Artificial Sequence: Synthetic oligonucleotide
cagcagaaggctactgtggag

SEQ ID NO: 25280 - DNA, 21 bp, Artificial Sequence
  Description of Artificial Sequence: Synthetic oligonucleotide
gaccaccccagcagagacaaa

SEQ ID NO: 25281 - DNA, 21 bp, Artificial Sequence
  Description of Artificial Sequence: Synthetic oligonucleotide
gacgcccccggcaaagtcacc

SEQ ID NO: 25282 - DNA, 21 bp, Artificial Sequence
  Description of Artificial Sequence: Synthetic oligonucleotide
gactacggcgaacccaaaagc

SEQ ID NO: 25283 - DNA, 21 bp, Artificial Sequence
  Description of Artificial Sequence: Synthetic oligonucleotide
gatcagagtagtaagcagcat

SEQ ID NO: 25284 - DNA, 21 bp, Artificial Sequence
  Description of Artificial Sequence: Synthetic oligonucleotide
gtggagggtaatcctccgaag

SEQ ID NO: 25285 - DNA, 21 bp, Artificial Sequence
  Description of Artificial Sequence: Synthetic oligonucleotide
ttcaccggcggcaccggcagc

SEQ ID NO: 25286 - DNA, 21 bp, Artificial Sequence
  Description of Artificial Sequence: Synthetic oligonucleotide
ttggggcatcctaagaattcg

SEQ ID NO: 25287 - DNA, 21 bp, Artificial Sequence
  Description of Artificial Sequence: Synthetic oligonucleotide
aagactggtacgagttcgaat

SEQ ID NO: 25288 - DNA, 21 bp, Artificial Sequence
  Description of Artificial Sequence: Synthetic oligonucleotide
tctcagtcgaatgcggctact

SEQ ID NO: 25289 - DNA, 21 bp, Artificial Sequence
  Description of Artificial Sequence: Synthetic oligonucleotide
accgccaccaaagaaaacatc

SEQ ID NO: 25290 - DNA, 21 bp, Artificial Sequence
  Description of Artificial Sequence: Synthetic oligonucleotide
agcggcctcaaacccctcaac

SEQ ID NO: 25291 - DNA, 21 bp, Artificial Sequence
  Description of Artificial Sequence: Synthetic oligonucleotide
gaggctgttaagccggctacg

SEQ ID NO: 25292 - DNA, 21 bp, Artificial Sequence
  Description of Artificial Sequence: Synthetic oligonucleotide
gatgggcttactaatcatatt

SEQ ID NO: 25293 - DNA, 21 bp, Artificial Sequence
  Description of Artificial Sequence: Synthetic oligonucleotide
gccaacgaaaccagacccccc

SEQ ID NO: 25294 - DNA, 21 bp, Artificial Sequence
  Description of Artificial Sequence: Synthetic oligonucleotide
gggggtggtcagaattcgctg

SEQ ID NO: 25295 - DNA, 21 bp, Artificial Sequence
  Description of Artificial Sequence: Synthetic oligonucleotide
gtccaaagcgaagccagaacc

SEQ ID NO: 25296 - DNA, 21 bp, Artificial Sequence
  Description of Artificial Sequence: Synthetic oligonucleotide
agccacggcagccccagcgtc

SEQ ID NO: 25297 - DNA, 21 bp, Artificial Sequence
  Description of Artificial Sequence: Synthetic oligonucleotide
aacaccgaagccgtcctcaaa

SEQ ID NO: 25298 - DNA, 21 bp, Artificial Sequence
  Description of Artificial Sequence: Synthetic oligonucleotide
accagcggcggcaccgtcccc

SEQ ID NO: 25299 - DNA, 21 bp, Artificial Sequence
  Description of Artificial Sequence: Synthetic oligonucleotide
atggccaccaaaaccagcgtc

SEQ ID NO: 25300 - DNA, 21 bp, Artificial Sequence
  Description of Artificial Sequence: Synthetic oligonucleotide
gccagcggcagcagcgtcctc

SEQ ID NO: 25301 - DNA, 21 bp, Artificial Sequence
  Description of Artificial Sequence: Synthetic oligonucleotide
gcttctaatacgattactaag

SEQ ID NO: 25302 - DNA, 21 bp, Artificial Sequence
  Description of Artificial Sequence: Synthetic oligonucleotide
ggcagcgtcgacatccaaaaa

SEQ ID NO: 25303 - DNA, 21 bp, Artificial Sequence
  Description of Artificial Sequence: Synthetic oligonucleotide
gtgtctactaatcaggttacg

SEQ ID NO: 25304 - DNA, 21 bp, Artificial Sequence
  Description of Artificial Sequence: Synthetic oligonucleotide
aacgccggcgccagcaaaaac

SEQ ID NO: 25305 - DNA, 21 bp, Artificial Sequence
  Description of Artificial Sequence: Synthetic oligonucleotide
accagccacaccaaacccccc

SEQ ID NO: 25306 - DNA, 21 bp, Artificial Sequence
  Description of Artificial Sequence: Synthetic oligonucleotide
agtcctggggatggtcggcgt

SEQ ID NO: 25307 - DNA, 21 bp, Artificial Sequence
  Description of Artificial Sequence: Synthetic oligonucleotide
gctagtgagggtaagtatctg

SEQ ID NO: 25308 - DNA, 21 bp, Artificial Sequence
  Description of Artificial Sequence: Synthetic oligonucleotide
ggcgtcagcaaagacaccaac

SEQ ID NO: 25309 - DNA, 21 bp, Artificial Sequence
  Description of Artificial Sequence: Synthetic oligonucleotide
tcgctgggtggtgggtctggg

SEQ ID NO: 25310 - DNA, 21 bp, Artificial Sequence
  Description of Artificial Sequence: Synthetic oligonucleotide
tcgcttagtggtcagcgggag

SEQ ID NO: 25311 - DNA, 21 bp, Artificial Sequence
  Description of Artificial Sequence: Synthetic oligonucleotide
tctgggactagtaggactgtc

SEQ ID NO: 25312 - DNA, 21 bp, Artificial Sequence
  Description of Artificial Sequence: Synthetic oligonucleotide
ggcagcgccaccgccagcagc

SEQ ID NO: 25313 - DNA, 21 bp, Artificial Sequence
  Description of Artificial Sequence: Synthetic oligonucleotide
gacaccggcacccacagcaac

SEQ ID NO: 25314 - DNA, 21 bp, Artificial Sequence
  Description of Artificial Sequence: Synthetic oligonucleotide
aacaacggcggcgtcaacgcc

SEQ ID NO: 25315 - DNA, 21 bp, Artificial Sequence
  Description of Artificial Sequence: Synthetic oligonucleotide
aacacccccaccacccaaggc

SEQ ID NO: 25316 - DNA, 21 bp, Artificial Sequence
  Description of Artificial Sequence: Synthetic oligonucleotide
cttaatgagactcggccttct

SEQ ID NO: 25317 - DNA, 21 bp, Artificial Sequence
  Description of Artificial Sequence: Synthetic oligonucleotide
gacgcccccaaacaagtcgcc

SEQ ID NO: 25318 - DNA, 21 bp, Artificial Sequence
  Description of Artificial Sequence: Synthetic oligonucleotide
gagggtaggaatgcttcgggt

SEQ ID NO: 25319 - DNA, 21 bp, Artificial Sequence
  Description of Artificial Sequence: Synthetic oligonucleotide
gccggcacccaaaacaaagcc

SEQ ID NO: 25320 - DNA, 21 bp, Artificial Sequence
  Description of Artificial Sequence: Synthetic oligonucleotide
ggcctcggcgcccccggcacc

SEQ ID NO: 25321 - DNA, 21 bp, Artificial Sequence
  Description of Artificial Sequence: Synthetic oligonucleotide
ggttcggcttctaaggatgtt

SEQ ID NO: 25322 - DNA, 21 bp, Artificial Sequence
  Description of Artificial Sequence: Synthetic oligonucleotide
tcgaatagtaagacgctgcag

SEQ ID NO: 25323 - DNA, 21 bp, Artificial Sequence
  Description of Artificial Sequence: Synthetic oligonucleotide
acccaaggcaacggcatccaa

SEQ ID NO: 25324 - DNA, 21 bp, Artificial Sequence
  Description of Artificial Sequence: Synthetic oligonucleotide
aacagagtcaacggcaacacc

SEQ ID NO: 25325 - DNA, 21 bp, Artificial Sequence
  Description of Artificial Sequence: Synthetic oligonucleotide
acggggatgcaggggagtcat

SEQ ID NO: 25326 - DNA, 21 bp, Artificial Sequence
  Description of Artificial Sequence: Synthetic oligonucleotide
actatggattctaagggtcag

SEQ ID NO: 25327 - DNA, 21 bp, Artificial Sequence
  Description of Artificial Sequence: Synthetic oligonucleotide
agcagcagcggcggcatcacc

SEQ ID NO: 25328 - DNA, 21 bp, Artificial Sequence
  Description of Artificial Sequence: Synthetic oligonucleotide
agcgaccaacccagcagaggc

SEQ ID NO: 25329 - DNA, 21 bp, Artificial Sequence
  Description of Artificial Sequence: Synthetic oligonucleotide
agcggcagccccggcatccaa

SEQ ID NO: 25330 - DNA, 21 bp, Artificial Sequence
  Description of Artificial Sequence: Synthetic oligonucleotide
atgggggataagagtctttat

SEQ ID NO: 25331 - DNA, 21 bp, Artificial Sequence
  Description of Artificial Sequence: Synthetic oligonucleotide
caccacagcgaaaaaagagac

SEQ ID NO: 25332 - DNA, 21 bp, Artificial Sequence
  Description of Artificial Sequence: Synthetic oligonucleotide
ctccaaggcagcagccaaccc

SEQ ID NO: 25333 - DNA, 21 bp, Artificial Sequence
  Description of Artificial Sequence: Synthetic oligonucleotide
gaaaacaccagcatccccaaa

SEQ ID NO: 25334 - DNA, 21 bp, Artificial Sequence
  Description of Artificial Sequence: Synthetic oligonucleotide
gaaggcgtcagcaaagccgac

SEQ ID NO: 25335 - DNA, 21 bp, Artificial Sequence
  Description of Artificial Sequence: Synthetic oligonucleotide
gacaaaagcagcagcagagaa

SEQ ID NO: 25336 - DNA, 21 bp, Artificial Sequence
  Description of Artificial Sequence: Synthetic oligonucleotide
gggacttctgctggggggtcg

SEQ ID NO: 25337 - DNA, 21 bp, Artificial Sequence
  Description of Artificial Sequence: Synthetic oligonucleotide
gtcaccagcaaaggcaccaac

SEQ ID NO: 25338 - DNA, 21 bp, Artificial Sequence
  Description of Artificial Sequence: Synthetic oligonucleotide
tgtactgatgggaagagtgct

SEQ ID NO: 25339 - DNA, 21 bp, Artificial Sequence
  Description of Artificial Sequence: Synthetic oligonucleotide
gaagtcaccaacaaaaccctc

SEQ ID NO: 25340 - DNA, 21 bp, Artificial Sequence
  Description of Artificial Sequence: Synthetic oligonucleotide
aattcgcatacggcttctacg

SEQ ID NO: 25341 - DNA, 21 bp, Artificial Sequence
  Description of Artificial Sequence: Synthetic oligonucleotide
ctcaccaccagcaccggcggc

SEQ ID NO: 25342 - DNA, 21 bp, Artificial Sequence
  Description of Artificial Sequence: Synthetic oligonucleotide
gtcgccagcgccaccagcacc

SEQ ID NO: 25343 - DNA, 21 bp, Artificial Sequence
  Description of Artificial Sequence: Synthetic oligonucleotide
accagcaccgccaccagcatc

SEQ ID NO: 25344 - DNA, 21 bp, Artificial Sequence
  Description of Artificial Sequence: Synthetic oligonucleotide
atcagcaccaacaccagccac

SEQ ID NO: 25345 - DNA, 21 bp, Artificial Sequence
  Description of Artificial Sequence: Synthetic oligonucleotide
ggcgaaagcaaccaccacacc

SEQ ID NO: 25346 - DNA, 21 bp, Artificial Sequence
  Description of Artificial Sequence: Synthetic oligonucleotide
gtgcagactcagacggcggct

SEQ ID NO: 25347 - DNA, 21 bp, Artificial Sequence
  Description of Artificial Sequence: Synthetic oligonucleotide
agcaacgccgtcaaaagcagc

SEQ ID NO: 25348 - DNA, 21 bp, Artificial Sequence
  Description of Artificial Sequence: Synthetic oligonucleotide
agcgtcaccacccccagaaac

SEQ ID NO: 25349 - DNA, 21 bp, Artificial Sequence
  Description of Artificial Sequence: Synthetic oligonucleotide
aatggggggtctactctttcg

SEQ ID NO: 25350 - DNA, 21 bp, Artificial Sequence
  Description of Artificial Sequence: Synthetic oligonucleotide
accgccgaaggcgccagaacc

SEQ ID NO: 25351 - DNA, 21 bp, Artificial Sequence
  Description of Artificial Sequence: Synthetic oligonucleotide
atccaagccagcgccaacaaa

SEQ ID NO: 25352 - DNA, 21 bp, Artificial Sequence
  Description of Artificial Sequence: Synthetic oligonucleotide
ggcgccacccacggcagcagc

SEQ ID NO: 25353 - DNA, 21 bp, Artificial Sequence
  Description of Artificial Sequence: Synthetic oligonucleotide
gtcagcagcggcaccctcggc

SEQ ID NO: 25354 - DNA, 21 bp, Artificial Sequence
  Description of Artificial Sequence: Synthetic oligonucleotide
tctattggtgctgctaatgct

SEQ ID NO: 25355 - DNA, 21 bp, Artificial Sequence
  Description of Artificial Sequence: Synthetic oligonucleotide
agtatggctgcgaggccgtct

SEQ ID NO: 25356 - DNA, 21 bp, Artificial Sequence
  Description of Artificial Sequence: Synthetic oligonucleotide
tctgctaattctactccgggt

SEQ ID NO: 25357 - DNA, 21 bp, Artificial Sequence
  Description of Artificial Sequence: Synthetic oligonucleotide
tctgtgtcgtcttctaatatg

SEQ ID NO: 25358 - DNA, 21 bp, Artificial Sequence
  Description of Artificial Sequence: Synthetic oligonucleotide
gttccgtcttcgtctccgacg

SEQ ID NO: 25359 - DNA, 21 bp, Artificial Sequence
  Description of Artificial Sequence: Synthetic oligonucleotide
acgacttcgccgccttcttcg

SEQ ID NO: 25360 - DNA, 21 bp, Artificial Sequence
  Description of Artificial Sequence: Synthetic oligonucleotide
accctcagccccgacgccaaa

SEQ ID NO: 25361 - DNA, 21 bp, Artificial Sequence
  Description of Artificial Sequence: Synthetic oligonucleotide
ggcctccccgccagcaacagc

SEQ ID NO: 25362 - DNA, 21 bp, Artificial Sequence
  Description of Artificial Sequence: Synthetic oligonucleotide
gtcagcgtcaaacccgaaagc

SEQ ID NO: 25363 - DNA, 21 bp, Artificial Sequence
  Description of Artificial Sequence: Synthetic oligonucleotide
gtgaagagtgagtcgcaggct

SEQ ID NO: 25364 - DNA, 21 bp, Artificial Sequence
  Description of Artificial Sequence: Synthetic oligonucleotide
ctcaacagcaccagcctcagc

SEQ ID NO: 25365 - DNA, 21 bp, Artificial Sequence
  Description of Artificial Sequence: Synthetic oligonucleotide
aagcagactcagtctcctacg

SEQ ID NO: 25366 - DNA, 21 bp, Artificial Sequence
  Description of Artificial Sequence: Synthetic oligonucleotide
cacgcccaaagaaccaacgaa

SEQ ID NO: 25367 - DNA, 21 bp, Artificial Sequence
  Description of Artificial Sequence: Synthetic oligonucleotide
ggcaccggcagagaaagaagc

SEQ ID NO: 25368 - DNA, 21 bp, Artificial Sequence
  Description of Artificial Sequence: Synthetic oligonucleotide
gccagcaccagcaccaccagc

SEQ ID NO: 25369 - DNA, 21 bp, Artificial Sequence
  Description of Artificial Sequence: Synthetic oligonucleotide
acgggtcagcgggatgtgact

SEQ ID NO: 25370 - DNA, 21 bp, Artificial Sequence
  Description of Artificial Sequence: Synthetic oligonucleotide
agcggcgtcggcaccgtcgtc

SEQ ID NO: 25371 - DNA, 21 bp, Artificial Sequence
  Description of Artificial Sequence: Synthetic oligonucleotide
catgcggcttctccttcgatt

SEQ ID NO: 25372 - DNA, 21 bp, Artificial Sequence
  Description of Artificial Sequence: Synthetic oligonucleotide
ggcaccggcaccgacagccac

SEQ ID NO: 25373 - DNA, 21 bp, Artificial Sequence
  Description of Artificial Sequence: Synthetic oligonucleotide
gggagtgcgagtagtaatggg

SEQ ID NO: 25374 - DNA, 21 bp, Artificial Sequence
  Description of Artificial Sequence: Synthetic oligonucleotide
agccaaagcagccaaagcgcc

SEQ ID NO: 25375 - DNA, 21 bp, Artificial Sequence
  Description of Artificial Sequence: Synthetic oligonucleotide
agcgaaagcgtcaaaggcagc

SEQ ID NO: 25376 - DNA, 21 bp, Artificial Sequence
  Description of Artificial Sequence: Synthetic oligonucleotide
ctcaacagcagccccacccac

SEQ ID NO: 25377 - DNA, 21 bp, Artificial Sequence
  Description of Artificial Sequence: Synthetic oligonucleotide
gacggcaaagacagaagcccc

SEQ ID NO: 25378 - DNA, 21 bp, Artificial Sequence
  Description of Artificial Sequence: Synthetic oligonucleotide
gcgggtgtgacggagcgttcg

SEQ ID NO: 25379 - DNA, 21 bp, Artificial Sequence
  Description of Artificial Sequence: Synthetic oligonucleotide
ggcaacgccaccacccaagcc

SEQ ID NO: 25380 - DNA, 21 bp, Artificial Sequence
  Description of Artificial Sequence: Synthetic oligonucleotide
gggacggctcgttcgactctg

SEQ ID NO: 25381 - DNA, 21 bp, Artificial Sequence
  Description of Artificial Sequence: Synthetic oligonucleotide
gggtctgataagccgcagaat

SEQ ID NO: 25382 - DNA, 21 bp, Artificial Sequence
  Description of Artificial Sequence: Synthetic oligonucleotide
gtgaagaatgggagttcgaat

SEQ ID NO: 25383 - DNA, 21 bp, Artificial Sequence
  Description of Artificial Sequence: Synthetic oligonucleotide
gtgactgatcgtccgtctgtc

SEQ ID NO: 25384 - DNA, 21 bp, Artificial Sequence
  Description of Artificial Sequence: Synthetic oligonucleotide
agcaccggcagcaaacaagac

SEQ ID NO: 25385 - DNA, 21 bp, Artificial Sequence
  Description of Artificial Sequence: Synthetic oligonucleotide
agccaaagcagcggcgtcaga

SEQ ID NO: 25386 - DNA, 21 bp, Artificial Sequence
  Description of Artificial Sequence: Synthetic oligonucleotide
gggcctggggagaaggtgcag

SEQ ID NO: 25387 - DNA, 21 bp, Artificial Sequence
  Description of Artificial Sequence: Synthetic oligonucleotide
tctcaggatcgtggtagtcag

SEQ ID NO: 25388 - DNA, 21 bp, Artificial Sequence
  Description of Artificial Sequence: Synthetic oligonucleotide
caaagcagcggcaccggcacc

SEQ ID NO: 25389 - DNA, 21 bp, Artificial Sequence
  Description of Artificial Sequence: Synthetic oligonucleotide
ggttctgttgataggtcttct

SEQ ID NO: 25390 - DNA, 21 bp, Artificial Sequence
  Description of Artificial Sequence: Synthetic oligonucleotide
accaccgaccccgccagcaga

SEQ ID NO: 25391 - DNA, 21 bp, Artificial Sequence
  Description of Artificial Sequence: Synthetic oligonucleotide
cttgcgtctactagtccgagt

SEQ ID NO: 25392 - DNA, 21 bp, Artificial Sequence
  Description of Artificial Sequence: Synthetic oligonucleotide
cgtgatggttcgtcgtcgagg

SEQ ID NO: 25393 - DNA, 21 bp, Artificial Sequence
  Description of Artificial Sequence: Synthetic oligonucleotide
gggacgactctgtcggagggt

SEQ ID NO: 25394 - DNA, 21 bp, Artificial Sequence
  Description of Artificial Sequence: Synthetic oligonucleotide
tctgggctgaagggtactaat

SEQ ID NO: 25395 - DNA, 21 bp, Artificial Sequence
  Description of Artificial Sequence: Synthetic oligonucleotide
aaaggcgtcaaacccgaatgc

SEQ ID NO: 25396 - DNA, 21 bp, Artificial Sequence
  Description of Artificial Sequence: Synthetic oligonucleotide
aacggcctcgacaaaagcctc

SEQ ID NO: 25397 - DNA, 21 bp, Artificial Sequence
  Description of Artificial Sequence: Synthetic oligonucleotide
acgggtactcattcgtctgtt

SEQ ID NO: 25398 - DNA, 21 bp, Artificial Sequence
  Description of Artificial Sequence: Synthetic oligonucleotide
agacacgaagaaaaaatgagc

SEQ ID NO: 25399 - DNA, 21 bp, Artificial Sequence
  Description of Artificial Sequence: Synthetic oligonucleotide
agtagggagagtaagggggat

SEQ ID NO: 25400 - DNA, 21 bp, Artificial Sequence
  Description of Artificial Sequence: Synthetic oligonucleotide
atgaacagcaaagaacccagc

SEQ ID NO: 25401 - DNA, 21 bp, Artificial Sequence
  Description of Artificial Sequence: Synthetic oligonucleotide
caggggggttctaatctgaag

SEQ ID NO: 25402 - DNA, 21 bp, Artificial Sequence
  Description of Artificial Sequence: Synthetic oligonucleotide
catactactccggctactgtt

SEQ ID NO: 25403 - DNA, 21 bp, Artificial Sequence
  Description of Artificial Sequence: Synthetic oligonucleotide
catgttagtactccgactagg

SEQ ID NO: 25404 - DNA, 21 bp, Artificial Sequence
  Description of Artificial Sequence: Synthetic oligonucleotide
cgttcggataatccttctacg

SEQ ID NO: 25405 - DNA, 21 bp, Artificial Sequence
  Description of Artificial Sequence: Synthetic oligonucleotide
gatatgcagcagaagccgtgt

SEQ ID NO: 25406 - DNA, 21 bp, Artificial Sequence
  Description of Artificial Sequence: Synthetic oligonucleotide
ggtgattcgccgggtagtact

SEQ ID NO: 25407 - DNA, 21 bp, Artificial Sequence
  Description of Artificial Sequence: Synthetic oligonucleotide
ggtttggctgaggggcagagt

SEQ ID NO: 25408 - DNA, 21 bp, Artificial Sequence
  Description of Artificial Sequence: Synthetic oligonucleotide
gtcaaaaccgccagcaccgcc

SEQ ID NO: 25409 - DNA, 21 bp, Artificial Sequence
  Description of Artificial Sequence: Synthetic oligonucleotide
gtcaacggcaaaagccccgcc

SEQ ID NO: 25410 - DNA, 21 bp, Artificial Sequence
  Description of Artificial Sequence: Synthetic oligonucleotide
tcgaatgcgactgtgtctaag

SEQ ID NO: 25411 - DNA, 21 bp, Artificial Sequence
  Description of Artificial Sequence: Synthetic oligonucleotide
tctaataagagtacgacgagt

SEQ ID NO: 25412 - DNA, 21 bp, Artificial Sequence
  Description of Artificial Sequence: Synthetic oligonucleotide
tctactagtgttgggccggtt

SEQ ID NO: 25413 - DNA, 21 bp, Artificial Sequence
  Description of Artificial Sequence: Synthetic oligonucleotide
tgcggcagcgtcagctgccaa

SEQ ID NO: 25414 - DNA, 21 bp, Artificial Sequence
  Description of Artificial Sequence: Synthetic oligonucleotide
ttgggtacgcagagtatgaag

SEQ ID NO: 25415 - DNA, 21 bp, Artificial Sequence
  Description of Artificial Sequence: Synthetic oligonucleotide
tttcgtggggataagagtgct

SEQ ID NO: 25416 - DNA, 21 bp, Artificial Sequence
  Description of Artificial Sequence: Synthetic oligonucleotide
ttttctaaggagaagtctcag

SEQ ID NO: 25417 - DNA, 21 bp, Artificial Sequence
  Description of Artificial Sequence: Synthetic oligonucleotide
agcccccaacaaagccacaac

SEQ ID NO: 25418 - DNA, 21 bp, Artificial Sequence
  Description of Artificial Sequence: Synthetic oligonucleotide
caccaaaacagcgccagcgtc

SEQ ID NO: 25419 - DNA, 21 bp, Artificial Sequence
  Description of Artificial Sequence: Synthetic oligonucleotide
aacgaaaacagccccagaggc

SEQ ID NO: 25420 - DNA, 21 bp, Artificial Sequence
  Description of Artificial Sequence: Synthetic oligonucleotide
agcgtcaaccccaaagaaggc

SEQ ID NO: 25421 - DNA, 21 bp, Artificial Sequence
  Description of Artificial Sequence: Synthetic oligonucleotide
ctggggtcttcttcggggggt

SEQ ID NO: 25422 - DNA, 21 bp, Artificial Sequence
  Description of Artificial Sequence: Synthetic oligonucleotide
acgcgggcgaatccgggtaat

SEQ ID NO: 25423 - DNA, 21 bp, Artificial Sequence
  Description of Artificial Sequence: Synthetic oligonucleotide
ctgaagaataatggtactggg

SEQ ID NO: 25424 - DNA, 21 bp, Artificial Sequence
  Description of Artificial Sequence: Synthetic oligonucleotide
cttgatgggaagcagcgtgct

SEQ ID NO: 25425 - DNA, 21 bp, Artificial Sequence
  Description of Artificial Sequence: Synthetic oligonucleotide
ctcaccaacggcagcgtcccc

SEQ ID NO: 25426 - DNA, 21 bp, Artificial Sequence
  Description of Artificial Sequence: Synthetic oligonucleotide
agcaccgtcaaccacagcgtc

SEQ ID NO: 25427 - DNA, 21 bp, Artificial Sequence
  Description of Artificial Sequence: Synthetic oligonucleotide
atgagcgccagcaccaacgtc

SEQ ID NO: 25428 - DNA, 21 bp, Artificial Sequence
  Description of Artificial Sequence: Synthetic oligonucleotide
aaccaagccaccggcaccagc

SEQ ID NO: 25429 - DNA, 21 bp, Artificial Sequence
  Description of Artificial Sequence: Synthetic oligonucleotide
ctcaacaccaacagcgtcatc

SEQ ID NO: 25430 - DNA, 21 bp, Artificial Sequence
  Description of Artificial Sequence: Synthetic oligonucleotide
ggcaacggcaacgtcctcaga

SEQ ID NO: 25431 - DNA, 21 bp, Artificial Sequence
  Description of Artificial Sequence: Synthetic oligonucleotide
agtgataagtcgtcggctcat

SEQ ID NO: 25432 - DNA, 21 bp, Artificial Sequence
  Description of Artificial Sequence: Synthetic oligonucleotide
ctgggtacttcgccgggtcat

SEQ ID NO: 25433 - DNA, 21 bp, Artificial Sequence
  Description of Artificial Sequence: Synthetic oligonucleotide
cttcctagtcctcagtcgggg

SEQ ID NO: 25434 - DNA, 21 bp, Artificial Sequence
  Description of Artificial Sequence: Synthetic oligonucleotide
gacggcatgaccaaccacaaa

SEQ ID NO: 25435 - DNA, 21 bp, Artificial Sequence
  Description of Artificial Sequence: Synthetic oligonucleotide
gagtctgatcataagtctggt

SEQ ID NO: 25436 - DNA, 21 bp, Artificial Sequence
  Description of Artificial Sequence: Synthetic oligonucleotide
gccgccgaaaaaagcaacacc

SEQ ID NO: 25437 - DNA, 21 bp, Artificial Sequence
  Description of Artificial Sequence: Synthetic oligonucleotide
ggcaccaaaaccgccagcgcc

SEQ ID NO: 25438 - DNA, 21 bp, Artificial Sequence
  Description of Artificial Sequence: Synthetic oligonucleotide
ggcagcgacggcaccaaactc

SEQ ID NO: 25439 - DNA, 21 bp, Artificial Sequence
  Description of Artificial Sequence: Synthetic oligonucleotide
ggtactcgtacggatccgaat

SEQ ID NO: 25440 - DNA, 21 bp, Artificial Sequence
  Description of Artificial Sequence: Synthetic oligonucleotide
agcggccccggcaccgcccaa

SEQ ID NO: 25441 - DNA, 21 bp, Artificial Sequence
  Description of Artificial Sequence: Synthetic oligonucleotide
agcgtcgaaagcaaccccgcc

SEQ ID NO: 25442 - DNA, 21 bp, Artificial Sequence
  Description of Artificial Sequence: Synthetic oligonucleotide
cacggcggcagcgccgtcagc

SEQ ID NO: 25443 - DNA, 21 bp, Artificial Sequence
  Description of Artificial Sequence: Synthetic oligonucleotide
ctcgacaacaaaagcaccagc

SEQ ID NO: 25444 - DNA, 21 bp, Artificial Sequence
  Description of Artificial Sequence: Synthetic oligonucleotide
ctcggccaaagcaccctcagc

SEQ ID NO: 25445 - DNA, 21 bp, Artificial Sequence
  Description of Artificial Sequence: Synthetic oligonucleotide
gctacgcctgctaaggatggg

SEQ ID NO: 25446 - DNA, 21 bp, Artificial Sequence
  Description of Artificial Sequence: Synthetic oligonucleotide
gctcagggtgattctgttacg

SEQ ID NO: 25447 - DNA, 21 bp, Artificial Sequence
  Description of Artificial Sequence: Synthetic oligonucleotide
gttcagcagggtagtgcgggt

SEQ ID NO: 25448 - DNA, 21 bp, Artificial Sequence
  Description of Artificial Sequence: Synthetic oligonucleotide
tcggggaattctggtctggcg

SEQ ID NO: 25449 - DNA, 21 bp, Artificial Sequence
  Description of Artificial Sequence: Synthetic oligonucleotide
gccaacgccccccccagaaac

SEQ ID NO: 25450 - DNA, 21 bp, Artificial Sequence
  Description of Artificial Sequence: Synthetic oligonucleotide
aatccgtcgactaagagtgat

SEQ ID NO: 25451 - DNA, 21 bp, Artificial Sequence
  Description of Artificial Sequence: Synthetic oligonucleotide
accaacagcaaagaccaaacc

SEQ ID NO: 25452 - DNA, 21 bp, Artificial Sequence
  Description of Artificial Sequence: Synthetic oligonucleotide
accgccgaaggcaccagaatc

SEQ ID NO: 25453 - DNA, 21 bp, Artificial Sequence
  Description of Artificial Sequence: Synthetic oligonucleotide
acgccgcgtgaggctggtggg

SEQ ID NO: 25454 - DNA, 21 bp, Artificial Sequence
  Description of Artificial Sequence: Synthetic oligonucleotide
actcaggatcctcagtttaag

SEQ ID NO: 25455 - DNA, 21 bp, Artificial Sequence
  Description of Artificial Sequence: Synthetic oligonucleotide
actttggggtcgagtactaat

SEQ ID NO: 25456 - DNA, 21 bp, Artificial Sequence
  Description of Artificial Sequence: Synthetic oligonucleotide
attggtagtgggtcgtctccg

SEQ ID NO: 25457 - DNA, 21 bp, Artificial Sequence
  Description of Artificial Sequence: Synthetic oligonucleotide
atttcggggtcggatacgaag

SEQ ID NO: 25458 - DNA, 21 bp, Artificial Sequence
  Description of Artificial Sequence: Synthetic oligonucleotide
caaagcggcaacaacgccgcc

SEQ ID NO: 25459 - DNA, 21 bp, Artificial Sequence
  Description of Artificial Sequence: Synthetic oligonucleotide
cagggtcgttcgcctgctact

SEQ ID NO: 25460 - DNA, 21 bp, Artificial Sequence
  Description of Artificial Sequence: Synthetic oligonucleotide
gatactggggataagcagagt

SEQ ID NO: 25461 - DNA, 21 bp, Artificial Sequence
  Description of Artificial Sequence: Synthetic oligonucleotide
gtcggccaagccagcacccaa

SEQ ID NO: 25462 - DNA, 21 bp, Artificial Sequence
  Description of Artificial Sequence: Synthetic oligonucleotide
agcagcagcagcagcagcagc

SEQ ID NO: 25463 - DNA, 21 bp, Artificial Sequence
  Description of Artificial Sequence: Synthetic oligonucleotide
actagtacgggtgttaatgcg

SEQ ID NO: 25464 - DNA, 21 bp, Artificial Sequence
  Description of Artificial Sequence: Synthetic oligonucleotide
actatgggtactacgcatact

SEQ ID NO: 25465 - DNA, 21 bp, Artificial Sequence
  Description of Artificial Sequence: Synthetic oligonucleotide
accggcgccaccaccgtcagc

SEQ ID NO: 25466 - DNA, 21 bp, Artificial Sequence
  Description of Artificial Sequence: Synthetic oligonucleotide
accaaaaccaccagcaacagc

SEQ ID NO: 25467 - DNA, 21 bp, Artificial Sequence
  Description of Artificial Sequence: Synthetic oligonucleotide
agcagcgacagaggcagaagc

SEQ ID NO: 25468 - DNA, 21 bp, Artificial Sequence
  Description of Artificial Sequence: Synthetic oligonucleotide
agcgaagccagccccagccac

SEQ ID NO: 25469 - protein, 7 aa, Artificial Sequence
  Description of Artificial Sequence: Synthetic peptide
AAQPSLK

SEQ ID NO: 25470 - protein, 7 aa, Artificial Sequence
  Description of Artificial Sequence: Synthetic peptide
GARPVLQ

SEQ ID NO: 25471 - protein, 7 aa, Artificial Sequence
  Description of Artificial Sequence: Synthetic peptide
HMNRKLE

SEQ ID NO: 25472 - protein, 7 aa, Artificial Sequence
  Description of Artificial Sequence: Synthetic peptide
GLSPVLK

SEQ ID NO: 25473 - protein, 7 aa, Artificial Sequence
  Description of Artificial Sequence: Synthetic peptide
SGAGSAG

SEQ ID NO: 25474 - protein, 7 aa, Artificial Sequence
  Description of Artificial Sequence: Synthetic peptide
NNTQKNS

SEQ ID NO: 25475 - protein, 7 aa, Artificial Sequence
  Description of Artificial Sequence: Synthetic peptide
IRTSKMN

SEQ ID NO: 25476 - protein, 7 aa, Artificial Sequence
  Description of Artificial Sequence: Synthetic peptide
PSGETSK

SEQ ID NO: 25477 - protein, 7 aa, Artificial Sequence
  Description of Artificial Sequence: Synthetic peptide
MKNTTVV

SEQ ID NO: 25478 - protein, 7 aa, Artificial Sequence
  Description of Artificial Sequence: Synthetic peptide
SSTSSPY

SEQ ID NO: 25479 - protein, 7 aa, Artificial Sequence
  Description of Artificial Sequence: Synthetic peptide
TGHSLVS

SEQ ID NO: 25480 - protein, 7 aa, Artificial Sequence
  Description of Artificial Sequence: Synthetic peptide
YSDNKTT

SEQ ID NO: 25481 - protein, 7 aa, Artificial Sequence
  Description of Artificial Sequence: Synthetic peptide
VSDGISK

SEQ ID NO: 25482 - protein, 7 aa, Artificial Sequence
  Description of Artificial Sequence: Synthetic peptide
PGSGSNN

SEQ ID NO: 25483 - protein, 7 aa, Artificial Sequence
  Description of Artificial Sequence: Synthetic peptide
NNSKSQI

SEQ ID NO: 25484 - protein, 7 aa, Artificial Sequence
  Description of Artificial Sequence: Synthetic peptide
QFPGTLR

SEQ ID NO: 25485 - protein, 7 aa, Artificial Sequence
  Description of Artificial Sequence: Synthetic peptide
FPSNGRT

SEQ ID NO: 25486 - protein, 7 aa, Artificial Sequence
  Description of Artificial Sequence: Synthetic peptide
GAKESQS

SEQ ID NO: 25487 - protein, 7 aa, Artificial Sequence
  Description of Artificial Sequence: Synthetic peptide
RLSNAYA

SEQ ID NO: 25488 - protein, 7 aa, Artificial Sequence
  Description of Artificial Sequence: Synthetic peptide
SGSNNFL

SEQ ID NO: 25489 - protein, 7 aa, Artificial Sequence
  Description of Artificial Sequence: Synthetic peptide
HGGPGAV

SEQ ID NO: 25490 - protein, 7 aa, Artificial Sequence
  Description of Artificial Sequence: Synthetic peptide
SNSSQQK

SEQ ID NO: 25491 - protein, 7 aa, Artificial Sequence
  Description of Artificial Sequence: Synthetic peptide
LISTAQR

SEQ ID NO: 25492 - protein, 7 aa, Artificial Sequence
  Description of Artificial Sequence: Synthetic peptide
MDGRSTT

SEQ ID NO: 25493 - protein, 7 aa, Artificial Sequence
  Description of Artificial Sequence: Synthetic peptide
TTNTVSR

SEQ ID NO: 25494 - protein, 7 aa, Artificial Sequence
  Description of Artificial Sequence: Synthetic peptide
VPHGATS

SEQ ID NO: 25495 - protein, 7 aa, Artificial Sequence
  Description of Artificial Sequence: Synthetic peptide
PFSEMQK

SEQ ID NO: 25496 - protein, 7 aa, Artificial Sequence
  Description of Artificial Sequence: Synthetic peptide
GGDNKLT

SEQ ID NO: 25497 - protein, 7 aa, Artificial Sequence
  Description of Artificial Sequence: Synthetic peptide
NSHQKPS

SEQ ID NO: 25498 - protein, 7 aa, Artificial Sequence
  Description of Artificial Sequence: Synthetic peptide
MLSGSRN

SEQ ID NO: 25499 - protein, 7 aa, Artificial Sequence
  Description of Artificial Sequence: Synthetic peptide
SSGGNMS

SEQ ID NO: 25500 - protein, 7 aa, Artificial Sequence
  Description of Artificial Sequence: Synthetic peptide
KIASKSE

SEQ ID NO: 25501 - protein, 7 aa, Artificial Sequence
  Description of Artificial Sequence: Synthetic peptide
TASGNLS

SEQ ID NO: 25502 - protein, 7 aa, Artificial Sequence
  Description of Artificial Sequence: Synthetic peptide
TGQQPAT

SEQ ID NO: 25503 - protein, 7 aa, Artificial Sequence
  Description of Artificial Sequence: Synthetic peptide
TASGSNA

SEQ ID NO: 25504 - protein, 7 aa, Artificial Sequence
  Description of Artificial Sequence: Synthetic peptide
HGQTGMI

SEQ ID NO: 25505 - protein, 7 aa, Artificial Sequence
  Description of Artificial Sequence: Synthetic peptide
SASPSIK

SEQ ID NO: 25506 - protein, 7 aa, Artificial Sequence
  Description of Artificial Sequence: Synthetic peptide
VSTGSFT

SEQ ID NO: 25507 - protein, 7 aa, Artificial Sequence
  Description of Artificial Sequence: Synthetic peptide
GSYSNPT

SEQ ID NO: 25508 - protein, 7 aa, Artificial Sequence
  Description of Artificial Sequence: Synthetic peptide
TTYGGNR

SEQ ID NO: 25509 - protein, 7 aa, Artificial Sequence
  Description of Artificial Sequence: Synthetic peptide
LNGTPQS

SEQ ID NO: 25510 - protein, 7 aa, Artificial Sequence
  Description of Artificial Sequence: Synthetic peptide
TNVDKPF

SEQ ID NO: 25511 - protein, 7 aa, Artificial Sequence
  Description of Artificial Sequence: Synthetic peptide
MSSERPG

SEQ ID NO: 25512 - protein, 7 aa, Artificial Sequence
  Description of Artificial Sequence: Synthetic peptide
NGITKSS

SEQ ID NO: 25513 - protein, 7 aa, Artificial Sequence
  Description of Artificial Sequence: Synthetic peptide
NGSGQNK

SEQ ID NO: 25514 - protein, 7 aa, Artificial Sequence
  Description of Artificial Sequence: Synthetic peptide
REDTKMH

SEQ ID NO: 25515 - protein, 7 aa, Artificial Sequence
  Description of Artificial Sequence: Synthetic peptide
VRDERPS

SEQ ID NO: 25516 - protein, 7 aa, Artificial Sequence
  Description of Artificial Sequence: Synthetic peptide
AKTQSVN

SEQ ID NO: 25517 - protein, 7 aa, Artificial Sequence
  Description of Artificial Sequence: Synthetic peptide
LNLKPIN

SEQ ID NO: 25518 - protein, 7 aa, Artificial Sequence
  Description of Artificial Sequence: Synthetic peptide
DPRNSTS

SEQ ID NO: 25519 - protein, 7 aa, Artificial Sequence
  Description of Artificial Sequence: Synthetic peptide
TTGGHAL

SEQ ID NO: 25520 - protein, 7 aa, Artificial Sequence
  Description of Artificial Sequence: Synthetic peptide
NNPKNVV

SEQ ID NO: 25521 - protein, 7 aa, Artificial Sequence
  Description of Artificial Sequence: Synthetic peptide
EPLSKQS

SEQ ID NO: 25522 - protein, 7 aa, Artificial Sequence
  Description of Artificial Sequence: Synthetic peptide
NYNQAGL

SEQ ID NO: 25523 - protein, 7 aa, Artificial Sequence
  Description of Artificial Sequence: Synthetic peptide
SPAYDTR

SEQ ID NO: 25524 - protein, 7 aa, Artificial Sequence
  Description of Artificial Sequence: Synthetic peptide
SPTSPMN

SEQ ID NO: 25525 - protein, 7 aa, Artificial Sequence
  Description of Artificial Sequence: Synthetic peptide
NNRSGMG

SEQ ID NO: 25526 - protein, 7 aa, Artificial Sequence
  Description of Artificial Sequence: Synthetic peptide
GVKTNPL

SEQ ID NO: 25527 - protein, 7 aa, Artificial Sequence
  Description of Artificial Sequence: Synthetic peptide
SGTTTFG

SEQ ID NO: 25528 - protein, 7 aa, Artificial Sequence
  Description of Artificial Sequence: Synthetic peptide
NGSRQNQ

SEQ ID NO: 25529 - protein, 7 aa, Artificial Sequence
  Description of Artificial Sequence: Synthetic peptide
TPHDGQR

SEQ ID NO: 25530 - protein, 7 aa, Artificial Sequence
  Description of Artificial Sequence: Synthetic peptide
SITGNRT

SEQ ID NO: 25531 - protein, 7 aa, Artificial Sequence
  Description of Artificial Sequence: Synthetic peptide
NSASLNH

SEQ ID NO: 25532 - protein, 7 aa, Artificial Sequence
  Description of Artificial Sequence: Synthetic peptide
DIPAKTA

SEQ ID NO: 25533 - protein, 7 aa, Artificial Sequence
  Description of Artificial Sequence: Synthetic peptide
RTGHYQD

SEQ ID NO: 25534 - protein, 7 aa, Artificial Sequence
  Description of Artificial Sequence: Synthetic peptide
NANQNQM

SEQ ID NO: 25535 - protein, 7 aa, Artificial Sequence
  Description of Artificial Sequence: Synthetic peptide
ESATPIR

SEQ ID NO: 25536 - protein, 7 aa, Artificial Sequence
  Description of Artificial Sequence: Synthetic peptide
MPARNVS

SEQ ID NO: 25537 - protein, 7 aa, Artificial Sequence
  Description of Artificial Sequence: Synthetic peptide
PSNKTNS

SEQ ID NO: 25538 - protein, 7 aa, Artificial Sequence
  Description of Artificial Sequence: Synthetic peptide
SASNTSV

SEQ ID NO: 25539 - protein, 7 aa, Artificial Sequence
  Description of Artificial Sequence: Synthetic peptide
NSSHNSP

SEQ ID NO: 25540 - protein, 7 aa, Artificial Sequence
  Description of Artificial Sequence: Synthetic peptide
STATNVY

SEQ ID NO: 25541 - protein, 7 aa, Artificial Sequence
  Description of Artificial Sequence: Synthetic peptide
LNIANSK

SEQ ID NO: 25542 - protein, 7 aa, Artificial Sequence
  Description of Artificial Sequence: Synthetic peptide
HGSKPYI

SEQ ID NO: 25543 - protein, 7 aa, Artificial Sequence
  Description of Artificial Sequence: Synthetic peptide
DKTQKQL

SEQ ID NO: 25544 - protein, 7 aa, Artificial Sequence
  Description of Artificial Sequence: Synthetic peptide
QKTQTTS

SEQ ID NO: 25545 - protein, 7 aa, Artificial Sequence
  Description of Artificial Sequence: Synthetic peptide
TNAKQAI

SEQ ID NO: 25546 - protein, 7 aa, Artificial Sequence
  Description of Artificial Sequence: Synthetic peptide
LHDGQTR

SEQ ID NO: 25547 - protein, 7 aa, Artificial Sequence
  Description of Artificial Sequence: Synthetic peptide
NTQSYTS

SEQ ID NO: 25548 - protein, 7 aa, Artificial Sequence
  Description of Artificial Sequence: Synthetic peptide
QSHSGIS

SEQ ID NO: 25549 - protein, 7 aa, Artificial Sequence
  Description of Artificial Sequence: Synthetic peptide
GLGHSAF

SEQ ID NO: 25550 - protein, 7 aa, Artificial Sequence
  Description of Artificial Sequence: Synthetic peptide
SFSKGSS

SEQ ID NO: 25551 - protein, 7 aa, Artificial Sequence
  Description of Artificial Sequence: Synthetic peptide
GTFSTQS

SEQ ID NO: 25552 - protein, 7 aa, Artificial Sequence
  Description of Artificial Sequence: Synthetic peptide
SDSRNTN

SEQ ID NO: 25553 - protein, 7 aa, Artificial Sequence
  Description of Artificial Sequence: Synthetic peptide
TSNSNIA

SEQ ID NO: 25554 - protein, 7 aa, Artificial Sequence
  Description of Artificial Sequence: Synthetic peptide
MGIANIG

SEQ ID NO: 25555 - protein, 7 aa, Artificial Sequence
  Description of Artificial Sequence: Synthetic peptide
SSLGHND

SEQ ID NO: 25556 - protein, 7 aa, Artificial Sequence
  Description of Artificial Sequence: Synthetic peptide
RALSKGG

SEQ ID NO: 25557 - protein, 7 aa, Artificial Sequence
  Description of Artificial Sequence: Synthetic peptide
KTGDQMG

SEQ ID NO: 25558 - protein, 7 aa, Artificial Sequence
  Description of Artificial Sequence: Synthetic peptide
NMDGATR

SEQ ID NO: 25559 - protein, 7 aa, Artificial Sequence
  Description of Artificial Sequence: Synthetic peptide
ANGTKSS

SEQ ID NO: 25560 - protein, 7 aa, Artificial Sequence
  Description of Artificial Sequence: Synthetic peptide
LILPGNN

SEQ ID NO: 25561 - protein, 7 aa, Artificial Sequence
  Description of Artificial Sequence: Synthetic peptide
HVIAPQQ

SEQ ID NO: 25562 - protein, 7 aa, Artificial Sequence
  Description of Artificial Sequence: Synthetic peptide
NGSGQNL

SEQ ID NO: 25563 - protein, 7 aa, Artificial Sequence
  Description of Artificial Sequence: Synthetic peptide
IRSKESA

SEQ ID NO: 25564 - protein, 7 aa, Artificial Sequence
  Description of Artificial Sequence: Synthetic peptide
QQYAKQA

SEQ ID NO: 25565 - protein, 7 aa, Artificial Sequence
  Description of Artificial Sequence: Synthetic peptide
LGTSPMK

SEQ ID NO: 25566 - protein, 7 aa, Artificial Sequence
  Description of Artificial Sequence: Synthetic peptide
NLSGSRY

SEQ ID NO: 25567 - protein, 7 aa, Artificial Sequence
  Description of Artificial Sequence: Synthetic peptide
NSEARLS

SEQ ID NO: 25568 - protein, 7 aa, Artificial Sequence
  Description of Artificial Sequence: Synthetic peptide
PTGEKRL

SEQ ID NO: 25569 - protein, 7 aa, Artificial Sequence
  Description of Artificial Sequence: Synthetic peptide
DMTHLSN

SEQ ID NO: 25570 - protein, 7 aa, Artificial Sequence
  Description of Artificial Sequence: Synthetic peptide
PSTSGAM

SEQ ID NO: 25571 - protein, 7 aa, Artificial Sequence
  Description of Artificial Sequence: Synthetic peptide
QNVGGIR

SEQ ID NO: 25572 - protein, 7 aa, Artificial Sequence
  Description of Artificial Sequence: Synthetic peptide
SISKTQA

SEQ ID NO: 25573 - protein, 7 aa, Artificial Sequence
  Description of Artificial Sequence: Synthetic peptide
SSSPNVK

SEQ ID NO: 25574 - protein, 7 aa, Artificial Sequence
  Description of Artificial Sequence: Synthetic peptide
LAKNPVI

SEQ ID NO: 25575 - protein, 7 aa, Artificial Sequence
  Description of Artificial Sequence: Synthetic peptide
GQGVTAK

SEQ ID NO: 25576 - protein, 7 aa, Artificial Sequence
  Description of Artificial Sequence: Synthetic peptide
SASRSAY

SEQ ID NO: 25577 - protein, 7 aa, Artificial Sequence
  Description of Artificial Sequence: Synthetic peptide
SYGGQSR

SEQ ID NO: 25578 - protein, 7 aa, Artificial Sequence
  Description of Artificial Sequence: Synthetic peptide
GQSNVTL

SEQ ID NO: 25579 - protein, 7 aa, Artificial Sequence
  Description of Artificial Sequence: Synthetic peptide
TTSHMLK

SEQ ID NO: 25580 - protein, 7 aa, Artificial Sequence
  Description of Artificial Sequence: Synthetic peptide
VQGTGNT

SEQ ID NO: 25581 - protein, 7 aa, Artificial Sequence
  Description of Artificial Sequence: Synthetic peptide
WDSKTPR

SEQ ID NO: 25582 - protein, 7 aa, Artificial Sequence
  Description of Artificial Sequence: Synthetic peptide
LNQHSSI

SEQ ID NO: 25583 - protein, 7 aa, Artificial Sequence
  Description of Artificial Sequence: Synthetic peptide
GVLGSKN

SEQ ID NO: 25584 - protein, 7 aa, Artificial Sequence
  Description of Artificial Sequence: Synthetic peptide
EQGSGNH

SEQ ID NO: 25585 - protein, 7 aa, Artificial Sequence
  Description of Artificial Sequence: Synthetic peptide
CVSNVTN

SEQ ID NO: 25586 - protein, 7 aa, Artificial Sequence
  Description of Artificial Sequence: Synthetic peptide
SKPANNV

SEQ ID NO: 25587 - protein, 7 aa, Artificial Sequence
  Description of Artificial Sequence: Synthetic peptide
GHGNNGA

SEQ ID NO: 25588 - protein, 7 aa, Artificial Sequence
  Description of Artificial Sequence: Synthetic peptide
PAHQKLS

SEQ ID NO: 25589 - protein, 7 aa, Artificial Sequence
  Description of Artificial Sequence: Synthetic peptide
NANSRPV

SEQ ID NO: 25590 - protein, 7 aa, Artificial Sequence
  Description of Artificial Sequence: Synthetic peptide
TATQKGQ

SEQ ID NO: 25591 - protein, 7 aa, Artificial Sequence
  Description of Artificial Sequence: Synthetic peptide
DIMSPLK

SEQ ID NO: 25592 - protein, 7 aa, Artificial Sequence
  Description of Artificial Sequence: Synthetic peptide
FLKGTGS

SEQ ID NO: 25593 - protein, 7 aa, Artificial Sequence
  Description of Artificial Sequence: Synthetic peptide
HANSPAT

SEQ ID NO: 25594 - protein, 7 aa, Artificial Sequence
  Description of Artificial Sequence: Synthetic peptide
GDSKSTW

SEQ ID NO: 25595 - protein, 7 aa, Artificial Sequence
  Description of Artificial Sequence: Synthetic peptide
RVVTNNL

SEQ ID NO: 25596 - protein, 7 aa, Artificial Sequence
  Description of Artificial Sequence: Synthetic peptide
ATNNGSK

SEQ ID NO: 25597 - protein, 7 aa, Artificial Sequence
  Description of Artificial Sequence: Synthetic peptide
HNNSKSA

SEQ ID NO: 25598 - protein, 7 aa, Artificial Sequence
  Description of Artificial Sequence: Synthetic peptide
TQQNGRN

SEQ ID NO: 25599 - protein, 7 aa, Artificial Sequence
  Description of Artificial Sequence: Synthetic peptide
ETTTPRK

SEQ ID NO: 25600 - protein, 7 aa, Artificial Sequence
  Description of Artificial Sequence: Synthetic peptide
NAGPNYD

SEQ ID NO: 25601 - protein, 7 aa, Artificial Sequence
  Description of Artificial Sequence: Synthetic peptide
DPLRNSN

SEQ ID NO: 25602 - protein, 7 aa, Artificial Sequence
  Description of Artificial Sequence: Synthetic peptide
DQNRVPY

SEQ ID NO: 25603 - protein, 7 aa, Artificial Sequence
  Description of Artificial Sequence: Synthetic peptide
SYGKESS

SEQ ID NO: 25604 - protein, 7 aa, Artificial Sequence
  Description of Artificial Sequence: Synthetic peptide
LDRSTYG

SEQ ID NO: 25605 - protein, 7 aa, Artificial Sequence
  Description of Artificial Sequence: Synthetic peptide
SRKNNTL

SEQ ID NO: 25606 - protein, 7 aa, Artificial Sequence
  Description of Artificial Sequence: Synthetic peptide
AISPTYM

SEQ ID NO: 25607 - protein, 7 aa, Artificial Sequence
  Description of Artificial Sequence: Synthetic peptide
YAMERVG

SEQ ID NO: 25608 - protein, 7 aa, Artificial Sequence
  Description of Artificial Sequence: Synthetic peptide
ELMNKSK

SEQ ID NO: 25609 - protein, 7 aa, Artificial Sequence
  Description of Artificial Sequence: Synthetic peptide
HDSKVIS

SEQ ID NO: 25610 - protein, 7 aa, Artificial Sequence
  Description of Artificial Sequence: Synthetic peptide
ARASSNS

SEQ ID NO: 25611 - protein, 7 aa, Artificial Sequence
  Description of Artificial Sequence: Synthetic peptide
ASRSTNP

SEQ ID NO: 25612 - protein, 7 aa, Artificial Sequence
  Description of Artificial Sequence: Synthetic peptide
SSLEKSN

SEQ ID NO: 25613 - protein, 7 aa, Artificial Sequence
  Description of Artificial Sequence: Synthetic peptide
SDQVRSA

SEQ ID NO: 25614 - protein, 7 aa, Artificial Sequence
  Description of Artificial Sequence: Synthetic peptide
LINPAGS

SEQ ID NO: 25615 - protein, 7 aa, Artificial Sequence
  Description of Artificial Sequence: Synthetic peptide
YGNPRQA

SEQ ID NO: 25616 - protein, 7 aa, Artificial Sequence
  Description of Artificial Sequence: Synthetic peptide
DINRQRT

SEQ ID NO: 25617 - protein, 7 aa, Artificial Sequence
  Description of Artificial Sequence: Synthetic peptide
LASTYSG

SEQ ID NO: 25618 - protein, 7 aa, Artificial Sequence
  Description of Artificial Sequence: Synthetic peptide
VPSQNRA

SEQ ID NO: 25619 - protein, 7 aa, Artificial Sequence
  Description of Artificial Sequence: Synthetic peptide
PRETHKQ

SEQ ID NO: 25620 - protein, 7 aa, Artificial Sequence
  Description of Artificial Sequence: Synthetic peptide
DGGNQRS

SEQ ID NO: 25621 - protein, 7 aa, Artificial Sequence
  Description of Artificial Sequence: Synthetic peptide
MGGVTSS

SEQ ID NO: 25622 - protein, 7 aa, Artificial Sequence
  Description of Artificial Sequence: Synthetic peptide
NNLAGSK

SEQ ID NO: 25623 - protein, 7 aa, Artificial Sequence
  Description of Artificial Sequence: Synthetic peptide
QPNSASH

SEQ ID NO: 25624 - protein, 7 aa, Artificial Sequence
  Description of Artificial Sequence: Synthetic peptide
PNGAHVT

SEQ ID NO: 25625 - protein, 7 aa, Artificial Sequence
  Description of Artificial Sequence: Synthetic peptide
SSDNRGL

SEQ ID NO: 25626 - protein, 7 aa, Artificial Sequence
  Description of Artificial Sequence: Synthetic peptide
ENTKTYS

SEQ ID NO: 25627 - protein, 7 aa, Artificial Sequence
  Description of Artificial Sequence: Synthetic peptide
NGSGQYQ

SEQ ID NO: 25628 - protein, 7 aa, Artificial Sequence
  Description of Artificial Sequence: Synthetic peptide
DPGTRKS

SEQ ID NO: 25629 - protein, 7 aa, Artificial Sequence
  Description of Artificial Sequence: Synthetic peptide
FRTQSTK

SEQ ID NO: 25630 - protein, 7 aa, Artificial Sequence
  Description of Artificial Sequence: Synthetic peptide
GVINNER

SEQ ID NO: 25631 - protein, 7 aa, Artificial Sequence
  Description of Artificial Sequence: Synthetic peptide
AAAVKGG

SEQ ID NO: 25632 - protein, 7 aa, Artificial Sequence
  Description of Artificial Sequence: Synthetic peptide
SGNDKNN

SEQ ID NO: 25633 - protein, 7 aa, Artificial Sequence
  Description of Artificial Sequence: Synthetic peptide
KDNTPGR

SEQ ID NO: 25634 - protein, 7 aa, Artificial Sequence
  Description of Artificial Sequence: Synthetic peptide
LMQTHGS

SEQ ID NO: 25635 - protein, 7 aa, Artificial Sequence
  Description of Artificial Sequence: Synthetic peptide
QVPATNR

SEQ ID NO: 25636 - protein, 7 aa, Artificial Sequence
  Description of Artificial Sequence: Synthetic peptide
ATRDSHS

SEQ ID NO: 25637 - protein, 7 aa, Artificial Sequence
  Description of Artificial Sequence: Synthetic peptide
MGVGMNG

SEQ ID NO: 25638 - protein, 7 aa, Artificial Sequence
  Description of Artificial Sequence: Synthetic peptide
GLSSGKT

SEQ ID NO: 25639 - protein, 7 aa, Artificial Sequence
  Description of Artificial Sequence: Synthetic peptide
RPSGSEP

SEQ ID NO: 25640 - protein, 7 aa, Artificial Sequence
  Description of Artificial Sequence: Synthetic peptide
GDTRLNA

SEQ ID NO: 25641 - protein, 7 aa, Artificial Sequence
  Description of Artificial Sequence: Synthetic peptide
DSGSSTK

SEQ ID NO: 25642 - protein, 7 aa, Artificial Sequence
  Description of Artificial Sequence: Synthetic peptide
PTLGTTK

SEQ ID NO: 25643 - protein, 7 aa, Artificial Sequence
  Description of Artificial Sequence: Synthetic peptide
DGKNNNV

SEQ ID NO: 25644 - protein, 7 aa, Artificial Sequence
  Description of Artificial Sequence: Synthetic peptide
PSVANVM

SEQ ID NO: 25645 - protein, 7 aa, Artificial Sequence
  Description of Artificial Sequence: Synthetic peptide
LGPGKNT

SEQ ID NO: 25646 - protein, 7 aa, Artificial Sequence
  Description of Artificial Sequence: Synthetic peptide
RNQLVSG

SEQ ID NO: 25647 - protein, 7 aa, Artificial Sequence
  Description of Artificial Sequence: Synthetic peptide
RDVDVRN

SEQ ID NO: 25648 - protein, 7 aa, Artificial Sequence
  Description of Artificial Sequence: Synthetic peptide
DRTNTQR

SEQ ID NO: 25649 - protein, 7 aa, Artificial Sequence
  Description of Artificial Sequence: Synthetic peptide
PQNNQAH

SEQ ID NO: 25650 - protein, 7 aa, Artificial Sequence
  Description of Artificial Sequence: Synthetic peptide
LPSGNTS

SEQ ID NO: 25651 - protein, 7 aa, Artificial Sequence
  Description of Artificial Sequence: Synthetic peptide
SRANSVP

SEQ ID NO: 25652 - protein, 7 aa, Artificial Sequence
  Description of Artificial Sequence: Synthetic peptide
ASSRESL

SEQ ID NO: 25653 - protein, 7 aa, Artificial Sequence
  Description of Artificial Sequence: Synthetic peptide
RVTDDHL

SEQ ID NO: 25654 - protein, 7 aa, Artificial Sequence
  Description of Artificial Sequence: Synthetic peptide
AVNELHD

SEQ ID NO: 25655 - protein, 7 aa, Artificial Sequence
  Description of Artificial Sequence: Synthetic peptide
SGSLSSA

SEQ ID NO: 25656 - protein, 7 aa, Artificial Sequence
  Description of Artificial Sequence: Synthetic peptide
NGTRQNQ

SEQ ID NO: 25657 - protein, 7 aa, Artificial Sequence
  Description of Artificial Sequence: Synthetic peptide
AATNSLT

SEQ ID NO: 25658 - protein, 7 aa, Artificial Sequence
  Description of Artificial Sequence: Synthetic peptide
STHHPAS

SEQ ID NO: 25659 - protein, 7 aa, Artificial Sequence
  Description of Artificial Sequence: Synthetic peptide
APLQSNL

SEQ ID NO: 25660 - protein, 7 aa, Artificial Sequence
  Description of Artificial Sequence: Synthetic peptide
SGGKSAL

SEQ ID NO: 25661 - protein, 7 aa, Artificial Sequence
  Description of Artificial Sequence: Synthetic peptide
KLVNSNG

SEQ ID NO: 25662 - protein, 7 aa, Artificial Sequence
  Description of Artificial Sequence: Synthetic peptide
SITDRHS

SEQ ID NO: 25663 - protein, 7 aa, Artificial Sequence
  Description of Artificial Sequence: Synthetic peptide
GCITNCS

SEQ ID NO: 25664 - protein, 7 aa, Artificial Sequence
  Description of Artificial Sequence: Synthetic peptide
TPGASLS

SEQ ID NO: 25665 - protein, 7 aa, Artificial Sequence
  Description of Artificial Sequence: Synthetic peptide
SSISRTS

SEQ ID NO: 25666 - protein, 7 aa, Artificial Sequence
  Description of Artificial Sequence: Synthetic peptide
NSVVSVS

SEQ ID NO: 25667 - protein, 7 aa, Artificial Sequence
  Description of Artificial Sequence: Synthetic peptide
NGSTSSG

SEQ ID NO: 25668 - protein, 7 aa, Artificial Sequence
  Description of Artificial Sequence: Synthetic peptide
DMVSPRN

SEQ ID NO: 25669 - protein, 7 aa, Artificial Sequence
  Description of Artificial Sequence: Synthetic peptide
RVRADDD

SEQ ID NO: 25670 - protein, 7 aa, Artificial Sequence
  Description of Artificial Sequence: Synthetic peptide
AQINTPT

SEQ ID NO: 25671 - protein, 7 aa, Artificial Sequence
  Description of Artificial Sequence: Synthetic peptide
AGSNSQG

SEQ ID NO: 25672 - protein, 7 aa, Artificial Sequence
  Description of Artificial Sequence: Synthetic peptide
DSIGSSK

SEQ ID NO: 25673 - protein, 7 aa, Artificial Sequence
  Description of Artificial Sequence: Synthetic peptide
NPAHGLN

SEQ ID NO: 25674 - protein, 7 aa, Artificial Sequence
  Description of Artificial Sequence: Synthetic peptide
NGVQQPK

SEQ ID NO: 25675 - protein, 7 aa, Artificial Sequence
  Description of Artificial Sequence: Synthetic peptide
RITSSNQ

SEQ ID NO: 25676 - protein, 7 aa, Artificial Sequence
  Description of Artificial Sequence: Synthetic peptide
IGNKQSQ

SEQ ID NO: 25677 - protein, 7 aa, Artificial Sequence
  Description of Artificial Sequence: Synthetic peptide
PTTLKHD

SEQ ID NO: 25678 - protein, 7 aa, Artificial Sequence
  Description of Artificial Sequence: Synthetic peptide
HTTGMLG

SEQ ID NO: 25679 - protein, 7 aa, Artificial Sequence
  Description of Artificial Sequence: Synthetic peptide
GSGHGTN

SEQ ID NO: 25680 - protein, 7 aa, Artificial Sequence
  Description of Artificial Sequence: Synthetic peptide
VTNSSLV

SEQ ID NO: 25681 - protein, 7 aa, Artificial Sequence
  Description of Artificial Sequence: Synthetic peptide
GTSNRYT

SEQ ID NO: 25682 - protein, 7 aa, Artificial Sequence
  Description of Artificial Sequence: Synthetic peptide
TPITPMT

SEQ ID NO: 25683 - protein, 7 aa, Artificial Sequence
  Description of Artificial Sequence: Synthetic peptide
SANTRVQ

SEQ ID NO: 25684 - protein, 7 aa, Artificial Sequence
  Description of Artificial Sequence: Synthetic peptide
PMTNLGT

SEQ ID NO: 25685 - protein, 7 aa, Artificial Sequence
  Description of Artificial Sequence: Synthetic peptide
NAQGTAK

SEQ ID NO: 25686 - protein, 7 aa, Artificial Sequence
  Description of Artificial Sequence: Synthetic peptide
ATTKEGI

SEQ ID NO: 25687 - protein, 7 aa, Artificial Sequence
  Description of Artificial Sequence: Synthetic peptide
NGISKSN

SEQ ID NO: 25688 - protein, 7 aa, Artificial Sequence
  Description of Artificial Sequence: Synthetic peptide
STHKNSP

SEQ ID NO: 25689 - protein, 7 aa, Artificial Sequence
  Description of Artificial Sequence: Synthetic peptide
NAFTTTV

SEQ ID NO: 25690 - protein, 7 aa, Artificial Sequence
  Description of Artificial Sequence: Synthetic peptide
YLSERNC

SEQ ID NO: 25691 - protein, 7 aa, Artificial Sequence
  Description of Artificial Sequence: Synthetic peptide
PVNLQNG

SEQ ID NO: 25692 - protein, 7 aa, Artificial Sequence
  Description of Artificial Sequence: Synthetic peptide
AYGKGSS

SEQ ID NO: 25693 - protein, 7 aa, Artificial Sequence
  Description of Artificial Sequence: Synthetic peptide
RLTQSSQ

SEQ ID NO: 25694 - protein, 7 aa, Artificial Sequence
  Description of Artificial Sequence: Synthetic peptide
ATGRSPN

SEQ ID NO: 25695 - protein, 7 aa, Artificial Sequence
  Description of Artificial Sequence: Synthetic peptide
GRQVTPT

SEQ ID NO: 25696 - protein, 7 aa, Artificial Sequence
  Description of Artificial Sequence: Synthetic peptide
SPGRTQS

SEQ ID NO: 25697 - protein, 7 aa, Artificial Sequence
  Description of Artificial Sequence: Synthetic peptide
DGSSRVG

SEQ ID NO: 25698 - protein, 7 aa, Artificial Sequence
  Description of Artificial Sequence: Synthetic peptide
MSTGVSP

SEQ ID NO: 25699 - protein, 7 aa, Artificial Sequence
  Description of Artificial Sequence: Synthetic peptide
RQVSTPL

SEQ ID NO: 25700 - protein, 7 aa, Artificial Sequence
  Description of Artificial Sequence: Synthetic peptide
RTNKSVT

SEQ ID NO: 25701 - protein, 7 aa, Artificial Sequence
  Description of Artificial Sequence: Synthetic peptide
YGSDKSI

SEQ ID NO: 25702 - protein, 7 aa, Artificial Sequence
  Description of Artificial Sequence: Synthetic peptide
ITTRSSM

SEQ ID NO: 25703 - protein, 7 aa, Artificial Sequence
  Description of Artificial Sequence: Synthetic peptide
DTITSRG

SEQ ID NO: 25704 - protein, 7 aa, Artificial Sequence
  Description of Artificial Sequence: Synthetic peptide
DSRNNMT

SEQ ID NO: 25705 - protein, 7 aa, Artificial Sequence
  Description of Artificial Sequence: Synthetic peptide
YPRQRTE

SEQ ID NO: 25706 - protein, 7 aa, Artificial Sequence
  Description of Artificial Sequence: Synthetic peptide
YVPRSSL

SEQ ID NO: 25707 - protein, 7 aa, Artificial Sequence
  Description of Artificial Sequence: Synthetic peptide
PLNTHQS

SEQ ID NO: 25708 - protein, 7 aa, Artificial Sequence
  Description of Artificial Sequence: Synthetic peptide
VPGNLPS

SEQ ID NO: 25709 - protein, 7 aa, Artificial Sequence
  Description of Artificial Sequence: Synthetic peptide
ALTGKLS

SEQ ID NO: 25710 - protein, 7 aa, Artificial Sequence
  Description of Artificial Sequence: Synthetic peptide
PVLNKAT

SEQ ID NO: 25711 - protein, 7 aa, Artificial Sequence
  Description of Artificial Sequence: Synthetic peptide
HLAYDNN

SEQ ID NO: 25712 - protein, 7 aa, Artificial Sequence
  Description of Artificial Sequence: Synthetic peptide
DSSERIR

SEQ ID NO: 25713 - protein, 7 aa, Artificial Sequence
  Description of Artificial Sequence: Synthetic peptide
SFSGANK

SEQ ID NO: 25714 - protein, 7 aa, Artificial Sequence
  Description of Artificial Sequence: Synthetic peptide
LKANATG

SEQ ID NO: 25715 - protein, 7 aa, Artificial Sequence
  Description of Artificial Sequence: Synthetic peptide
MPHPSSK

SEQ ID NO: 25716 - protein, 7 aa, Artificial Sequence
  Description of Artificial Sequence: Synthetic peptide
QDKGNAG

SEQ ID NO: 25717 - protein, 7 aa, Artificial Sequence
  Description of Artificial Sequence: Synthetic peptide
INFSGTR

SEQ ID NO: 25718 - protein, 7 aa, Artificial Sequence
  Description of Artificial Sequence: Synthetic peptide
QTSSHAY

SEQ ID NO: 25719 - protein, 7 aa, Artificial Sequence
  Description of Artificial Sequence: Synthetic peptide
SHSVTPG

SEQ ID NO: 25720 - protein, 7 aa, Artificial Sequence
  Description of Artificial Sequence: Synthetic peptide
IGITNHS

SEQ ID NO: 25721 - protein, 7 aa, Artificial Sequence
  Description of Artificial Sequence: Synthetic peptide
HYTGKQN

SEQ ID NO: 25722 - protein, 7 aa, Artificial Sequence
  Description of Artificial Sequence: Synthetic peptide
QRVSSTL

SEQ ID NO: 25723 - protein, 7 aa, Artificial Sequence
  Description of Artificial Sequence: Synthetic peptide
GLAGSLQ

SEQ ID NO: 25724 - protein, 7 aa, Artificial Sequence
  Description of Artificial Sequence: Synthetic peptide
DLSMQTR

SEQ ID NO: 25725 - protein, 7 aa, Artificial Sequence
  Description of Artificial Sequence: Synthetic peptide
TPAGPNK

SEQ ID NO: 25726 - protein, 7 aa, Artificial Sequence
  Description of Artificial Sequence: Synthetic peptide
VRISTQA

SEQ ID NO: 25727 - protein, 7 aa, Artificial Sequence
  Description of Artificial Sequence: Synthetic peptide
VLAGSNT

SEQ ID NO: 25728 - protein, 7 aa, Artificial Sequence
  Description of Artificial Sequence: Synthetic peptide
ASSKGLT

SEQ ID NO: 25729 - protein, 7 aa, Artificial Sequence
  Description of Artificial Sequence: Synthetic peptide
RTLNLNT

SEQ ID NO: 25730 - protein, 7 aa, Artificial Sequence
  Description of Artificial Sequence: Synthetic peptide
NREQLRD

SEQ ID NO: 25731 - protein, 7 aa, Artificial Sequence
  Description of Artificial Sequence: Synthetic peptide
PGEVHRS

SEQ ID NO: 25732 - protein, 7 aa, Artificial Sequence
  Description of Artificial Sequence: Synthetic peptide
SIHSDRT

SEQ ID NO: 25733 - protein, 7 aa, Artificial Sequence
  Description of Artificial Sequence: Synthetic peptide
YATDGLK

SEQ ID NO: 25734 - protein, 7 aa, Artificial Sequence
  Description of Artificial Sequence: Synthetic peptide
DTNKTSY

SEQ ID NO: 25735 - protein, 7 aa, Artificial Sequence
  Description of Artificial Sequence: Synthetic peptide
YGSRPPS

SEQ ID NO: 25736 - protein, 7 aa, Artificial Sequence
  Description of Artificial Sequence: Synthetic peptide
PLINRTM

SEQ ID NO: 25737 - protein, 7 aa, Artificial Sequence
  Description of Artificial Sequence: Synthetic peptide
SKSVAQS

SEQ ID NO: 25738 - protein, 7 aa, Artificial Sequence
  Description of Artificial Sequence: Synthetic peptide
RDPTPVR

SEQ ID NO: 25739 - protein, 7 aa, Artificial Sequence
  Description of Artificial Sequence: Synthetic peptide
YGSESNK

SEQ ID NO: 25740 - protein, 7 aa, Artificial Sequence
  Description of Artificial Sequence: Synthetic peptide
DRVLSQG

SEQ ID NO: 25741 - protein, 7 aa, Artificial Sequence
  Description of Artificial Sequence: Synthetic peptide
LVASGQK

SEQ ID NO: 25742 - protein, 7 aa, Artificial Sequence
  Description of Artificial Sequence: Synthetic peptide
NSSDSLT

SEQ ID NO: 25743 - protein, 7 aa, Artificial Sequence
  Description of Artificial Sequence: Synthetic peptide
GASGKIG

SEQ ID NO: 25744 - protein, 7 aa, Artificial Sequence
  Description of Artificial Sequence: Synthetic peptide
NTTGHAG

SEQ ID NO: 25745 - protein, 7 aa, Artificial Sequence
  Description of Artificial Sequence: Synthetic peptide
YRVGSIS

SEQ ID NO: 25746 - protein, 7 aa, Artificial Sequence
  Description of Artificial Sequence: Synthetic peptide
VTLPPNA

SEQ ID NO: 25747 - protein, 7 aa, Artificial Sequence
  Description of Artificial Sequence: Synthetic peptide
CATRASY

SEQ ID NO: 25748 - protein, 7 aa, Artificial Sequence
  Description of Artificial Sequence: Synthetic peptide
SISHSSS

SEQ ID NO: 25749 - protein, 7 aa, Artificial Sequence
  Description of Artificial Sequence: Synthetic peptide
CNNARVS

SEQ ID NO: 25750 - protein, 7 aa, Artificial Sequence
  Description of Artificial Sequence: Synthetic peptide
TVPGRST

SEQ ID NO: 25751 - protein, 7 aa, Artificial Sequence
  Description of Artificial Sequence: Synthetic peptide
NALPNRG

SEQ ID NO: 25752 - protein, 7 aa, Artificial Sequence
  Description of Artificial Sequence: Synthetic peptide
NPSEKML

SEQ ID NO: 25753 - protein, 7 aa, Artificial Sequence
  Description of Artificial Sequence: Synthetic peptide
PGTGSNH

SEQ ID NO: 25754 - protein, 7 aa, Artificial Sequence
  Description of Artificial Sequence: Synthetic peptide
HITPATS

SEQ ID NO: 25755 - protein, 7 aa, Artificial Sequence
  Description of Artificial Sequence: Synthetic peptide
SRNPNMI

SEQ ID NO: 25756 - protein, 7 aa, Artificial Sequence
  Description of Artificial Sequence: Synthetic peptide
GENSAKR

SEQ ID NO: 25757 - protein, 7 aa, Artificial Sequence
  Description of Artificial Sequence: Synthetic peptide
SLSSKQM

SEQ ID NO: 25758 - protein, 7 aa, Artificial Sequence
  Description of Artificial Sequence: Synthetic peptide
CNSVNDR

SEQ ID NO: 25759 - protein, 7 aa, Artificial Sequence
  Description of Artificial Sequence: Synthetic peptide
ESKNSVV

SEQ ID NO: 25760 - protein, 7 aa, Artificial Sequence
  Description of Artificial Sequence: Synthetic peptide
DYHNSKL

SEQ ID NO: 25761 - protein, 7 aa, Artificial Sequence
  Description of Artificial Sequence: Synthetic peptide
GQNTVSR

SEQ ID NO: 25762 - protein, 7 aa, Artificial Sequence
  Description of Artificial Sequence: Synthetic peptide
DSVAGFT

SEQ ID NO: 25763 - protein, 7 aa, Artificial Sequence
  Description of Artificial Sequence: Synthetic peptide
PYKNKPS

SEQ ID NO: 25764 - protein, 7 aa, Artificial Sequence
  Description of Artificial Sequence: Synthetic peptide
VADKGSM

SEQ ID NO: 25765 - protein, 7 aa, Artificial Sequence
  Description of Artificial Sequence: Synthetic peptide
GQNRNNT

SEQ ID NO: 25766 - protein, 7 aa, Artificial Sequence
  Description of Artificial Sequence: Synthetic peptide
RSYEGMQ

SEQ ID NO: 25767 - protein, 7 aa, Artificial Sequence
  Description of Artificial Sequence: Synthetic peptide
KQRSAPN

SEQ ID NO: 25768 - protein, 7 aa, Artificial Sequence
  Description of Artificial Sequence: Synthetic peptide
TARGGPT

SEQ ID NO: 25769 - protein, 7 aa, Artificial Sequence
  Description of Artificial Sequence: Synthetic peptide
SMGKLSS

SEQ ID NO: 25770 - protein, 7 aa, Artificial Sequence
  Description of Artificial Sequence: Synthetic peptide
VVLDTNR

SEQ ID NO: 25771 - protein, 7 aa, Artificial Sequence
  Description of Artificial Sequence: Synthetic peptide
NGATKNS

SEQ ID NO: 25772 - protein, 7 aa, Artificial Sequence
  Description of Artificial Sequence: Synthetic peptide
SSPLEHS

SEQ ID NO: 25773 - protein, 7 aa, Artificial Sequence
  Description of Artificial Sequence: Synthetic peptide
AKTNLSS

SEQ ID NO: 25774 - protein, 7 aa, Artificial Sequence
  Description of Artificial Sequence: Synthetic peptide
SLPNTNG

SEQ ID NO: 25775 - protein, 7 aa, Artificial Sequence
  Description of Artificial Sequence: Synthetic peptide
LGLRDNT

SEQ ID NO: 25776 - protein, 7 aa, Artificial Sequence
  Description of Artificial Sequence: Synthetic peptide
SNETKSS

SEQ ID NO: 25777 - protein, 7 aa, Artificial Sequence
  Description of Artificial Sequence: Synthetic peptide
SVNSHHG

SEQ ID NO: 25778 - protein, 7 aa, Artificial Sequence
  Description of Artificial Sequence: Synthetic peptide
TKGGSQL

SEQ ID NO: 25779 - protein, 7 aa, Artificial Sequence
  Description of Artificial Sequence: Synthetic peptide
RNGAMSN

SEQ ID NO: 25780 - protein, 7 aa, Artificial Sequence
  Description of Artificial Sequence: Synthetic peptide
TGVSPLA

SEQ ID NO: 25781 - protein, 7 aa, Artificial Sequence
  Description of Artificial Sequence: Synthetic peptide
AMTGSHT

SEQ ID NO: 25782 - protein, 7 aa, Artificial Sequence
  Description of Artificial Sequence: Synthetic peptide
GTPNTKV

SEQ ID NO: 25783 - protein, 7 aa, Artificial Sequence
  Description of Artificial Sequence: Synthetic peptide
HGIGNSA

SEQ ID NO: 25784 - protein, 7 aa, Artificial Sequence
  Description of Artificial Sequence: Synthetic peptide
EGSGRLT

SEQ ID NO: 25785 - protein, 7 aa, Artificial Sequence
  Description of Artificial Sequence: Synthetic peptide
SGASSNS

SEQ ID NO: 25786 - protein, 7 aa, Artificial Sequence
  Description of Artificial Sequence: Synthetic peptide
QNRNTVG

SEQ ID NO: 25787 - protein, 7 aa, Artificial Sequence
  Description of Artificial Sequence: Synthetic peptide
GTQKQTS

SEQ ID NO: 25788 - protein, 7 aa, Artificial Sequence
  Description of Artificial Sequence: Synthetic peptide
YNSTTAT

SEQ ID NO: 25789 - protein, 7 aa, Artificial Sequence
  Description of Artificial Sequence: Synthetic peptide
MGNAGVR

SEQ ID NO: 25790 - protein, 7 aa, Artificial Sequence
  Description of Artificial Sequence: Synthetic peptide
FSLKGGN

SEQ ID NO: 25791 - protein, 7 aa, Artificial Sequence
  Description of Artificial Sequence: Synthetic peptide
NGSGQTQ

SEQ ID NO: 25792 - protein, 7 aa, Artificial Sequence
  Description of Artificial Sequence: Synthetic peptide
LNKSTLP

SEQ ID NO: 25793 - protein, 7 aa, Artificial Sequence
  Description of Artificial Sequence: Synthetic peptide
PSNSGNN

SEQ ID NO: 25794 - protein, 7 aa, Artificial Sequence
  Description of Artificial Sequence: Synthetic peptide
QPTTSAL

SEQ ID NO: 25795 - protein, 7 aa, Artificial Sequence
  Description of Artificial Sequence: Synthetic peptide
VASSAHV

SEQ ID NO: 25796 - protein, 7 aa, Artificial Sequence
  Description of Artificial Sequence: Synthetic peptide
GIATTNR

SEQ ID NO: 25797 - protein, 7 aa, Artificial Sequence
  Description of Artificial Sequence: Synthetic peptide
RLHNMSA

SEQ ID NO: 25798 - protein, 7 aa, Artificial Sequence
  Description of Artificial Sequence: Synthetic peptide
SQQSAAL

SEQ ID NO: 25799 - protein, 7 aa, Artificial Sequence
  Description of Artificial Sequence: Synthetic peptide
MLNTSHY

SEQ ID NO: 25800 - protein, 7 aa, Artificial Sequence
  Description of Artificial Sequence: Synthetic peptide
QGLSKSG

SEQ ID NO: 25801 - protein, 7 aa, Artificial Sequence
  Description of Artificial Sequence: Synthetic peptide
RPIASSG

SEQ ID NO: 25802 - protein, 7 aa, Artificial Sequence
  Description of Artificial Sequence: Synthetic peptide
DVHRSSG

SEQ ID NO: 25803 - protein, 7 aa, Artificial Sequence
  Description of Artificial Sequence: Synthetic peptide
FNSGSGR

SEQ ID NO: 25804 - protein, 7 aa, Artificial Sequence
  Description of Artificial Sequence: Synthetic peptide
IGSNARQ

SEQ ID NO: 25805 - protein, 7 aa, Artificial Sequence
  Description of Artificial Sequence: Synthetic peptide
PHVARQM

SEQ ID NO: 25806 - protein, 7 aa, Artificial Sequence
  Description of Artificial Sequence: Synthetic peptide
LTAVSPK

SEQ ID NO: 25807 - protein, 7 aa, Artificial Sequence
  Description of Artificial Sequence: Synthetic peptide
YPSPTVT

SEQ ID NO: 25808 - protein, 7 aa, Artificial Sequence
  Description of Artificial Sequence: Synthetic peptide
IQQGSRT

SEQ ID NO: 25809 - protein, 7 aa, Artificial Sequence
  Description of Artificial Sequence: Synthetic peptide
NVSGQNQ

SEQ ID NO: 25810 - protein, 7 aa, Artificial Sequence
  Description of Artificial Sequence: Synthetic peptide
GSGSRLI

SEQ ID NO: 25811 - protein, 7 aa, Artificial Sequence
  Description of Artificial Sequence: Synthetic peptide
NQQNGSN

SEQ ID NO: 25812 - protein, 7 aa, Artificial Sequence
  Description of Artificial Sequence: Synthetic peptide
MVSGKSY

SEQ ID NO: 25813 - protein, 7 aa, Artificial Sequence
  Description of Artificial Sequence: Synthetic peptide
LGGRSSN

SEQ ID NO: 25814 - protein, 7 aa, Artificial Sequence
  Description of Artificial Sequence: Synthetic peptide
NGSAQNQ

SEQ ID NO: 25815 - protein, 7 aa, Artificial Sequence
  Description of Artificial Sequence: Synthetic peptide
TGQQTAT

SEQ ID NO: 25816 - protein, 7 aa, Artificial Sequence
  Description of Artificial Sequence: Synthetic peptide
ASTAINQ

SEQ ID NO: 25817 - protein, 7 aa, Artificial Sequence
  Description of Artificial Sequence: Synthetic peptide
GQPNSAR

SEQ ID NO: 25818 - protein, 7 aa, Artificial Sequence
  Description of Artificial Sequence: Synthetic peptide
NSISRVT

SEQ ID NO: 25819 - protein, 7 aa, Artificial Sequence
  Description of Artificial Sequence: Synthetic peptide
VNTSHTN

SEQ ID NO: 25820 - protein, 7 aa, Artificial Sequence
  Description of Artificial Sequence: Synthetic peptide
STNGNGL

SEQ ID NO: 25821 - protein, 7 aa, Artificial Sequence
  Description of Artificial Sequence: Synthetic peptide
NSGARLS

SEQ ID NO: 25822 - protein, 7 aa, Artificial Sequence
  Description of Artificial Sequence: Synthetic peptide
SSTSPGR

SEQ ID NO: 25823 - protein, 7 aa, Artificial Sequence
  Description of Artificial Sequence: Synthetic peptide
KSDAHTA

SEQ ID NO: 25824 - protein, 7 aa, Artificial Sequence
  Description of Artificial Sequence: Synthetic peptide
VHQAGAN

SEQ ID NO: 25825 - protein, 7 aa, Artificial Sequence
  Description of Artificial Sequence: Synthetic peptide
SDTKPFT

SEQ ID NO: 25826 - protein, 7 aa, Artificial Sequence
  Description of Artificial Sequence: Synthetic peptide
TAFSTNR

SEQ ID NO: 25827 - protein, 7 aa, Artificial Sequence
  Description of Artificial Sequence: Synthetic peptide
LSMNTSK

SEQ ID NO: 25828 - protein, 7 aa, Artificial Sequence
  Description of Artificial Sequence: Synthetic peptide
MTESSRT

SEQ ID NO: 25829 - protein, 7 aa, Artificial Sequence
  Description of Artificial Sequence: Synthetic peptide
ERAKGSS

SEQ ID NO: 25830 - protein, 7 aa, Artificial Sequence
  Description of Artificial Sequence: Synthetic peptide
RLTGIST

SEQ ID NO: 25831 - protein, 7 aa, Artificial Sequence
  Description of Artificial Sequence: Synthetic peptide
MKSQKYA

SEQ ID NO: 25832 - protein, 7 aa, Artificial Sequence
  Description of Artificial Sequence: Synthetic peptide
SPGNKST

SEQ ID NO: 25833 - protein, 7 aa, Artificial Sequence
  Description of Artificial Sequence: Synthetic peptide
FSSASFT

SEQ ID NO: 25834 - protein, 7 aa, Artificial Sequence
  Description of Artificial Sequence: Synthetic peptide
RGIDNKG

SEQ ID NO: 25835 - protein, 7 aa, Artificial Sequence
  Description of Artificial Sequence: Synthetic peptide
IVSPVSK

SEQ ID NO: 25836 - protein, 7 aa, Artificial Sequence
  Description of Artificial Sequence: Synthetic peptide
TTHNIQG

SEQ ID NO: 25837 - protein, 7 aa, Artificial Sequence
  Description of Artificial Sequence: Synthetic peptide
GDAGSFS

SEQ ID NO: 25838 - protein, 7 aa, Artificial Sequence
  Description of Artificial Sequence: Synthetic peptide
LGVKTPT

SEQ ID NO: 25839 - protein, 7 aa, Artificial Sequence
  Description of Artificial Sequence: Synthetic peptide
TNRVGYG

SEQ ID NO: 25840 - protein, 7 aa, Artificial Sequence
  Description of Artificial Sequence: Synthetic peptide
SARDRAS

SEQ ID NO: 25841 - protein, 7 aa, Artificial Sequence
  Description of Artificial Sequence: Synthetic peptide
KDFGQMR

SEQ ID NO: 25842 - protein, 7 aa, Artificial Sequence
  Description of Artificial Sequence: Synthetic peptide
DISVRPG

SEQ ID NO: 25843 - protein, 7 aa, Artificial Sequence
  Description of Artificial Sequence: Synthetic peptide
PSQEGQQ

SEQ ID NO: 25844 - protein, 7 aa, Artificial Sequence
  Description of Artificial Sequence: Synthetic peptide
PITHPLR

SEQ ID NO: 25845 - protein, 7 aa, Artificial Sequence
  Description of Artificial Sequence: Synthetic peptide
PGHATQS

SEQ ID NO: 25846 - protein, 7 aa, Artificial Sequence
  Description of Artificial Sequence: Synthetic peptide
RPVGGLA

SEQ ID NO: 25847 - protein, 7 aa, Artificial Sequence
  Description of Artificial Sequence: Synthetic peptide
MSTARSA

SEQ ID NO: 25848 - protein, 7 aa, Artificial Sequence
  Description of Artificial Sequence: Synthetic peptide
SNPSGFS

SEQ ID NO: 25849 - protein, 7 aa, Artificial Sequence
  Description of Artificial Sequence: Synthetic peptide
GMQKMSS

SEQ ID NO: 25850 - protein, 7 aa, Artificial Sequence
  Description of Artificial Sequence: Synthetic peptide
PLDKSMM

SEQ ID NO: 25851 - protein, 7 aa, Artificial Sequence
  Description of Artificial Sequence: Synthetic peptide
VQRSSNQ

SEQ ID NO: 25852 - protein, 7 aa, Artificial Sequence
  Description of Artificial Sequence: Synthetic peptide
SGGKGPT

SEQ ID NO: 25853 - protein, 7 aa, Artificial Sequence
  Description of Artificial Sequence: Synthetic peptide
DQVSHKL

SEQ ID NO: 25854 - protein, 7 aa, Artificial Sequence
  Description of Artificial Sequence: Synthetic peptide
SHDSRVA

SEQ ID NO: 25855 - protein, 7 aa, Artificial Sequence
  Description of Artificial Sequence: Synthetic peptide
GTAGRFN

SEQ ID NO: 25856 - protein, 7 aa, Artificial Sequence
  Description of Artificial Sequence: Synthetic peptide
RDRTNAA

SEQ ID NO: 25857 - protein, 7 aa, Artificial Sequence
  Description of Artificial Sequence: Synthetic peptide
PVSGATI

SEQ ID NO: 25858 - protein, 7 aa, Artificial Sequence
  Description of Artificial Sequence: Synthetic peptide
VLNAKSS

SEQ ID NO: 25859 - protein, 7 aa, Artificial Sequence
  Description of Artificial Sequence: Synthetic peptide
HVTKSTA

SEQ ID NO: 25860 - protein, 7 aa, Artificial Sequence
  Description of Artificial Sequence: Synthetic peptide
SIKSVTN

SEQ ID NO: 25861 - protein, 7 aa, Artificial Sequence
  Description of Artificial Sequence: Synthetic peptide
SAGGAVS

SEQ ID NO: 25862 - protein, 7 aa, Artificial Sequence
  Description of Artificial Sequence: Synthetic peptide
MGQGTLR

SEQ ID NO: 25863 - protein, 7 aa, Artificial Sequence
  Description of Artificial Sequence: Synthetic peptide
GRLTSSI

SEQ ID NO: 25864 - protein, 7 aa, Artificial Sequence
  Description of Artificial Sequence: Synthetic peptide
TQSHNLA

SEQ ID NO: 25865 - protein, 7 aa, Artificial Sequence
  Description of Artificial Sequence: Synthetic peptide
HISTRSA

SEQ ID NO: 25866 - protein, 7 aa, Artificial Sequence
  Description of Artificial Sequence: Synthetic peptide
DQGNGYG

SEQ ID NO: 25867 - protein, 7 aa, Artificial Sequence
  Description of Artificial Sequence: Synthetic peptide
TPQNSVK

SEQ ID NO: 25868 - protein, 7 aa, Artificial Sequence
  Description of Artificial Sequence: Synthetic peptide
KSAQGGN

SEQ ID NO: 25869 - protein, 7 aa, Artificial Sequence
  Description of Artificial Sequence: Synthetic peptide
ESSSSMG

SEQ ID NO: 25870 - protein, 7 aa, Artificial Sequence
  Description of Artificial Sequence: Synthetic peptide
RNNNTPG

SEQ ID NO: 25871 - protein, 7 aa, Artificial Sequence
  Description of Artificial Sequence: Synthetic peptide
YQNVSSK

SEQ ID NO: 25872 - protein, 7 aa, Artificial Sequence
  Description of Artificial Sequence: Synthetic peptide
YNNGGTR

SEQ ID NO: 25873 - protein, 7 aa, Artificial Sequence
  Description of Artificial Sequence: Synthetic peptide
NGSGTNQ

SEQ ID NO: 25874 - protein, 7 aa, Artificial Sequence
  Description of Artificial Sequence: Synthetic peptide
IPLSSQR

SEQ ID NO: 25875 - protein, 7 aa, Artificial Sequence
  Description of Artificial Sequence: Synthetic peptide
GLHPTYS

SEQ ID NO: 25876 - protein, 7 aa, Artificial Sequence
  Description of Artificial Sequence: Synthetic peptide
DAQRRGV

SEQ ID NO: 25877 - protein, 7 aa, Artificial Sequence
  Description of Artificial Sequence: Synthetic peptide
NVSTGAT

SEQ ID NO: 25878 - protein, 7 aa, Artificial Sequence
  Description of Artificial Sequence: Synthetic peptide
PTQNGRS

SEQ ID NO: 25879 - protein, 7 aa, Artificial Sequence
  Description of Artificial Sequence: Synthetic peptide
SSVSRSH

SEQ ID NO: 25880 - protein, 7 aa, Artificial Sequence
  Description of Artificial Sequence: Synthetic peptide
PDVKVTR

SEQ ID NO: 25881 - protein, 7 aa, Artificial Sequence
  Description of Artificial Sequence: Synthetic peptide
NVSSAIK

SEQ ID NO: 25882 - protein, 7 aa, Artificial Sequence
  Description of Artificial Sequence: Synthetic peptide
MSSRSSV

SEQ ID NO: 25883 - protein, 7 aa, Artificial Sequence
  Description of Artificial Sequence: Synthetic peptide
GRLNTNG

SEQ ID NO: 25884 - protein, 7 aa, Artificial Sequence
  Description of Artificial Sequence: Synthetic peptide
DISRSHG

SEQ ID NO: 25885 - protein, 7 aa, Artificial Sequence
  Description of Artificial Sequence: Synthetic peptide
EATSSTK

SEQ ID NO: 25886 - protein, 7 aa, Artificial Sequence
  Description of Artificial Sequence: Synthetic peptide
GISPGTA

SEQ ID NO: 25887 - protein, 7 aa, Artificial Sequence
  Description of Artificial Sequence: Synthetic peptide
PLTTRPS

SEQ ID NO: 25888 - protein, 7 aa, Artificial Sequence
  Description of Artificial Sequence: Synthetic peptide
AMNREVS

SEQ ID NO: 25889 - protein, 7 aa, Artificial Sequence
  Description of Artificial Sequence: Synthetic peptide
PSQTKPS

SEQ ID NO: 25890 - protein, 7 aa, Artificial Sequence
  Description of Artificial Sequence: Synthetic peptide
SSNEKDR

SEQ ID NO: 25891 - protein, 7 aa, Artificial Sequence
  Description of Artificial Sequence: Synthetic peptide
HHSTLQT

SEQ ID NO: 25892 - protein, 7 aa, Artificial Sequence
  Description of Artificial Sequence: Synthetic peptide
NASGQNQ

SEQ ID NO: 25893 - protein, 7 aa, Artificial Sequence
  Description of Artificial Sequence: Synthetic peptide
SMGNSIS

SEQ ID NO: 25894 - protein, 7 aa, Artificial Sequence
  Description of Artificial Sequence: Synthetic peptide
SAVGKAS

SEQ ID NO: 25895 - protein, 7 aa, Artificial Sequence
  Description of Artificial Sequence: Synthetic peptide
PSHNPTN

SEQ ID NO: 25896 - protein, 7 aa, Artificial Sequence
  Description of Artificial Sequence: Synthetic peptide
SDKGNTR

SEQ ID NO: 25897 - protein, 7 aa, Artificial Sequence
  Description of Artificial Sequence: Synthetic peptide
SRLEKSN

SEQ ID NO: 25898 - protein, 7 aa, Artificial Sequence
  Description of Artificial Sequence: Synthetic peptide
RPSMPHS

SEQ ID NO: 25899 - protein, 7 aa, Artificial Sequence
  Description of Artificial Sequence: Synthetic peptide
LRDTNMN

SEQ ID NO: 25900 - protein, 7 aa, Artificial Sequence
  Description of Artificial Sequence: Synthetic peptide
RVNLNEL

SEQ ID NO: 25901 - protein, 7 aa, Artificial Sequence
  Description of Artificial Sequence: Synthetic peptide
GTTNSRN

SEQ ID NO: 25902 - protein, 7 aa, Artificial Sequence
  Description of Artificial Sequence: Synthetic peptide
NSNGFNN

SEQ ID NO: 25903 - protein, 7 aa, Artificial Sequence
  Description of Artificial Sequence: Synthetic peptide
NQGGYHG

SEQ ID NO: 25904 - protein, 7 aa, Artificial Sequence
  Description of Artificial Sequence: Synthetic peptide
ISPVPLT

SEQ ID NO: 25905 - protein, 7 aa, Artificial Sequence
  Description of Artificial Sequence: Synthetic peptide
HVPSKLA

SEQ ID NO: 25906 - protein, 7 aa, Artificial Sequence
  Description of Artificial Sequence: Synthetic peptide
SIPSTSQ

SEQ ID NO: 25907 - protein, 7 aa, Artificial Sequence
  Description of Artificial Sequence: Synthetic peptide
NRVEHTQ

SEQ ID NO: 25908 - protein, 7 aa, Artificial Sequence
  Description of Artificial Sequence: Synthetic peptide
RMSSTHG

SEQ ID NO: 25909 - protein, 7 aa, Artificial Sequence
  Description of Artificial Sequence: Synthetic peptide
GMKGSVN

SEQ ID NO: 25910 - protein, 7 aa, Artificial Sequence
  Description of Artificial Sequence: Synthetic peptide
SVAGTSR

SEQ ID NO: 25911 - protein, 7 aa, Artificial Sequence
  Description of Artificial Sequence: Synthetic peptide
NKSNTFL

SEQ ID NO: 25912 - protein, 7 aa, Artificial Sequence
  Description of Artificial Sequence: Synthetic peptide
DPHSGGK

SEQ ID NO: 25913 - protein, 7 aa, Artificial Sequence
  Description of Artificial Sequence: Synthetic peptide
GTSTSLR

SEQ ID NO: 25914 - protein, 7 aa, Artificial Sequence
  Description of Artificial Sequence: Synthetic peptide
LATNRSN

SEQ ID NO: 25915 - protein, 7 aa, Artificial Sequence
  Description of Artificial Sequence: Synthetic peptide
NRQVPGL

SEQ ID NO: 25916 - protein, 7 aa, Artificial Sequence
  Description of Artificial Sequence: Synthetic peptide
STGSVSK

SEQ ID NO: 25917 - protein, 7 aa, Artificial Sequence
  Description of Artificial Sequence: Synthetic peptide
GLPLRSV

SEQ ID NO: 25918 - protein, 7 aa, Artificial Sequence
  Description of Artificial Sequence: Synthetic peptide
QVTSIGA

SEQ ID NO: 25919 - protein, 7 aa, Artificial Sequence
  Description of Artificial Sequence: Synthetic peptide
PQSRKGE

SEQ ID NO: 25920 - protein, 7 aa, Artificial Sequence
  Description of Artificial Sequence: Synthetic peptide
SYADKQG

SEQ ID NO: 25921 - protein, 7 aa, Artificial Sequence
  Description of Artificial Sequence: Synthetic peptide
PLQQNRS

SEQ ID NO: 25922 - protein, 7 aa, Artificial Sequence
  Description of Artificial Sequence: Synthetic peptide
HSENGNR

SEQ ID NO: 25923 - protein, 7 aa, Artificial Sequence
  Description of Artificial Sequence: Synthetic peptide
RASQSVG

SEQ ID NO: 25924 - protein, 7 aa, Artificial Sequence
  Description of Artificial Sequence: Synthetic peptide
FNSSSGS

SEQ ID NO: 25925 - protein, 7 aa, Artificial Sequence
  Description of Artificial Sequence: Synthetic peptide
NGSGQSQ

SEQ ID NO: 25926 - protein, 7 aa, Artificial Sequence
  Description of Artificial Sequence: Synthetic peptide
NTTAKSS

SEQ ID NO: 25927 - protein, 7 aa, Artificial Sequence
  Description of Artificial Sequence: Synthetic peptide
SVSSPRD

SEQ ID NO: 25928 - protein, 7 aa, Artificial Sequence
  Description of Artificial Sequence: Synthetic peptide
SHGPQIT

SEQ ID NO: 25929 - protein, 7 aa, Artificial Sequence
  Description of Artificial Sequence: Synthetic peptide
KLPDSRF

SEQ ID NO: 25930 - protein, 7 aa, Artificial Sequence
  Description of Artificial Sequence: Synthetic peptide
AGGINKL

SEQ ID NO: 25931 - protein, 7 aa, Artificial Sequence
  Description of Artificial Sequence: Synthetic peptide
GAERILR

SEQ ID NO: 25932 - protein, 7 aa, Artificial Sequence
  Description of Artificial Sequence: Synthetic peptide
PSAGREK

SEQ ID NO: 25933 - protein, 7 aa, Artificial Sequence
  Description of Artificial Sequence: Synthetic peptide
VSTTPAL

SEQ ID NO: 25934 - protein, 7 aa, Artificial Sequence
  Description of Artificial Sequence: Synthetic peptide
HSTSLSK

SEQ ID NO: 25935 - protein, 7 aa, Artificial Sequence
  Description of Artificial Sequence: Synthetic peptide
GSSIPWQ

SEQ ID NO: 25936 - protein, 7 aa, Artificial Sequence
  Description of Artificial Sequence: Synthetic peptide
WSTSKQV

SEQ ID NO: 25937 - protein, 7 aa, Artificial Sequence
  Description of Artificial Sequence: Synthetic peptide
GSAGNML

SEQ ID NO: 25938 - protein, 7 aa, Artificial Sequence
  Description of Artificial Sequence: Synthetic peptide
NGPGQNQ

SEQ ID NO: 25939 - protein, 7 aa, Artificial Sequence
  Description of Artificial Sequence: Synthetic peptide
TTSGAGR

SEQ ID NO: 25940 - protein, 7 aa, Artificial Sequence
  Description of Artificial Sequence: Synthetic peptide
SRNTQSM

SEQ ID NO: 25941 - protein, 7 aa, Artificial Sequence
  Description of Artificial Sequence: Synthetic peptide
TTMSKVG

SEQ ID NO: 25942 - protein, 7 aa, Artificial Sequence
  Description of Artificial Sequence: Synthetic peptide
SGGTPGR

SEQ ID NO: 25943 - protein, 7 aa, Artificial Sequence
  Description of Artificial Sequence: Synthetic peptide
IRAKESA

SEQ ID NO: 25944 - protein, 7 aa, Artificial Sequence
  Description of Artificial Sequence: Synthetic peptide
GNRGSVI

SEQ ID NO: 25945 - protein, 7 aa, Artificial Sequence
  Description of Artificial Sequence: Synthetic peptide
DDYQHKG

SEQ ID NO: 25946 - protein, 7 aa, Artificial Sequence
  Description of Artificial Sequence: Synthetic peptide
NRVGSIS

SEQ ID NO: 25947 - protein, 7 aa, Artificial Sequence
  Description of Artificial Sequence: Synthetic peptide
DLTRATS

SEQ ID NO: 25948 - protein, 7 aa, Artificial Sequence
  Description of Artificial Sequence: Synthetic peptide
HATSGTR

SEQ ID NO: 25949 - protein, 7 aa, Artificial Sequence
  Description of Artificial Sequence: Synthetic peptide
KNYDNAV

SEQ ID NO: 25950 - protein, 7 aa, Artificial Sequence
  Description of Artificial Sequence: Synthetic peptide
SFAKSAS

SEQ ID NO: 25951 - protein, 7 aa, Artificial Sequence
  Description of Artificial Sequence: Synthetic peptide
HHDASPN

SEQ ID NO: 25952 - protein, 7 aa, Artificial Sequence
  Description of Artificial Sequence: Synthetic peptide
DVLSKSQ

SEQ ID NO: 25953 - protein, 7 aa, Artificial Sequence
  Description of Artificial Sequence: Synthetic peptide
HPETAFK

SEQ ID NO: 25954 - protein, 7 aa, Artificial Sequence
  Description of Artificial Sequence: Synthetic peptide
RAGGNAV

SEQ ID NO: 25955 - protein, 7 aa, Artificial Sequence
  Description of Artificial Sequence: Synthetic peptide
VGGGRDN

SEQ ID NO: 25956 - protein, 7 aa, Artificial Sequence
  Description of Artificial Sequence: Synthetic peptide
CTTRQGN

SEQ ID NO: 25957 - protein, 7 aa, Artificial Sequence
  Description of Artificial Sequence: Synthetic peptide
YGSNTPT

SEQ ID NO: 25958 - protein, 7 aa, Artificial Sequence
  Description of Artificial Sequence: Synthetic peptide
GPMRPFQ

SEQ ID NO: 25959 - protein, 7 aa, Artificial Sequence
  Description of Artificial Sequence: Synthetic peptide
DRHNTTS

SEQ ID NO: 25960 - protein, 7 aa, Artificial Sequence
  Description of Artificial Sequence: Synthetic peptide
LPHHTSA

SEQ ID NO: 25961 - protein, 7 aa, Artificial Sequence
  Description of Artificial Sequence: Synthetic peptide
RTVDSSD

SEQ ID NO: 25962 - protein, 7 aa, Artificial Sequence
  Description of Artificial Sequence: Synthetic peptide
SVHSNAI

SEQ ID NO: 25963 - protein, 7 aa, Artificial Sequence
  Description of Artificial Sequence: Synthetic peptide
EGPSSPH

SEQ ID NO: 25964 - protein, 7 aa, Artificial Sequence
  Description of Artificial Sequence: Synthetic peptide
TFSKGTN

SEQ ID NO: 25965 - protein, 7 aa, Artificial Sequence
  Description of Artificial Sequence: Synthetic peptide
SSPVRNT

SEQ ID NO: 25966 - protein, 7 aa, Artificial Sequence
  Description of Artificial Sequence: Synthetic peptide
NSSSSNH

SEQ ID NO: 25967 - protein, 7 aa, Artificial Sequence
  Description of Artificial Sequence: Synthetic peptide
DRSATVK

SEQ ID NO: 25968 - protein, 7 aa, Artificial Sequence
  Description of Artificial Sequence: Synthetic peptide
SVPGVSR

SEQ ID NO: 25969 - protein, 7 aa, Artificial Sequence
  Description of Artificial Sequence: Synthetic peptide
REGGQMV

SEQ ID NO: 25970 - protein, 7 aa, Artificial Sequence
  Description of Artificial Sequence: Synthetic peptide
LSTVNQN

SEQ ID NO: 25971 - protein, 7 aa, Artificial Sequence
  Description of Artificial Sequence: Synthetic peptide
RNTSDLA

SEQ ID NO: 25972 - protein, 7 aa, Artificial Sequence
  Description of Artificial Sequence: Synthetic peptide
NGSGLNQ

SEQ ID NO: 25973 - protein, 7 aa, Artificial Sequence
  Description of Artificial Sequence: Synthetic peptide
PGLRDTA

SEQ ID NO: 25974 - protein, 7 aa, Artificial Sequence
  Description of Artificial Sequence: Synthetic peptide
MSTHSSG

SEQ ID NO: 25975 - protein, 7 aa, Artificial Sequence
  Description of Artificial Sequence: Synthetic peptide
VSTGKSV

SEQ ID NO: 25976 - protein, 7 aa, Artificial Sequence
  Description of Artificial Sequence: Synthetic peptide
NPSMAMK

SEQ ID NO: 25977 - protein, 7 aa, Artificial Sequence
  Description of Artificial Sequence: Synthetic peptide
RLPENVR

SEQ ID NO: 25978 - protein, 7 aa, Artificial Sequence
  Description of Artificial Sequence: Synthetic peptide
RPDRTTL

SEQ ID NO: 25979 - protein, 7 aa, Artificial Sequence
  Description of Artificial Sequence: Synthetic peptide
SRETVPT

SEQ ID NO: 25980 - protein, 7 aa, Artificial Sequence
  Description of Artificial Sequence: Synthetic peptide
DPHNTSR

SEQ ID NO: 25981 - protein, 7 aa, Artificial Sequence
  Description of Artificial Sequence: Synthetic peptide
RDGGQDR

SEQ ID NO: 25982 - protein, 7 aa, Artificial Sequence
  Description of Artificial Sequence: Synthetic peptide
SFDSKPP

SEQ ID NO: 25983 - protein, 7 aa, Artificial Sequence
  Description of Artificial Sequence: Synthetic peptide
SNATRSS

SEQ ID NO: 25984 - protein, 7 aa, Artificial Sequence
  Description of Artificial Sequence: Synthetic peptide
PQNLAHV

SEQ ID NO: 25985 - protein, 7 aa, Artificial Sequence
  Description of Artificial Sequence: Synthetic peptide
NTGSGSR

SEQ ID NO: 25986 - protein, 7 aa, Artificial Sequence
  Description of Artificial Sequence: Synthetic peptide
MNSGPKV

SEQ ID NO: 25987 - protein, 7 aa, Artificial Sequence
  Description of Artificial Sequence: Synthetic peptide
QSGPGVT

SEQ ID NO: 25988 - protein, 7 aa, Artificial Sequence
  Description of Artificial Sequence: Synthetic peptide
KQGGPTG

SEQ ID NO: 25989 - protein, 7 aa, Artificial Sequence
  Description of Artificial Sequence: Synthetic peptide
TGSGSNH

SEQ ID NO: 25990 - protein, 7 aa, Artificial Sequence
  Description of Artificial Sequence: Synthetic peptide
PANHKTM

SEQ ID NO: 25991 - protein, 7 aa, Artificial Sequence
  Description of Artificial Sequence: Synthetic peptide
APSAGNS

SEQ ID NO: 25992 - protein, 7 aa, Artificial Sequence
  Description of Artificial Sequence: Synthetic peptide
LSLNKSQ

SEQ ID NO: 25993 - protein, 7 aa, Artificial Sequence
  Description of Artificial Sequence: Synthetic peptide
PGASGKV

SEQ ID NO: 25994 - protein, 7 aa, Artificial Sequence
  Description of Artificial Sequence: Synthetic peptide
LRSAPSI

SEQ ID NO: 25995 - protein, 7 aa, Artificial Sequence
  Description of Artificial Sequence: Synthetic peptide
SMASAYK

SEQ ID NO: 25996 - protein, 7 aa, Artificial Sequence
  Description of Artificial Sequence: Synthetic peptide
PYAGTSP

SEQ ID NO: 25997 - protein, 7 aa, Artificial Sequence
  Description of Artificial Sequence: Synthetic peptide
VNKINGS

SEQ ID NO: 25998 - protein, 7 aa, Artificial Sequence
  Description of Artificial Sequence: Synthetic peptide
LPTVTRS

SEQ ID NO: 25999 - protein, 7 aa, Artificial Sequence
  Description of Artificial Sequence: Synthetic peptide
NPGSGYG

SEQ ID NO: 26000 - protein, 7 aa, Artificial Sequence
  Description of Artificial Sequence: Synthetic peptide
QPNSGTT

SEQ ID NO: 26001 - protein, 7 aa, Artificial Sequence
  Description of Artificial Sequence: Synthetic peptide
LGNAHQL

SEQ ID NO: 26002 - protein, 7 aa, Artificial Sequence
  Description of Artificial Sequence: Synthetic peptide
RTQSLTA

SEQ ID NO: 26003 - protein, 7 aa, Artificial Sequence
  Description of Artificial Sequence: Synthetic peptide
SGAPGSS

SEQ ID NO: 26004 - protein, 7 aa, Artificial Sequence
  Description of Artificial Sequence: Synthetic peptide
NLTSSSS

SEQ ID NO: 26005 - protein, 7 aa, Artificial Sequence
  Description of Artificial Sequence: Synthetic peptide
PFSHSVA

SEQ ID NO: 26006 - protein, 7 aa, Artificial Sequence
  Description of Artificial Sequence: Synthetic peptide
LLKNDAS

SEQ ID NO: 26007 - protein, 7 aa, Artificial Sequence
  Description of Artificial Sequence: Synthetic peptide
VRESRSS

SEQ ID NO: 26008 - protein, 7 aa, Artificial Sequence
  Description of Artificial Sequence: Synthetic peptide
REPMKGS

SEQ ID NO: 26009 - protein, 7 aa, Artificial Sequence
  Description of Artificial Sequence: Synthetic peptide
VQQSKAY

SEQ ID NO: 26010 - protein, 7 aa, Artificial Sequence
  Description of Artificial Sequence: Synthetic peptide
KSADQGR

SEQ ID NO: 26011 - protein, 7 aa, Artificial Sequence
  Description of Artificial Sequence: Synthetic peptide
GTGTPRT

SEQ ID NO: 26012 - protein, 7 aa, Artificial Sequence
  Description of Artificial Sequence: Synthetic peptide
QNTPKST

SEQ ID NO: 26013 - protein, 7 aa, Artificial Sequence
  Description of Artificial Sequence: Synthetic peptide
SRDSSIH

SEQ ID NO: 26014 - protein, 7 aa, Artificial Sequence
  Description of Artificial Sequence: Synthetic peptide
HTANSQS

SEQ ID NO: 26015 - protein, 7 aa, Artificial Sequence
  Description of Artificial Sequence: Synthetic peptide
TQQHGSN

SEQ ID NO: 26016 - protein, 7 aa, Artificial Sequence
  Description of Artificial Sequence: Synthetic peptide
STSKDYT

SEQ ID NO: 26017 - protein, 7 aa, Artificial Sequence
  Description of Artificial Sequence: Synthetic peptide
LPGVRVA

SEQ ID NO: 26018 - protein, 7 aa, Artificial Sequence
  Description of Artificial Sequence: Synthetic peptide
SLPGESK

SEQ ID NO: 26019 - protein, 7 aa, Artificial Sequence
  Description of Artificial Sequence: Synthetic peptide
HTSPGKN

SEQ ID NO: 26020 - protein, 7 aa, Artificial Sequence
  Description of Artificial Sequence: Synthetic peptide
PVVGKMS

SEQ ID NO: 26021 - protein, 7 aa, Artificial Sequence
  Description of Artificial Sequence: Synthetic peptide
PSLERGS

SEQ ID NO: 26022 - protein, 7 aa, Artificial Sequence
  Description of Artificial Sequence: Synthetic peptide
YINSPSN

SEQ ID NO: 26023 - protein, 7 aa, Artificial Sequence
  Description of Artificial Sequence: Synthetic peptide
SSQAQPT

SEQ ID NO: 26024 - protein, 7 aa, Artificial Sequence
  Description of Artificial Sequence: Synthetic peptide
DPVRKTS

SEQ ID NO: 26025 - protein, 7 aa, Artificial Sequence
  Description of Artificial Sequence: Synthetic peptide
NSHNGAS

SEQ ID NO: 26026 - protein, 7 aa, Artificial Sequence
  Description of Artificial Sequence: Synthetic peptide
PGPEVGR

SEQ ID NO: 26027 - protein, 7 aa, Artificial Sequence
  Description of Artificial Sequence: Synthetic peptide
LPITARN

SEQ ID NO: 26028 - protein, 7 aa, Artificial Sequence
  Description of Artificial Sequence: Synthetic peptide
VASQPVR

SEQ ID NO: 26029 - protein, 7 aa, Artificial Sequence
  Description of Artificial Sequence: Synthetic peptide
NLSSSGG

SEQ ID NO: 26030 - protein, 7 aa, Artificial Sequence
  Description of Artificial Sequence: Synthetic peptide
ERNGNFT

SEQ ID NO: 26031 - protein, 7 aa, Artificial Sequence
  Description of Artificial Sequence: Synthetic peptide
PGSSNRN

SEQ ID NO: 26032 - protein, 7 aa, Artificial Sequence
  Description of Artificial Sequence: Synthetic peptide
KRMDKSS

SEQ ID NO: 26033 - protein, 7 aa, Artificial Sequence
  Description of Artificial Sequence: Synthetic peptide
VKCSGCS

SEQ ID NO: 26034 - protein, 7 aa, Artificial Sequence
  Description of Artificial Sequence: Synthetic peptide
CVLPSGN

SEQ ID NO: 26035 - protein, 7 aa, Artificial Sequence
  Description of Artificial Sequence: Synthetic peptide
FTSNKAS

SEQ ID NO: 26036 - protein, 7 aa, Artificial Sequence
  Description of Artificial Sequence: Synthetic peptide
LSSDKNV

SEQ ID NO: 26037 - protein, 7 aa, Artificial Sequence
  Description of Artificial Sequence: Synthetic peptide
SSSTHAV

SEQ ID NO: 26038 - protein, 7 aa, Artificial Sequence
  Description of Artificial Sequence: Synthetic peptide
TNPKSSS

SEQ ID NO: 26039 - protein, 7 aa, Artificial Sequence
  Description of Artificial Sequence: Synthetic peptide
SSEQTTR

SEQ ID NO: 26040 - protein, 7 aa, Artificial Sequence
  Description of Artificial Sequence: Synthetic peptide
EPLQGSR

SEQ ID NO: 26041 - protein, 7 aa, Artificial Sequence
  Description of Artificial Sequence: Synthetic peptide
SKTGTSL

SEQ ID NO: 26042 - protein, 7 aa, Artificial Sequence
  Description of Artificial Sequence: Synthetic peptide
RVVNRGD

SEQ ID NO: 26043 - protein, 7 aa, Artificial Sequence
  Description of Artificial Sequence: Synthetic peptide
PMSGTRL

SEQ ID NO: 26044 - protein, 7 aa, Artificial Sequence
  Description of Artificial Sequence: Synthetic peptide
TSNTKQG

SEQ ID NO: 26045 - protein, 7 aa, Artificial Sequence
  Description of Artificial Sequence: Synthetic peptide
GPNQSGR

SEQ ID NO: 26046 - protein, 7 aa, Artificial Sequence
  Description of Artificial Sequence: Synthetic peptide
TNPNPHR

SEQ ID NO: 26047 - protein, 7 aa, Artificial Sequence
  Description of Artificial Sequence: Synthetic peptide
PGREKTV

SEQ ID NO: 26048 - protein, 7 aa, Artificial Sequence
  Description of Artificial Sequence: Synthetic peptide
FANTANR

SEQ ID NO: 26049 - protein, 7 aa, Artificial Sequence
  Description of Artificial Sequence: Synthetic peptide
TVLGARG

SEQ ID NO: 26050 - protein, 7 aa, Artificial Sequence
  Description of Artificial Sequence: Synthetic peptide
NVTTPLI

SEQ ID NO: 26051 - protein, 7 aa, Artificial Sequence
  Description of Artificial Sequence: Synthetic peptide
YRASGIS

SEQ ID NO: 26052 - protein, 7 aa, Artificial Sequence
  Description of Artificial Sequence: Synthetic peptide
GSNRNPL

SEQ ID NO: 26053 - protein, 7 aa, Artificial Sequence
  Description of Artificial Sequence: Synthetic peptide
SRGQPPL

SEQ ID NO: 26054 - protein, 7 aa, Artificial Sequence
  Description of Artificial Sequence: Synthetic peptide
GVTGTHV

SEQ ID NO: 26055 - protein, 7 aa, Artificial Sequence
  Description of Artificial Sequence: Synthetic peptide
NLKTKGE

SEQ ID NO: 26056 - protein, 7 aa, Artificial Sequence
  Description of Artificial Sequence: Synthetic peptide
RSPGSNT

SEQ ID NO: 26057 - protein, 7 aa, Artificial Sequence
  Description of Artificial Sequence: Synthetic peptide
WGTGIGS

SEQ ID NO: 26058 - protein, 7 aa, Artificial Sequence
  Description of Artificial Sequence: Synthetic peptide
GSISTAH

SEQ ID NO: 26059 - protein, 7 aa, Artificial Sequence
  Description of Artificial Sequence: Synthetic peptide
LPGQGVG

SEQ ID NO: 26060 - protein, 7 aa, Artificial Sequence
  Description of Artificial Sequence: Synthetic peptide
NSGKPNA

SEQ ID NO: 26061 - protein, 7 aa, Artificial Sequence
  Description of Artificial Sequence: Synthetic peptide
FASRPVQ

SEQ ID NO: 26062 - protein, 7 aa, Artificial Sequence
  Description of Artificial Sequence: Synthetic peptide
GQVKAIG

SEQ ID NO: 26063 - protein, 7 aa, Artificial Sequence
  Description of Artificial Sequence: Synthetic peptide
QSSRTVT

SEQ ID NO: 26064 - protein, 7 aa, Artificial Sequence
  Description of Artificial Sequence: Synthetic peptide
TSSPQPS

SEQ ID NO: 26065 - protein, 7 aa, Artificial Sequence
  Description of Artificial Sequence: Synthetic peptide
LGASTIL

SEQ ID NO: 26066 - protein, 7 aa, Artificial Sequence
  Description of Artificial Sequence: Synthetic peptide
NDQAKLT

SEQ ID NO: 26067 - protein, 7 aa, Artificial Sequence
  Description of Artificial Sequence: Synthetic peptide
TRSKESP

SEQ ID NO: 26068 - protein, 7 aa, Artificial Sequence
  Description of Artificial Sequence: Synthetic peptide
QGSGSNH

SEQ ID NO: 26069 - protein, 7 aa, Artificial Sequence
  Description of Artificial Sequence: Synthetic peptide
NSANKTP

SEQ ID NO: 26070 - protein, 7 aa, Artificial Sequence
  Description of Artificial Sequence: Synthetic peptide
ATHNSSQ

SEQ ID NO: 26071 - protein, 7 aa, Artificial Sequence
  Description of Artificial Sequence: Synthetic peptide
FPVNGLS

SEQ ID NO: 26072 - protein, 7 aa, Artificial Sequence
  Description of Artificial Sequence: Synthetic peptide
SVGSGAL

SEQ ID NO: 26073 - protein, 7 aa, Artificial Sequence
  Description of Artificial Sequence: Synthetic peptide
QGSSLRT

SEQ ID NO: 26074 - protein, 7 aa, Artificial Sequence
  Description of Artificial Sequence: Synthetic peptide
SRVDQYK

SEQ ID NO: 26075 - protein, 7 aa, Artificial Sequence
  Description of Artificial Sequence: Synthetic peptide
PLAAGGT

SEQ ID NO: 26076 - protein, 7 aa, Artificial Sequence
  Description of Artificial Sequence: Synthetic peptide
IKQSSSA

SEQ ID NO: 26077 - protein, 7 aa, Artificial Sequence
  Description of Artificial Sequence: Synthetic peptide
TPSMRNT

SEQ ID NO: 26078 - protein, 7 aa, Artificial Sequence
  Description of Artificial Sequence: Synthetic peptide
TRMNKQT

SEQ ID NO: 26079 - protein, 7 aa, Artificial Sequence
  Description of Artificial Sequence: Synthetic peptide
DFSEKRL

SEQ ID NO: 26080 - protein, 7 aa, Artificial Sequence
  Description of Artificial Sequence: Synthetic peptide
SAYERTS

SEQ ID NO: 26081 - protein, 7 aa, Artificial Sequence
  Description of Artificial Sequence: Synthetic peptide
STSGTSS

SEQ ID NO: 26082 - protein, 7 aa, Artificial Sequence
  Description of Artificial Sequence: Synthetic peptide
GTTSSRD

SEQ ID NO: 26083 - protein, 7 aa, Artificial Sequence
  Description of Artificial Sequence: Synthetic peptide
QSTPRMG

SEQ ID NO: 26084 - protein, 7 aa, Artificial Sequence
  Description of Artificial Sequence: Synthetic peptide
GQVKALG

SEQ ID NO: 26085 - protein, 7 aa, Artificial Sequence
  Description of Artificial Sequence: Synthetic peptide
VGTKAAT

SEQ ID NO: 26086 - protein, 7 aa, Artificial Sequence
  Description of Artificial Sequence: Synthetic peptide
SDMSGQR

SEQ ID NO: 26087 - protein, 7 aa, Artificial Sequence
  Description of Artificial Sequence: Synthetic peptide
PISHTTG

SEQ ID NO: 26088 - protein, 7 aa, Artificial Sequence
  Description of Artificial Sequence: Synthetic peptide
GSSPSLR

SEQ ID NO: 26089 - protein, 7 aa, Artificial Sequence
  Description of Artificial Sequence: Synthetic peptide
LSSNRHN

SEQ ID NO: 26090 - protein, 7 aa, Artificial Sequence
  Description of Artificial Sequence: Synthetic peptide
HTHDVGK

SEQ ID NO: 26091 - protein, 7 aa, Artificial Sequence
  Description of Artificial Sequence: Synthetic peptide
GLKNEPA

SEQ ID NO: 26092 - protein, 7 aa, Artificial Sequence
  Description of Artificial Sequence: Synthetic peptide
SRIGMST

SEQ ID NO: 26093 - protein, 7 aa, Artificial Sequence
  Description of Artificial Sequence: Synthetic peptide
TANSPAT

SEQ ID NO: 26094 - protein, 7 aa, Artificial Sequence
  Description of Artificial Sequence: Synthetic peptide
SVEKAQS

SEQ ID NO: 26095 - protein, 7 aa, Artificial Sequence
  Description of Artificial Sequence: Synthetic peptide
VSGMSGS

SEQ ID NO: 26096 - protein, 7 aa, Artificial Sequence
  Description of Artificial Sequence: Synthetic peptide
HTSSNSL

SEQ ID NO: 26097 - protein, 7 aa, Artificial Sequence
  Description of Artificial Sequence: Synthetic peptide
GSPNHSS

SEQ ID NO: 26098 - protein, 7 aa, Artificial Sequence
  Description of Artificial Sequence: Synthetic peptide
GQAMPFK

SEQ ID NO: 26099 - protein, 7 aa, Artificial Sequence
  Description of Artificial Sequence: Synthetic peptide
RMKSLDN

SEQ ID NO: 26100 - protein, 7 aa, Artificial Sequence
  Description of Artificial Sequence: Synthetic peptide
YRSAANS

SEQ ID NO: 26101 - protein, 7 aa, Artificial Sequence
  Description of Artificial Sequence: Synthetic peptide
LGTSHQQ

SEQ ID NO: 26102 - protein, 7 aa, Artificial Sequence
  Description of Artificial Sequence: Synthetic peptide
NISTRQS

SEQ ID NO: 26103 - protein, 7 aa, Artificial Sequence
  Description of Artificial Sequence: Synthetic peptide
PGINTNS

SEQ ID NO: 26104 - protein, 7 aa, Artificial Sequence
  Description of Artificial Sequence: Synthetic peptide
MEIKPNR

SEQ ID NO: 26105 - protein, 7 aa, Artificial Sequence
  Description of Artificial Sequence: Synthetic peptide
LPQDRVG

SEQ ID NO: 26106 - protein, 7 aa, Artificial Sequence
  Description of Artificial Sequence: Synthetic peptide
EGLNTSR

SEQ ID NO: 26107 - protein, 7 aa, Artificial Sequence
  Description of Artificial Sequence: Synthetic peptide
FHVGASS

SEQ ID NO: 26108 - protein, 7 aa, Artificial Sequence
  Description of Artificial Sequence: Synthetic peptide
GPSSPRL

SEQ ID NO: 26109 - protein, 7 aa, Artificial Sequence
  Description of Artificial Sequence: Synthetic peptide
DSTHRAT

SEQ ID NO: 26110 - protein, 7 aa, Artificial Sequence
  Description of Artificial Sequence: Synthetic peptide
PPTDSGL

SEQ ID NO: 26111 - protein, 7 aa, Artificial Sequence
  Description of Artificial Sequence: Synthetic peptide
TATTLSS

SEQ ID NO: 26112 - protein, 7 aa, Artificial Sequence
  Description of Artificial Sequence: Synthetic peptide
LKSVSGQ

SEQ ID NO: 26113 - protein, 7 aa, Artificial Sequence
  Description of Artificial Sequence: Synthetic peptide
PLQTSRT

SEQ ID NO: 26114 - protein, 7 aa, Artificial Sequence
  Description of Artificial Sequence: Synthetic peptide
ATGNGRG

SEQ ID NO: 26115 - protein, 7 aa, Artificial Sequence
  Description of Artificial Sequence: Synthetic peptide
DLHVQKA

SEQ ID NO: 26116 - protein, 7 aa, Artificial Sequence
  Description of Artificial Sequence: Synthetic peptide
PGTKQSS

SEQ ID NO: 26117 - protein, 7 aa, Artificial Sequence
  Description of Artificial Sequence: Synthetic peptide
ASRDRAG

SEQ ID NO: 26118 - protein, 7 aa, Artificial Sequence
  Description of Artificial Sequence: Synthetic peptide
FNSSSSK

SEQ ID NO: 26119 - protein, 7 aa, Artificial Sequence
  Description of Artificial Sequence: Synthetic peptide
SSSAKSI

SEQ ID NO: 26120 - protein, 7 aa, Artificial Sequence
  Description of Artificial Sequence: Synthetic peptide
GRAQLAS

SEQ ID NO: 26121 - protein, 7 aa, Artificial Sequence
  Description of Artificial Sequence: Synthetic peptide
FVNTSAQ

SEQ ID NO: 26122 - protein, 7 aa, Artificial Sequence
  Description of Artificial Sequence: Synthetic peptide
RNQGALQ

SEQ ID NO: 26123 - protein, 7 aa, Artificial Sequence
  Description of Artificial Sequence: Synthetic peptide
DLPHHTR

SEQ ID NO: 26124 - protein, 7 aa, Artificial Sequence
  Description of Artificial Sequence: Synthetic peptide
YLKTGDN

SEQ ID NO: 26125 - protein, 7 aa, Artificial Sequence
  Description of Artificial Sequence: Synthetic peptide
RPSSTHA

SEQ ID NO: 26126 - protein, 7 aa, Artificial Sequence
  Description of Artificial Sequence: Synthetic peptide
ILGNKSS

SEQ ID NO: 26127 - protein, 7 aa, Artificial Sequence
  Description of Artificial Sequence: Synthetic peptide
GLAGRLS

SEQ ID NO: 26128 - protein, 7 aa, Artificial Sequence
  Description of Artificial Sequence: Synthetic peptide
TNGGRVT

SEQ ID NO: 26129 - protein, 7 aa, Artificial Sequence
  Description of Artificial Sequence: Synthetic peptide
TGMSNNR

SEQ ID NO: 26130 - protein, 7 aa, Artificial Sequence
  Description of Artificial Sequence: Synthetic peptide
PKLSHTG

SEQ ID NO: 26131 - protein, 7 aa, Artificial Sequence
  Description of Artificial Sequence: Synthetic peptide
SIGKGYN

SEQ ID NO: 26132 - protein, 7 aa, Artificial Sequence
  Description of Artificial Sequence: Synthetic peptide
TTMSKPS

SEQ ID NO: 26133 - protein, 7 aa, Artificial Sequence
  Description of Artificial Sequence: Synthetic peptide
TERTKAT

SEQ ID NO: 26134 - protein, 7 aa, Artificial Sequence
  Description of Artificial Sequence: Synthetic peptide
VSSNASM

SEQ ID NO: 26135 - protein, 7 aa, Artificial Sequence
  Description of Artificial Sequence: Synthetic peptide
PNLQSSK

SEQ ID NO: 26136 - protein, 7 aa, Artificial Sequence
  Description of Artificial Sequence: Synthetic peptide
SPGNVRK

SEQ ID NO: 26137 - protein, 7 aa, Artificial Sequence
  Description of Artificial Sequence: Synthetic peptide
QGSSKTT

SEQ ID NO: 26138 - protein, 7 aa, Artificial Sequence
  Description of Artificial Sequence: Synthetic peptide
NAVRSEN

SEQ ID NO: 26139 - protein, 7 aa, Artificial Sequence
  Description of Artificial Sequence: Synthetic peptide
TEARSAN

SEQ ID NO: 26140 - protein, 7 aa, Artificial Sequence
  Description of Artificial Sequence: Synthetic peptide
LTTHGMK

SEQ ID NO: 26141 - protein, 7 aa, Artificial Sequence
  Description of Artificial Sequence: Synthetic peptide
RQNGGVK

SEQ ID NO: 26142 - protein, 7 aa, Artificial Sequence
  Description of Artificial Sequence: Synthetic peptide
RVSDRHI

SEQ ID NO: 26143 - protein, 7 aa, Artificial Sequence
  Description of Artificial Sequence: Synthetic peptide
EGSSGRR

SEQ ID NO: 26144 - protein, 7 aa, Artificial Sequence
  Description of Artificial Sequence: Synthetic peptide
RGDTKNL

SEQ ID NO: 26145 - protein, 7 aa, Artificial Sequence
  Description of Artificial Sequence: Synthetic peptide
NINSRLA

SEQ ID NO: 26146 - protein, 7 aa, Artificial Sequence
  Description of Artificial Sequence: Synthetic peptide
TSRGNLS

SEQ ID NO: 26147 - protein, 7 aa, Artificial Sequence
  Description of Artificial Sequence: Synthetic peptide
NGSARMT

SEQ ID NO: 26148 - protein, 7 aa, Artificial Sequence
  Description of Artificial Sequence: Synthetic peptide
GSSPKLT

SEQ ID NO: 26149 - protein, 7 aa, Artificial Sequence
  Description of Artificial Sequence: Synthetic peptide
YQNKSLT

SEQ ID NO: 26150 - protein, 7 aa, Artificial Sequence
  Description of Artificial Sequence: Synthetic peptide
SPLLDYK

SEQ ID NO: 26151 - protein, 7 aa, Artificial Sequence
  Description of Artificial Sequence: Synthetic peptide
PSNTGTI

SEQ ID NO: 26152 - protein, 7 aa, Artificial Sequence
  Description of Artificial Sequence: Synthetic peptide
SATKSSC

SEQ ID NO: 26153 - protein, 7 aa, Artificial Sequence
  Description of Artificial Sequence: Synthetic peptide
QNLNSFS

SEQ ID NO: 26154 - protein, 7 aa, Artificial Sequence
  Description of Artificial Sequence: Synthetic peptide
GSASIEK

SEQ ID NO: 26155 - protein, 7 aa, Artificial Sequence
  Description of Artificial Sequence: Synthetic peptide
YRPVSVQ

SEQ ID NO: 26156 - protein, 7 aa, Artificial Sequence
  Description of Artificial Sequence: Synthetic peptide
FRTTAST

SEQ ID NO: 26157 - protein, 7 aa, Artificial Sequence
  Description of Artificial Sequence: Synthetic peptide
NNAATHS

SEQ ID NO: 26158 - protein, 7 aa, Artificial Sequence
  Description of Artificial Sequence: Synthetic peptide
TQRSQAA

SEQ ID NO: 26159 - protein, 7 aa, Artificial Sequence
  Description of Artificial Sequence: Synthetic peptide
PGSAMLN

SEQ ID NO: 26160 - protein, 7 aa, Artificial Sequence
  Description of Artificial Sequence: Synthetic peptide
PYKGNGL

SEQ ID NO: 26161 - protein, 7 aa, Artificial Sequence
  Description of Artificial Sequence: Synthetic peptide
ISSGTHG

SEQ ID NO: 26162 - protein, 7 aa, Artificial Sequence
  Description of Artificial Sequence: Synthetic peptide
QNLPKAS

SEQ ID NO: 26163 - protein, 7 aa, Artificial Sequence
  Description of Artificial Sequence: Synthetic peptide
NPSHTSV

SEQ ID NO: 26164 - protein, 7 aa, Artificial Sequence
  Description of Artificial Sequence: Synthetic peptide
YQMTTPQ

SEQ ID NO: 26165 - protein, 7 aa, Artificial Sequence
  Description of Artificial Sequence: Synthetic peptide
DSSTRGQ

SEQ ID NO: 26166 - protein, 7 aa, Artificial Sequence
  Description of Artificial Sequence: Synthetic peptide
QGHSSFL

SEQ ID NO: 26167 - protein, 7 aa, Artificial Sequence
  Description of Artificial Sequence: Synthetic peptide
TSSGNLS

SEQ ID NO: 26168 - protein, 7 aa, Artificial Sequence
  Description of Artificial Sequence: Synthetic peptide
SLTSTGK

SEQ ID NO: 26169 - protein, 7 aa, Artificial Sequence
  Description of Artificial Sequence: Synthetic peptide
GTDSKRH

SEQ ID NO: 26170 - protein, 7 aa, Artificial Sequence
  Description of Artificial Sequence: Synthetic peptide
EGNRSNM

SEQ ID NO: 26171 - protein, 7 aa, Artificial Sequence
  Description of Artificial Sequence: Synthetic peptide
YNRTSIV

SEQ ID NO: 26172 - protein, 7 aa, Artificial Sequence
  Description of Artificial Sequence: Synthetic peptide
SLNAPNR

SEQ ID NO: 26173 - protein, 7 aa, Artificial Sequence
  Description of Artificial Sequence: Synthetic peptide
VLSSSPK

SEQ ID NO: 26174 - protein, 7 aa, Artificial Sequence
  Description of Artificial Sequence: Synthetic peptide
PGQKQGI

SEQ ID NO: 26175 - protein, 7 aa, Artificial Sequence
  Description of Artificial Sequence: Synthetic peptide
ETRKQGV

SEQ ID NO: 26176 - protein, 7 aa, Artificial Sequence
  Description of Artificial Sequence: Synthetic peptide
TPQNVRN

SEQ ID NO: 26177 - protein, 7 aa, Artificial Sequence
  Description of Artificial Sequence: Synthetic peptide
QDATPRS

SEQ ID NO: 26178 - protein, 7 aa, Artificial Sequence
  Description of Artificial Sequence: Synthetic peptide
SPNANSV

SEQ ID NO: 26179 - protein, 7 aa, Artificial Sequence
  Description of Artificial Sequence: Synthetic peptide
QDMRLSG

SEQ ID NO: 26180 - protein, 7 aa, Artificial Sequence
  Description of Artificial Sequence: Synthetic peptide
NRVKPMV

SEQ ID NO: 26181 - protein, 7 aa, Artificial Sequence
  Description of Artificial Sequence: Synthetic peptide
PGESGKV

SEQ ID NO: 26182 - protein, 7 aa, Artificial Sequence
  Description of Artificial Sequence: Synthetic peptide
YRNVNAM

SEQ ID NO: 26183 - protein, 7 aa, Artificial Sequence
  Description of Artificial Sequence: Synthetic peptide
FPSVSTT

SEQ ID NO: 26184 - protein, 7 aa, Artificial Sequence
  Description of Artificial Sequence: Synthetic peptide
STVATSF

SEQ ID NO: 26185 - protein, 7 aa, Artificial Sequence
  Description of Artificial Sequence: Synthetic peptide
PSARMSG

SEQ ID NO: 26186 - protein, 7 aa, Artificial Sequence
  Description of Artificial Sequence: Synthetic peptide
HLRGSNT

SEQ ID NO: 26187 - protein, 7 aa, Artificial Sequence
  Description of Artificial Sequence: Synthetic peptide
VGAATIR

SEQ ID NO: 26188 - protein, 7 aa, Artificial Sequence
  Description of Artificial Sequence: Synthetic peptide
GSRDKST

SEQ ID NO: 26189 - protein, 7 aa, Artificial Sequence
  Description of Artificial Sequence: Synthetic peptide
RLVPASG

SEQ ID NO: 26190 - protein, 7 aa, Artificial Sequence
  Description of Artificial Sequence: Synthetic peptide
ISQSTTR

SEQ ID NO: 26191 - protein, 7 aa, Artificial Sequence
  Description of Artificial Sequence: Synthetic peptide
SSSAPRL

SEQ ID NO: 26192 - protein, 7 aa, Artificial Sequence
  Description of Artificial Sequence: Synthetic peptide
WMSGKNS

SEQ ID NO: 26193 - protein, 7 aa, Artificial Sequence
  Description of Artificial Sequence: Synthetic peptide
QHTTTNQ

SEQ ID NO: 26194 - protein, 7 aa, Artificial Sequence
  Description of Artificial Sequence: Synthetic peptide
YSGGTQQ

SEQ ID NO: 26195 - protein, 7 aa, Artificial Sequence
  Description of Artificial Sequence: Synthetic peptide
LLSAKGG

SEQ ID NO: 26196 - protein, 7 aa, Artificial Sequence
  Description of Artificial Sequence: Synthetic peptide
QEGVRSS

SEQ ID NO: 26197 - protein, 7 aa, Artificial Sequence
  Description of Artificial Sequence: Synthetic peptide
ASRAPPG

SEQ ID NO: 26198 - protein, 7 aa, Artificial Sequence
  Description of Artificial Sequence: Synthetic peptide
QRTVGTA

SEQ ID NO: 26199 - protein, 7 aa, Artificial Sequence
  Description of Artificial Sequence: Synthetic peptide
SSSTSPR

SEQ ID NO: 26200 - protein, 7 aa, Artificial Sequence
  Description of Artificial Sequence: Synthetic peptide
QTQGQLK

SEQ ID NO: 26201 - protein, 7 aa, Artificial Sequence
  Description of Artificial Sequence: Synthetic peptide
GPTDHKL

SEQ ID NO: 26202 - protein, 7 aa, Artificial Sequence
  Description of Artificial Sequence: Synthetic peptide
GVNNNIN

SEQ ID NO: 26203 - protein, 7 aa, Artificial Sequence
  Description of Artificial Sequence: Synthetic peptide
AGRASNT

SEQ ID NO: 26204 - protein, 7 aa, Artificial Sequence
  Description of Artificial Sequence: Synthetic peptide
SSAKSSL

SEQ ID NO: 26205 - protein, 7 aa, Artificial Sequence
  Description of Artificial Sequence: Synthetic peptide
TSKNAAM

SEQ ID NO: 26206 - protein, 7 aa, Artificial Sequence
  Description of Artificial Sequence: Synthetic peptide
AAQPSLK

SEQ ID NO: 26207 - protein, 7 aa, Artificial Sequence
  Description of Artificial Sequence: Synthetic peptide
HREIVMK

SEQ ID NO: 26208 - protein, 7 aa, Artificial Sequence
  Description of Artificial Sequence: Synthetic peptide
NNTQKNS

SEQ ID NO: 26209 - protein, 7 aa, Artificial Sequence
  Description of Artificial Sequence: Synthetic peptide
GARPVLQ

SEQ ID NO: 26210 - protein, 7 aa, Artificial Sequence
  Description of Artificial Sequence: Synthetic peptide
GGDNKLT

SEQ ID NO: 26211 - protein, 7 aa, Artificial Sequence
  Description of Artificial Sequence: Synthetic peptide
NCSGQNQ

SEQ ID NO: 26212 - protein, 7 aa, Artificial Sequence
  Description of Artificial Sequence: Synthetic peptide
NGSPGFY

SEQ ID NO: 26213 - protein, 7 aa, Artificial Sequence
  Description of Artificial Sequence: Synthetic peptide
RRQDTQE

SEQ ID NO: 26214 - protein, 7 aa, Artificial Sequence
  Description of Artificial Sequence: Synthetic peptide
ISGLDGN

SEQ ID NO: 26215 - protein, 7 aa, Artificial Sequence
  Description of Artificial Sequence: Synthetic peptide
NRNGFNN

SEQ ID NO: 26216 - protein, 7 aa, Artificial Sequence
  Description of Artificial Sequence: Synthetic peptide
NSSGQNQ

SEQ ID NO: 26217 - protein, 7 aa, Artificial Sequence
  Description of Artificial Sequence: Synthetic peptide
NNNSGSG

SEQ ID NO: 26218 - protein, 7 aa, Artificial Sequence
  Description of Artificial Sequence: Synthetic peptide
GLSPVLK

SEQ ID NO: 26219 - protein, 7 aa, Artificial Sequence
  Description of Artificial Sequence: Synthetic peptide
NGAGQNQ

SEQ ID NO: 26220 - protein, 7 aa, Artificial Sequence
  Description of Artificial Sequence: Synthetic peptide
NGSGQSQ

SEQ ID NO: 26221 - protein, 7 aa, Artificial Sequence
  Description of Artificial Sequence: Synthetic peptide
DFSEKRL

SEQ ID NO: 26222 - protein, 7 aa, Artificial Sequence
  Description of Artificial Sequence: Synthetic peptide
GTDNNTR

SEQ ID NO: 26223 - protein, 7 aa, Artificial Sequence
  Description of Artificial Sequence: Synthetic peptide
EVFSSQK

SEQ ID NO: 26224 - protein, 7 aa, Artificial Sequence
  Description of Artificial Sequence: Synthetic peptide
PSNTGTI

SEQ ID NO: 26225 - protein, 7 aa, Artificial Sequence
  Description of Artificial Sequence: Synthetic peptide
MGAGALT

SEQ ID NO: 26226 - protein, 7 aa, Artificial Sequence
  Description of Artificial Sequence: Synthetic peptide
FRSKESA

SEQ ID NO: 26227 - protein, 7 aa, Artificial Sequence
  Description of Artificial Sequence: Synthetic peptide
QQGVGNN

SEQ ID NO: 26228 - protein, 7 aa, Artificial Sequence
  Description of Artificial Sequence: Synthetic peptide
DSRNNMT

SEQ ID NO: 26229 - protein, 7 aa, Artificial Sequence
  Description of Artificial Sequence: Synthetic peptide
MSRSDPP

SEQ ID NO: 26230 - protein, 7 aa, Artificial Sequence
  Description of Artificial Sequence: Synthetic peptide
QYDSSSG

SEQ ID NO: 26231 - protein, 7 aa, Artificial Sequence
  Description of Artificial Sequence: Synthetic peptide
FNSSSGS

SEQ ID NO: 26232 - protein, 7 aa, Artificial Sequence
  Description of Artificial Sequence: Synthetic peptide
YPSSVQQ

SEQ ID NO: 26233 - protein, 7 aa, Artificial Sequence
  Description of Artificial Sequence: Synthetic peptide
NATSPRK

SEQ ID NO: 26234 - protein, 7 aa, Artificial Sequence
  Description of Artificial Sequence: Synthetic peptide
NGSGQIQ

SEQ ID NO: 26235 - protein, 7 aa, Artificial Sequence
  Description of Artificial Sequence: Synthetic peptide
RPESSYS

SEQ ID NO: 26236 - protein, 7 aa, Artificial Sequence
  Description of Artificial Sequence: Synthetic peptide
NAVRSEN

SEQ ID NO: 26237 - protein, 7 aa, Artificial Sequence
  Description of Artificial Sequence: Synthetic peptide
SVGSGAL

SEQ ID NO: 26238 - protein, 7 aa, Artificial Sequence
  Description of Artificial Sequence: Synthetic peptide
TTQTPYK

SEQ ID NO: 26239 - protein, 7 aa, Artificial Sequence
  Description of Artificial Sequence: Synthetic peptide
NGCGQNQ

SEQ ID NO: 26240 - protein, 7 aa, Artificial Sequence
  Description of Artificial Sequence: Synthetic peptide
YSDNKTT

SEQ ID NO: 26241 - protein, 7 aa, Artificial Sequence
  Description of Artificial Sequence: Synthetic peptide
MRQDTSK

SEQ ID NO: 26242 - protein, 7 aa, Artificial Sequence
  Description of Artificial Sequence: Synthetic peptide
LNSGNGS

SEQ ID NO: 26243 - protein, 7 aa, Artificial Sequence
  Description of Artificial Sequence: Synthetic peptide
SSNEKDR

SEQ ID NO: 26244 - protein, 7 aa, Artificial Sequence
  Description of Artificial Sequence: Synthetic peptide
LPSGNTS

SEQ ID NO: 26245 - protein, 7 aa, Artificial Sequence
  Description of Artificial Sequence: Synthetic peptide
NPGHKLT

SEQ ID NO: 26246 - protein, 7 aa, Artificial Sequence
  Description of Artificial Sequence: Synthetic peptide
QTSSHAY

SEQ ID NO: 26247 - protein, 7 aa, Artificial Sequence
  Description of Artificial Sequence: Synthetic peptide
SNNGTQK

SEQ ID NO: 26248 - protein, 7 aa, Artificial Sequence
  Description of Artificial Sequence: Synthetic peptide
GDHNRIN

SEQ ID NO: 26249 - protein, 7 aa, Artificial Sequence
  Description of Artificial Sequence: Synthetic peptide
VSGTKIE

SEQ ID NO: 26250 - protein, 7 aa, Artificial Sequence
  Description of Artificial Sequence: Synthetic peptide
VGEAGKA

SEQ ID NO: 26251 - protein, 7 aa, Artificial Sequence
  Description of Artificial Sequence: Synthetic peptide
IAGRGLG

SEQ ID NO: 26252 - protein, 7 aa, Artificial Sequence
  Description of Artificial Sequence: Synthetic peptide
NVLGREG

SEQ ID NO: 26253 - protein, 7 aa, Artificial Sequence
  Description of Artificial Sequence: Synthetic peptide
SGQHSLN

SEQ ID NO: 26254 - protein, 7 aa, Artificial Sequence
  Description of Artificial Sequence: Synthetic peptide
NGSGQTQ

SEQ ID NO: 26255 - protein, 7 aa, Artificial Sequence
  Description of Artificial Sequence: Synthetic peptide
DMVSPRN

SEQ ID NO: 26256 - protein, 7 aa, Artificial Sequence
  Description of Artificial Sequence: Synthetic peptide
MTTQLNS

SEQ ID NO: 26257 - protein, 7 aa, Artificial Sequence
  Description of Artificial Sequence: Synthetic peptide
QTPVSAP

SEQ ID NO: 26258 - protein, 7 aa, Artificial Sequence
  Description of Artificial Sequence: Synthetic peptide
NVATLSA

SEQ ID NO: 26259 - protein, 7 aa, Artificial Sequence
  Description of Artificial Sequence: Synthetic peptide
SADHIRN

SEQ ID NO: 26260 - protein, 7 aa, Artificial Sequence
  Description of Artificial Sequence: Synthetic peptide
SVSTNFS

SEQ ID NO: 26261 - protein, 7 aa, Artificial Sequence
  Description of Artificial Sequence: Synthetic peptide
NDSGQNQ

SEQ ID NO: 26262 - protein, 7 aa, Artificial Sequence
  Description of Artificial Sequence: Synthetic peptide
ATGSPSK

SEQ ID NO: 26263 - protein, 7 aa, Artificial Sequence
  Description of Artificial Sequence: Synthetic peptide
TQQHGSN

SEQ ID NO: 26264 - protein, 7 aa, Artificial Sequence
  Description of Artificial Sequence: Synthetic peptide
ENRTSVQ

SEQ ID NO: 26265 - protein, 7 aa, Artificial Sequence
  Description of Artificial Sequence: Synthetic peptide
TSQVSHG

SEQ ID NO: 26266 - protein, 7 aa, Artificial Sequence
  Description of Artificial Sequence: Synthetic peptide
DRVLSQG

SEQ ID NO: 26267 - protein, 7 aa, Artificial Sequence
  Description of Artificial Sequence: Synthetic peptide
DSGSSTK

SEQ ID NO: 26268 - protein, 7 aa, Artificial Sequence
  Description of Artificial Sequence: Synthetic peptide
PTHASSL

SEQ ID NO: 26269 - protein, 7 aa, Artificial Sequence
  Description of Artificial Sequence: Synthetic peptide
NGSGQNP

SEQ ID NO: 26270 - protein, 7 aa, Artificial Sequence
  Description of Artificial Sequence: Synthetic peptide
PNGAHVT

SEQ ID NO: 26271 - protein, 7 aa, Artificial Sequence
  Description of Artificial Sequence: Synthetic peptide
GAKESQS

SEQ ID NO: 26272 - protein, 7 aa, Artificial Sequence
  Description of Artificial Sequence: Synthetic peptide
GHDGQSR

SEQ ID NO: 26273 - protein, 7 aa, Artificial Sequence
  Description of Artificial Sequence: Synthetic peptide
RSYEGMQ

SEQ ID NO: 26274 - protein, 7 aa, Artificial Sequence
  Description of Artificial Sequence: Synthetic peptide
TTVGSGY

SEQ ID NO: 26275 - protein, 7 aa, Artificial Sequence
  Description of Artificial Sequence: Synthetic peptide
GIATTNR

SEQ ID NO: 26276 - protein, 7 aa, Artificial Sequence
  Description of Artificial Sequence: Synthetic peptide
SYSGTLG

SEQ ID NO: 26277 - protein, 7 aa, Artificial Sequence
  Description of Artificial Sequence: Synthetic peptide
FSTHEVS

SEQ ID NO: 26278 - protein, 7 aa, Artificial Sequence
  Description of Artificial Sequence: Synthetic peptide
ITGNQGV

SEQ ID NO: 26279 - protein, 7 aa, Artificial Sequence
  Description of Artificial Sequence: Synthetic peptide
STVGHMN

SEQ ID NO: 26280 - protein, 7 aa, Artificial Sequence
  Description of Artificial Sequence: Synthetic peptide
SGVKAFS

SEQ ID NO: 26281 - protein, 7 aa, Artificial Sequence
  Description of Artificial Sequence: Synthetic peptide
HKVPGSG

SEQ ID NO: 26282 - protein, 7 aa, Artificial Sequence
  Description of Artificial Sequence: Synthetic peptide
SNDSNKK

SEQ ID NO: 26283 - protein, 7 aa, Artificial Sequence
  Description of Artificial Sequence: Synthetic peptide
NNGASVV

SEQ ID NO: 26284 - protein, 7 aa, Artificial Sequence
  Description of Artificial Sequence: Synthetic peptide
TASPNNR

SEQ ID NO: 26285 - protein, 7 aa, Artificial Sequence
  Description of Artificial Sequence: Synthetic peptide
TNPKSSS

SEQ ID NO: 26286 - protein, 7 aa, Artificial Sequence
  Description of Artificial Sequence: Synthetic peptide
FNQHSSL

SEQ ID NO: 26287 - protein, 7 aa, Artificial Sequence
  Description of Artificial Sequence: Synthetic peptide
TPQNSVK

SEQ ID NO: 26288 - protein, 7 aa, Artificial Sequence
  Description of Artificial Sequence: Synthetic peptide
GGLSPKV

SEQ ID NO: 26289 - protein, 7 aa, Artificial Sequence
  Description of Artificial Sequence: Synthetic peptide
STGSVSK

SEQ ID NO: 26290 - protein, 7 aa, Artificial Sequence
  Description of Artificial Sequence: Synthetic peptide
TLPSNYM

SEQ ID NO: 26291 - protein, 7 aa, Artificial Sequence
  Description of Artificial Sequence: Synthetic peptide
MAAKPND

SEQ ID NO: 26292 - protein, 7 aa, Artificial Sequence
  Description of Artificial Sequence: Synthetic peptide
PGTGSNH

SEQ ID NO: 26293 - protein, 7 aa, Artificial Sequence
  Description of Artificial Sequence: Synthetic peptide
GSAGNML

SEQ ID NO: 26294 - protein, 7 aa, Artificial Sequence
  Description of Artificial Sequence: Synthetic peptide
DANSTHA

SEQ ID NO: 26295 - protein, 7 aa, Artificial Sequence
  Description of Artificial Sequence: Synthetic peptide
QLRSDQT

SEQ ID NO: 26296 - protein, 7 aa, Artificial Sequence
  Description of Artificial Sequence: Synthetic peptide
NLKTKGE

SEQ ID NO: 26297 - protein, 7 aa, Artificial Sequence
  Description of Artificial Sequence: Synthetic peptide
SISDKLG

SEQ ID NO: 26298 - protein, 7 aa, Artificial Sequence
  Description of Artificial Sequence: Synthetic peptide
ERPGGTP

SEQ ID NO: 26299 - protein, 7 aa, Artificial Sequence
  Description of Artificial Sequence: Synthetic peptide
SNSRQAD

SEQ ID NO: 26300 - protein, 7 aa, Artificial Sequence
  Description of Artificial Sequence: Synthetic peptide
ESVSNSL

SEQ ID NO: 26301 - protein, 7 aa, Artificial Sequence
  Description of Artificial Sequence: Synthetic peptide
NASGQNQ

SEQ ID NO: 26302 - protein, 7 aa, Artificial Sequence
  Description of Artificial Sequence: Synthetic peptide
LLSQHSD

SEQ ID NO: 26303 - protein, 7 aa, Artificial Sequence
  Description of Artificial Sequence: Synthetic peptide
SVTSPNK

SEQ ID NO: 26304 - protein, 7 aa, Artificial Sequence
  Description of Artificial Sequence: Synthetic peptide
ATGNGRG

SEQ ID NO: 26305 - protein, 7 aa, Artificial Sequence
  Description of Artificial Sequence: Synthetic peptide
IRSKESE

SEQ ID NO: 26306 - protein, 7 aa, Artificial Sequence
  Description of Artificial Sequence: Synthetic peptide
SGTNMWQ

SEQ ID NO: 26307 - protein, 7 aa, Artificial Sequence
  Description of Artificial Sequence: Synthetic peptide
PTTRMVN

SEQ ID NO: 26308 - protein, 7 aa, Artificial Sequence
  Description of Artificial Sequence: Synthetic peptide
GDKNHGS

SEQ ID NO: 26309 - protein, 7 aa, Artificial Sequence
  Description of Artificial Sequence: Synthetic peptide
QSHGITN

SEQ ID NO: 26310 - protein, 7 aa, Artificial Sequence
  Description of Artificial Sequence: Synthetic peptide
NSTPSTR

SEQ ID NO: 26311 - protein, 7 aa, Artificial Sequence
  Description of Artificial Sequence: Synthetic peptide
LVQGGVN

SEQ ID NO: 26312 - protein, 7 aa, Artificial Sequence
  Description of Artificial Sequence: Synthetic peptide
IPTARAA

SEQ ID NO: 26313 - protein, 7 aa, Artificial Sequence
  Description of Artificial Sequence: Synthetic peptide
YNHGSVD

SEQ ID NO: 26314 - protein, 7 aa, Artificial Sequence
  Description of Artificial Sequence: Synthetic peptide
WSLGHND

SEQ ID NO: 26315 - protein, 7 aa, Artificial Sequence
  Description of Artificial Sequence: Synthetic peptide
TQSHNLA

SEQ ID NO: 26316 - protein, 7 aa, Artificial Sequence
  Description of Artificial Sequence: Synthetic peptide
NPGSGYG

SEQ ID NO: 26317 - protein, 7 aa, Artificial Sequence
  Description of Artificial Sequence: Synthetic peptide
NPSHTSV

SEQ ID NO: 26318 - protein, 7 aa, Artificial Sequence
  Description of Artificial Sequence: Synthetic peptide
QSNTSPT

SEQ ID NO: 26319 - protein, 7 aa, Artificial Sequence
  Description of Artificial Sequence: Synthetic peptide
PGSGSNH

SEQ ID NO: 26320 - protein, 7 aa, Artificial Sequence
  Description of Artificial Sequence: Synthetic peptide
ARGASTN

SEQ ID NO: 26321 - protein, 7 aa, Artificial Sequence
  Description of Artificial Sequence: Synthetic peptide
DNMSTPK

SEQ ID NO: 26322 - protein, 7 aa, Artificial Sequence
  Description of Artificial Sequence: Synthetic peptide
TATQKGQ

SEQ ID NO: 26323 - protein, 7 aa, Artificial Sequence
  Description of Artificial Sequence: Synthetic peptide
MPTSSLN

SEQ ID NO: 26324 - protein, 7 aa, Artificial Sequence
  Description of Artificial Sequence: Synthetic peptide
SSHKDYL

SEQ ID NO: 26325 - protein, 7 aa, Artificial Sequence
  Description of Artificial Sequence: Synthetic peptide
AGASSNT

SEQ ID NO: 26326 - protein, 7 aa, Artificial Sequence
  Description of Artificial Sequence: Synthetic peptide
SVHSNAI

SEQ ID NO: 26327 - protein, 7 aa, Artificial Sequence
  Description of Artificial Sequence: Synthetic peptide
VLAGSNT

SEQ ID NO: 26328 - protein, 7 aa, Artificial Sequence
  Description of Artificial Sequence: Synthetic peptide
QTGTSST

SEQ ID NO: 26329 - protein, 7 aa, Artificial Sequence
  Description of Artificial Sequence: Synthetic peptide
ASTPNNT

SEQ ID NO: 26330 - protein, 7 aa, Artificial Sequence
  Description of Artificial Sequence: Synthetic peptide
TNIQASK

SEQ ID NO: 26331 - protein, 7 aa, Artificial Sequence
  Description of Artificial Sequence: Synthetic peptide
APSHASL

SEQ ID NO: 26332 - protein, 7 aa, Artificial Sequence
  Description of Artificial Sequence: Synthetic peptide
GQIKNLG

SEQ ID NO: 26333 - protein, 7 aa, Artificial Sequence
  Description of Artificial Sequence: Synthetic peptide
GLDHLRT

SEQ ID NO: 26334 - protein, 7 aa, Artificial Sequence
  Description of Artificial Sequence: Synthetic peptide
SLSREHM

SEQ ID NO: 26335 - protein, 7 aa, Artificial Sequence
  Description of Artificial Sequence: Synthetic peptide
TPTLAHG

SEQ ID NO: 26336 - protein, 7 aa, Artificial Sequence
  Description of Artificial Sequence: Synthetic peptide
SVHQNRA

SEQ ID NO: 26337 - protein, 7 aa, Artificial Sequence
  Description of Artificial Sequence: Synthetic peptide
SRDSGGA

SEQ ID NO: 26338 - protein, 7 aa, Artificial Sequence
  Description of Artificial Sequence: Synthetic peptide
SSEARLM

SEQ ID NO: 26339 - protein, 7 aa, Artificial Sequence
  Description of Artificial Sequence: Synthetic peptide
STSRDAT

SEQ ID NO: 26340 - protein, 7 aa, Artificial Sequence
  Description of Artificial Sequence: Synthetic peptide
CNQSPNR

SEQ ID NO: 26341 - protein, 7 aa, Artificial Sequence
  Description of Artificial Sequence: Synthetic peptide
GQTRESS

SEQ ID NO: 26342 - protein, 7 aa, Artificial Sequence
  Description of Artificial Sequence: Synthetic peptide
SSTKSSL

SEQ ID NO: 26343 - protein, 7 aa, Artificial Sequence
  Description of Artificial Sequence: Synthetic peptide
PLASPMV

SEQ ID NO: 26344 - protein, 7 aa, Artificial Sequence
  Description of Artificial Sequence: Synthetic peptide
GTSPSTM

SEQ ID NO: 26345 - protein, 7 aa, Artificial Sequence
  Description of Artificial Sequence: Synthetic peptide
ISKASTH

SEQ ID NO: 26346 - protein, 7 aa, Artificial Sequence
  Description of Artificial Sequence: Synthetic peptide
NGNISIG

SEQ ID NO: 26347 - protein, 7 aa, Artificial Sequence
  Description of Artificial Sequence: Synthetic peptide
TAVTANQ

SEQ ID NO: 26348 - protein, 7 aa, Artificial Sequence
  Description of Artificial Sequence: Synthetic peptide
DGGNQRS

SEQ ID NO: 26349 - protein, 7 aa, Artificial Sequence
  Description of Artificial Sequence: Synthetic peptide
DDRSNLS

SEQ ID NO: 26350 - protein, 7 aa, Artificial Sequence
  Description of Artificial Sequence: Synthetic peptide
PVPYRAD

SEQ ID NO: 26351 - protein, 7 aa, Artificial Sequence
  Description of Artificial Sequence: Synthetic peptide
NSREKGA

SEQ ID NO: 26352 - protein, 7 aa, Artificial Sequence
  Description of Artificial Sequence: Synthetic peptide
RLPAHQA

SEQ ID NO: 26353 - protein, 7 aa, Artificial Sequence
  Description of Artificial Sequence: Synthetic peptide
NANQNQM

SEQ ID NO: 26354 - protein, 7 aa, Artificial Sequence
  Description of Artificial Sequence: Synthetic peptide
YNVNRNT

SEQ ID NO: 26355 - protein, 7 aa, Artificial Sequence
  Description of Artificial Sequence: Synthetic peptide
YSGGNMS

SEQ ID NO: 26356 - protein, 7 aa, Artificial Sequence
  Description of Artificial Sequence: Synthetic peptide
ATNNGSK

SEQ ID NO: 26357 - protein, 7 aa, Artificial Sequence
  Description of Artificial Sequence: Synthetic peptide
DSIGSSK

SEQ ID NO: 26358 - protein, 7 aa, Artificial Sequence
  Description of Artificial Sequence: Synthetic peptide
DGIKSYA

SEQ ID NO: 26359 - protein, 7 aa, Artificial Sequence
  Description of Artificial Sequence: Synthetic peptide
SRPSNMA

SEQ ID NO: 26360 - protein, 7 aa, Artificial Sequence
  Description of Artificial Sequence: Synthetic peptide
GLPTEKM

SEQ ID NO: 26361 - protein, 7 aa, Artificial Sequence
  Description of Artificial Sequence: Synthetic peptide
NGSAQNQ

SEQ ID NO: 26362 - protein, 7 aa, Artificial Sequence
  Description of Artificial Sequence: Synthetic peptide
TSRVGQV

SEQ ID NO: 26363 - protein, 7 aa, Artificial Sequence
  Description of Artificial Sequence: Synthetic peptide
STSNIAS

SEQ ID NO: 26364 - protein, 7 aa, Artificial Sequence
  Description of Artificial Sequence: Synthetic peptide
NANPSLR

SEQ ID NO: 26365 - protein, 7 aa, Artificial Sequence
  Description of Artificial Sequence: Synthetic peptide
ESNSSRG

SEQ ID NO: 26366 - protein, 7 aa, Artificial Sequence
  Description of Artificial Sequence: Synthetic peptide
SGGQAMG

SEQ ID NO: 26367 - protein, 7 aa, Artificial Sequence
  Description of Artificial Sequence: Synthetic peptide
FVNTSAQ

SEQ ID NO: 26368 - protein, 7 aa, Artificial Sequence
  Description of Artificial Sequence: Synthetic peptide
MMGGVKN

SEQ ID NO: 26369 - protein, 7 aa, Artificial Sequence
  Description of Artificial Sequence: Synthetic peptide
HTPDVGK

SEQ ID NO: 26370 - protein, 7 aa, Artificial Sequence
  Description of Artificial Sequence: Synthetic peptide
RSSSAMT

SEQ ID NO: 26371 - protein, 7 aa, Artificial Sequence
  Description of Artificial Sequence: Synthetic peptide
SQIPPST

SEQ ID NO: 26372 - protein, 7 aa, Artificial Sequence
  Description of Artificial Sequence: Synthetic peptide
SGSNNFL

SEQ ID NO: 26373 - protein, 7 aa, Artificial Sequence
  Description of Artificial Sequence: Synthetic peptide
MRAESGQ

SEQ ID NO: 26374 - protein, 7 aa, Artificial Sequence
  Description of Artificial Sequence: Synthetic peptide
SISHSSS

SEQ ID NO: 26375 - protein, 7 aa, Artificial Sequence
  Description of Artificial Sequence: Synthetic peptide
YRASGIS

SEQ ID NO: 26376 - protein, 7 aa, Artificial Sequence
  Description of Artificial Sequence: Synthetic peptide
SGTTTFG

SEQ ID NO: 26377 - protein, 7 aa, Artificial Sequence
  Description of Artificial Sequence: Synthetic peptide
ALSSQKG

SEQ ID NO: 26378 - protein, 7 aa, Artificial Sequence
  Description of Artificial Sequence: Synthetic peptide
LGVKTPT

SEQ ID NO: 26379 - protein, 7 aa, Artificial Sequence
  Description of Artificial Sequence: Synthetic peptide
NDRGQNG

SEQ ID NO: 26380 - protein, 7 aa, Artificial Sequence
  Description of Artificial Sequence: Synthetic peptide
FHANSTV

SEQ ID NO: 26381 - protein, 7 aa, Artificial Sequence
  Description of Artificial Sequence: Synthetic peptide
KSVNPLL

SEQ ID NO: 26382 - protein, 7 aa, Artificial Sequence
  Description of Artificial Sequence: Synthetic peptide
HSSRPLE

SEQ ID NO: 26383 - protein, 7 aa, Artificial Sequence
  Description of Artificial Sequence: Synthetic peptide
SDNKGSV

SEQ ID NO: 26384 - protein, 7 aa, Artificial Sequence
  Description of Artificial Sequence: Synthetic peptide
RMGNKEA

SEQ ID NO: 26385 - protein, 7 aa, Artificial Sequence
  Description of Artificial Sequence: Synthetic peptide
GLADPRT

SEQ ID NO: 26386 - protein, 7 aa, Artificial Sequence
  Description of Artificial Sequence: Synthetic peptide
ITSTGSS

SEQ ID NO: 26387 - protein, 7 aa, Artificial Sequence
  Description of Artificial Sequence: Synthetic peptide
AGSSPPT

SEQ ID NO: 26388 - protein, 7 aa, Artificial Sequence
  Description of Artificial Sequence: Synthetic peptide
PLPKNSS

SEQ ID NO: 26389 - protein, 7 aa, Artificial Sequence
  Description of Artificial Sequence: Synthetic peptide
SRVDQYK

SEQ ID NO: 26390 - protein, 7 aa, Artificial Sequence
  Description of Artificial Sequence: Synthetic peptide
GMTQGGK

SEQ ID NO: 26391 - protein, 7 aa, Artificial Sequence
  Description of Artificial Sequence: Synthetic peptide
QFPGTLR

SEQ ID NO: 26392 - protein, 7 aa, Artificial Sequence
  Description of Artificial Sequence: Synthetic peptide
GANTNPG

SEQ ID NO: 26393 - protein, 7 aa, Artificial Sequence
  Description of Artificial Sequence: Synthetic peptide
DRADANS

SEQ ID NO: 26394 - protein, 7 aa, Artificial Sequence
  Description of Artificial Sequence: Synthetic peptide
TTHNIKG

SEQ ID NO: 26395 - protein, 7 aa, Artificial Sequence
  Description of Artificial Sequence: Synthetic peptide
VGSQTNS

SEQ ID NO: 26396 - protein, 7 aa, Artificial Sequence
  Description of Artificial Sequence: Synthetic peptide
HTATPLL

SEQ ID NO: 26397 - protein, 7 aa, Artificial Sequence
  Description of Artificial Sequence: Synthetic peptide
AVGKSTE

SEQ ID NO: 26398 - protein, 7 aa, Artificial Sequence
  Description of Artificial Sequence: Synthetic peptide
GAAVQAN

SEQ ID NO: 26399 - protein, 7 aa, Artificial Sequence
  Description of Artificial Sequence: Synthetic peptide
DPLGKQG

SEQ ID NO: 26400 - protein, 7 aa, Artificial Sequence
  Description of Artificial Sequence: Synthetic peptide
SIKSAAA

SEQ ID NO: 26401 - protein, 7 aa, Artificial Sequence
  Description of Artificial Sequence: Synthetic peptide
SNQRGEG

SEQ ID NO: 26402 - protein, 7 aa, Artificial Sequence
  Description of Artificial Sequence: Synthetic peptide
HGISNQS

SEQ ID NO: 26403 - protein, 7 aa, Artificial Sequence
  Description of Artificial Sequence: Synthetic peptide
GTGVPGK

SEQ ID NO: 26404 - protein, 7 aa, Artificial Sequence
  Description of Artificial Sequence: Synthetic peptide
TGSGQNQ

SEQ ID NO: 26405 - protein, 7 aa, Artificial Sequence
  Description of Artificial Sequence: Synthetic peptide
PNLSKSL

SEQ ID NO: 26406 - protein, 7 aa, Artificial Sequence
  Description of Artificial Sequence: Synthetic peptide
DYHNSKL

SEQ ID NO: 26407 - protein, 7 aa, Artificial Sequence
  Description of Artificial Sequence: Synthetic peptide
SVNSRSE

SEQ ID NO: 26408 - protein, 7 aa, Artificial Sequence
  Description of Artificial Sequence: Synthetic peptide
QPNRADN

SEQ ID NO: 26409 - protein, 7 aa, Artificial Sequence
  Description of Artificial Sequence: Synthetic peptide
AATMRNS

SEQ ID NO: 26410 - protein, 7 aa, Artificial Sequence
  Description of Artificial Sequence: Synthetic peptide
SQQSPSM

SEQ ID NO: 26411 - protein, 7 aa, Artificial Sequence
  Description of Artificial Sequence: Synthetic peptide
HRDQVSL

SEQ ID NO: 26412 - protein, 7 aa, Artificial Sequence
  Description of Artificial Sequence: Synthetic peptide
SNETKSS

SEQ ID NO: 26413 - protein, 7 aa, Artificial Sequence
  Description of Artificial Sequence: Synthetic peptide
SGSGQNQ

SEQ ID NO: 26414 - protein, 7 aa, Artificial Sequence
  Description of Artificial Sequence: Synthetic peptide
SSEAATR

SEQ ID NO: 26415 - protein, 7 aa, Artificial Sequence
  Description of Artificial Sequence: Synthetic peptide
SGSDKFS

SEQ ID NO: 26416 - protein, 7 aa, Artificial Sequence
  Description of Artificial Sequence: Synthetic peptide
PNNQSTR

SEQ ID NO: 26417 - protein, 7 aa, Artificial Sequence
  Description of Artificial Sequence: Synthetic peptide
SHNSKDS

SEQ ID NO: 26418 - protein, 7 aa, Artificial Sequence
  Description of Artificial Sequence: Synthetic peptide
CTTRQGN

SEQ ID NO: 26419 - protein, 7 aa, Artificial Sequence
  Description of Artificial Sequence: Synthetic peptide
VFNHASK

SEQ ID NO: 26420 - protein, 7 aa, Artificial Sequence
  Description of Artificial Sequence: Synthetic peptide
ELHSKNA

SEQ ID NO: 26421 - protein, 7 aa, Artificial Sequence
  Description of Artificial Sequence: Synthetic peptide
GPGRNLI

SEQ ID NO: 26422 - protein, 7 aa, Artificial Sequence
  Description of Artificial Sequence: Synthetic peptide
SLGRDHA

SEQ ID NO: 26423 - protein, 7 aa, Artificial Sequence
  Description of Artificial Sequence: Synthetic peptide
YGQTKTQ

SEQ ID NO: 26424 - protein, 7 aa, Artificial Sequence
  Description of Artificial Sequence: Synthetic peptide
ATNHSPQ

SEQ ID NO: 26425 - protein, 7 aa, Artificial Sequence
  Description of Artificial Sequence: Synthetic peptide
NVTTPLI

SEQ ID NO: 26426 - protein, 7 aa, Artificial Sequence
  Description of Artificial Sequence: Synthetic peptide
PTKGANA

SEQ ID NO: 26427 - protein, 7 aa, Artificial Sequence
  Description of Artificial Sequence: Synthetic peptide
GSSHLTT

SEQ ID NO: 26428 - protein, 7 aa, Artificial Sequence
  Description of Artificial Sequence: Synthetic peptide
SLTTKAN

SEQ ID NO: 26429 - protein, 7 aa, Artificial Sequence
  Description of Artificial Sequence: Synthetic peptide
TGSSKVG

SEQ ID NO: 26430 - protein, 7 aa, Artificial Sequence
  Description of Artificial Sequence: Synthetic peptide
SQSPNRG

SEQ ID NO: 26431 - protein, 7 aa, Artificial Sequence
  Description of Artificial Sequence: Synthetic peptide
GLKGSFP

SEQ ID NO: 26432 - protein, 7 aa, Artificial Sequence
  Description of Artificial Sequence: Synthetic peptide
SMGNSIS

SEQ ID NO: 26433 - protein, 7 aa, Artificial Sequence
  Description of Artificial Sequence: Synthetic peptide
ETNSRLG

SEQ ID NO: 26434 - protein, 7 aa, Artificial Sequence
  Description of Artificial Sequence: Synthetic peptide
APNGTLS

SEQ ID NO: 26435 - protein, 7 aa, Artificial Sequence
  Description of Artificial Sequence: Synthetic peptide
LSTANKS

SEQ ID NO: 26436 - protein, 7 aa, Artificial Sequence
  Description of Artificial Sequence: Synthetic peptide
MQTSQST

SEQ ID NO: 26437 - protein, 7 aa, Artificial Sequence
  Description of Artificial Sequence: Synthetic peptide
NSANKTP

SEQ ID NO: 26438 - protein, 7 aa, Artificial Sequence
  Description of Artificial Sequence: Synthetic peptide
IGTSINS

SEQ ID NO: 26439 - protein, 7 aa, Artificial Sequence
  Description of Artificial Sequence: Synthetic peptide
FRTTAST

SEQ ID NO: 26440 - protein, 7 aa, Artificial Sequence
  Description of Artificial Sequence: Synthetic peptide
SAYERTS

SEQ ID NO: 26441 - protein, 7 aa, Artificial Sequence
  Description of Artificial Sequence: Synthetic peptide
SITGNRT

SEQ ID NO: 26442 - protein, 7 aa, Artificial Sequence
  Description of Artificial Sequence: Synthetic peptide
AFGGETK

SEQ ID NO: 26443 - protein, 7 aa, Artificial Sequence
  Description of Artificial Sequence: Synthetic peptide
GTARGVA

SEQ ID NO: 26444 - protein, 7 aa, Artificial Sequence
  Description of Artificial Sequence: Synthetic peptide
SHGPQIT

SEQ ID NO: 26445 - protein, 7 aa, Artificial Sequence
  Description of Artificial Sequence: Synthetic peptide
LVSSKSS

SEQ ID NO: 26446 - protein, 7 aa, Artificial Sequence
  Description of Artificial Sequence: Synthetic peptide
AQVDKRS

SEQ ID NO: 26447 - protein, 7 aa, Artificial Sequence
  Description of Artificial Sequence: Synthetic peptide
ENTKTYS

SEQ ID NO: 26448 - protein, 7 aa, Artificial Sequence
  Description of Artificial Sequence: Synthetic peptide
SNMPGMV

SEQ ID NO: 26449 - protein, 7 aa, Artificial Sequence
  Description of Artificial Sequence: Synthetic peptide
AEHQSGK

SEQ ID NO: 26450 - protein, 7 aa, Artificial Sequence
  Description of Artificial Sequence: Synthetic peptide
GKTGPNS

SEQ ID NO: 26451 - protein, 7 aa, Artificial Sequence
  Description of Artificial Sequence: Synthetic peptide
GNISTSS

SEQ ID NO: 26452 - protein, 7 aa, Artificial Sequence
  Description of Artificial Sequence: Synthetic peptide
TVAHPSH

SEQ ID NO: 26453 - protein, 7 aa, Artificial Sequence
  Description of Artificial Sequence: Synthetic peptide
PTMQGVH

SEQ ID NO: 26454 - protein, 7 aa, Artificial Sequence
  Description of Artificial Sequence: Synthetic peptide
RMNGGGP

SEQ ID NO: 26455 - protein, 7 aa, Artificial Sequence
  Description of Artificial Sequence: Synthetic peptide
NQSSSAR

SEQ ID NO: 26456 - protein, 7 aa, Artificial Sequence
  Description of Artificial Sequence: Synthetic peptide
IGSGQNQ

SEQ ID NO: 26457 - protein, 7 aa, Artificial Sequence
  Description of Artificial Sequence: Synthetic peptide
MEIKPNR

SEQ ID NO: 26458 - protein, 7 aa, Artificial Sequence
  Description of Artificial Sequence: Synthetic peptide
NAVGVGY

SEQ ID NO: 26459 - protein, 7 aa, Artificial Sequence
  Description of Artificial Sequence: Synthetic peptide
HQGNVIS

SEQ ID NO: 26460 - protein, 7 aa, Artificial Sequence
  Description of Artificial Sequence: Synthetic peptide
HNVGGGD

SEQ ID NO: 26461 - protein, 7 aa, Artificial Sequence
  Description of Artificial Sequence: Synthetic peptide
TPTLSHT

SEQ ID NO: 26462 - protein, 7 aa, Artificial Sequence
  Description of Artificial Sequence: Synthetic peptide
NNTSTHL

SEQ ID NO: 26463 - protein, 7 aa, Artificial Sequence
  Description of Artificial Sequence: Synthetic peptide
NIASKGP

SEQ ID NO: 26464 - protein, 7 aa, Artificial Sequence
  Description of Artificial Sequence: Synthetic peptide
NGSEQNQ

SEQ ID NO: 26465 - protein, 7 aa, Artificial Sequence
  Description of Artificial Sequence: Synthetic peptide
GSRSSTT

SEQ ID NO: 26466 - protein, 7 aa, Artificial Sequence
  Description of Artificial Sequence: Synthetic peptide
FNTSKLS

SEQ ID NO: 26467 - protein, 7 aa, Artificial Sequence
  Description of Artificial Sequence: Synthetic peptide
RPTQVGA

SEQ ID NO: 26468 - protein, 7 aa, Artificial Sequence
  Description of Artificial Sequence: Synthetic peptide
QSTERLA

SEQ ID NO: 26469 - protein, 7 aa, Artificial Sequence
  Description of Artificial Sequence: Synthetic peptide
MSTHSSG

SEQ ID NO: 26470 - protein, 7 aa, Artificial Sequence
  Description of Artificial Sequence: Synthetic peptide
QQASLSS

SEQ ID NO: 26471 - protein, 7 aa, Artificial Sequence
  Description of Artificial Sequence: Synthetic peptide
IDGHRNG

SEQ ID NO: 26472 - protein, 7 aa, Artificial Sequence
  Description of Artificial Sequence: Synthetic peptide
CSPPTRG

SEQ ID NO: 26473 - protein, 7 aa, Artificial Sequence
  Description of Artificial Sequence: Synthetic peptide
SGAGSAG

SEQ ID NO: 26474 - protein, 7 aa, Artificial Sequence
  Description of Artificial Sequence: Synthetic peptide
RESSPSL

SEQ ID NO: 26475 - protein, 7 aa, Artificial Sequence
  Description of Artificial Sequence: Synthetic peptide
VNTSHTN

SEQ ID NO: 26476 - protein, 7 aa, Artificial Sequence
  Description of Artificial Sequence: Synthetic peptide
AYPKNSN

SEQ ID NO: 26477 - protein, 7 aa, Artificial Sequence
  Description of Artificial Sequence: Synthetic peptide
FANTANR

SEQ ID NO: 26478 - protein, 7 aa, Artificial Sequence
  Description of Artificial Sequence: Synthetic peptide
NSASLNH

SEQ ID NO: 26479 - protein, 7 aa, Artificial Sequence
  Description of Artificial Sequence: Synthetic peptide
GDAGSFS

SEQ ID NO: 26480 - protein, 7 aa, Artificial Sequence
  Description of Artificial Sequence: Synthetic peptide
FNEQRVS

SEQ ID NO: 26481 - protein, 7 aa, Artificial Sequence
  Description of Artificial Sequence: Synthetic peptide
LRSKESA

SEQ ID NO: 26482 - protein, 7 aa, Artificial Sequence
  Description of Artificial Sequence: Synthetic peptide
FRTQSTK

SEQ ID NO: 26483 - protein, 7 aa, Artificial Sequence
  Description of Artificial Sequence: Synthetic peptide
PTGEKRL

SEQ ID NO: 26484 - protein, 7 aa, Artificial Sequence
  Description of Artificial Sequence: Synthetic peptide
GRESNLS

SEQ ID NO: 26485 - protein, 7 aa, Artificial Sequence
  Description of Artificial Sequence: Synthetic peptide
QGPKNAD

SEQ ID NO: 26486 - protein, 7 aa, Artificial Sequence
  Description of Artificial Sequence: Synthetic peptide
HATSGTR

SEQ ID NO: 26487 - protein, 7 aa, Artificial Sequence
  Description of Artificial Sequence: Synthetic peptide
GGSNLRT

SEQ ID NO: 26488 - protein, 7 aa, Artificial Sequence
  Description of Artificial Sequence: Synthetic peptide
NASTANM

SEQ ID NO: 26489 - protein, 7 aa, Artificial Sequence
  Description of Artificial Sequence: Synthetic peptide
ALANPQT

SEQ ID NO: 26490 - protein, 7 aa, Artificial Sequence
  Description of Artificial Sequence: Synthetic peptide
RSGNATI

SEQ ID NO: 26491 - protein, 7 aa, Artificial Sequence
  Description of Artificial Sequence: Synthetic peptide
QSEIVNK

SEQ ID NO: 26492 - protein, 7 aa, Artificial Sequence
  Description of Artificial Sequence: Synthetic peptide
NGYGQNQ

SEQ ID NO: 26493 - protein, 7 aa, Artificial Sequence
  Description of Artificial Sequence: Synthetic peptide
RSSPASL

SEQ ID NO: 26494 - protein, 7 aa, Artificial Sequence
  Description of Artificial Sequence: Synthetic peptide
AVTGASG

SEQ ID NO: 26495 - protein, 7 aa, Artificial Sequence
  Description of Artificial Sequence: Synthetic peptide
SGSEHLR

SEQ ID NO: 26496 - protein, 7 aa, Artificial Sequence
  Description of Artificial Sequence: Synthetic peptide
HMNRKLE

SEQ ID NO: 26497 - protein, 7 aa, Artificial Sequence
  Description of Artificial Sequence: Synthetic peptide
DNTGRNA

SEQ ID NO: 26498 - protein, 7 aa, Artificial Sequence
  Description of Artificial Sequence: Synthetic peptide
PGAALSI

SEQ ID NO: 26499 - protein, 7 aa, Artificial Sequence
  Description of Artificial Sequence: Synthetic peptide
RTDHGGV

SEQ ID NO: 26500 - protein, 7 aa, Artificial Sequence
  Description of Artificial Sequence: Synthetic peptide
LNSTAGK

SEQ ID NO: 26501 - protein, 7 aa, Artificial Sequence
  Description of Artificial Sequence: Synthetic peptide
SHLDRLN

SEQ ID NO: 26502 - protein, 7 aa, Artificial Sequence
  Description of Artificial Sequence: Synthetic peptide
SYADKQG

SEQ ID NO: 26503 - protein, 7 aa, Artificial Sequence
  Description of Artificial Sequence: Synthetic peptide
TATTLSS

SEQ ID NO: 26504 - protein, 7 aa, Artificial Sequence
  Description of Artificial Sequence: Synthetic peptide
PRTGTLM

SEQ ID NO: 26505 - protein, 7 aa, Artificial Sequence
  Description of Artificial Sequence: Synthetic peptide
ASTNSMQ

SEQ ID NO: 26506 - protein, 7 aa, Artificial Sequence
  Description of Artificial Sequence: Synthetic peptide
GNSMAGT

SEQ ID NO: 26507 - protein, 7 aa, Artificial Sequence
  Description of Artificial Sequence: Synthetic peptide
AVSSKVG

SEQ ID NO: 26508 - protein, 7 aa, Artificial Sequence
  Description of Artificial Sequence: Synthetic peptide
SASPSIK

SEQ ID NO: 26509 - protein, 7 aa, Artificial Sequence
  Description of Artificial Sequence: Synthetic peptide
LSMNTSK

SEQ ID NO: 26510 - protein, 7 aa, Artificial Sequence
  Description of Artificial Sequence: Synthetic peptide
PNGSPLS

SEQ ID NO: 26511 - protein, 7 aa, Artificial Sequence
  Description of Artificial Sequence: Synthetic peptide
NGSGQNK

SEQ ID NO: 26512 - protein, 7 aa, Artificial Sequence
  Description of Artificial Sequence: Synthetic peptide
VKTAKVN

SEQ ID NO: 26513 - protein, 7 aa, Artificial Sequence
  Description of Artificial Sequence: Synthetic peptide
HRVDNQG

SEQ ID NO: 26514 - protein, 7 aa, Artificial Sequence
  Description of Artificial Sequence: Synthetic peptide
PLVPRGT

SEQ ID NO: 26515 - protein, 7 aa, Artificial Sequence
  Description of Artificial Sequence: Synthetic peptide
SSQAQPT

SEQ ID NO: 26516 - protein, 7 aa, Artificial Sequence
  Description of Artificial Sequence: Synthetic peptide
AGNTGSH

SEQ ID NO: 26517 - protein, 7 aa, Artificial Sequence
  Description of Artificial Sequence: Synthetic peptide
SIPSTSQ

SEQ ID NO: 26518 - protein, 7 aa, Artificial Sequence
  Description of Artificial Sequence: Synthetic peptide
MSHTKSN

SEQ ID NO: 26519 - protein, 7 aa, Artificial Sequence
  Description of Artificial Sequence: Synthetic peptide
QGAGVSS

SEQ ID NO: 26520 - protein, 7 aa, Artificial Sequence
  Description of Artificial Sequence: Synthetic peptide
QETRGNS

SEQ ID NO: 26521 - protein, 7 aa, Artificial Sequence
  Description of Artificial Sequence: Synthetic peptide
VSGSNSL

SEQ ID NO: 26522 - protein, 7 aa, Artificial Sequence
  Description of Artificial Sequence: Synthetic peptide
SAGTSVG

SEQ ID NO: 26523 - protein, 7 aa, Artificial Sequence
  Description of Artificial Sequence: Synthetic peptide
NSAGTRV

SEQ ID NO: 26524 - protein, 7 aa, Artificial Sequence
  Description of Artificial Sequence: Synthetic peptide
RLEGSMA

SEQ ID NO: 26525 - protein, 7 aa, Artificial Sequence
  Description of Artificial Sequence: Synthetic peptide
PADHGKL

SEQ ID NO: 26526 - protein, 7 aa, Artificial Sequence
  Description of Artificial Sequence: Synthetic peptide
MDGRSTT

SEQ ID NO: 26527 - protein, 7 aa, Artificial Sequence
  Description of Artificial Sequence: Synthetic peptide
TGTDSRS

SEQ ID NO: 26528 - protein, 7 aa, Artificial Sequence
  Description of Artificial Sequence: Synthetic peptide
IRTKESA

SEQ ID NO: 26529 - protein, 7 aa, Artificial Sequence
  Description of Artificial Sequence: Synthetic peptide
RDVDVRN

SEQ ID NO: 26530 - protein, 7 aa, Artificial Sequence
  Description of Artificial Sequence: Synthetic peptide
YVSSGKA

SEQ ID NO: 26531 - protein, 7 aa, Artificial Sequence
  Description of Artificial Sequence: Synthetic peptide
SFPPGNV

SEQ ID NO: 26532 - protein, 7 aa, Artificial Sequence
  Description of Artificial Sequence: Synthetic peptide
QLPTMTV

SEQ ID NO: 26533 - protein, 7 aa, Artificial Sequence
  Description of Artificial Sequence: Synthetic peptide
PTTLKHD

SEQ ID NO: 26534 - protein, 7 aa, Artificial Sequence
  Description of Artificial Sequence: Synthetic peptide
GPSTHSG

SEQ ID NO: 26535 - protein, 7 aa, Artificial Sequence
  Description of Artificial Sequence: Synthetic peptide
HRSPSTQ

SEQ ID NO: 26536 - protein, 7 aa, Artificial Sequence
  Description of Artificial Sequence: Synthetic peptide
QRVNTAS

SEQ ID NO: 26537 - protein, 7 aa, Artificial Sequence
  Description of Artificial Sequence: Synthetic peptide
HNSGNGS

SEQ ID NO: 26538 - protein, 7 aa, Artificial Sequence
  Description of Artificial Sequence: Synthetic peptide
TAQGPSA

SEQ ID NO: 26539 - protein, 7 aa, Artificial Sequence
  Description of Artificial Sequence: Synthetic peptide
PVTRSKD

SEQ ID NO: 26540 - protein, 7 aa, Artificial Sequence
  Description of Artificial Sequence: Synthetic peptide
AATNSLT

SEQ ID NO: 26541 - protein, 7 aa, Artificial Sequence
  Description of Artificial Sequence: Synthetic peptide
SGAPGSS

SEQ ID NO: 26542 - protein, 7 aa, Artificial Sequence
  Description of Artificial Sequence: Synthetic peptide
TSNTKQG

SEQ ID NO: 26543 - protein, 7 aa, Artificial Sequence
  Description of Artificial Sequence: Synthetic peptide
RTPTASG

SEQ ID NO: 26544 - protein, 7 aa, Artificial Sequence
  Description of Artificial Sequence: Synthetic peptide
GASTPRL

SEQ ID NO: 26545 - protein, 7 aa, Artificial Sequence
  Description of Artificial Sequence: Synthetic peptide
MLNNASA

SEQ ID NO: 26546 - protein, 7 aa, Artificial Sequence
  Description of Artificial Sequence: Synthetic peptide
DYGKGSS

SEQ ID NO: 26547 - protein, 7 aa, Artificial Sequence
  Description of Artificial Sequence: Synthetic peptide
GNMRNLA

SEQ ID NO: 26548 - protein, 7 aa, Artificial Sequence
  Description of Artificial Sequence: Synthetic peptide
HANSPAT

SEQ ID NO: 26549 - protein, 7 aa, Artificial Sequence
  Description of Artificial Sequence: Synthetic peptide
ASRSVNA

SEQ ID NO: 26550 - protein, 7 aa, Artificial Sequence
  Description of Artificial Sequence: Synthetic peptide
ENRVKVN

SEQ ID NO: 26551 - protein, 7 aa, Artificial Sequence
  Description of Artificial Sequence: Synthetic peptide
NVSGQNQ

SEQ ID NO: 26552 - protein, 7 aa, Artificial Sequence
  Description of Artificial Sequence: Synthetic peptide
FMGRPNV

SEQ ID NO: 26553 - protein, 7 aa, Artificial Sequence
  Description of Artificial Sequence: Synthetic peptide
DSRSIKG

SEQ ID NO: 26554 - protein, 7 aa, Artificial Sequence
  Description of Artificial Sequence: Synthetic peptide
LQKPSLV

SEQ ID NO: 26555 - protein, 7 aa, Artificial Sequence
  Description of Artificial Sequence: Synthetic peptide
SKDRSTV

SEQ ID NO: 26556 - protein, 7 aa, Artificial Sequence
  Description of Artificial Sequence: Synthetic peptide
TQNTKSI

SEQ ID NO: 26557 - protein, 7 aa, Artificial Sequence
  Description of Artificial Sequence: Synthetic peptide
NPVALRD

SEQ ID NO: 26558 - protein, 7 aa, Artificial Sequence
  Description of Artificial Sequence: Synthetic peptide
GQSNVTL

SEQ ID NO: 26559 - protein, 7 aa, Artificial Sequence
  Description of Artificial Sequence: Synthetic peptide
SSSGGVK

SEQ ID NO: 26560 - protein, 7 aa, Artificial Sequence
  Description of Artificial Sequence: Synthetic peptide
SDINRST

SEQ ID NO: 26561 - protein, 7 aa, Artificial Sequence
  Description of Artificial Sequence: Synthetic peptide
NRVEHTQ

SEQ ID NO: 26562 - protein, 7 aa, Artificial Sequence
  Description of Artificial Sequence: Synthetic peptide
DQGNGYG

SEQ ID NO: 26563 - protein, 7 aa, Artificial Sequence
  Description of Artificial Sequence: Synthetic peptide
RLETKSG

SEQ ID NO: 26564 - protein, 7 aa, Artificial Sequence
  Description of Artificial Sequence: Synthetic peptide
STPIRSV

SEQ ID NO: 26565 - protein, 7 aa, Artificial Sequence
  Description of Artificial Sequence: Synthetic peptide
TSSARVT

SEQ ID NO: 26566 - protein, 7 aa, Artificial Sequence
  Description of Artificial Sequence: Synthetic peptide
EAVTMHG

SEQ ID NO: 26567 - protein, 7 aa, Artificial Sequence
  Description of Artificial Sequence: Synthetic peptide
TKGGSQL

SEQ ID NO: 26568 - protein, 7 aa, Artificial Sequence
  Description of Artificial Sequence: Synthetic peptide
GTGNSNL

SEQ ID NO: 26569 - protein, 7 aa, Artificial Sequence
  Description of Artificial Sequence: Synthetic peptide
GTSTSLR

SEQ ID NO: 26570 - protein, 7 aa, Artificial Sequence
  Description of Artificial Sequence: Synthetic peptide
LGPHPTH

SEQ ID NO: 26571 - protein, 7 aa, Artificial Sequence
  Description of Artificial Sequence: Synthetic peptide
ASVSQRS

SEQ ID NO: 26572 - protein, 7 aa, Artificial Sequence
  Description of Artificial Sequence: Synthetic peptide
PSTPTIK

SEQ ID NO: 26573 - protein, 7 aa, Artificial Sequence
  Description of Artificial Sequence: Synthetic peptide
RSSGGLT

SEQ ID NO: 26574 - protein, 7 aa, Artificial Sequence
  Description of Artificial Sequence: Synthetic peptide
SRSHAMT

SEQ ID NO: 26575 - protein, 7 aa, Artificial Sequence
  Description of Artificial Sequence: Synthetic peptide
FLKGTGS

SEQ ID NO: 26576 - protein, 7 aa, Artificial Sequence
  Description of Artificial Sequence: Synthetic peptide
PSTSSAG

SEQ ID NO: 26577 - protein, 7 aa, Artificial Sequence
  Description of Artificial Sequence: Synthetic peptide
DPLRSMH

SEQ ID NO: 26578 - protein, 7 aa, Artificial Sequence
  Description of Artificial Sequence: Synthetic peptide
YQVGDTR

SEQ ID NO: 26579 - protein, 7 aa, Artificial Sequence
  Description of Artificial Sequence: Synthetic peptide
EGSGRLT

SEQ ID NO: 26580 - protein, 7 aa, Artificial Sequence
  Description of Artificial Sequence: Synthetic peptide
SDSRSRS

SEQ ID NO: 26581 - protein, 7 aa, Artificial Sequence
  Description of Artificial Sequence: Synthetic peptide
SLERLKT

SEQ ID NO: 26582 - protein, 7 aa, Artificial Sequence
  Description of Artificial Sequence: Synthetic peptide
TTNNIQG

SEQ ID NO: 26583 - protein, 7 aa, Artificial Sequence
  Description of Artificial Sequence: Synthetic peptide
SNGQRKE

SEQ ID NO: 26584 - protein, 7 aa, Artificial Sequence
  Description of Artificial Sequence: Synthetic peptide
KDNTPGR

SEQ ID NO: 26585 - protein, 7 aa, Artificial Sequence
  Description of Artificial Sequence: Synthetic peptide
QTSHSAK

SEQ ID NO: 26586 - protein, 7 aa, Artificial Sequence
  Description of Artificial Sequence: Synthetic peptide
GMGGLKN

SEQ ID NO: 26587 - protein, 7 aa, Artificial Sequence
  Description of Artificial Sequence: Synthetic peptide
HERGQNG

SEQ ID NO: 26588 - protein, 7 aa, Artificial Sequence
  Description of Artificial Sequence: Synthetic peptide
STSTVHS

SEQ ID NO: 26589 - protein, 7 aa, Artificial Sequence
  Description of Artificial Sequence: Synthetic peptide
GGHPPTS

SEQ ID NO: 26590 - protein, 7 aa, Artificial Sequence
  Description of Artificial Sequence: Synthetic peptide
GSISTAH

SEQ ID NO: 26591 - protein, 7 aa, Artificial Sequence
  Description of Artificial Sequence: Synthetic peptide
SSPSKMA

SEQ ID NO: 26592 - protein, 7 aa, Artificial Sequence
  Description of Artificial Sequence: Synthetic peptide
WGTGIGS

SEQ ID NO: 26593 - protein, 7 aa, Artificial Sequence
  Description of Artificial Sequence: Synthetic peptide
RAPGSNT

SEQ ID NO: 26594 - protein, 7 aa, Artificial Sequence
  Description of Artificial Sequence: Synthetic peptide
VVPERSK

SEQ ID NO: 26595 - protein, 7 aa, Artificial Sequence
  Description of Artificial Sequence: Synthetic peptide
LGMRDNT

SEQ ID NO: 26596 - protein, 7 aa, Artificial Sequence
  Description of Artificial Sequence: Synthetic peptide
GPSSINR

SEQ ID NO: 26597 - protein, 7 aa, Artificial Sequence
  Description of Artificial Sequence: Synthetic peptide
NFSNPTV

SEQ ID NO: 26598 - protein, 7 aa, Artificial Sequence
  Description of Artificial Sequence: Synthetic peptide
TGRGTDV

SEQ ID NO: 26599 - protein, 7 aa, Artificial Sequence
  Description of Artificial Sequence: Synthetic peptide
YRVTQSS

SEQ ID NO: 26600 - protein, 7 aa, Artificial Sequence
  Description of Artificial Sequence: Synthetic peptide
TSNTKSV

SEQ ID NO: 26601 - protein, 7 aa, Artificial Sequence
  Description of Artificial Sequence: Synthetic peptide
RLTQSSQ

SEQ ID NO: 26602 - protein, 7 aa, Artificial Sequence
  Description of Artificial Sequence: Synthetic peptide
PANSPAT

SEQ ID NO: 26603 - protein, 7 aa, Artificial Sequence
  Description of Artificial Sequence: Synthetic peptide
PRSQPVP

SEQ ID NO: 26604 - protein, 7 aa, Artificial Sequence
  Description of Artificial Sequence: Synthetic peptide
PDTLTRQ

SEQ ID NO: 26605 - protein, 7 aa, Artificial Sequence
  Description of Artificial Sequence: Synthetic peptide
NGRGSDV

SEQ ID NO: 26606 - protein, 7 aa, Artificial Sequence
  Description of Artificial Sequence: Synthetic peptide
ANGTKSS

SEQ ID NO: 26607 - protein, 7 aa, Artificial Sequence
  Description of Artificial Sequence: Synthetic peptide
PGGTTKG

SEQ ID NO: 26608 - protein, 7 aa, Artificial Sequence
  Description of Artificial Sequence: Synthetic peptide
PTHSSRD

SEQ ID NO: 26609 - protein, 7 aa, Artificial Sequence
  Description of Artificial Sequence: Synthetic peptide
SGMASVT

SEQ ID NO: 26610 - protein, 7 aa, Artificial Sequence
  Description of Artificial Sequence: Synthetic peptide
GPVNAHS

SEQ ID NO: 26611 - protein, 7 aa, Artificial Sequence
  Description of Artificial Sequence: Synthetic peptide
GNTGSYQ

SEQ ID NO: 26612 - protein, 7 aa, Artificial Sequence
  Description of Artificial Sequence: Synthetic peptide
ALSSPAN

SEQ ID NO: 26613 - protein, 7 aa, Artificial Sequence
  Description of Artificial Sequence: Synthetic peptide
QQSPRNG

SEQ ID NO: 26614 - protein, 7 aa, Artificial Sequence
  Description of Artificial Sequence: Synthetic peptide
PSQTKPS

SEQ ID NO: 26615 - protein, 7 aa, Artificial Sequence
  Description of Artificial Sequence: Synthetic peptide
QTSSREM

SEQ ID NO: 26616 - protein, 7 aa, Artificial Sequence
  Description of Artificial Sequence: Synthetic peptide
NTTAKSS

SEQ ID NO: 26617 - protein, 7 aa, Artificial Sequence
  Description of Artificial Sequence: Synthetic peptide
ERVGSIS

SEQ ID NO: 26618 - protein, 7 aa, Artificial Sequence
  Description of Artificial Sequence: Synthetic peptide
QTRTDVT

SEQ ID NO: 26619 - protein, 7 aa, Artificial Sequence
  Description of Artificial Sequence: Synthetic peptide
GNRPTTL

SEQ ID NO: 26620 - protein, 7 aa, Artificial Sequence
  Description of Artificial Sequence: Synthetic peptide
VGTNHTS

SEQ ID NO: 26621 - protein, 7 aa, Artificial Sequence
  Description of Artificial Sequence: Synthetic peptide
DHRNISS

SEQ ID NO: 26622 - protein, 7 aa, Artificial Sequence
  Description of Artificial Sequence: Synthetic peptide
NTSNNIQ

SEQ ID NO: 26623 - protein, 7 aa, Artificial Sequence
  Description of Artificial Sequence: Synthetic peptide
GTTNSRN

SEQ ID NO: 26624 - protein, 7 aa, Artificial Sequence
  Description of Artificial Sequence: Synthetic peptide
SYGKESS

SEQ ID NO: 26625 - protein, 7 aa, Artificial Sequence
  Description of Artificial Sequence: Synthetic peptide
RSDTNRG

SEQ ID NO: 26626 - protein, 7 aa, Artificial Sequence
  Description of Artificial Sequence: Synthetic peptide
PLNARGS

SEQ ID NO: 26627 - protein, 7 aa, Artificial Sequence
  Description of Artificial Sequence: Synthetic peptide
DLHVQKA

SEQ ID NO: 26628 - protein, 7 aa, Artificial Sequence
  Description of Artificial Sequence: Synthetic peptide
SGGTHIA

SEQ ID NO: 26629 - protein, 7 aa, Artificial Sequence
  Description of Artificial Sequence: Synthetic peptide
SASTSTL

SEQ ID NO: 26630 - protein, 7 aa, Artificial Sequence
  Description of Artificial Sequence: Synthetic peptide
AATRQPD

SEQ ID NO: 26631 - protein, 7 aa, Artificial Sequence
  Description of Artificial Sequence: Synthetic peptide
VGSSSVM

SEQ ID NO: 26632 - protein, 7 aa, Artificial Sequence
  Description of Artificial Sequence: Synthetic peptide
SSSPNVK

SEQ ID NO: 26633 - protein, 7 aa, Artificial Sequence
  Description of Artificial Sequence: Synthetic peptide
NNAHSSS

SEQ ID NO: 26634 - protein, 7 aa, Artificial Sequence
  Description of Artificial Sequence: Synthetic peptide
RDSTKLV

SEQ ID NO: 26635 - protein, 7 aa, Artificial Sequence
  Description of Artificial Sequence: Synthetic peptide
TLSSTGG

SEQ ID NO: 26636 - protein, 7 aa, Artificial Sequence
  Description of Artificial Sequence: Synthetic peptide
RIGQGSS

SEQ ID NO: 26637 - protein, 7 aa, Artificial Sequence
  Description of Artificial Sequence: Synthetic peptide
SISHARE

SEQ ID NO: 26638 - protein, 7 aa, Artificial Sequence
  Description of Artificial Sequence: Synthetic peptide
DPRNSTS

SEQ ID NO: 26639 - protein, 7 aa, Artificial Sequence
  Description of Artificial Sequence: Synthetic peptide
DSHPRSI

SEQ ID NO: 26640 - protein, 7 aa, Artificial Sequence
  Description of Artificial Sequence: Synthetic peptide
LPGHPRA

SEQ ID NO: 26641 - protein, 7 aa, Artificial Sequence
  Description of Artificial Sequence: Synthetic peptide
YGSGQNQ

SEQ ID NO: 26642 - protein, 7 aa, Artificial Sequence
  Description of Artificial Sequence: Synthetic peptide
SANRPSA

SEQ ID NO: 26643 - protein, 7 aa, Artificial Sequence
  Description of Artificial Sequence: Synthetic peptide
TPGASLS

SEQ ID NO: 26644 - protein, 7 aa, Artificial Sequence
  Description of Artificial Sequence: Synthetic peptide
EGMGVHG

SEQ ID NO: 26645 - protein, 7 aa, Artificial Sequence
  Description of Artificial Sequence: Synthetic peptide
TTAPGLR

SEQ ID NO: 26646 - protein, 7 aa, Artificial Sequence
  Description of Artificial Sequence: Synthetic peptide
PLSGSKA

SEQ ID NO: 26647 - protein, 7 aa, Artificial Sequence
  Description of Artificial Sequence: Synthetic peptide
HQISSLK

SEQ ID NO: 26648 - protein, 7 aa, Artificial Sequence
  Description of Artificial Sequence: Synthetic peptide
PSKGTYP

SEQ ID NO: 26649 - protein, 7 aa, Artificial Sequence
  Description of Artificial Sequence: Synthetic peptide
SDMSGQR

SEQ ID NO: 26650 - protein, 7 aa, Artificial Sequence
  Description of Artificial Sequence: Synthetic peptide
VADKGSM

SEQ ID NO: 26651 - protein, 7 aa, Artificial Sequence
  Description of Artificial Sequence: Synthetic peptide
GYEANRG

SEQ ID NO: 26652 - protein, 7 aa, Artificial Sequence
  Description of Artificial Sequence: Synthetic peptide
DESGKSK

SEQ ID NO: 26653 - protein, 7 aa, Artificial Sequence
  Description of Artificial Sequence: Synthetic peptide
GVRTAMS

SEQ ID NO: 26654 - protein, 7 aa, Artificial Sequence
  Description of Artificial Sequence: Synthetic peptide
SGSTKGQ

SEQ ID NO: 26655 - protein, 7 aa, Artificial Sequence
  Description of Artificial Sequence: Synthetic peptide
LGSNRYS

SEQ ID NO: 26656 - protein, 7 aa, Artificial Sequence
  Description of Artificial Sequence: Synthetic peptide
GGGTSFG

SEQ ID NO: 26657 - protein, 7 aa, Artificial Sequence
  Description of Artificial Sequence: Synthetic peptide
VNLRSNT

SEQ ID NO: 26658 - protein, 7 aa, Artificial Sequence
  Description of Artificial Sequence: Synthetic peptide
PYAGTSP

SEQ ID NO: 26659 - protein, 7 aa, Artificial Sequence
  Description of Artificial Sequence: Synthetic peptide
HTHDVGK

SEQ ID NO: 26660 - protein, 7 aa, Artificial Sequence
  Description of Artificial Sequence: Synthetic peptide
TGTKSDN

SEQ ID NO: 26661 - protein, 7 aa, Artificial Sequence
  Description of Artificial Sequence: Synthetic peptide
SKSTHQA

SEQ ID NO: 26662 - protein, 7 aa, Artificial Sequence
  Description of Artificial Sequence: Synthetic peptide
DSRQTSL

SEQ ID NO: 26663 - protein, 7 aa, Artificial Sequence
  Description of Artificial Sequence: Synthetic peptide
LAPGHGN

SEQ ID NO: 26664 - protein, 7 aa, Artificial Sequence
  Description of Artificial Sequence: Synthetic peptide
SVHGNQL

SEQ ID NO: 26665 - protein, 7 aa, Artificial Sequence
  Description of Artificial Sequence: Synthetic peptide
SSTSPGR

SEQ ID NO: 26666 - protein, 7 aa, Artificial Sequence
  Description of Artificial Sequence: Synthetic peptide
TNPTGYR

SEQ ID NO: 26667 - protein, 7 aa, Artificial Sequence
  Description of Artificial Sequence: Synthetic peptide
HVPSKLA

SEQ ID NO: 26668 - protein, 7 aa, Artificial Sequence
  Description of Artificial Sequence: Synthetic peptide
QVTGASH

SEQ ID NO: 26669 - protein, 7 aa, Artificial Sequence
  Description of Artificial Sequence: Synthetic peptide
RPGGKDG

SEQ ID NO: 26670 - protein, 7 aa, Artificial Sequence
  Description of Artificial Sequence: Synthetic peptide
HTSNTRV

SEQ ID NO: 26671 - protein, 7 aa, Artificial Sequence
  Description of Artificial Sequence: Synthetic peptide
RSTSSAP

SEQ ID NO: 26672 - protein, 7 aa, Artificial Sequence
  Description of Artificial Sequence: Synthetic peptide
MGNPRHV

SEQ ID NO: 26673 - protein, 7 aa, Artificial Sequence
  Description of Artificial Sequence: Synthetic peptide
TPAGPNK

SEQ ID NO: 26674 - protein, 7 aa, Artificial Sequence
  Description of Artificial Sequence: Synthetic peptide
SGGGTRT

SEQ ID NO: 26675 - protein, 7 aa, Artificial Sequence
  Description of Artificial Sequence: Synthetic peptide
AGSSSPA

SEQ ID NO: 26676 - protein, 7 aa, Artificial Sequence
  Description of Artificial Sequence: Synthetic peptide
VSFKPNE

SEQ ID NO: 26677 - protein, 7 aa, Artificial Sequence
  Description of Artificial Sequence: Synthetic peptide
SYPSQLN

SEQ ID NO: 26678 - protein, 7 aa, Artificial Sequence
  Description of Artificial Sequence: Synthetic peptide
PSHMASA

SEQ ID NO: 26679 - protein, 7 aa, Artificial Sequence
  Description of Artificial Sequence: Synthetic peptide
RTLSNNG

SEQ ID NO: 26680 - protein, 7 aa, Artificial Sequence
  Description of Artificial Sequence: Synthetic peptide
NGPGQNQ

SEQ ID NO: 26681 - protein, 7 aa, Artificial Sequence
  Description of Artificial Sequence: Synthetic peptide
DLPHHTR

SEQ ID NO: 26682 - protein, 7 aa, Artificial Sequence
  Description of Artificial Sequence: Synthetic peptide
NGSGQNR

SEQ ID NO: 26683 - protein, 7 aa, Artificial Sequence
  Description of Artificial Sequence: Synthetic peptide
HGSGQNQ

SEQ ID NO: 26684 - protein, 7 aa, Artificial Sequence
  Description of Artificial Sequence: Synthetic peptide
SQTVKTG

SEQ ID NO: 26685 - protein, 7 aa, Artificial Sequence
  Description of Artificial Sequence: Synthetic peptide
SSAPSLS

SEQ ID NO: 26686 - protein, 7 aa, Artificial Sequence
  Description of Artificial Sequence: Synthetic peptide
RTLSASS

SEQ ID NO: 26687 - protein, 7 aa, Artificial Sequence
  Description of Artificial Sequence: Synthetic peptide
HPTSPAM

SEQ ID NO: 26688 - protein, 7 aa, Artificial Sequence
  Description of Artificial Sequence: Synthetic peptide
EPSRSST

SEQ ID NO: 26689 - protein, 7 aa, Artificial Sequence
  Description of Artificial Sequence: Synthetic peptide
HNTAHAS

SEQ ID NO: 26690 - protein, 7 aa, Artificial Sequence
  Description of Artificial Sequence: Synthetic peptide
QVTSIGA

SEQ ID NO: 26691 - protein, 7 aa, Artificial Sequence
  Description of Artificial Sequence: Synthetic peptide
PGSVTGS

SEQ ID NO: 26692 - protein, 7 aa, Artificial Sequence
  Description of Artificial Sequence: Synthetic peptide
QSSRTVT

SEQ ID NO: 26693 - protein, 7 aa, Artificial Sequence
  Description of Artificial Sequence: Synthetic peptide
GRLNTNG

SEQ ID NO: 26694 - protein, 7 aa, Artificial Sequence
  Description of Artificial Sequence: Synthetic peptide
TRSQGIL

SEQ ID NO: 26695 - protein, 7 aa, Artificial Sequence
  Description of Artificial Sequence: Synthetic peptide
RDVGSAA

SEQ ID NO: 26696 - protein, 7 aa, Artificial Sequence
  Description of Artificial Sequence: Synthetic peptide
NGSGQYQ

SEQ ID NO: 26697 - protein, 7 aa, Artificial Sequence
  Description of Artificial Sequence: Synthetic peptide
AGAPKTD

SEQ ID NO: 26698 - protein, 7 aa, Artificial Sequence
  Description of Artificial Sequence: Synthetic peptide
GTVDKAS

SEQ ID NO: 26699 - protein, 7 aa, Artificial Sequence
  Description of Artificial Sequence: Synthetic peptide
NKMTSVS

SEQ ID NO: 26700 - protein, 7 aa, Artificial Sequence
  Description of Artificial Sequence: Synthetic peptide
EFTKVGA

SEQ ID NO: 26701 - protein, 7 aa, Artificial Sequence
  Description of Artificial Sequence: Synthetic peptide
ATSPRLS

SEQ ID NO: 26702 - protein, 7 aa, Artificial Sequence
  Description of Artificial Sequence: Synthetic peptide
VTQSSSK

SEQ ID NO: 26703 - protein, 7 aa, Artificial Sequence
  Description of Artificial Sequence: Synthetic peptide
PKGVHSM

SEQ ID NO: 26704 - protein, 7 aa, Artificial Sequence
  Description of Artificial Sequence: Synthetic peptide
RGVSTPT

SEQ ID NO: 26705 - protein, 7 aa, Artificial Sequence
  Description of Artificial Sequence: Synthetic peptide
DIPAKTA

SEQ ID NO: 26706 - protein, 7 aa, Artificial Sequence
  Description of Artificial Sequence: Synthetic peptide
STSGIRS

SEQ ID NO: 26707 - protein, 7 aa, Artificial Sequence
  Description of Artificial Sequence: Synthetic peptide
SRDSSIH

SEQ ID NO: 26708 - protein, 7 aa, Artificial Sequence
  Description of Artificial Sequence: Synthetic peptide
NSTSTSQ

SEQ ID NO: 26709 - protein, 7 aa, Artificial Sequence
  Description of Artificial Sequence: Synthetic peptide
NGTGQNQ

SEQ ID NO: 26710 - protein, 7 aa, Artificial Sequence
  Description of Artificial Sequence: Synthetic peptide
VKSNNLP

SEQ ID NO: 26711 - protein, 7 aa, Artificial Sequence
  Description of Artificial Sequence: Synthetic peptide
GQTGDMR

SEQ ID NO: 26712 - protein, 7 aa, Artificial Sequence
  Description of Artificial Sequence: Synthetic peptide
VQPRTST

SEQ ID NO: 26713 - protein, 7 aa, Artificial Sequence
  Description of Artificial Sequence: Synthetic peptide
QGSSLRT

SEQ ID NO: 26714 - protein, 7 aa, Artificial Sequence
  Description of Artificial Sequence: Synthetic peptide
MRSNPTS

SEQ ID NO: 26715 - protein, 7 aa, Artificial Sequence
  Description of Artificial Sequence: Synthetic peptide
ENISRSH

SEQ ID NO: 26716 - protein, 7 aa, Artificial Sequence
  Description of Artificial Sequence: Synthetic peptide
GLAGRLS

SEQ ID NO: 26717 - protein, 7 aa, Artificial Sequence
  Description of Artificial Sequence: Synthetic peptide
TPLSASC

SEQ ID NO: 26718 - protein, 7 aa, Artificial Sequence
  Description of Artificial Sequence: Synthetic peptide
GPTDHKL

SEQ ID NO: 26719 - protein, 7 aa, Artificial Sequence
  Description of Artificial Sequence: Synthetic peptide
ERFTSSS

SEQ ID NO: 26720 - protein, 7 aa, Artificial Sequence
  Description of Artificial Sequence: Synthetic peptide
TAGQASV

SEQ ID NO: 26721 - protein, 7 aa, Artificial Sequence
  Description of Artificial Sequence: Synthetic peptide
RVITPST

SEQ ID NO: 26722 - protein, 7 aa, Artificial Sequence
  Description of Artificial Sequence: Synthetic peptide
GTFQSGT

SEQ ID NO: 26723 - protein, 7 aa, Artificial Sequence
  Description of Artificial Sequence: Synthetic peptide
TVSAPSA

SEQ ID NO: 26724 - protein, 7 aa, Artificial Sequence
  Description of Artificial Sequence: Synthetic peptide
RPSSTHA

SEQ ID NO: 26725 - protein, 7 aa, Artificial Sequence
  Description of Artificial Sequence: Synthetic peptide
SGASSNS

SEQ ID NO: 26726 - protein, 7 aa, Artificial Sequence
  Description of Artificial Sequence: Synthetic peptide
PPVTTRP

SEQ ID NO: 26727 - protein, 7 aa, Artificial Sequence
  Description of Artificial Sequence: Synthetic peptide
AFSHSSG

SEQ ID NO: 26728 - protein, 7 aa, Artificial Sequence
  Description of Artificial Sequence: Synthetic peptide
NGSGQHQ

SEQ ID NO: 26729 - protein, 7 aa, Artificial Sequence
  Description of Artificial Sequence: Synthetic peptide
NGSGLNQ

SEQ ID NO: 26730 - protein, 7 aa, Artificial Sequence
  Description of Artificial Sequence: Synthetic peptide
LVNSAVQ

SEQ ID NO: 26731 - protein, 7 aa, Artificial Sequence
  Description of Artificial Sequence: Synthetic peptide
QSSNARN

SEQ ID NO: 26732 - protein, 7 aa, Artificial Sequence
  Description of Artificial Sequence: Synthetic peptide
GVLGSKN

SEQ ID NO: 26733 - protein, 7 aa, Artificial Sequence
  Description of Artificial Sequence: Synthetic peptide
SPNSHPS

SEQ ID NO: 26734 - protein, 7 aa, Artificial Sequence
  Description of Artificial Sequence: Synthetic peptide
TSSANTV

SEQ ID NO: 26735 - protein, 7 aa, Artificial Sequence
  Description of Artificial Sequence: Synthetic peptide
GSTKPSP

SEQ ID NO: 26736 - protein, 7 aa, Artificial Sequence
  Description of Artificial Sequence: Synthetic peptide
YASSRDG

SEQ ID NO: 26737 - protein, 7 aa, Artificial Sequence
  Description of Artificial Sequence: Synthetic peptide
NNVPLIK

SEQ ID NO: 26738 - protein, 7 aa, Artificial Sequence
  Description of Artificial Sequence: Synthetic peptide
SSASTYK

SEQ ID NO: 26739 - protein, 7 aa, Artificial Sequence
  Description of Artificial Sequence: Synthetic peptide
RSGNGSL

SEQ ID NO: 26740 - protein, 7 aa, Artificial Sequence
  Description of Artificial Sequence: Synthetic peptide
AGVTTVN

SEQ ID NO: 26741 - protein, 7 aa, Artificial Sequence
  Description of Artificial Sequence: Synthetic peptide
PRTNVMP

SEQ ID NO: 26742 - protein, 7 aa, Artificial Sequence
  Description of Artificial Sequence: Synthetic peptide
YADGARN

SEQ ID NO: 26743 - protein, 7 aa, Artificial Sequence
  Description of Artificial Sequence: Synthetic peptide
SSSRGQN

SEQ ID NO: 26744 - protein, 7 aa, Artificial Sequence
  Description of Artificial Sequence: Synthetic peptide
VSTKSAP

SEQ ID NO: 26745 - protein, 7 aa, Artificial Sequence
  Description of Artificial Sequence: Synthetic peptide
MGQGTLR

SEQ ID NO: 26746 - protein, 7 aa, Artificial Sequence
  Description of Artificial Sequence: Synthetic peptide
RGTGIGS

SEQ ID NO: 26747 - protein, 7 aa, Artificial Sequence
  Description of Artificial Sequence: Synthetic peptide
SASHGAL

SEQ ID NO: 26748 - protein, 7 aa, Artificial Sequence
  Description of Artificial Sequence: Synthetic peptide
SHPSSFG

SEQ ID NO: 26749 - protein, 7 aa, Artificial Sequence
  Description of Artificial Sequence: Synthetic peptide
PTPVSNR

SEQ ID NO: 26750 - protein, 7 aa, Artificial Sequence
  Description of Artificial Sequence: Synthetic peptide
SAASNGR

SEQ ID NO: 26751 - protein, 7 aa, Artificial Sequence
  Description of Artificial Sequence: Synthetic peptide
VLHNASS

SEQ ID NO: 26752 - protein, 7 aa, Artificial Sequence
  Description of Artificial Sequence: Synthetic peptide
GHLSPSS

SEQ ID NO: 26753 - protein, 7 aa, Artificial Sequence
  Description of Artificial Sequence: Synthetic peptide
AGAGMYA

SEQ ID NO: 26754 - protein, 7 aa, Artificial Sequence
  Description of Artificial Sequence: Synthetic peptide
GTNTGIV

SEQ ID NO: 26755 - protein, 7 aa, Artificial Sequence
  Description of Artificial Sequence: Synthetic peptide
SMDIKPR

SEQ ID NO: 26756 - protein, 7 aa, Artificial Sequence
  Description of Artificial Sequence: Synthetic peptide
PANSHAT

SEQ ID NO: 26757 - protein, 7 aa, Artificial Sequence
  Description of Artificial Sequence: Synthetic peptide
GVGTPRS

SEQ ID NO: 26758 - protein, 7 aa, Artificial Sequence
  Description of Artificial Sequence: Synthetic peptide
SQPAGRS

SEQ ID NO: 26759 - protein, 7 aa, Artificial Sequence
  Description of Artificial Sequence: Synthetic peptide
PGMKVSP

SEQ ID NO: 26760 - protein, 7 aa, Artificial Sequence
  Description of Artificial Sequence: Synthetic peptide
AGAGKVY

SEQ ID NO: 26761 - protein, 7 aa, Artificial Sequence
  Description of Artificial Sequence: Synthetic peptide
GSLTPKA

SEQ ID NO: 26762 - protein, 7 aa, Artificial Sequence
  Description of Artificial Sequence: Synthetic peptide
PPTLNTR

SEQ ID NO: 26763 - protein, 7 aa, Artificial Sequence
  Description of Artificial Sequence: Synthetic peptide
ALPAKSA

SEQ ID NO: 26764 - protein, 7 aa, Artificial Sequence
  Description of Artificial Sequence: Synthetic peptide
LMPSSSS

SEQ ID NO: 26765 - protein, 7 aa, Artificial Sequence
  Description of Artificial Sequence: Synthetic peptide
CLAQPRV

SEQ ID NO: 26766 - protein, 7 aa, Artificial Sequence
  Description of Artificial Sequence: Synthetic peptide
QGTTARS

SEQ ID NO: 26767 - protein, 7 aa, Artificial Sequence
  Description of Artificial Sequence: Synthetic peptide
SASNVSR

SEQ ID NO: 26768 - protein, 7 aa, Artificial Sequence
  Description of Artificial Sequence: Synthetic peptide
STVGHMT

SEQ ID NO: 26769 - protein, 7 aa, Artificial Sequence
  Description of Artificial Sequence: Synthetic peptide
MGAVSVS

SEQ ID NO: 26770 - protein, 7 aa, Artificial Sequence
  Description of Artificial Sequence: Synthetic peptide
GTSLKMS

SEQ ID NO: 26771 - protein, 7 aa, Artificial Sequence
  Description of Artificial Sequence: Synthetic peptide
SSAGTYT

SEQ ID NO: 26772 - protein, 7 aa, Artificial Sequence
  Description of Artificial Sequence: Synthetic peptide
GTPNTKV

SEQ ID NO: 26773 - protein, 7 aa, Artificial Sequence
  Description of Artificial Sequence: Synthetic peptide
QKTQTTS

SEQ ID NO: 26774 - protein, 7 aa, Artificial Sequence
  Description of Artificial Sequence: Synthetic peptide
ASTAINQ

SEQ ID NO: 26775 - protein, 7 aa, Artificial Sequence
  Description of Artificial Sequence: Synthetic peptide
GLHPPRT

SEQ ID NO: 26776 - protein, 7 aa, Artificial Sequence
  Description of Artificial Sequence: Synthetic peptide
PSLERGS

SEQ ID NO: 26777 - protein, 7 aa, Artificial Sequence
  Description of Artificial Sequence: Synthetic peptide
MALQPNR

SEQ ID NO: 26778 - protein, 7 aa, Artificial Sequence
  Description of Artificial Sequence: Synthetic peptide
PRSTTGG

SEQ ID NO: 26779 - protein, 7 aa, Artificial Sequence
  Description of Artificial Sequence: Synthetic peptide
NGSRQNQ

SEQ ID NO: 26780 - protein, 7 aa, Artificial Sequence
  Description of Artificial Sequence: Synthetic peptide
ANATPHH

SEQ ID NO: 26781 - protein, 7 aa, Artificial Sequence
  Description of Artificial Sequence: Synthetic peptide
PRMQEAN

SEQ ID NO: 26782 - protein, 7 aa, Artificial Sequence
  Description of Artificial Sequence: Synthetic peptide
STTTASS

SEQ ID NO: 26783 - protein, 7 aa, Artificial Sequence
  Description of Artificial Sequence: Synthetic peptide
HGVNKTE

SEQ ID NO: 26784 - protein, 7 aa, Artificial Sequence
  Description of Artificial Sequence: Synthetic peptide
TTSNKDS

SEQ ID NO: 26785 - protein, 7 aa, Artificial Sequence
  Description of Artificial Sequence: Synthetic peptide
GNNNGRT

SEQ ID NO: 26786 - protein, 7 aa, Artificial Sequence
  Description of Artificial Sequence: Synthetic peptide
SGVVKSS

SEQ ID NO: 26787 - protein, 7 aa, Artificial Sequence
  Description of Artificial Sequence: Synthetic peptide
SSLTTPH

SEQ ID NO: 26788 - protein, 7 aa, Artificial Sequence
  Description of Artificial Sequence: Synthetic peptide
YTQSTSR

SEQ ID NO: 26789 - protein, 7 aa, Artificial Sequence
  Description of Artificial Sequence: Synthetic peptide
HVTKSTA

SEQ ID NO: 26790 - protein, 7 aa, Artificial Sequence
  Description of Artificial Sequence: Synthetic peptide
SSSNKHV

SEQ ID NO: 26791 - protein, 7 aa, Artificial Sequence
  Description of Artificial Sequence: Synthetic peptide
SDQRTAN

SEQ ID NO: 26792 - protein, 7 aa, Artificial Sequence
  Description of Artificial Sequence: Synthetic peptide
KGSGQNQ

SEQ ID NO: 26793 - protein, 7 aa, Artificial Sequence
  Description of Artificial Sequence: Synthetic peptide
DSGFKSP

SEQ ID NO: 26794 - protein, 7 aa, Artificial Sequence
  Description of Artificial Sequence: Synthetic peptide
STPHHTT

SEQ ID NO: 26795 - protein, 7 aa, Artificial Sequence
  Description of Artificial Sequence: Synthetic peptide
NGSGENQ

SEQ ID NO: 26796 - protein, 7 aa, Artificial Sequence
  Description of Artificial Sequence: Synthetic peptide
SSPVRNT

SEQ ID NO: 26797 - protein, 7 aa, Artificial Sequence
  Description of Artificial Sequence: Synthetic peptide
SSRTQSL

SEQ ID NO: 26798 - protein, 7 aa, Artificial Sequence
  Description of Artificial Sequence: Synthetic peptide
GTNSTRG

SEQ ID NO: 26799 - protein, 7 aa, Artificial Sequence
  Description of Artificial Sequence: Synthetic peptide
LNGSATA

SEQ ID NO: 26800 - protein, 7 aa, Artificial Sequence
  Description of Artificial Sequence: Synthetic peptide
SSPPVGR

SEQ ID NO: 26801 - protein, 7 aa, Artificial Sequence
  Description of Artificial Sequence: Synthetic peptide
THAAHSS

SEQ ID NO: 26802 - protein, 7 aa, Artificial Sequence
  Description of Artificial Sequence: Synthetic peptide
GSAQSPR

SEQ ID NO: 26803 - protein, 7 aa, Artificial Sequence
  Description of Artificial Sequence: Synthetic peptide
PIHPSSG

SEQ ID NO: 26804 - protein, 7 aa, Artificial Sequence
  Description of Artificial Sequence: Synthetic peptide
RNQGALQ

SEQ ID NO: 26805 - protein, 7 aa, Artificial Sequence
  Description of Artificial Sequence: Synthetic peptide
GQVNHTT

SEQ ID NO: 26806 - protein, 7 aa, Artificial Sequence
  Description of Artificial Sequence: Synthetic peptide
GSSQRSD

SEQ ID NO: 26807 - protein, 7 aa, Artificial Sequence
  Description of Artificial Sequence: Synthetic peptide
TGRAPSS

SEQ ID NO: 26808 - protein, 7 aa, Artificial Sequence
  Description of Artificial Sequence: Synthetic peptide
GGTPTHR

SEQ ID NO: 26809 - protein, 7 aa, Artificial Sequence
  Description of Artificial Sequence: Synthetic peptide
VPQVSSA

SEQ ID NO: 26810 - protein, 7 aa, Artificial Sequence
  Description of Artificial Sequence: Synthetic peptide
TNGQAAR

SEQ ID NO: 26811 - protein, 7 aa, Artificial Sequence
  Description of Artificial Sequence: Synthetic peptide
ALGHNHN

SEQ ID NO: 26812 - protein, 7 aa, Artificial Sequence
  Description of Artificial Sequence: Synthetic peptide
GSGHGTN

SEQ ID NO: 26813 - protein, 7 aa, Artificial Sequence
  Description of Artificial Sequence: Synthetic peptide
PTVRSST

SEQ ID NO: 26814 - protein, 7 aa, Artificial Sequence
  Description of Artificial Sequence: Synthetic peptide
SVNTKAL

SEQ ID NO: 26815 - protein, 7 aa, Artificial Sequence
  Description of Artificial Sequence: Synthetic peptide
EPTHPRG

SEQ ID NO: 26816 - protein, 7 aa, Artificial Sequence
  Description of Artificial Sequence: Synthetic peptide
QHSPRNG

SEQ ID NO: 26817 - protein, 7 aa, Artificial Sequence
  Description of Artificial Sequence: Synthetic peptide
SGSSTFR

SEQ ID NO: 26818 - protein, 7 aa, Artificial Sequence
  Description of Artificial Sequence: Synthetic peptide
HGSSSFT

SEQ ID NO: 26819 - protein, 7 aa, Artificial Sequence
  Description of Artificial Sequence: Synthetic peptide
AGSHKGV

SEQ ID NO: 26820 - protein, 7 aa, Artificial Sequence
  Description of Artificial Sequence: Synthetic peptide
SSPTRGL

SEQ ID NO: 26821 - protein, 7 aa, Artificial Sequence
  Description of Artificial Sequence: Synthetic peptide
SRNSPPQ

SEQ ID NO: 26822 - protein, 7 aa, Artificial Sequence
  Description of Artificial Sequence: Synthetic peptide
PVGSVRG

SEQ ID NO: 26823 - protein, 7 aa, Artificial Sequence
  Description of Artificial Sequence: Synthetic peptide
GTGHQRS

SEQ ID NO: 26824 - protein, 7 aa, Artificial Sequence
  Description of Artificial Sequence: Synthetic peptide
TTQSRSL

SEQ ID NO: 26825 - protein, 7 aa, Artificial Sequence
  Description of Artificial Sequence: Synthetic peptide
ASRDRAG

SEQ ID NO: 26826 - protein, 7 aa, Artificial Sequence
  Description of Artificial Sequence: Synthetic peptide
TGMQSLS

SEQ ID NO: 26827 - protein, 7 aa, Artificial Sequence
  Description of Artificial Sequence: Synthetic peptide
SSSSTHG

SEQ ID NO: 26828 - protein, 7 aa, Artificial Sequence
  Description of Artificial Sequence: Synthetic peptide
NISTMSK

SEQ ID NO: 26829 - protein, 7 aa, Artificial Sequence
  Description of Artificial Sequence: Synthetic peptide
GRAHNVI

SEQ ID NO: 26830 - protein, 7 aa, Artificial Sequence
  Description of Artificial Sequence: Synthetic peptide
SPGNKLL

SEQ ID NO: 26831 - protein, 7 aa, Artificial Sequence
  Description of Artificial Sequence: Synthetic peptide
VQPVKMS

SEQ ID NO: 26832 - protein, 7 aa, Artificial Sequence
  Description of Artificial Sequence: Synthetic peptide
QGSSKTT

SEQ ID NO: 26833 - protein, 7 aa, Artificial Sequence
  Description of Artificial Sequence: Synthetic peptide
VTKSGNG

SEQ ID NO: 26834 - protein, 7 aa, Artificial Sequence
  Description of Artificial Sequence: Synthetic peptide
GTYGEMR

SEQ ID NO: 26835 - protein, 7 aa, Artificial Sequence
  Description of Artificial Sequence: Synthetic peptide
VNTNRAA

SEQ ID NO: 26836 - protein, 7 aa, Artificial Sequence
  Description of Artificial Sequence: Synthetic peptide
NGSGQNE

SEQ ID NO: 26837 - protein, 7 aa, Artificial Sequence
  Description of Artificial Sequence: Synthetic peptide
DAGSRSS

SEQ ID NO: 26838 - protein, 7 aa, Artificial Sequence
  Description of Artificial Sequence: Synthetic peptide
PLPAHSP

SEQ ID NO: 26839 - protein, 7 aa, Artificial Sequence
  Description of Artificial Sequence: Synthetic peptide
TSGTKAH

SEQ ID NO: 26840 - protein, 7 aa, Artificial Sequence
  Description of Artificial Sequence: Synthetic peptide
LQQHNTK

SEQ ID NO: 26841 - protein, 7 aa, Artificial Sequence
  Description of Artificial Sequence: Synthetic peptide
HQSSSSS

SEQ ID NO: 26842 - protein, 7 aa, Artificial Sequence
  Description of Artificial Sequence: Synthetic peptide
FRAQANV

SEQ ID NO: 26843 - protein, 7 aa, Artificial Sequence
  Description of Artificial Sequence: Synthetic peptide
PYNSKAS

SEQ ID NO: 26844 - protein, 7 aa, Artificial Sequence
  Description of Artificial Sequence: Synthetic peptide
AHSNNSY

SEQ ID NO: 26845 - protein, 7 aa, Artificial Sequence
  Description of Artificial Sequence: Synthetic peptide
TTASRPS

SEQ ID NO: 26846 - protein, 7 aa, Artificial Sequence
  Description of Artificial Sequence: Synthetic peptide
VSTGKSV

SEQ ID NO: 26847 - protein, 7 aa, Artificial Sequence
  Description of Artificial Sequence: Synthetic peptide
GASVNQG

SEQ ID NO: 26848 - protein, 7 aa, Artificial Sequence
  Description of Artificial Sequence: Synthetic peptide
NGSGQNL

SEQ ID NO: 26849 - protein, 7 aa, Artificial Sequence
  Description of Artificial Sequence: Synthetic peptide
QLGSTTR

SEQ ID NO: 26850 - protein, 7 aa, Artificial Sequence
  Description of Artificial Sequence: Synthetic peptide
SGRDKIS

SEQ ID NO: 26851 - protein, 7 aa, Artificial Sequence
  Description of Artificial Sequence: Synthetic peptide
NGSVQNQ

SEQ ID NO: 26852 - protein, 7 aa, Artificial Sequence
  Description of Artificial Sequence: Synthetic peptide
MPSQRDG

SEQ ID NO: 26853 - protein, 7 aa, Artificial Sequence
  Description of Artificial Sequence: Synthetic peptide
VTTSTGR

SEQ ID NO: 26854 - protein, 7 aa, Artificial Sequence
  Description of Artificial Sequence: Synthetic peptide
NGSGHNQ

SEQ ID NO: 26855 - protein, 7 aa, Artificial Sequence
  Description of Artificial Sequence: Synthetic peptide
TGIGSHL

SEQ ID NO: 26856 - protein, 7 aa, Artificial Sequence
  Description of Artificial Sequence: Synthetic peptide
NGSGRNQ

SEQ ID NO: 26857 - protein, 7 aa, Artificial Sequence
  Description of Artificial Sequence: Synthetic peptide
VRESRSS

SEQ ID NO: 26858 - protein, 7 aa, Artificial Sequence
  Description of Artificial Sequence: Synthetic peptide
PQNLAHV

SEQ ID NO: 26859 - protein, 7 aa, Artificial Sequence
  Description of Artificial Sequence: Synthetic peptide
KNPSSAP

SEQ ID NO: 26860 - protein, 7 aa, Artificial Sequence
  Description of Artificial Sequence: Synthetic peptide
NSGKPNA

SEQ ID NO: 26861 - protein, 7 aa, Artificial Sequence
  Description of Artificial Sequence: Synthetic peptide
NGSGQKQ

SEQ ID NO: 26862 - protein, 7 aa, Artificial Sequence
  Description of Artificial Sequence: Synthetic peptide
NGVPQPK

SEQ ID NO: 26863 - protein, 7 aa, Artificial Sequence
  Description of Artificial Sequence: Synthetic peptide
NGSGKNQ

SEQ ID NO: 26864 - protein, 7 aa, Artificial Sequence
  Description of Artificial Sequence: Synthetic peptide
NGSGQDQ

SEQ ID NO: 26865 - protein, 7 aa, Artificial Sequence
  Description of Artificial Sequence: Synthetic peptide
GFSRPNT

SEQ ID NO: 26866 - protein, 7 aa, Artificial Sequence
  Description of Artificial Sequence: Synthetic peptide
SRQATSS

SEQ ID NO: 26867 - protein, 7 aa, Artificial Sequence
  Description of Artificial Sequence: Synthetic peptide
YANNLNR

SEQ ID NO: 26868 - protein, 7 aa, Artificial Sequence
  Description of Artificial Sequence: Synthetic peptide
EVTNAPK

SEQ ID NO: 26869 - protein, 7 aa, Artificial Sequence
  Description of Artificial Sequence: Synthetic peptide
SGTQTWS

SEQ ID NO: 26870 - protein, 7 aa, Artificial Sequence
  Description of Artificial Sequence: Synthetic peptide
AVPAKGA

SEQ ID NO: 26871 - protein, 7 aa, Artificial Sequence
  Description of Artificial Sequence: Synthetic peptide
RNYTGDS

SEQ ID NO: 26872 - protein, 7 aa, Artificial Sequence
  Description of Artificial Sequence: Synthetic peptide
NGFGQNQ

SEQ ID NO: 26873 - protein, 7 aa, Artificial Sequence
  Description of Artificial Sequence: Synthetic peptide
LRATSGN

SEQ ID NO: 26874 - protein, 7 aa, Artificial Sequence
  Description of Artificial Sequence: Synthetic peptide
AAQPSLK

SEQ ID NO: 26875 - protein, 7 aa, Artificial Sequence
  Description of Artificial Sequence: Synthetic peptide
HMNRKLE

SEQ ID NO: 26876 - protein, 7 aa, Artificial Sequence
  Description of Artificial Sequence: Synthetic peptide
GARPVLQ

SEQ ID NO: 26877 - protein, 7 aa, Artificial Sequence
  Description of Artificial Sequence: Synthetic peptide
RHTMTHV

SEQ ID NO: 26878 - protein, 7 aa, Artificial Sequence
  Description of Artificial Sequence: Synthetic peptide
GLSPVLK

SEQ ID NO: 26879 - protein, 7 aa, Artificial Sequence
  Description of Artificial Sequence: Synthetic peptide
QFPGTLR

SEQ ID NO: 26880 - protein, 7 aa, Artificial Sequence
  Description of Artificial Sequence: Synthetic peptide
HNLHMPG

SEQ ID NO: 26881 - protein, 7 aa, Artificial Sequence
  Description of Artificial Sequence: Synthetic peptide
PKARQHN

SEQ ID NO: 26882 - protein, 7 aa, Artificial Sequence
  Description of Artificial Sequence: Synthetic peptide
RPPVDAV

SEQ ID NO: 26883 - protein, 7 aa, Artificial Sequence
  Description of Artificial Sequence: Synthetic peptide
KPTRSTA

SEQ ID NO: 26884 - protein, 7 aa, Artificial Sequence
  Description of Artificial Sequence: Synthetic peptide
NYVGQRS

SEQ ID NO: 26885 - protein, 7 aa, Artificial Sequence
  Description of Artificial Sequence: Synthetic peptide
SQAKKTG

SEQ ID NO: 26886 - protein, 7 aa, Artificial Sequence
  Description of Artificial Sequence: Synthetic peptide
YGNSGRY

SEQ ID NO: 26887 - protein, 7 aa, Artificial Sequence
  Description of Artificial Sequence: Synthetic peptide
RGPGHNT

SEQ ID NO: 26888 - protein, 7 aa, Artificial Sequence
  Description of Artificial Sequence: Synthetic peptide
CAVSKSR

SEQ ID NO: 26889 - protein, 7 aa, Artificial Sequence
  Description of Artificial Sequence: Synthetic peptide
KLNKSQA

SEQ ID NO: 26890 - protein, 7 aa, Artificial Sequence
  Description of Artificial Sequence: Synthetic peptide
DQKTVNR

SEQ ID NO: 26891 - protein, 7 aa, Artificial Sequence
  Description of Artificial Sequence: Synthetic peptide
PAALNEL

SEQ ID NO: 26892 - protein, 7 aa, Artificial Sequence
  Description of Artificial Sequence: Synthetic peptide
NPGHKLT

SEQ ID NO: 26893 - protein, 7 aa, Artificial Sequence
  Description of Artificial Sequence: Synthetic peptide
NTQSYTR

SEQ ID NO: 26894 - protein, 7 aa, Artificial Sequence
  Description of Artificial Sequence: Synthetic peptide
QVVPATN

SEQ ID NO: 26895 - protein, 7 aa, Artificial Sequence
  Description of Artificial Sequence: Synthetic peptide
TASYKPS

SEQ ID NO: 26896 - protein, 7 aa, Artificial Sequence
  Description of Artificial Sequence: Synthetic peptide
EMRVERP

SEQ ID NO: 26897 - protein, 7 aa, Artificial Sequence
  Description of Artificial Sequence: Synthetic peptide
MKSQKYA

SEQ ID NO: 26898 - protein, 7 aa, Artificial Sequence
  Description of Artificial Sequence: Synthetic peptide
KDFGQMR

SEQ ID NO: 26899 - protein, 7 aa, Artificial Sequence
  Description of Artificial Sequence: Synthetic peptide
EHIGHNH

SEQ ID NO: 26900 - protein, 7 aa, Artificial Sequence
  Description of Artificial Sequence: Synthetic peptide
NNTQKNS

SEQ ID NO: 26901 - protein, 7 aa, Artificial Sequence
  Description of Artificial Sequence: Synthetic peptide
SSSGGVK

SEQ ID NO: 26902 - protein, 7 aa, Artificial Sequence
  Description of Artificial Sequence: Synthetic peptide
VSGTKIE

SEQ ID NO: 26903 - protein, 7 aa, Artificial Sequence
  Description of Artificial Sequence: Synthetic peptide
YGMRLVN

SEQ ID NO: 26904 - protein, 7 aa, Artificial Sequence
  Description of Artificial Sequence: Synthetic peptide
PKLSHTG

SEQ ID NO: 26905 - protein, 7 aa, Artificial Sequence
  Description of Artificial Sequence: Synthetic peptide
ERKVQNC

SEQ ID NO: 26906 - protein, 7 aa, Artificial Sequence
  Description of Artificial Sequence: Synthetic peptide
PGTSDSV

SEQ ID NO: 26907 - protein, 7 aa, Artificial Sequence
  Description of Artificial Sequence: Synthetic peptide
CVYSGTR

SEQ ID NO: 26908 - protein, 7 aa, Artificial Sequence
  Description of Artificial Sequence: Synthetic peptide
SYVTTAG

SEQ ID NO: 26909 - protein, 7 aa, Artificial Sequence
  Description of Artificial Sequence: Synthetic peptide
KSNGHRI

SEQ ID NO: 26910 - protein, 7 aa, Artificial Sequence
  Description of Artificial Sequence: Synthetic peptide
GNELVHL

SEQ ID NO: 26911 - protein, 7 aa, Artificial Sequence
  Description of Artificial Sequence: Synthetic peptide
SMAPAGL

SEQ ID NO: 26912 - protein, 7 aa, Artificial Sequence
  Description of Artificial Sequence: Synthetic peptide
QQEMSKK

SEQ ID NO: 26913 - protein, 7 aa, Artificial Sequence
  Description of Artificial Sequence: Synthetic peptide
KNQSLMS

SEQ ID NO: 26914 - protein, 7 aa, Artificial Sequence
  Description of Artificial Sequence: Synthetic peptide
HVERTGV

SEQ ID NO: 26915 - protein, 7 aa, Artificial Sequence
  Description of Artificial Sequence: Synthetic peptide
LKANATG

SEQ ID NO: 26916 - protein, 7 aa, Artificial Sequence
  Description of Artificial Sequence: Synthetic peptide
NSTQITP

SEQ ID NO: 26917 - protein, 7 aa, Artificial Sequence
  Description of Artificial Sequence: Synthetic peptide
SKTSKVH

SEQ ID NO: 26918 - protein, 7 aa, Artificial Sequence
  Description of Artificial Sequence: Synthetic peptide
RHYTGDS

SEQ ID NO: 26919 - protein, 7 aa, Artificial Sequence
  Description of Artificial Sequence: Synthetic peptide
NGRPQFR

SEQ ID NO: 26920 - protein, 7 aa, Artificial Sequence
  Description of Artificial Sequence: Synthetic peptide
NSVGHSR

SEQ ID NO: 26921 - protein, 7 aa, Artificial Sequence
  Description of Artificial Sequence: Synthetic peptide
GPTPYSR

SEQ ID NO: 26922 - protein, 7 aa, Artificial Sequence
  Description of Artificial Sequence: Synthetic peptide
SPGNVRK

SEQ ID NO: 26923 - protein, 7 aa, Artificial Sequence
  Description of Artificial Sequence: Synthetic peptide
QSSEKRQ

SEQ ID NO: 26924 - protein, 7 aa, Artificial Sequence
  Description of Artificial Sequence: Synthetic peptide
IDGHRNG

SEQ ID NO: 26925 - protein, 7 aa, Artificial Sequence
  Description of Artificial Sequence: Synthetic peptide
GSQIPRI

SEQ ID NO: 26926 - protein, 7 aa, Artificial Sequence
  Description of Artificial Sequence: Synthetic peptide
DRGRPAG

SEQ ID NO: 26927 - protein, 7 aa, Artificial Sequence
  Description of Artificial Sequence: Synthetic peptide
SDSRNTN

SEQ ID NO: 26928 - protein, 7 aa, Artificial Sequence
  Description of Artificial Sequence: Synthetic peptide
SRTQSYC

SEQ ID NO: 26929 - protein, 7 aa, Artificial Sequence
  Description of Artificial Sequence: Synthetic peptide
NNPKNAV

SEQ ID NO: 26930 - protein, 7 aa, Artificial Sequence
  Description of Artificial Sequence: Synthetic peptide
PSSGHSR

SEQ ID NO: 26931 - protein, 7 aa, Artificial Sequence
  Description of Artificial Sequence: Synthetic peptide
LLSNSFK

SEQ ID NO: 26932 - protein, 7 aa, Artificial Sequence
  Description of Artificial Sequence: Synthetic peptide
PLGATFA

SEQ ID NO: 26933 - protein, 7 aa, Artificial Sequence
  Description of Artificial Sequence: Synthetic peptide
RVPLSTI

SEQ ID NO: 26934 - protein, 7 aa, Artificial Sequence
  Description of Artificial Sequence: Synthetic peptide
NLKNQVA

SEQ ID NO: 26935 - protein, 7 aa, Artificial Sequence
  Description of Artificial Sequence: Synthetic peptide
GLQSQSR

SEQ ID NO: 26936 - protein, 7 aa, Artificial Sequence
  Description of Artificial Sequence: Synthetic peptide
ASRAPPG

SEQ ID NO: 26937 - protein, 7 aa, Artificial Sequence
  Description of Artificial Sequence: Synthetic peptide
GTDRTLH

SEQ ID NO: 26938 - protein, 7 aa, Artificial Sequence
  Description of Artificial Sequence: Synthetic peptide
NSFSRNS

SEQ ID NO: 26939 - protein, 7 aa, Artificial Sequence
  Description of Artificial Sequence: Synthetic peptide
YIKSVTN

SEQ ID NO: 26940 - protein, 7 aa, Artificial Sequence
  Description of Artificial Sequence: Synthetic peptide
VLRNISK

SEQ ID NO: 26941 - protein, 7 aa, Artificial Sequence
  Description of Artificial Sequence: Synthetic peptide
AGHSGRD

SEQ ID NO: 26942 - protein, 7 aa, Artificial Sequence
  Description of Artificial Sequence: Synthetic peptide
RELKNSS

SEQ ID NO: 26943 - protein, 7 aa, Artificial Sequence
  Description of Artificial Sequence: Synthetic peptide
ARTNMVK

SEQ ID NO: 26944 - protein, 7 aa, Artificial Sequence
  Description of Artificial Sequence: Synthetic peptide
IPANSFK

SEQ ID NO: 26945 - protein, 7 aa, Artificial Sequence
  Description of Artificial Sequence: Synthetic peptide
QTGSNNK

SEQ ID NO: 26946 - protein, 7 aa, Artificial Sequence
  Description of Artificial Sequence: Synthetic peptide
RQPKKDS

SEQ ID NO: 26947 - protein, 7 aa, Artificial Sequence
  Description of Artificial Sequence: Synthetic peptide
NSGRNSV

SEQ ID NO: 26948 - protein, 7 aa, Artificial Sequence
  Description of Artificial Sequence: Synthetic peptide
SFPVGVG

SEQ ID NO: 26949 - protein, 7 aa, Artificial Sequence
  Description of Artificial Sequence: Synthetic peptide
VMDVQHR

SEQ ID NO: 26950 - protein, 7 aa, Artificial Sequence
  Description of Artificial Sequence: Synthetic peptide
SITSVTN

SEQ ID NO: 26951 - protein, 7 aa, Artificial Sequence
  Description of Artificial Sequence: Synthetic peptide
KAGQERT

SEQ ID NO: 26952 - protein, 7 aa, Artificial Sequence
  Description of Artificial Sequence: Synthetic peptide
NPGRQQF

SEQ ID NO: 26953 - protein, 7 aa, Artificial Sequence
  Description of Artificial Sequence: Synthetic peptide
KLPDSRF

SEQ ID NO: 26954 - protein, 7 aa, Artificial Sequence
  Description of Artificial Sequence: Synthetic peptide
HNLSLVK

SEQ ID NO: 26955 - protein, 7 aa, Artificial Sequence
  Description of Artificial Sequence: Synthetic peptide
NSNGFNN

SEQ ID NO: 26956 - protein, 7 aa, Artificial Sequence
  Description of Artificial Sequence: Synthetic peptide
PMGTGRG

SEQ ID NO: 26957 - protein, 7 aa, Artificial Sequence
  Description of Artificial Sequence: Synthetic peptide
AQTKGTQ

SEQ ID NO: 26958 - protein, 7 aa, Artificial Sequence
  Description of Artificial Sequence: Synthetic peptide
TATQKGQ

SEQ ID NO: 26959 - protein, 7 aa, Artificial Sequence
  Description of Artificial Sequence: Synthetic peptide
IQTHTSN

SEQ ID NO: 26960 - protein, 7 aa, Artificial Sequence
  Description of Artificial Sequence: Synthetic peptide
NLGIPKG

SEQ ID NO: 26961 - protein, 7 aa, Artificial Sequence
  Description of Artificial Sequence: Synthetic peptide
SPAIQRR

SEQ ID NO: 26962 - protein, 7 aa, Artificial Sequence
  Description of Artificial Sequence: Synthetic peptide
GSNAISG

SEQ ID NO: 26963 - protein, 7 aa, Artificial Sequence
  Description of Artificial Sequence: Synthetic peptide
CLHSNEG

SEQ ID NO: 26964 - protein, 7 aa, Artificial Sequence
  Description of Artificial Sequence: Synthetic peptide
RRDDKDR

SEQ ID NO: 26965 - protein, 7 aa, Artificial Sequence
  Description of Artificial Sequence: Synthetic peptide
RVVGQTT

SEQ ID NO: 26966 - protein, 7 aa, Artificial Sequence
  Description of Artificial Sequence: Synthetic peptide
QDGSKGK

SEQ ID NO: 26967 - protein, 7 aa, Artificial Sequence
  Description of Artificial Sequence: Synthetic peptide
TRMNKQT

SEQ ID NO: 26968 - protein, 7 aa, Artificial Sequence
  Description of Artificial Sequence: Synthetic peptide
ISGQQTT

SEQ ID NO: 26969 - protein, 7 aa, Artificial Sequence
  Description of Artificial Sequence: Synthetic peptide
HVVEQFK

SEQ ID NO: 26970 - protein, 7 aa, Artificial Sequence
  Description of Artificial Sequence: Synthetic peptide
IPSRNLS

SEQ ID NO: 26971 - protein, 7 aa, Artificial Sequence
  Description of Artificial Sequence: Synthetic peptide
NPVNTKS

SEQ ID NO: 26972 - protein, 7 aa, Artificial Sequence
  Description of Artificial Sequence: Synthetic peptide
RYSRDNV

SEQ ID NO: 26973 - protein, 7 aa, Artificial Sequence
  Description of Artificial Sequence: Synthetic peptide
GQYGRTS

SEQ ID NO: 26974 - protein, 7 aa, Artificial Sequence
  Description of Artificial Sequence: Synthetic peptide
DRTNTQR

SEQ ID NO: 26975 - protein, 7 aa, Artificial Sequence
  Description of Artificial Sequence: Synthetic peptide
TNSPSPG

SEQ ID NO: 26976 - protein, 7 aa, Artificial Sequence
  Description of Artificial Sequence: Synthetic peptide
NPSEKML

SEQ ID NO: 26977 - protein, 7 aa, Artificial Sequence
  Description of Artificial Sequence: Synthetic peptide
DESGKSK

SEQ ID NO: 26978 - protein, 7 aa, Artificial Sequence
  Description of Artificial Sequence: Synthetic peptide
PQHSVYS

SEQ ID NO: 26979 - protein, 7 aa, Artificial Sequence
  Description of Artificial Sequence: Synthetic peptide
RRAELLT

SEQ ID NO: 26980 - protein, 7 aa, Artificial Sequence
  Description of Artificial Sequence: Synthetic peptide
CPQSREK

SEQ ID NO: 26981 - protein, 7 aa, Artificial Sequence
  Description of Artificial Sequence: Synthetic peptide
NGQAGNR

SEQ ID NO: 26982 - protein, 7 aa, Artificial Sequence
  Description of Artificial Sequence: Synthetic peptide
TPHDGQR

SEQ ID NO: 26983 - protein, 7 aa, Artificial Sequence
  Description of Artificial Sequence: Synthetic peptide
SASPSIK

SEQ ID NO: 26984 - protein, 7 aa, Artificial Sequence
  Description of Artificial Sequence: Synthetic peptide
SVSGRHI

SEQ ID NO: 26985 - protein, 7 aa, Artificial Sequence
  Description of Artificial Sequence: Synthetic peptide
NHGAAQG

SEQ ID NO: 26986 - protein, 7 aa, Artificial Sequence
  Description of Artificial Sequence: Synthetic peptide
SAQKNLI

SEQ ID NO: 26987 - protein, 7 aa, Artificial Sequence
  Description of Artificial Sequence: Synthetic peptide
GHGGQSR

SEQ ID NO: 26988 - protein, 7 aa, Artificial Sequence
  Description of Artificial Sequence: Synthetic peptide
MNMRSTH

SEQ ID NO: 26989 - protein, 7 aa, Artificial Sequence
  Description of Artificial Sequence: Synthetic peptide
QDKHNPG

SEQ ID NO: 26990 - protein, 7 aa, Artificial Sequence
  Description of Artificial Sequence: Synthetic peptide
NCSGQNQ

SEQ ID NO: 26991 - protein, 7 aa, Artificial Sequence
  Description of Artificial Sequence: Synthetic peptide
SVGSGYK

SEQ ID NO: 26992 - protein, 7 aa, Artificial Sequence
  Description of Artificial Sequence: Synthetic peptide
GRGKDYR

SEQ ID NO: 26993 - protein, 7 aa, Artificial Sequence
  Description of Artificial Sequence: Synthetic peptide
PAHRRSE

SEQ ID NO: 26994 - protein, 7 aa, Artificial Sequence
  Description of Artificial Sequence: Synthetic peptide
NDVKQGH

SEQ ID NO: 26995 - protein, 7 aa, Artificial Sequence
  Description of Artificial Sequence: Synthetic peptide
GMKGSVN

SEQ ID NO: 26996 - protein, 7 aa, Artificial Sequence
  Description of Artificial Sequence: Synthetic peptide
HTSPGKN

SEQ ID NO: 26997 - protein, 7 aa, Artificial Sequence
  Description of Artificial Sequence: Synthetic peptide
GLAAGFG

SEQ ID NO: 26998 - protein, 7 aa, Artificial Sequence
  Description of Artificial Sequence: Synthetic peptide
ASLHRNN

SEQ ID NO: 26999 - protein, 7 aa, Artificial Sequence
  Description of Artificial Sequence: Synthetic peptide
DRSRVLG

SEQ ID NO: 27000 - protein, 7 aa, Artificial Sequence
  Description of Artificial Sequence: Synthetic peptide
PGDRGKV

SEQ ID NO: 27001 - protein, 7 aa, Artificial Sequence
  Description of Artificial Sequence: Synthetic peptide
KTSETRS

SEQ ID NO: 27002 - protein, 7 aa, Artificial Sequence
  Description of Artificial Sequence: Synthetic peptide
VKVTHQQ

SEQ ID NO: 27003 - protein, 7 aa, Artificial Sequence
  Description of Artificial Sequence: Synthetic peptide
HSTPSTR

SEQ ID NO: 27004 - protein, 7 aa, Artificial Sequence
  Description of Artificial Sequence: Synthetic peptide
ALNNHRA

SEQ ID NO: 27005 - protein, 7 aa, Artificial Sequence
  Description of Artificial Sequence: Synthetic peptide
NSITRSS

SEQ ID NO: 27006 - protein, 7 aa, Artificial Sequence
  Description of Artificial Sequence: Synthetic peptide
PNRTSSY

SEQ ID NO: 27007 - protein, 7 aa, Artificial Sequence
  Description of Artificial Sequence: Synthetic peptide
RPESSYS

SEQ ID NO: 27008 - protein, 7 aa, Artificial Sequence
  Description of Artificial Sequence: Synthetic peptide
ALANPQT

SEQ ID NO: 27009 - protein, 7 aa, Artificial Sequence
  Description of Artificial Sequence: Synthetic peptide
CNNARVS

SEQ ID NO: 27010 - protein, 7 aa, Artificial Sequence
  Description of Artificial Sequence: Synthetic peptide
HRDQVSL

SEQ ID NO: 27011 - protein, 7 aa, Artificial Sequence
  Description of Artificial Sequence: Synthetic peptide
RGNENIN

SEQ ID NO: 27012 - protein, 7 aa, Artificial Sequence
  Description of Artificial Sequence: Synthetic peptide
QIKTISA

SEQ ID NO: 27013 - protein, 7 aa, Artificial Sequence
  Description of Artificial Sequence: Synthetic peptide
DIRNLQR

SEQ ID NO: 27014 - protein, 7 aa, Artificial Sequence
  Description of Artificial Sequence: Synthetic peptide
MLTVPQQ

SEQ ID NO: 27015 - protein, 7 aa, Artificial Sequence
  Description of Artificial Sequence: Synthetic peptide
LQSGGHR

SEQ ID NO: 27016 - protein, 7 aa, Artificial Sequence
  Description of Artificial Sequence: Synthetic peptide
GPIRPIQ

SEQ ID NO: 27017 - protein, 7 aa, Artificial Sequence
  Description of Artificial Sequence: Synthetic peptide
VSNGQNP

SEQ ID NO: 27018 - protein, 7 aa, Artificial Sequence
  Description of Artificial Sequence: Synthetic peptide
CRGISGK

SEQ ID NO: 27019 - protein, 7 aa, Artificial Sequence
  Description of Artificial Sequence: Synthetic peptide
FTYAEGN

SEQ ID NO: 27020 - protein, 7 aa, Artificial Sequence
  Description of Artificial Sequence: Synthetic peptide
LTTHGMK

SEQ ID NO: 27021 - protein, 7 aa, Artificial Sequence
  Description of Artificial Sequence: Synthetic peptide
ALLNINT

SEQ ID NO: 27022 - protein, 7 aa, Artificial Sequence
  Description of Artificial Sequence: Synthetic peptide
LTFNSSG

SEQ ID NO: 27023 - protein, 7 aa, Artificial Sequence
  Description of Artificial Sequence: Synthetic peptide
TGDSPLA

SEQ ID NO: 27024 - protein, 7 aa, Artificial Sequence
  Description of Artificial Sequence: Synthetic peptide
FHSRDSS

SEQ ID NO: 27025 - protein, 7 aa, Artificial Sequence
  Description of Artificial Sequence: Synthetic peptide
VKTARAT

SEQ ID NO: 27026 - protein, 7 aa, Artificial Sequence
  Description of Artificial Sequence: Synthetic peptide
GTARTTG

SEQ ID NO: 27027 - protein, 7 aa, Artificial Sequence
  Description of Artificial Sequence: Synthetic peptide
QHIQLSR

SEQ ID NO: 27028 - protein, 7 aa, Artificial Sequence
  Description of Artificial Sequence: Synthetic peptide
SKLRTST

SEQ ID NO: 27029 - protein, 7 aa, Artificial Sequence
  Description of Artificial Sequence: Synthetic peptide
TRSKESP

SEQ ID NO: 27030 - protein, 7 aa, Artificial Sequence
  Description of Artificial Sequence: Synthetic peptide
LPTGKML

SEQ ID NO: 27031 - protein, 7 aa, Artificial Sequence
  Description of Artificial Sequence: Synthetic peptide
MGTHSIG

SEQ ID NO: 27032 - protein, 7 aa, Artificial Sequence
  Description of Artificial Sequence: Synthetic peptide
KSSSGWT

SEQ ID NO: 27033 - protein, 7 aa, Artificial Sequence
  Description of Artificial Sequence: Synthetic peptide
SITGNRT

SEQ ID NO: 27034 - protein, 7 aa, Artificial Sequence
  Description of Artificial Sequence: Synthetic peptide
MNLSTER

SEQ ID NO: 27035 - protein, 7 aa, Artificial Sequence
  Description of Artificial Sequence: Synthetic peptide
GQSLSVI

SEQ ID NO: 27036 - protein, 7 aa, Artificial Sequence
  Description of Artificial Sequence: Synthetic peptide
KNATGIL

SEQ ID NO: 27037 - protein, 7 aa, Artificial Sequence
  Description of Artificial Sequence: Synthetic peptide
PLRELKP

SEQ ID NO: 27038 - protein, 7 aa, Artificial Sequence
  Description of Artificial Sequence: Synthetic peptide
SLSTLTL

SEQ ID NO: 27039 - protein, 7 aa, Artificial Sequence
  Description of Artificial Sequence: Synthetic peptide
QAKGSRD

SEQ ID NO: 27040 - protein, 7 aa, Artificial Sequence
  Description of Artificial Sequence: Synthetic peptide
KRVTYTD

SEQ ID NO: 27041 - protein, 7 aa, Artificial Sequence
  Description of Artificial Sequence: Synthetic peptide
THLTGVQ

SEQ ID NO: 27042 - protein, 7 aa, Artificial Sequence
  Description of Artificial Sequence: Synthetic peptide
GHTARLY

SEQ ID NO: 27043 - protein, 7 aa, Artificial Sequence
  Description of Artificial Sequence: Synthetic peptide
FVKTHSA

SEQ ID NO: 27044 - protein, 7 aa, Artificial Sequence
  Description of Artificial Sequence: Synthetic peptide
PGSVTGS

SEQ ID NO: 27045 - protein, 7 aa, Artificial Sequence
  Description of Artificial Sequence: Synthetic peptide
QTGTSST

SEQ ID NO: 27046 - protein, 7 aa, Artificial Sequence
  Description of Artificial Sequence: Synthetic peptide
SNNGTQK

SEQ ID NO: 27047 - protein, 7 aa, Artificial Sequence
  Description of Artificial Sequence: Synthetic peptide
LGTSPMK

SEQ ID NO: 27048 - protein, 7 aa, Artificial Sequence
  Description of Artificial Sequence: Synthetic peptide
TRGQKPQ

SEQ ID NO: 27049 - protein, 7 aa, Artificial Sequence
  Description of Artificial Sequence: Synthetic peptide
GHSSNNA

SEQ ID NO: 27050 - protein, 7 aa, Artificial Sequence
  Description of Artificial Sequence: Synthetic peptide
ARGASTN

SEQ ID NO: 27051 - protein, 7 aa, Artificial Sequence
  Description of Artificial Sequence: Synthetic peptide
MRQDTSK

SEQ ID NO: 27052 - protein, 7 aa, Artificial Sequence
  Description of Artificial Sequence: Synthetic peptide
RASGVTN

SEQ ID NO: 27053 - protein, 7 aa, Artificial Sequence
  Description of Artificial Sequence: Synthetic peptide
LGASTIL

SEQ ID NO: 27054 - protein, 7 aa, Artificial Sequence
  Description of Artificial Sequence: Synthetic peptide
YGGLHNP

SEQ ID NO: 27055 - protein, 7 aa, Artificial Sequence
  Description of Artificial Sequence: Synthetic peptide
DSGSSTK

SEQ ID NO: 27056 - protein, 7 aa, Artificial Sequence
  Description of Artificial Sequence: Synthetic peptide
EARKVTS

SEQ ID NO: 27057 - protein, 7 aa, Artificial Sequence
  Description of Artificial Sequence: Synthetic peptide
EYPQQAK

SEQ ID NO: 27058 - protein, 7 aa, Artificial Sequence
  Description of Artificial Sequence: Synthetic peptide
GQRGDHL

SEQ ID NO: 27059 - protein, 7 aa, Artificial Sequence
  Description of Artificial Sequence: Synthetic peptide
SSRTDSP

SEQ ID NO: 27060 - protein, 7 aa, Artificial Sequence
  Description of Artificial Sequence: Synthetic peptide
LNAGNTR

SEQ ID NO: 27061 - protein, 7 aa, Artificial Sequence
  Description of Artificial Sequence: Synthetic peptide
PGQKQGI

SEQ ID NO: 27062 - protein, 7 aa, Artificial Sequence
  Description of Artificial Sequence: Synthetic peptide
SRYSGHS

SEQ ID NO: 27063 - protein, 7 aa, Artificial Sequence
  Description of Artificial Sequence: Synthetic peptide
PVLGTIS

SEQ ID NO: 27064 - protein, 7 aa, Artificial Sequence
  Description of Artificial Sequence: Synthetic peptide
QRPSTGN

SEQ ID NO: 27065 - protein, 7 aa, Artificial Sequence
  Description of Artificial Sequence: Synthetic peptide
RIAGPTV

SEQ ID NO: 27066 - protein, 7 aa, Artificial Sequence
  Description of Artificial Sequence: Synthetic peptide
QTSSHAY

SEQ ID NO: 27067 - protein, 7 aa, Artificial Sequence
  Description of Artificial Sequence: Synthetic peptide
NGTRQNQ

SEQ ID NO: 27068 - protein, 7 aa, Artificial Sequence
  Description of Artificial Sequence: Synthetic peptide
NANPSLR

SEQ ID NO: 27069 - protein, 7 aa, Artificial Sequence
  Description of Artificial Sequence: Synthetic peptide
FNEQRVS

SEQ ID NO: 27070 - protein, 7 aa, Artificial Sequence
  Description of Artificial Sequence: Synthetic peptide
RVITPST

SEQ ID NO: 27071 - protein, 7 aa, Artificial Sequence
  Description of Artificial Sequence: Synthetic peptide
EPVTSKS

SEQ ID NO: 27072 - protein, 7 aa, Artificial Sequence
  Description of Artificial Sequence: Synthetic peptide
SNVAKRT

SEQ ID NO: 27073 - protein, 7 aa, Artificial Sequence
  Description of Artificial Sequence: Synthetic peptide
QRKSGTS

SEQ ID NO: 27074 - protein, 7 aa, Artificial Sequence
  Description of Artificial Sequence: Synthetic peptide
KGKSTDP

SEQ ID NO: 27075 - protein, 7 aa, Artificial Sequence
  Description of Artificial Sequence: Synthetic peptide
QYMGANS

SEQ ID NO: 27076 - protein, 7 aa, Artificial Sequence
  Description of Artificial Sequence: Synthetic peptide
SSDQPRL

SEQ ID NO: 27077 - protein, 7 aa, Artificial Sequence
  Description of Artificial Sequence: Synthetic peptide
GFSSQQR

SEQ ID NO: 27078 - protein, 7 aa, Artificial Sequence
  Description of Artificial Sequence: Synthetic peptide
CHKRPGE

SEQ ID NO: 27079 - protein, 7 aa, Artificial Sequence
  Description of Artificial Sequence: Synthetic peptide
DSTLGQS

SEQ ID NO: 27080 - protein, 7 aa, Artificial Sequence
  Description of Artificial Sequence: Synthetic peptide
PGREKTV

SEQ ID NO: 27081 - protein, 7 aa, Artificial Sequence
  Description of Artificial Sequence: Synthetic peptide
AESGGSR

SEQ ID NO: 27082 - protein, 7 aa, Artificial Sequence
  Description of Artificial Sequence: Synthetic peptide
LRDTNMN

SEQ ID NO: 27083 - protein, 7 aa, Artificial Sequence
  Description of Artificial Sequence: Synthetic peptide
CPSTKSC

SEQ ID NO: 27084 - protein, 7 aa, Artificial Sequence
  Description of Artificial Sequence: Synthetic peptide
HSSSKIH

SEQ ID NO: 27085 - protein, 7 aa, Artificial Sequence
  Description of Artificial Sequence: Synthetic peptide
GLQTPPR

SEQ ID NO: 27086 - protein, 7 aa, Artificial Sequence
  Description of Artificial Sequence: Synthetic peptide
ESNSSRG

SEQ ID NO: 27087 - protein, 7 aa, Artificial Sequence
  Description of Artificial Sequence: Synthetic peptide
VTTGGSK

SEQ ID NO: 27088 - protein, 7 aa, Artificial Sequence
  Description of Artificial Sequence: Synthetic peptide
GSLDNRK

SEQ ID NO: 27089 - protein, 7 aa, Artificial Sequence
  Description of Artificial Sequence: Synthetic peptide
NGVQQPK

SEQ ID NO: 27090 - protein, 7 aa, Artificial Sequence
  Description of Artificial Sequence: Synthetic peptide
QPSQGHS

SEQ ID NO: 27091 - protein, 7 aa, Artificial Sequence
  Description of Artificial Sequence: Synthetic peptide
GTDNNTR

SEQ ID NO: 27092 - protein, 7 aa, Artificial Sequence
  Description of Artificial Sequence: Synthetic peptide
HQPHQNQ

SEQ ID NO: 27093 - protein, 7 aa, Artificial Sequence
  Description of Artificial Sequence: Synthetic peptide
STASVNQ

SEQ ID NO: 27094 - protein, 7 aa, Artificial Sequence
  Description of Artificial Sequence: Synthetic peptide
NSANKTP

SEQ ID NO: 27095 - protein, 7 aa, Artificial Sequence
  Description of Artificial Sequence: Synthetic peptide
NRSTDFK

SEQ ID NO: 27096 - protein, 7 aa, Artificial Sequence
  Description of Artificial Sequence: Synthetic peptide
LNIANSK

SEQ ID NO: 27097 - protein, 7 aa, Artificial Sequence
  Description of Artificial Sequence: Synthetic peptide
YNQPVGK

SEQ ID NO: 27098 - protein, 7 aa, Artificial Sequence
  Description of Artificial Sequence: Synthetic peptide
NLGNSLK

SEQ ID NO: 27099 - protein, 7 aa, Artificial Sequence
  Description of Artificial Sequence: Synthetic peptide
GPNPGNH

SEQ ID NO: 27100 - protein, 7 aa, Artificial Sequence
  Description of Artificial Sequence: Synthetic peptide
MGGHTHT

SEQ ID NO: 27101 - protein, 7 aa, Artificial Sequence
  Description of Artificial Sequence: Synthetic peptide
QSGSKPG

SEQ ID NO: 27102 - protein, 7 aa, Artificial Sequence
  Description of Artificial Sequence: Synthetic peptide
SNDSNKK

SEQ ID NO: 27103 - protein, 7 aa, Artificial Sequence
  Description of Artificial Sequence: Synthetic peptide
SSQAVFR

SEQ ID NO: 27104 - protein, 7 aa, Artificial Sequence
  Description of Artificial Sequence: Synthetic peptide
SHDNGQS

SEQ ID NO: 27105 - protein, 7 aa, Artificial Sequence
  Description of Artificial Sequence: Synthetic peptide
FRSKESA

SEQ ID NO: 27106 - protein, 7 aa, Artificial Sequence
  Description of Artificial Sequence: Synthetic peptide
QGSSKTT

SEQ ID NO: 27107 - protein, 7 aa, Artificial Sequence
  Description of Artificial Sequence: Synthetic peptide
TGQQPAT

SEQ ID NO: 27108 - protein, 7 aa, Artificial Sequence
  Description of Artificial Sequence: Synthetic peptide
TNRNTYV

SEQ ID NO: 27109 - protein, 7 aa, Artificial Sequence
  Description of Artificial Sequence: Synthetic peptide
ALQYKAS

SEQ ID NO: 27110 - protein, 7 aa, Artificial Sequence
  Description of Artificial Sequence: Synthetic peptide
GSNRNPL

SEQ ID NO: 27111 - protein, 7 aa, Artificial Sequence
  Description of Artificial Sequence: Synthetic peptide
GTVPKPR

SEQ ID NO: 27112 - protein, 7 aa, Artificial Sequence
  Description of Artificial Sequence: Synthetic peptide
GTGNSNL

SEQ ID NO: 27113 - protein, 7 aa, Artificial Sequence
  Description of Artificial Sequence: Synthetic peptide
NRESPQR

SEQ ID NO: 27114 - protein, 7 aa, Artificial Sequence
  Description of Artificial Sequence: Synthetic peptide
SSTVKSG

SEQ ID NO: 27115 - protein, 7 aa, Artificial Sequence
  Description of Artificial Sequence: Synthetic peptide
FNMQRSQ

SEQ ID NO: 27116 - protein, 7 aa, Artificial Sequence
  Description of Artificial Sequence: Synthetic peptide
HSENGNR

SEQ ID NO: 27117 - protein, 7 aa, Artificial Sequence
  Description of Artificial Sequence: Synthetic peptide
SNETKSS

SEQ ID NO: 27118 - protein, 7 aa, Artificial Sequence
  Description of Artificial Sequence: Synthetic peptide
LQPSVIA

SEQ ID NO: 27119 - protein, 7 aa, Artificial Sequence
  Description of Artificial Sequence: Synthetic peptide
NVASNYS

SEQ ID NO: 27120 - protein, 7 aa, Artificial Sequence
  Description of Artificial Sequence: Synthetic peptide
MDGRSTT

SEQ ID NO: 27121 - protein, 7 aa, Artificial Sequence
  Description of Artificial Sequence: Synthetic peptide
SRNPNMI

SEQ ID NO: 27122 - protein, 7 aa, Artificial Sequence
  Description of Artificial Sequence: Synthetic peptide
KFPPNSG

SEQ ID NO: 27123 - protein, 7 aa, Artificial Sequence
  Description of Artificial Sequence: Synthetic peptide
CIRAGSC

SEQ ID NO: 27124 - protein, 7 aa, Artificial Sequence
  Description of Artificial Sequence: Synthetic peptide
GSHIAYT

SEQ ID NO: 27125 - protein, 7 aa, Artificial Sequence
  Description of Artificial Sequence: Synthetic peptide
SSSAKSI

SEQ ID NO: 27126 - protein, 7 aa, Artificial Sequence
  Description of Artificial Sequence: Synthetic peptide
AAHSTMN

SEQ ID NO: 27127 - protein, 7 aa, Artificial Sequence
  Description of Artificial Sequence: Synthetic peptide
SVGSGAL

SEQ ID NO: 27128 - protein, 7 aa, Artificial Sequence
  Description of Artificial Sequence: Synthetic peptide
PNGAHVT

SEQ ID NO: 27129 - protein, 7 aa, Artificial Sequence
  Description of Artificial Sequence: Synthetic peptide
PDRRPLE

SEQ ID NO: 27130 - protein, 7 aa, Artificial Sequence
  Description of Artificial Sequence: Synthetic peptide
SDRGQSH

SEQ ID NO: 27131 - protein, 7 aa, Artificial Sequence
  Description of Artificial Sequence: Synthetic peptide
SPVKGSV

SEQ ID NO: 27132 - protein, 7 aa, Artificial Sequence
  Description of Artificial Sequence: Synthetic peptide
DATKNHS

SEQ ID NO: 27133 - protein, 7 aa, Artificial Sequence
  Description of Artificial Sequence: Synthetic peptide
ERLTRSS

SEQ ID NO: 27134 - protein, 7 aa, Artificial Sequence
  Description of Artificial Sequence: Synthetic peptide
DSRAGVH

SEQ ID NO: 27135 - protein, 7 aa, Artificial Sequence
  Description of Artificial Sequence: Synthetic peptide
GQTGDMR

SEQ ID NO: 27136 - protein, 7 aa, Artificial Sequence
  Description of Artificial Sequence: Synthetic peptide
GRLEAQK

SEQ ID NO: 27137 - protein, 7 aa, Artificial Sequence
  Description of Artificial Sequence: Synthetic peptide
SSGLSSS

SEQ ID NO: 27138 - protein, 7 aa, Artificial Sequence
  Description of Artificial Sequence: Synthetic peptide
DPPKGSR

SEQ ID NO: 27139 - protein, 7 aa, Artificial Sequence
  Description of Artificial Sequence: Synthetic peptide
GDHNRIN

SEQ ID NO: 27140 - protein, 7 aa, Artificial Sequence
  Description of Artificial Sequence: Synthetic peptide
ASALRSH

SEQ ID NO: 27141 - protein, 7 aa, Artificial Sequence
  Description of Artificial Sequence: Synthetic peptide
YSTHLNN

SEQ ID NO: 27142 - protein, 7 aa, Artificial Sequence
  Description of Artificial Sequence: Synthetic peptide
TYNSSQA

SEQ ID NO: 27143 - protein, 7 aa, Artificial Sequence
  Description of Artificial Sequence: Synthetic peptide
NGSRQNQ

SEQ ID NO: 27144 - protein, 7 aa, Artificial Sequence
  Description of Artificial Sequence: Synthetic peptide
VVPERSK

SEQ ID NO: 27145 - protein, 7 aa, Artificial Sequence
  Description of Artificial Sequence: Synthetic peptide
VGLQSPE

SEQ ID NO: 27146 - protein, 7 aa, Artificial Sequence
  Description of Artificial Sequence: Synthetic peptide
TIKSVTN

SEQ ID NO: 27147 - protein, 7 aa, Artificial Sequence
  Description of Artificial Sequence: Synthetic peptide
RNDKQNS

SEQ ID NO: 27148 - protein, 7 aa, Artificial Sequence
  Description of Artificial Sequence: Synthetic peptide
GDKGLQR

SEQ ID NO: 27149 - protein, 7 aa, Artificial Sequence
  Description of Artificial Sequence: Synthetic peptide
CSSDTHR

SEQ ID NO: 27150 - protein, 7 aa, Artificial Sequence
  Description of Artificial Sequence: Synthetic peptide
SADHIRN

SEQ ID NO: 27151 - protein, 7 aa, Artificial Sequence
  Description of Artificial Sequence: Synthetic peptide
NGISKSN

SEQ ID NO: 27152 - protein, 7 aa, Artificial Sequence
  Description of Artificial Sequence: Synthetic peptide
RATPLSG

SEQ ID NO: 27153 - protein, 7 aa, Artificial Sequence
  Description of Artificial Sequence: Synthetic peptide
DGGNQRS

SEQ ID NO: 27154 - protein, 7 aa, Artificial Sequence
  Description of Artificial Sequence: Synthetic peptide
VSDNTYK

SEQ ID NO: 27155 - protein, 7 aa, Artificial Sequence
  Description of Artificial Sequence: Synthetic peptide
NVSGQNQ

SEQ ID NO: 27156 - protein, 7 aa, Artificial Sequence
  Description of Artificial Sequence: Synthetic peptide
SNQVRQI

SEQ ID NO: 27157 - protein, 7 aa, Artificial Sequence
  Description of Artificial Sequence: Synthetic peptide
PGGDRLR

SEQ ID NO: 27158 - protein, 7 aa, Artificial Sequence
  Description of Artificial Sequence: Synthetic peptide
FIRTASI

SEQ ID NO: 27159 - protein, 7 aa, Artificial Sequence
  Description of Artificial Sequence: Synthetic peptide
SMHALQC

SEQ ID NO: 27160 - protein, 7 aa, Artificial Sequence
  Description of Artificial Sequence: Synthetic peptide
RTGSYTQ

SEQ ID NO: 27161 - protein, 7 aa, Artificial Sequence
  Description of Artificial Sequence: Synthetic peptide
IIKKDQV

SEQ ID NO: 27162 - protein, 7 aa, Artificial Sequence
  Description of Artificial Sequence: Synthetic peptide
RPVGGLA

SEQ ID NO: 27163 - protein, 7 aa, Artificial Sequence
  Description of Artificial Sequence: Synthetic peptide
GMGGLKN

SEQ ID NO: 27164 - protein, 7 aa, Artificial Sequence
  Description of Artificial Sequence: Synthetic peptide
GVINNER

SEQ ID NO: 27165 - protein, 7 aa, Artificial Sequence
  Description of Artificial Sequence: Synthetic peptide
IISQKGM

SEQ ID NO: 27166 - protein, 7 aa, Artificial Sequence
  Description of Artificial Sequence: Synthetic peptide
LLDQPRN

SEQ ID NO: 27167 - protein, 7 aa, Artificial Sequence
  Description of Artificial Sequence: Synthetic peptide
GVTGSRG

SEQ ID NO: 27168 - protein, 7 aa, Artificial Sequence
  Description of Artificial Sequence: Synthetic peptide
EVNTRSR

SEQ ID NO: 27169 - protein, 7 aa, Artificial Sequence
  Description of Artificial Sequence: Synthetic peptide
NNNSGSG

SEQ ID NO: 27170 - protein, 7 aa, Artificial Sequence
  Description of Artificial Sequence: Synthetic peptide
LAKNPVI

SEQ ID NO: 27171 - protein, 7 aa, Artificial Sequence
  Description of Artificial Sequence: Synthetic peptide
PGGTTKG

SEQ ID NO: 27172 - protein, 7 aa, Artificial Sequence
  Description of Artificial Sequence: Synthetic peptide
WRSQHNS

SEQ ID NO: 27173 - protein, 7 aa, Artificial Sequence
  Description of Artificial Sequence: Synthetic peptide
SQSSRSG

SEQ ID NO: 27174 - protein, 7 aa, Artificial Sequence
  Description of Artificial Sequence: Synthetic peptide
GLHPPRT

SEQ ID NO: 27175 - protein, 7 aa, Artificial Sequence
  Description of Artificial Sequence: Synthetic peptide
GQERTNM

SEQ ID NO: 27176 - protein, 7 aa, Artificial Sequence
  Description of Artificial Sequence: Synthetic peptide
YLGKVQV

SEQ ID NO: 27177 - protein, 7 aa, Artificial Sequence
  Description of Artificial Sequence: Synthetic peptide
YADGARN

SEQ ID NO: 27178 - protein, 7 aa, Artificial Sequence
  Description of Artificial Sequence: Synthetic peptide
SREQGVG

SEQ ID NO: 27179 - protein, 7 aa, Artificial Sequence
  Description of Artificial Sequence: Synthetic peptide
STSIPGM

SEQ ID NO: 27180 - protein, 7 aa, Artificial Sequence
  Description of Artificial Sequence: Synthetic peptide
LHPKGQT

SEQ ID NO: 27181 - protein, 7 aa, Artificial Sequence
  Description of Artificial Sequence: Synthetic peptide
PRTDRNT

SEQ ID NO: 27182 - protein, 7 aa, Artificial Sequence
  Description of Artificial Sequence: Synthetic peptide
PRSLSTS

SEQ ID NO: 27183 - protein, 7 aa, Artificial Sequence
  Description of Artificial Sequence: Synthetic peptide
FPSNGRT

SEQ ID NO: 27184 - protein, 7 aa, Artificial Sequence
  Description of Artificial Sequence: Synthetic peptide
SMASAYK

SEQ ID NO: 27185 - protein, 7 aa, Artificial Sequence
  Description of Artificial Sequence: Synthetic peptide
LDAGVAR

SEQ ID NO: 27186 - protein, 7 aa, Artificial Sequence
  Description of Artificial Sequence: Synthetic peptide
HPSNKPL

SEQ ID NO: 27187 - protein, 7 aa, Artificial Sequence
  Description of Artificial Sequence: Synthetic peptide
ENISRSH

SEQ ID NO: 27188 - protein, 7 aa, Artificial Sequence
  Description of Artificial Sequence: Synthetic peptide
MGIANIG

SEQ ID NO: 27189 - protein, 7 aa, Artificial Sequence
  Description of Artificial Sequence: Synthetic peptide
QSEIVNK

SEQ ID NO: 27190 - protein, 7 aa, Artificial Sequence
  Description of Artificial Sequence: Synthetic peptide
FQKERYQ

SEQ ID NO: 27191 - protein, 7 aa, Artificial Sequence
  Description of Artificial Sequence: Synthetic peptide
PGAGNTR

SEQ ID NO: 27192 - protein, 7 aa, Artificial Sequence
  Description of Artificial Sequence: Synthetic peptide
SVPGVSR

SEQ ID NO: 27193 - protein, 7 aa, Artificial Sequence
  Description of Artificial Sequence: Synthetic peptide
RVSSGMS

SEQ ID NO: 27194 - protein, 7 aa, Artificial Sequence
  Description of Artificial Sequence: Synthetic peptide
HNNSKSA

SEQ ID NO: 27195 - protein, 7 aa, Artificial Sequence
  Description of Artificial Sequence: Synthetic peptide
VGARTGG

SEQ ID NO: 27196 - protein, 7 aa, Artificial Sequence
  Description of Artificial Sequence: Synthetic peptide
RENNTSS

SEQ ID NO: 27197 - protein, 7 aa, Artificial Sequence
  Description of Artificial Sequence: Synthetic peptide
SPGRTQS

SEQ ID NO: 27198 - protein, 7 aa, Artificial Sequence
  Description of Artificial Sequence: Synthetic peptide
NAPNSSG

SEQ ID NO: 27199 - protein, 7 aa, Artificial Sequence
  Description of Artificial Sequence: Synthetic peptide
PGSAMLN

SEQ ID NO: 27200 - protein, 7 aa, Artificial Sequence
  Description of Artificial Sequence: Synthetic peptide
HGQTGLI

SEQ ID NO: 27201 - protein, 7 aa, Artificial Sequence
  Description of Artificial Sequence: Synthetic peptide
SMMPSSS

SEQ ID NO: 27202 - protein, 7 aa, Artificial Sequence
  Description of Artificial Sequence: Synthetic peptide
QKTQTTS

SEQ ID NO: 27203 - protein, 7 aa, Artificial Sequence
  Description of Artificial Sequence: Synthetic peptide
VPGNLPS

SEQ ID NO: 27204 - protein, 7 aa, Artificial Sequence
  Description of Artificial Sequence: Synthetic peptide
SSGSNRS

SEQ ID NO: 27205 - protein, 7 aa, Artificial Sequence
  Description of Artificial Sequence: Synthetic peptide
SGVKAFS

SEQ ID NO: 27206 - protein, 7 aa, Artificial Sequence
  Description of Artificial Sequence: Synthetic peptide
KGDGRVM

SEQ ID NO: 27207 - protein, 7 aa, Artificial Sequence
  Description of Artificial Sequence: Synthetic peptide
GVVISSR

SEQ ID NO: 27208 - protein, 7 aa, Artificial Sequence
  Description of Artificial Sequence: Synthetic peptide
RLVPASG

SEQ ID NO: 27209 - protein, 7 aa, Artificial Sequence
  Description of Artificial Sequence: Synthetic peptide
RVLSNET

SEQ ID NO: 27210 - protein, 7 aa, Artificial Sequence
  Description of Artificial Sequence: Synthetic peptide
IRTSKMN

SEQ ID NO: 27211 - protein, 7 aa, Artificial Sequence
  Description of Artificial Sequence: Synthetic peptide
WSTSKQV

SEQ ID NO: 27212 - protein, 7 aa, Artificial Sequence
  Description of Artificial Sequence: Synthetic peptide
QPNASPT

SEQ ID NO: 27213 - protein, 7 aa, Artificial Sequence
  Description of Artificial Sequence: Synthetic peptide
SNATRAI

SEQ ID NO: 27214 - protein, 7 aa, Artificial Sequence
  Description of Artificial Sequence: Synthetic peptide
STTPGLK

SEQ ID NO: 27215 - protein, 7 aa, Artificial Sequence
  Description of Artificial Sequence: Synthetic peptide
IGTSINS

SEQ ID NO: 27216 - protein, 7 aa, Artificial Sequence
  Description of Artificial Sequence: Synthetic peptide
ENRVKVN

SEQ ID NO: 27217 - protein, 7 aa, Artificial Sequence
  Description of Artificial Sequence: Synthetic peptide
IGKNSMA

SEQ ID NO: 27218 - protein, 7 aa, Artificial Sequence
  Description of Artificial Sequence: Synthetic peptide
DNMSTPK

SEQ ID NO: 27219 - protein, 7 aa, Artificial Sequence
  Description of Artificial Sequence: Synthetic peptide
YGRGRDL

SEQ ID NO: 27220 - protein, 7 aa, Artificial Sequence
  Description of Artificial Sequence: Synthetic peptide
GSRNSSA

SEQ ID NO: 27221 - protein, 7 aa, Artificial Sequence
  Description of Artificial Sequence: Synthetic peptide
HVYPKQS

SEQ ID NO: 27222 - protein, 7 aa, Artificial Sequence
  Description of Artificial Sequence: Synthetic peptide
FNRSKVT

SEQ ID NO: 27223 - protein, 7 aa, Artificial Sequence
  Description of Artificial Sequence: Synthetic peptide
GSRPPGT

SEQ ID NO: 27224 - protein, 7 aa, Artificial Sequence
  Description of Artificial Sequence: Synthetic peptide
ANATPHH

SEQ ID NO: 27225 - protein, 7 aa, Artificial Sequence
  Description of Artificial Sequence: Synthetic peptide
VAGAAQR

SEQ ID NO: 27226 - protein, 7 aa, Artificial Sequence
  Description of Artificial Sequence: Synthetic peptide
PKVRDGY

SEQ ID NO: 27227 - protein, 7 aa, Artificial Sequence
  Description of Artificial Sequence: Synthetic peptide
PPNGYQS

SEQ ID NO: 27228 - protein, 7 aa, Artificial Sequence
  Description of Artificial Sequence: Synthetic peptide
NVPSISR

SEQ ID NO: 27229 - protein, 7 aa, Artificial Sequence
  Description of Artificial Sequence: Synthetic peptide
TPQNSVK

SEQ ID NO: 27230 - protein, 7 aa, Artificial Sequence
  Description of Artificial Sequence: Synthetic peptide
SHTGNMV

SEQ ID NO: 27231 - protein, 7 aa, Artificial Sequence
  Description of Artificial Sequence: Synthetic peptide
RDPTPVR

SEQ ID NO: 27232 - protein, 7 aa, Artificial Sequence
  Description of Artificial Sequence: Synthetic peptide
YVTSSGG

SEQ ID NO: 27233 - protein, 7 aa, Artificial Sequence
  Description of Artificial Sequence: Synthetic peptide
GTGHQRS

SEQ ID NO: 27234 - protein, 7 aa, Artificial Sequence
  Description of Artificial Sequence: Synthetic peptide
GSGIKRE

SEQ ID NO: 27235 - protein, 7 aa, Artificial Sequence
  Description of Artificial Sequence: Synthetic peptide
VKTAKVN

SEQ ID NO: 27236 - protein, 7 aa, Artificial Sequence
  Description of Artificial Sequence: Synthetic peptide
VTGQNQT

SEQ ID NO: 27237 - protein, 7 aa, Artificial Sequence
  Description of Artificial Sequence: Synthetic peptide
SGRSVGN

SEQ ID NO: 27238 - protein, 7 aa, Artificial Sequence
  Description of Artificial Sequence: Synthetic peptide
PPSTLKN

SEQ ID NO: 27239 - protein, 7 aa, Artificial Sequence
  Description of Artificial Sequence: Synthetic peptide
PNLQSSK

SEQ ID NO: 27240 - protein, 7 aa, Artificial Sequence
  Description of Artificial Sequence: Synthetic peptide
REPRVQE

SEQ ID NO: 27241 - protein, 7 aa, Artificial Sequence
  Description of Artificial Sequence: Synthetic peptide
NRSGQNQ

SEQ ID NO: 27242 - protein, 7 aa, Artificial Sequence
  Description of Artificial Sequence: Synthetic peptide
QVSAKSA

SEQ ID NO: 27243 - protein, 7 aa, Artificial Sequence
  Description of Artificial Sequence: Synthetic peptide
STHKNSP

SEQ ID NO: 27244 - protein, 7 aa, Artificial Sequence
  Description of Artificial Sequence: Synthetic peptide
TFSKGTN

SEQ ID NO: 27245 - protein, 7 aa, Artificial Sequence
  Description of Artificial Sequence: Synthetic peptide
GLEHNRA

SEQ ID NO: 27246 - protein, 7 aa, Artificial Sequence
  Description of Artificial Sequence: Synthetic peptide
RSTKTEN

SEQ ID NO: 27247 - protein, 7 aa, Artificial Sequence
  Description of Artificial Sequence: Synthetic peptide
QLGDRNR

SEQ ID NO: 27248 - protein, 7 aa, Artificial Sequence
  Description of Artificial Sequence: Synthetic peptide
HNSKSQI

SEQ ID NO: 27249 - protein, 7 aa, Artificial Sequence
  Description of Artificial Sequence: Synthetic peptide
PRERDRS

SEQ ID NO: 27250 - protein, 7 aa, Artificial Sequence
  Description of Artificial Sequence: Synthetic peptide
QEGVRSS

SEQ ID NO: 27251 - protein, 7 aa, Artificial Sequence
  Description of Artificial Sequence: Synthetic peptide
NVNGRTH

SEQ ID NO: 27252 - protein, 7 aa, Artificial Sequence
  Description of Artificial Sequence: Synthetic peptide
ATNKTTN

SEQ ID NO: 27253 - protein, 7 aa, Artificial Sequence
  Description of Artificial Sequence: Synthetic peptide
QSTGRER

SEQ ID NO: 27254 - protein, 7 aa, Artificial Sequence
  Description of Artificial Sequence: Synthetic peptide
YHSKGTT

SEQ ID NO: 27255 - protein, 7 aa, Artificial Sequence
  Description of Artificial Sequence: Synthetic peptide
GNRPTTL

SEQ ID NO: 27256 - protein, 7 aa, Artificial Sequence
  Description of Artificial Sequence: Synthetic peptide
QRNVSVV

SEQ ID NO: 27257 - protein, 7 aa, Artificial Sequence
  Description of Artificial Sequence: Synthetic peptide
DNTGRNA

SEQ ID NO: 27258 - protein, 7 aa, Artificial Sequence
  Description of Artificial Sequence: Synthetic peptide
QTQGQLK

SEQ ID NO: 27259 - protein, 7 aa, Artificial Sequence
  Description of Artificial Sequence: Synthetic peptide
NGSGQNK

SEQ ID NO: 27260 - protein, 7 aa, Artificial Sequence
  Description of Artificial Sequence: Synthetic peptide
NSEARLS

SEQ ID NO: 27261 - protein, 7 aa, Artificial Sequence
  Description of Artificial Sequence: Synthetic peptide
LCRAQTG

SEQ ID NO: 27262 - protein, 7 aa, Artificial Sequence
  Description of Artificial Sequence: Synthetic peptide
RDGTPPT

SEQ ID NO: 27263 - protein, 7 aa, Artificial Sequence
  Description of Artificial Sequence: Synthetic peptide
RMNGGGP

SEQ ID NO: 27264 - protein, 7 aa, Artificial Sequence
  Description of Artificial Sequence: Synthetic peptide
AGRTHSC

SEQ ID NO: 27265 - protein, 7 aa, Artificial Sequence
  Description of Artificial Sequence: Synthetic peptide
KRDAHTA

SEQ ID NO: 27266 - protein, 7 aa, Artificial Sequence
  Description of Artificial Sequence: Synthetic peptide
TSMNGNK

SEQ ID NO: 27267 - protein, 7 aa, Artificial Sequence
  Description of Artificial Sequence: Synthetic peptide
QEHPDRR

SEQ ID NO: 27268 - protein, 7 aa, Artificial Sequence
  Description of Artificial Sequence: Synthetic peptide
QSKIPHP

SEQ ID NO: 27269 - protein, 7 aa, Artificial Sequence
  Description of Artificial Sequence: Synthetic peptide
VCSPEGK

SEQ ID NO: 27270 - protein, 7 aa, Artificial Sequence
  Description of Artificial Sequence: Synthetic peptide
QLNEEHG

SEQ ID NO: 27271 - protein, 7 aa, Artificial Sequence
  Description of Artificial Sequence: Synthetic peptide
ETTTPRK

SEQ ID NO: 27272 - protein, 7 aa, Artificial Sequence
  Description of Artificial Sequence: Synthetic peptide
EMKGHTA

SEQ ID NO: 27273 - protein, 7 aa, Artificial Sequence
  Description of Artificial Sequence: Synthetic peptide
TNRGGTP

SEQ ID NO: 27274 - protein, 7 aa, Artificial Sequence
  Description of Artificial Sequence: Synthetic peptide
SGSNNFL

SEQ ID NO: 27275 - protein, 7 aa, Artificial Sequence
  Description of Artificial Sequence: Synthetic peptide
SSAKSSL

SEQ ID NO: 27276 - protein, 7 aa, Artificial Sequence
  Description of Artificial Sequence: Synthetic peptide
WAGSNPR

SEQ ID NO: 27277 - protein, 7 aa, Artificial Sequence
  Description of Artificial Sequence: Synthetic peptide
NNKSASQ

SEQ ID NO: 27278 - protein, 7 aa, Artificial Sequence
  Description of Artificial Sequence: Synthetic peptide
KSAQGGN

SEQ ID NO: 27279 - protein, 7 aa, Artificial Sequence
  Description of Artificial Sequence: Synthetic peptide
SSGPSSG

SEQ ID NO: 27280 - protein, 7 aa, Artificial Sequence
  Description of Artificial Sequence: Synthetic peptide
ETLPSLI

SEQ ID NO: 27281 - protein, 7 aa, Artificial Sequence
  Description of Artificial Sequence: Synthetic peptide
QANTSTE

SEQ ID NO: 27282 - protein, 7 aa, Artificial Sequence
  Description of Artificial Sequence: Synthetic peptide
GINKNGT

SEQ ID NO: 27283 - protein, 7 aa, Artificial Sequence
  Description of Artificial Sequence: Synthetic peptide
RPMKSTN

SEQ ID NO: 27284 - protein, 7 aa, Artificial Sequence
  Description of Artificial Sequence: Synthetic peptide
PEIGKQR

SEQ ID NO: 27285 - protein, 7 aa, Artificial Sequence
  Description of Artificial Sequence: Synthetic peptide
KVDKRTD

SEQ ID NO: 27286 - protein, 7 aa, Artificial Sequence
  Description of Artificial Sequence: Synthetic peptide
IPLTLSL

SEQ ID NO: 27287 - protein, 7 aa, Artificial Sequence
  Description of Artificial Sequence: Synthetic peptide
FPLKLGR

SEQ ID NO: 27288 - protein, 7 aa, Artificial Sequence
  Description of Artificial Sequence: Synthetic peptide
LSRSKQG

SEQ ID NO: 27289 - protein, 7 aa, Artificial Sequence
  Description of Artificial Sequence: Synthetic peptide
DKPAGSL

SEQ ID NO: 27290 - protein, 7 aa, Artificial Sequence
  Description of Artificial Sequence: Synthetic peptide
LNPNVAR

SEQ ID NO: 27291 - protein, 7 aa, Artificial Sequence
  Description of Artificial Sequence: Synthetic peptide
QSKAGNS

SEQ ID NO: 27292 - protein, 7 aa, Artificial Sequence
  Description of Artificial Sequence: Synthetic peptide
PNRVPNH

SEQ ID NO: 27293 - protein, 7 aa, Artificial Sequence
  Description of Artificial Sequence: Synthetic peptide
TTIPKRQ

SEQ ID NO: 27294 - protein, 7 aa, Artificial Sequence
  Description of Artificial Sequence: Synthetic peptide
FGDHTRT

SEQ ID NO: 27295 - protein, 7 aa, Artificial Sequence
  Description of Artificial Sequence: Synthetic peptide
PRISGNL

SEQ ID NO: 27296 - protein, 7 aa, Artificial Sequence
  Description of Artificial Sequence: Synthetic peptide
RNNPTTV

SEQ ID NO: 27297 - protein, 7 aa, Artificial Sequence
  Description of Artificial Sequence: Synthetic peptide
ATTKDGI

SEQ ID NO: 27298 - protein, 7 aa, Artificial Sequence
  Description of Artificial Sequence: Synthetic peptide
SKPSGSS

SEQ ID NO: 27299 - protein, 7 aa, Artificial Sequence
  Description of Artificial Sequence: Synthetic peptide
PSTKTRV

SEQ ID NO: 27300 - protein, 7 aa, Artificial Sequence
  Description of Artificial Sequence: Synthetic peptide
DPLGKQG

SEQ ID NO: 27301 - protein, 7 aa, Artificial Sequence
  Description of Artificial Sequence: Synthetic peptide
HTRPNSM

SEQ ID NO: 27302 - protein, 7 aa, Artificial Sequence
  Description of Artificial Sequence: Synthetic peptide
TQSHNLA

SEQ ID NO: 27303 - protein, 7 aa, Artificial Sequence
  Description of Artificial Sequence: Synthetic peptide
LGKSAHS

SEQ ID NO: 27304 - protein, 7 aa, Artificial Sequence
  Description of Artificial Sequence: Synthetic peptide
HNGRNVS

SEQ ID NO: 27305 - protein, 7 aa, Artificial Sequence
  Description of Artificial Sequence: Synthetic peptide
YNNGGTR

SEQ ID NO: 27306 - protein, 7 aa, Artificial Sequence
  Description of Artificial Sequence: Synthetic peptide
STTAQVK

SEQ ID NO: 27307 - protein, 7 aa, Artificial Sequence
  Description of Artificial Sequence: Synthetic peptide
FRNNGSH

SEQ ID NO: 27308 - protein, 7 aa, Artificial Sequence
  Description of Artificial Sequence: Synthetic peptide
GQIKNLG

SEQ ID NO: 27309 - protein, 7 aa, Artificial Sequence
  Description of Artificial Sequence: Synthetic peptide
NPVAAAT

SEQ ID NO: 27310 - protein, 7 aa, Artificial Sequence
  Description of Artificial Sequence: Synthetic peptide
PSAGREK

SEQ ID NO: 27311 - protein, 7 aa, Artificial Sequence
  Description of Artificial Sequence: Synthetic peptide
TGVSPLA

SEQ ID NO: 27312 - protein, 7 aa, Artificial Sequence
  Description of Artificial Sequence: Synthetic peptide
FPVNAGA

SEQ ID NO: 27313 - protein, 7 aa, Artificial Sequence
  Description of Artificial Sequence: Synthetic peptide
SFSGANK

SEQ ID NO: 27314 - protein, 7 aa, Artificial Sequence
  Description of Artificial Sequence: Synthetic peptide
KQGGPTG

SEQ ID NO: 27315 - protein, 7 aa, Artificial Sequence
  Description of Artificial Sequence: Synthetic peptide
TKSTSHV

SEQ ID NO: 27316 - protein, 7 aa, Artificial Sequence
  Description of Artificial Sequence: Synthetic peptide
GSIKAPP

SEQ ID NO: 27317 - protein, 7 aa, Artificial Sequence
  Description of Artificial Sequence: Synthetic peptide
YGLPSSR

SEQ ID NO: 27318 - protein, 7 aa, Artificial Sequence
  Description of Artificial Sequence: Synthetic peptide
RQDSTPG

SEQ ID NO: 27319 - protein, 7 aa, Artificial Sequence
  Description of Artificial Sequence: Synthetic peptide
PTLASGR

SEQ ID NO: 27320 - protein, 7 aa, Artificial Sequence
  Description of Artificial Sequence: Synthetic peptide
NPGSGYG

SEQ ID NO: 27321 - protein, 7 aa, Artificial Sequence
  Description of Artificial Sequence: Synthetic peptide
LVASGQK

SEQ ID NO: 27322 - protein, 7 aa, Artificial Sequence
  Description of Artificial Sequence: Synthetic peptide
GLPTEKM

SEQ ID NO: 27323 - protein, 7 aa, Artificial Sequence
  Description of Artificial Sequence: Synthetic peptide
TVGTTTI

SEQ ID NO: 27324 - protein, 7 aa, Artificial Sequence
  Description of Artificial Sequence: Synthetic peptide
PSVNRTP

SEQ ID NO: 27325 - protein, 7 aa, Artificial Sequence
  Description of Artificial Sequence: Synthetic peptide
LGTSQMK

SEQ ID NO: 27326 - protein, 7 aa, Artificial Sequence
  Description of Artificial Sequence: Synthetic peptide
QKTNKLY

SEQ ID NO: 27327 - protein, 7 aa, Artificial Sequence
  Description of Artificial Sequence: Synthetic peptide
TSKPNSP

SEQ ID NO: 27328 - protein, 7 aa, Artificial Sequence
  Description of Artificial Sequence: Synthetic peptide
TSTQKGQ

SEQ ID NO: 27329 - protein, 7 aa, Artificial Sequence
  Description of Artificial Sequence: Synthetic peptide
SISNQRS

SEQ ID NO: 27330 - protein, 7 aa, Artificial Sequence
  Description of Artificial Sequence: Synthetic peptide
YTITPQK

SEQ ID NO: 27331 - protein, 7 aa, Artificial Sequence
  Description of Artificial Sequence: Synthetic peptide
LGIRDNT

SEQ ID NO: 27332 - protein, 7 aa, Artificial Sequence
  Description of Artificial Sequence: Synthetic peptide
KVSAQAL

SEQ ID NO: 27333 - protein, 7 aa, Artificial Sequence
  Description of Artificial Sequence: Synthetic peptide
PSTFTEV

SEQ ID NO: 27334 - protein, 7 aa, Artificial Sequence
  Description of Artificial Sequence: Synthetic peptide
NRSKESA

SEQ ID NO: 27335 - protein, 7 aa, Artificial Sequence
  Description of Artificial Sequence: Synthetic peptide
SHNSKVS

SEQ ID NO: 27336 - protein, 7 aa, Artificial Sequence
  Description of Artificial Sequence: Synthetic peptide
ETPNRSQ

SEQ ID NO: 27337 - protein, 7 aa, Artificial Sequence
  Description of Artificial Sequence: Synthetic peptide
ETKRSNM

SEQ ID NO: 27338 - protein, 7 aa, Artificial Sequence
  Description of Artificial Sequence: Synthetic peptide
LPSFRPP

SEQ ID NO: 27339 - protein, 7 aa, Artificial Sequence
  Description of Artificial Sequence: Synthetic peptide
PGTGSNH

SEQ ID NO: 27340 - protein, 7 aa, Artificial Sequence
  Description of Artificial Sequence: Synthetic peptide
PGSRALT

SEQ ID NO: 27341 - protein, 7 aa, Artificial Sequence
  Description of Artificial Sequence: Synthetic peptide
NNSRVLG

SEQ ID NO: 27342 - protein, 7 aa, Artificial Sequence
  Description of Artificial Sequence: Synthetic peptide
MNRAPTN

SEQ ID NO: 27343 - protein, 7 aa, Artificial Sequence
  Description of Artificial Sequence: Synthetic peptide
GPHTAVG

SEQ ID NO: 27344 - protein, 7 aa, Artificial Sequence
  Description of Artificial Sequence: Synthetic peptide
QSHSGIS

SEQ ID NO: 27345 - protein, 7 aa, Artificial Sequence
  Description of Artificial Sequence: Synthetic peptide
HGGPGAV

SEQ ID NO: 27346 - protein, 7 aa, Artificial Sequence
  Description of Artificial Sequence: Synthetic peptide
LNRAHTS

SEQ ID NO: 27347 - protein, 7 aa, Artificial Sequence
  Description of Artificial Sequence: Synthetic peptide
AGSKTTS

SEQ ID NO: 27348 - protein, 7 aa, Artificial Sequence
  Description of Artificial Sequence: Synthetic peptide
ELMNKSK

SEQ ID NO: 27349 - protein, 7 aa, Artificial Sequence
  Description of Artificial Sequence: Synthetic peptide
EGSGRLT

SEQ ID NO: 27350 - protein, 7 aa, Artificial Sequence
  Description of Artificial Sequence: Synthetic peptide
AVGKSTE

SEQ ID NO: 27351 - protein, 7 aa, Artificial Sequence
  Description of Artificial Sequence: Synthetic peptide
YRSKEIG

SEQ ID NO: 27352 - protein, 7 aa, Artificial Sequence
  Description of Artificial Sequence: Synthetic peptide
SRNSPPQ

SEQ ID NO: 27353 - protein, 7 aa, Artificial Sequence
  Description of Artificial Sequence: Synthetic peptide
TGSGQNQ

SEQ ID NO: 27354 - protein, 7 aa, Artificial Sequence
  Description of Artificial Sequence: Synthetic peptide
PNNQSTR

SEQ ID NO: 27355 - protein, 7 aa, Artificial Sequence
  Description of Artificial Sequence: Synthetic peptide
GTFSTQS

SEQ ID NO: 27356 - protein, 7 aa, Artificial Sequence
  Description of Artificial Sequence: Synthetic peptide
NISSKVA

SEQ ID NO: 27357 - protein, 7 aa, Artificial Sequence
  Description of Artificial Sequence: Synthetic peptide
QAVARQA

SEQ ID NO: 27358 - protein, 7 aa, Artificial Sequence
  Description of Artificial Sequence: Synthetic peptide
PLERTTK

SEQ ID NO: 27359 - protein, 7 aa, Artificial Sequence
  Description of Artificial Sequence: Synthetic peptide
YQTNNKH

SEQ ID NO: 27360 - protein, 7 aa, Artificial Sequence
  Description of Artificial Sequence: Synthetic peptide
RTDTHSL

SEQ ID NO: 27361 - protein, 7 aa, Artificial Sequence
  Description of Artificial Sequence: Synthetic peptide
SFRAQEG

SEQ ID NO: 27362 - protein, 7 aa, Artificial Sequence
  Description of Artificial Sequence: Synthetic peptide
TTGGHAL

SEQ ID NO: 27363 - protein, 7 aa, Artificial Sequence
  Description of Artificial Sequence: Synthetic peptide
MSSKQVS

SEQ ID NO: 27364 - protein, 7 aa, Artificial Sequence
  Description of Artificial Sequence: Synthetic peptide
PYNVRPA

SEQ ID NO: 27365 - protein, 7 aa, Artificial Sequence
  Description of Artificial Sequence: Synthetic peptide
QQSPRNG

SEQ ID NO: 27366 - protein, 7 aa, Artificial Sequence
  Description of Artificial Sequence: Synthetic peptide
TTMSKVG

SEQ ID NO: 27367 - protein, 7 aa, Artificial Sequence
  Description of Artificial Sequence: Synthetic peptide
PYNSKAS

SEQ ID NO: 27368 - protein, 7 aa, Artificial Sequence
  Description of Artificial Sequence: Synthetic peptide
RAITQSN

SEQ ID NO: 27369 - protein, 7 aa, Artificial Sequence
  Description of Artificial Sequence: Synthetic peptide
RHASDFY

SEQ ID NO: 27370 - protein, 7 aa, Artificial Sequence
  Description of Artificial Sequence: Synthetic peptide
NTQSYTS

SEQ ID NO: 27371 - protein, 7 aa, Artificial Sequence
  Description of Artificial Sequence: Synthetic peptide
PTDRINR

SEQ ID NO: 27372 - protein, 7 aa, Artificial Sequence
  Description of Artificial Sequence: Synthetic peptide
NAQQAQR

SEQ ID NO: 27373 - protein, 7 aa, Artificial Sequence
  Description of Artificial Sequence: Synthetic peptide
MSLSKNH

SEQ ID NO: 27374 - protein, 7 aa, Artificial Sequence
  Description of Artificial Sequence: Synthetic peptide
ATTSRIS

SEQ ID NO: 27375 - protein, 7 aa, Artificial Sequence
  Description of Artificial Sequence: Synthetic peptide
SLGSGFQ

SEQ ID NO: 27376 - protein, 7 aa, Artificial Sequence
  Description of Artificial Sequence: Synthetic peptide
EGLNTSR

SEQ ID NO: 27377 - protein, 7 aa, Artificial Sequence
  Description of Artificial Sequence: Synthetic peptide
SSQEVLR

SEQ ID NO: 27378 - protein, 7 aa, Artificial Sequence
  Description of Artificial Sequence: Synthetic peptide
RATEGVF

SEQ ID NO: 27379 - protein, 7 aa, Artificial Sequence
  Description of Artificial Sequence: Synthetic peptide
GTTSSRD

SEQ ID NO: 27380 - protein, 7 aa, Artificial Sequence
  Description of Artificial Sequence: Synthetic peptide
NRQGILS

SEQ ID NO: 27381 - protein, 7 aa, Artificial Sequence
  Description of Artificial Sequence: Synthetic peptide
STTKDGI

SEQ ID NO: 27382 - protein, 7 aa, Artificial Sequence
  Description of Artificial Sequence: Synthetic peptide
RSGSVNP

SEQ ID NO: 27383 - protein, 7 aa, Artificial Sequence
  Description of Artificial Sequence: Synthetic peptide
DTNKTSY

SEQ ID NO: 27384 - protein, 7 aa, Artificial Sequence
  Description of Artificial Sequence: Synthetic peptide
LPGQLRT

SEQ ID NO: 27385 - protein, 7 aa, Artificial Sequence
  Description of Artificial Sequence: Synthetic peptide
TTSGAGR

SEQ ID NO: 27386 - protein, 7 aa, Artificial Sequence
  Description of Artificial Sequence: Synthetic peptide
AFGGETK

SEQ ID NO: 27387 - protein, 7 aa, Artificial Sequence
  Description of Artificial Sequence: Synthetic peptide
STGVRVG

SEQ ID NO: 27388 - protein, 7 aa, Artificial Sequence
  Description of Artificial Sequence: Synthetic peptide
PARDSKS

SEQ ID NO: 27389 - protein, 7 aa, Artificial Sequence
  Description of Artificial Sequence: Synthetic peptide
GHPTNTT

SEQ ID NO: 27390 - protein, 7 aa, Artificial Sequence
  Description of Artificial Sequence: Synthetic peptide
SSAGTYT

SEQ ID NO: 27391 - protein, 7 aa, Artificial Sequence
  Description of Artificial Sequence: Synthetic peptide
TPITPMT

SEQ ID NO: 27392 - protein, 7 aa, Artificial Sequence
  Description of Artificial Sequence: Synthetic peptide
IRSKASA

SEQ ID NO: 27393 - protein, 7 aa, Artificial Sequence
  Description of Artificial Sequence: Synthetic peptide
PVGSSGP

SEQ ID NO: 27394 - protein, 7 aa, Artificial Sequence
  Description of Artificial Sequence: Synthetic peptide
TQQHGSN

SEQ ID NO: 27395 - protein, 7 aa, Artificial Sequence
  Description of Artificial Sequence: Synthetic peptide
STTNSKN

SEQ ID NO: 27396 - protein, 7 aa, Artificial Sequence
  Description of Artificial Sequence: Synthetic peptide
PGSSNRN

SEQ ID NO: 27397 - protein, 7 aa, Artificial Sequence
  Description of Artificial Sequence: Synthetic peptide
PIGSQHI

SEQ ID NO: 27398 - protein, 7 aa, Artificial Sequence
  Description of Artificial Sequence: Synthetic peptide
NNAHSSS

SEQ ID NO: 27399 - protein, 7 aa, Artificial Sequence
  Description of Artificial Sequence: Synthetic peptide
NTLQGHR

SEQ ID NO: 27400 - protein, 7 aa, Artificial Sequence
  Description of Artificial Sequence: Synthetic peptide
YNRSERP

SEQ ID NO: 27401 - protein, 7 aa, Artificial Sequence
  Description of Artificial Sequence: Synthetic peptide
PTKGANA

SEQ ID NO: 27402 - protein, 7 aa, Artificial Sequence
  Description of Artificial Sequence: Synthetic peptide
PLGQSYR

SEQ ID NO: 27403 - protein, 7 aa, Artificial Sequence
  Description of Artificial Sequence: Synthetic peptide
TNPKSSS

SEQ ID NO: 27404 - protein, 7 aa, Artificial Sequence
  Description of Artificial Sequence: Synthetic peptide
AEQRPGQ

SEQ ID NO: 27405 - protein, 7 aa, Artificial Sequence
  Description of Artificial Sequence: Synthetic peptide
DPRNSTS

SEQ ID NO: 27406 - protein, 7 aa, Artificial Sequence
  Description of Artificial Sequence: Synthetic peptide
VSTRSIS

SEQ ID NO: 27407 - protein, 7 aa, Artificial Sequence
  Description of Artificial Sequence: Synthetic peptide
WRTSKAT

SEQ ID NO: 27408 - protein, 7 aa, Artificial Sequence
  Description of Artificial Sequence: Synthetic peptide
YTGSQYM

SEQ ID NO: 27409 - protein, 7 aa, Artificial Sequence
  Description of Artificial Sequence: Synthetic peptide
CGRPQIR

SEQ ID NO: 27410 - protein, 7 aa, Artificial Sequence
  Description of Artificial Sequence: Synthetic peptide
VFNRNAS

SEQ ID NO: 27411 - protein, 7 aa, Artificial Sequence
  Description of Artificial Sequence: Synthetic peptide
GTSGGIV

SEQ ID NO: 27412 - protein, 7 aa, Artificial Sequence
  Description of Artificial Sequence: Synthetic peptide
RVVTNNL

SEQ ID NO: 27413 - protein, 7 aa, Artificial Sequence
  Description of Artificial Sequence: Synthetic peptide
QTRSAER

SEQ ID NO: 27414 - protein, 7 aa, Artificial Sequence
  Description of Artificial Sequence: Synthetic peptide
LNHSKYS

SEQ ID NO: 27415 - protein, 7 aa, Artificial Sequence
  Description of Artificial Sequence: Synthetic peptide
ATNHSPQ

SEQ ID NO: 27416 - protein, 7 aa, Artificial Sequence
  Description of Artificial Sequence: Synthetic peptide
CSNQRML

SEQ ID NO: 27417 - protein, 7 aa, Artificial Sequence
  Description of Artificial Sequence: Synthetic peptide
HGSGQNQ

SEQ ID NO: 27418 - protein, 7 aa, Artificial Sequence
  Description of Artificial Sequence: Synthetic peptide
PGTTSVG

SEQ ID NO: 27419 - protein, 7 aa, Artificial Sequence
  Description of Artificial Sequence: Synthetic peptide
IGNKQSQ

SEQ ID NO: 27420 - protein, 7 aa, Artificial Sequence
  Description of Artificial Sequence: Synthetic peptide
NPGKGSS

SEQ ID NO: 27421 - protein, 7 aa, Artificial Sequence
  Description of Artificial Sequence: Synthetic peptide
NSNTRGP

SEQ ID NO: 27422 - protein, 7 aa, Artificial Sequence
  Description of Artificial Sequence: Synthetic peptide
AGSSPPT

SEQ ID NO: 27423 - protein, 7 aa, Artificial Sequence
  Description of Artificial Sequence: Synthetic peptide
QNQNSGR

SEQ ID NO: 27424 - protein, 7 aa, Artificial Sequence
  Description of Artificial Sequence: Synthetic peptide
SMANTVA

SEQ ID NO: 27425 - protein, 7 aa, Artificial Sequence
  Description of Artificial Sequence: Synthetic peptide
VQRSSNQ

SEQ ID NO: 27426 - protein, 7 aa, Artificial Sequence
  Description of Artificial Sequence: Synthetic peptide
NGNISIG

SEQ ID NO: 27427 - protein, 7 aa, Artificial Sequence
  Description of Artificial Sequence: Synthetic peptide
SPEKNMR

SEQ ID NO: 27428 - protein, 7 aa, Artificial Sequence
  Description of Artificial Sequence: Synthetic peptide
QDMRLSG

SEQ ID NO: 27429 - protein, 7 aa, Artificial Sequence
  Description of Artificial Sequence: Synthetic peptide
GNGISTK

SEQ ID NO: 27430 - protein, 7 aa, Artificial Sequence
  Description of Artificial Sequence: Synthetic peptide
FQPRSST

SEQ ID NO: 27431 - protein, 7 aa, Artificial Sequence
  Description of Artificial Sequence: Synthetic peptide
DPVTRQS

SEQ ID NO: 27432 - protein, 7 aa, Artificial Sequence
  Description of Artificial Sequence: Synthetic peptide
SISHSSS

SEQ ID NO: 27433 - protein, 7 aa, Artificial Sequence
  Description of Artificial Sequence: Synthetic peptide
PGNMTSR

SEQ ID NO: 27434 - protein, 7 aa, Artificial Sequence
  Description of Artificial Sequence: Synthetic peptide
LCASKCD

SEQ ID NO: 27435 - protein, 7 aa, Artificial Sequence
  Description of Artificial Sequence: Synthetic peptide
NDSGQNQ

SEQ ID NO: 27436 - protein, 7 aa, Artificial Sequence
  Description of Artificial Sequence: Synthetic peptide
PSNSGNN

SEQ ID NO: 27437 - protein, 7 aa, Artificial Sequence
  Description of Artificial Sequence: Synthetic peptide
RQNGGVK

SEQ ID NO: 27438 - protein, 7 aa, Artificial Sequence
  Description of Artificial Sequence: Synthetic peptide
TSERPTC

SEQ ID NO: 27439 - protein, 7 aa, Artificial Sequence
  Description of Artificial Sequence: Synthetic peptide
TRYDNVG

SEQ ID NO: 27440 - protein, 7 aa, Artificial Sequence
  Description of Artificial Sequence: Synthetic peptide
GAGRALQ

SEQ ID NO: 27441 - protein, 7 aa, Artificial Sequence
  Description of Artificial Sequence: Synthetic peptide
NGVPHPK

SEQ ID NO: 27442 - protein, 7 aa, Artificial Sequence
  Description of Artificial Sequence: Synthetic peptide
PSTQSSS

SEQ ID NO: 27443 - protein, 7 aa, Artificial Sequence
  Description of Artificial Sequence: Synthetic peptide
TKPGVGS

SEQ ID NO: 27444 - protein, 7 aa, Artificial Sequence
  Description of Artificial Sequence: Synthetic peptide
SIKTVTN

SEQ ID NO: 27445 - protein, 7 aa, Artificial Sequence
  Description of Artificial Sequence: Synthetic peptide
RQSTNIG

SEQ ID NO: 27446 - protein, 7 aa, Artificial Sequence
  Description of Artificial Sequence: Synthetic peptide
PTSQQRP

SEQ ID NO: 27447 - protein, 7 aa, Artificial Sequence
  Description of Artificial Sequence: Synthetic peptide
PTVQVTK

SEQ ID NO: 27448 - protein, 7 aa, Artificial Sequence
  Description of Artificial Sequence: Synthetic peptide
NTSNNIQ

SEQ ID NO: 27449 - protein, 7 aa, Artificial Sequence
  Description of Artificial Sequence: Synthetic peptide
QPAGKVV

SEQ ID NO: 27450 - protein, 7 aa, Artificial Sequence
  Description of Artificial Sequence: Synthetic peptide
VRESRSS

SEQ ID NO: 27451 - protein, 7 aa, Artificial Sequence
  Description of Artificial Sequence: Synthetic peptide
MGSVAML

SEQ ID NO: 27452 - protein, 7 aa, Artificial Sequence
  Description of Artificial Sequence: Synthetic peptide
LPGQGVG

SEQ ID NO: 27453 - protein, 7 aa, Artificial Sequence
  Description of Artificial Sequence: Synthetic peptide
SNGQRKE

SEQ ID NO: 27454 - protein, 7 aa, Artificial Sequence
  Description of Artificial Sequence: Synthetic peptide
PGINTNS

SEQ ID NO: 27455 - protein, 7 aa, Artificial Sequence
  Description of Artificial Sequence: Synthetic peptide
PTTRMVN

SEQ ID NO: 27456 - protein, 7 aa, Artificial Sequence
  Description of Artificial Sequence: Synthetic peptide
YGKSVTP

SEQ ID NO: 27457 - protein, 7 aa, Artificial Sequence
  Description of Artificial Sequence: Synthetic peptide
SLHQVGG

SEQ ID NO: 27458 - protein, 7 aa, Artificial Sequence
  Description of Artificial Sequence: Synthetic peptide
ENSSKAK

SEQ ID NO: 27459 - protein, 7 aa, Artificial Sequence
  Description of Artificial Sequence: Synthetic peptide
MSSERPG

SEQ ID NO: 27460 - protein, 7 aa, Artificial Sequence
  Description of Artificial Sequence: Synthetic peptide
SKAGRVT

SEQ ID NO: 27461 - protein, 7 aa, Artificial Sequence
  Description of Artificial Sequence: Synthetic peptide
HKVPGSG

SEQ ID NO: 27462 - protein, 7 aa, Artificial Sequence
  Description of Artificial Sequence: Synthetic peptide
HLRDKYS

SEQ ID NO: 27463 - protein, 7 aa, Artificial Sequence
  Description of Artificial Sequence: Synthetic peptide
KNGSVAL

SEQ ID NO: 27464 - protein, 7 aa, Artificial Sequence
  Description of Artificial Sequence: Synthetic peptide
FTSNKAS

SEQ ID NO: 27465 - protein, 7 aa, Artificial Sequence
  Description of Artificial Sequence: Synthetic peptide
GTGKIMP

SEQ ID NO: 27466 - protein, 7 aa, Artificial Sequence
  Description of Artificial Sequence: Synthetic peptide
PSGSPVR

SEQ ID NO: 27467 - protein, 7 aa, Artificial Sequence
  Description of Artificial Sequence: Synthetic peptide
PRETHKQ

SEQ ID NO: 27468 - protein, 7 aa, Artificial Sequence
  Description of Artificial Sequence: Synthetic peptide
QGPKNAD

SEQ ID NO: 27469 - protein, 7 aa, Artificial Sequence
  Description of Artificial Sequence: Synthetic peptide
TSNGGSA

SEQ ID NO: 27470 - protein, 7 aa, Artificial Sequence
  Description of Artificial Sequence: Synthetic peptide
QGAGVSS

SEQ ID NO: 27471 - protein, 7 aa, Artificial Sequence
  Description of Artificial Sequence: Synthetic peptide
IGGNKPL

SEQ ID NO: 27472 - protein, 7 aa, Artificial Sequence
  Description of Artificial Sequence: Synthetic peptide
YPLSRST

SEQ ID NO: 27473 - protein, 7 aa, Artificial Sequence
  Description of Artificial Sequence: Synthetic peptide
STTGGAS

SEQ ID NO: 27474 - protein, 7 aa, Artificial Sequence
  Description of Artificial Sequence: Synthetic peptide
YSGGTQQ

SEQ ID NO: 27475 - protein, 7 aa, Artificial Sequence
  Description of Artificial Sequence: Synthetic peptide
GVVPPTK

SEQ ID NO: 27476 - protein, 7 aa, Artificial Sequence
  Description of Artificial Sequence: Synthetic peptide
SRTNATA

SEQ ID NO: 27477 - protein, 7 aa, Artificial Sequence
  Description of Artificial Sequence: Synthetic peptide
KNESMVL

SEQ ID NO: 27478 - protein, 7 aa, Artificial Sequence
  Description of Artificial Sequence: Synthetic peptide
TMRATPP

SEQ ID NO: 27479 - protein, 7 aa, Artificial Sequence
  Description of Artificial Sequence: Synthetic peptide
EQGSGNH

SEQ ID NO: 27480 - protein, 7 aa, Artificial Sequence
  Description of Artificial Sequence: Synthetic peptide
VNTNLVG

SEQ ID NO: 27481 - protein, 7 aa, Artificial Sequence
  Description of Artificial Sequence: Synthetic peptide
SGNDKNN

SEQ ID NO: 27482 - protein, 7 aa, Artificial Sequence
  Description of Artificial Sequence: Synthetic peptide
PLSHSKM

SEQ ID NO: 27483 - protein, 7 aa, Artificial Sequence
  Description of Artificial Sequence: Synthetic peptide
AQQLNGV

SEQ ID NO: 27484 - protein, 7 aa, Artificial Sequence
  Description of Artificial Sequence: Synthetic peptide
KKVTGQG

SEQ ID NO: 27485 - protein, 7 aa, Artificial Sequence
  Description of Artificial Sequence: Synthetic peptide
DNVSTFT

SEQ ID NO: 27486 - protein, 7 aa, Artificial Sequence
  Description of Artificial Sequence: Synthetic peptide
ASSKGLT

SEQ ID NO: 27487 - protein, 7 aa, Artificial Sequence
  Description of Artificial Sequence: Synthetic peptide
RDGGQDR

SEQ ID NO: 27488 - protein, 7 aa, Artificial Sequence
  Description of Artificial Sequence: Synthetic peptide
LPSGNTS

SEQ ID NO: 27489 - protein, 7 aa, Artificial Sequence
  Description of Artificial Sequence: Synthetic peptide
SKATHNI

SEQ ID NO: 27490 - protein, 7 aa, Artificial Sequence
  Description of Artificial Sequence: Synthetic peptide
SGTQMHL

SEQ ID NO: 27491 - protein, 7 aa, Artificial Sequence
  Description of Artificial Sequence: Synthetic peptide
ATVQSAT

SEQ ID NO: 27492 - protein, 7 aa, Artificial Sequence
  Description of Artificial Sequence: Synthetic peptide
PVRDGGR

SEQ ID NO: 27493 - protein, 7 aa, Artificial Sequence
  Description of Artificial Sequence: Synthetic peptide
YVRPGTG

SEQ ID NO: 27494 - protein, 7 aa, Artificial Sequence
  Description of Artificial Sequence: Synthetic peptide
TGSGRGL

SEQ ID NO: 27495 - protein, 7 aa, Artificial Sequence
  Description of Artificial Sequence: Synthetic peptide
MSSRSSV

SEQ ID NO: 27496 - protein, 7 aa, Artificial Sequence
  Description of Artificial Sequence: Synthetic peptide
DYGKGSS

SEQ ID NO: 27497 - protein, 7 aa, Artificial Sequence
  Description of Artificial Sequence: Synthetic peptide
SKTGTSL

SEQ ID NO: 27498 - protein, 7 aa, Artificial Sequence
  Description of Artificial Sequence: Synthetic peptide
MPSQRDG

SEQ ID NO: 27499 - protein, 7 aa, Artificial Sequence
  Description of Artificial Sequence: Synthetic peptide
GQSGSRL

SEQ ID NO: 27500 - protein, 7 aa, Artificial Sequence
  Description of Artificial Sequence: Synthetic peptide
SRNVNAM

SEQ ID NO: 27501 - protein, 7 aa, Artificial Sequence
  Description of Artificial Sequence: Synthetic peptide
QVSPLNA

SEQ ID NO: 27502 - protein, 7 aa, Artificial Sequence
  Description of Artificial Sequence: Synthetic peptide
LNSTAGK

SEQ ID NO: 27503 - protein, 7 aa, Artificial Sequence
  Description of Artificial Sequence: Synthetic peptide
PTQPRYQ

SEQ ID NO: 27504 - protein, 7 aa, Artificial Sequence
  Description of Artificial Sequence: Synthetic peptide
TRSDRVA

SEQ ID NO: 27505 - protein, 7 aa, Artificial Sequence
  Description of Artificial Sequence: Synthetic peptide
CSTGTRK

SEQ ID NO: 27506 - protein, 7 aa, Artificial Sequence
  Description of Artificial Sequence: Synthetic peptide
GTPNTKV

SEQ ID NO: 27507 - protein, 7 aa, Artificial Sequence
  Description of Artificial Sequence: Synthetic peptide
AGSSRNL

SEQ ID NO: 27508 - protein, 7 aa, Artificial Sequence
  Description of Artificial Sequence: Synthetic peptide
YTASRME

SEQ ID NO: 27509 - protein, 7 aa, Artificial Sequence
  Description of Artificial Sequence: Synthetic peptide
GQNRNNT

SEQ ID NO: 27510 - protein, 7 aa, Artificial Sequence
  Description of Artificial Sequence: Synthetic peptide
NPYTANN

SEQ ID NO: 27511 - protein, 7 aa, Artificial Sequence
  Description of Artificial Sequence: Synthetic peptide
RSLSTEN

SEQ ID NO: 27512 - protein, 7 aa, Artificial Sequence
  Description of Artificial Sequence: Synthetic peptide
SGPRGNS

SEQ ID NO: 27513 - protein, 7 aa, Artificial Sequence
  Description of Artificial Sequence: Synthetic peptide
TQDHHVK

SEQ ID NO: 27514 - protein, 7 aa, Artificial Sequence
  Description of Artificial Sequence: Synthetic peptide
EVTPLRK

SEQ ID NO: 27515 - protein, 7 aa, Artificial Sequence
  Description of Artificial Sequence: Synthetic peptide
DMVSPRN

SEQ ID NO: 27516 - protein, 7 aa, Artificial Sequence
  Description of Artificial Sequence: Synthetic peptide
DYSETRR

SEQ ID NO: 27517 - protein, 7 aa, Artificial Sequence
  Description of Artificial Sequence: Synthetic peptide
PRSTASL

SEQ ID NO: 27518 - protein, 7 aa, Artificial Sequence
  Description of Artificial Sequence: Synthetic peptide
YFNSHSN

SEQ ID NO: 27519 - protein, 7 aa, Artificial Sequence
  Description of Artificial Sequence: Synthetic peptide
NLVQDRR

SEQ ID NO: 27520 - protein, 7 aa, Artificial Sequence
  Description of Artificial Sequence: Synthetic peptide
ADDKSLR

SEQ ID NO: 27521 - protein, 7 aa, Artificial Sequence
  Description of Artificial Sequence: Synthetic peptide
EARERKG

SEQ ID NO: 27522 - protein, 7 aa, Artificial Sequence
  Description of Artificial Sequence: Synthetic peptide
YRSAANS

SEQ ID NO: 27523 - protein, 7 aa, Artificial Sequence
  Description of Artificial Sequence: Synthetic peptide
SHNSKDS

SEQ ID NO: 27524 - protein, 7 aa, Artificial Sequence
  Description of Artificial Sequence: Synthetic peptide
LSGHSPQ

SEQ ID NO: 27525 - protein, 7 aa, Artificial Sequence
  Description of Artificial Sequence: Synthetic peptide
CTGSRSM

SEQ ID NO: 27526 - protein, 7 aa, Artificial Sequence
  Description of Artificial Sequence: Synthetic peptide
RHYTGES

SEQ ID NO: 27527 - protein, 7 aa, Artificial Sequence
  Description of Artificial Sequence: Synthetic peptide
NSSSSNH

SEQ ID NO: 27528 - protein, 7 aa, Artificial Sequence
  Description of Artificial Sequence: Synthetic peptide
TPTLSHT

SEQ ID NO: 27529 - protein, 7 aa, Artificial Sequence
  Description of Artificial Sequence: Synthetic peptide
NSISRVT

SEQ ID NO: 27530 - protein, 7 aa, Artificial Sequence
  Description of Artificial Sequence: Synthetic peptide
NNLPRNL

SEQ ID NO: 27531 - protein, 7 aa, Artificial Sequence
  Description of Artificial Sequence: Synthetic peptide
GRQNEYR

SEQ ID NO: 27532 - protein, 7 aa, Artificial Sequence
  Description of Artificial Sequence: Synthetic peptide
ANTTRLT

SEQ ID NO: 27533 - protein, 7 aa, Artificial Sequence
  Description of Artificial Sequence: Synthetic peptide
NLSHSAG

SEQ ID NO: 27534 - protein, 7 aa, Artificial Sequence
  Description of Artificial Sequence: Synthetic peptide
QTRSTGN

SEQ ID NO: 27535 - protein, 7 aa, Artificial Sequence
  Description of Artificial Sequence: Synthetic peptide
NNVGVRG

SEQ ID NO: 27536 - protein, 7 aa, Artificial Sequence
  Description of Artificial Sequence: Synthetic peptide
GMTQGGK

SEQ ID NO: 27537 - protein, 7 aa, Artificial Sequence
  Description of Artificial Sequence: Synthetic peptide
PVARAAQ

SEQ ID NO: 27538 - protein, 7 aa, Artificial Sequence
  Description of Artificial Sequence: Synthetic peptide
SHSTRLG

SEQ ID NO: 27539 - protein, 7 aa, Artificial Sequence
  Description of Artificial Sequence: Synthetic peptide
TNSQKLA

SEQ ID NO: 27540 - protein, 7 aa, Artificial Sequence
  Description of Artificial Sequence: Synthetic peptide
PTHSSRD

SEQ ID NO: 27541 - protein, 7 aa, Artificial Sequence
  Description of Artificial Sequence: Synthetic peptide
SHSVTPG

SEQ ID NO: 27542 - protein, 7 aa, Artificial Sequence
  Description of Artificial Sequence: Synthetic peptide
PNLSKSL

SEQ ID NO: 27543 - protein, 7 aa, Artificial Sequence
  Description of Artificial Sequence: Synthetic peptide
IIQNQSK

SEQ ID NO: 27544 - protein, 7 aa, Artificial Sequence
  Description of Artificial Sequence: Synthetic peptide
QTSHSAK

SEQ ID NO: 27545 - protein, 7 aa, Artificial Sequence
  Description of Artificial Sequence: Synthetic peptide
DGNHARA

SEQ ID NO: 27546 - protein, 7 aa, Artificial Sequence
  Description of Artificial Sequence: Synthetic peptide
ERMGKNQ

SEQ ID NO: 27547 - protein, 7 aa, Artificial Sequence
  Description of Artificial Sequence: Synthetic peptide
SVLNRNG

SEQ ID NO: 27548 - protein, 7 aa, Artificial Sequence
  Description of Artificial Sequence: Synthetic peptide
QSSSQQR

SEQ ID NO: 27549 - protein, 7 aa, Artificial Sequence
  Description of Artificial Sequence: Synthetic peptide
PYKGNGL

SEQ ID NO: 27550 - protein, 7 aa, Artificial Sequence
  Description of Artificial Sequence: Synthetic peptide
SSQQKAS

SEQ ID NO: 27551 - protein, 7 aa, Artificial Sequence
  Description of Artificial Sequence: Synthetic peptide
SNPSGFS

SEQ ID NO: 27552 - protein, 7 aa, Artificial Sequence
  Description of Artificial Sequence: Synthetic peptide
HVQDGRT

SEQ ID NO: 27553 - protein, 7 aa, Artificial Sequence
  Description of Artificial Sequence: Synthetic peptide
GSHNDSR

SEQ ID NO: 27554 - protein, 7 aa, Artificial Sequence
  Description of Artificial Sequence: Synthetic peptide
AKTNLRS

SEQ ID NO: 27555 - protein, 7 aa, Artificial Sequence
  Description of Artificial Sequence: Synthetic peptide
VQPSGRP

SEQ ID NO: 27556 - protein, 7 aa, Artificial Sequence
  Description of Artificial Sequence: Synthetic peptide
SESGQQR

SEQ ID NO: 27557 - protein, 7 aa, Artificial Sequence
  Description of Artificial Sequence: Synthetic peptide
FSSASFT

SEQ ID NO: 27558 - protein, 7 aa, Artificial Sequence
  Description of Artificial Sequence: Synthetic peptide
VQPVKMS

SEQ ID NO: 27559 - protein, 7 aa, Artificial Sequence
  Description of Artificial Sequence: Synthetic peptide
TGTGSFH

SEQ ID NO: 27560 - protein, 7 aa, Artificial Sequence
  Description of Artificial Sequence: Synthetic peptide
NGSGQSQ

SEQ ID NO: 27561 - protein, 7 aa, Artificial Sequence
  Description of Artificial Sequence: Synthetic peptide
LPTDSLR

SEQ ID NO: 27562 - protein, 7 aa, Artificial Sequence
  Description of Artificial Sequence: Synthetic peptide
DPATRKS

SEQ ID NO: 27563 - protein, 7 aa, Artificial Sequence
  Description of Artificial Sequence: Synthetic peptide
RVTNQNA

SEQ ID NO: 27564 - protein, 7 aa, Artificial Sequence
  Description of Artificial Sequence: Synthetic peptide
LNNQRIA

SEQ ID NO: 27565 - protein, 7 aa, Artificial Sequence
  Description of Artificial Sequence: Synthetic peptide
VNGHGVS

SEQ ID NO: 27566 - protein, 7 aa, Artificial Sequence
  Description of Artificial Sequence: Synthetic peptide
NQSKASV

SEQ ID NO: 27567 - protein, 7 aa, Artificial Sequence
  Description of Artificial Sequence: Synthetic peptide
PTGEKRL

SEQ ID NO: 27568 - protein, 7 aa, Artificial Sequence
  Description of Artificial Sequence: Synthetic peptide
SNATRSS

SEQ ID NO: 27569 - protein, 7 aa, Artificial Sequence
  Description of Artificial Sequence: Synthetic peptide
PGASGKV

SEQ ID NO: 27570 - protein, 7 aa, Artificial Sequence
  Description of Artificial Sequence: Synthetic peptide
YANNLNR

SEQ ID NO: 27571 - protein, 7 aa, Artificial Sequence
  Description of Artificial Sequence: Synthetic peptide
GLNVNSN

SEQ ID NO: 27572 - protein, 7 aa, Artificial Sequence
  Description of Artificial Sequence: Synthetic peptide
SSPQDHN

SEQ ID NO: 27573 - protein, 7 aa, Artificial Sequence
  Description of Artificial Sequence: Synthetic peptide
NQGGYHG

SEQ ID NO: 27574 - protein, 7 aa, Artificial Sequence
  Description of Artificial Sequence: Synthetic peptide
DLDTKAL

SEQ ID NO: 27575 - protein, 7 aa, Artificial Sequence
  Description of Artificial Sequence: Synthetic peptide
TMDVRSD

SEQ ID NO: 27576 - protein, 7 aa, Artificial Sequence
  Description of Artificial Sequence: Synthetic peptide
NNKGNPG

SEQ ID NO: 27577 - protein, 7 aa, Artificial Sequence
  Description of Artificial Sequence: Synthetic peptide
NLSSSGG

SEQ ID NO: 27578 - protein, 7 aa, Artificial Sequence
  Description of Artificial Sequence: Synthetic peptide
SSSPSSL

SEQ ID NO: 27579 - protein, 7 aa, Artificial Sequence
  Description of Artificial Sequence: Synthetic peptide
STNGNGL

SEQ ID NO: 27580 - protein, 7 aa, Artificial Sequence
  Description of Artificial Sequence: Synthetic peptide
NASGQNQ

SEQ ID NO: 27581 - protein, 7 aa, Artificial Sequence
  Description of Artificial Sequence: Synthetic peptide
PRTRENQ

SEQ ID NO: 27582 - protein, 7 aa, Artificial Sequence
  Description of Artificial Sequence: Synthetic peptide
QQGVGNN

SEQ ID NO: 27583 - protein, 7 aa, Artificial Sequence
  Description of Artificial Sequence: Synthetic peptide
ARASSNS

SEQ ID NO: 27584 - protein, 7 aa, Artificial Sequence
  Description of Artificial Sequence: Synthetic peptide
GSNLNST

SEQ ID NO: 27585 - protein, 7 aa, Artificial Sequence
  Description of Artificial Sequence: Synthetic peptide
TSSGHSV

SEQ ID NO: 27586 - protein, 7 aa, Artificial Sequence
  Description of Artificial Sequence: Synthetic peptide
PSHEGQQ

SEQ ID NO: 27587 - protein, 7 aa, Artificial Sequence
  Description of Artificial Sequence: Synthetic peptide
YTQSTSR

SEQ ID NO: 27588 - protein, 7 aa, Artificial Sequence
  Description of Artificial Sequence: Synthetic peptide
VRAKVAS

SEQ ID NO: 27589 - protein, 7 aa, Artificial Sequence
  Description of Artificial Sequence: Synthetic peptide
DIPSRAA

SEQ ID NO: 27590 - protein, 7 aa, Artificial Sequence
  Description of Artificial Sequence: Synthetic peptide
PPHDGQR

SEQ ID NO: 27591 - protein, 7 aa, Artificial Sequence
  Description of Artificial Sequence: Synthetic peptide
MEIKPNR

SEQ ID NO: 27592 - protein, 7 aa, Artificial Sequence
  Description of Artificial Sequence: Synthetic peptide
WVGSPVC

SEQ ID NO: 27593 - protein, 7 aa, Artificial Sequence
  Description of Artificial Sequence: Synthetic peptide
GYEANRG

SEQ ID NO: 27594 - protein, 7 aa, Artificial Sequence
  Description of Artificial Sequence: Synthetic peptide
LVSKSGT

SEQ ID NO: 27595 - protein, 7 aa, Artificial Sequence
  Description of Artificial Sequence: Synthetic peptide
KGYSSNE

SEQ ID NO: 27596 - protein, 7 aa, Artificial Sequence
  Description of Artificial Sequence: Synthetic peptide
PLAEMHG

SEQ ID NO: 27597 - protein, 7 aa, Artificial Sequence
  Description of Artificial Sequence: Synthetic peptide
PSRASIT

SEQ ID NO: 27598 - protein, 7 aa, Artificial Sequence
  Description of Artificial Sequence: Synthetic peptide
LRNSTSV

SEQ ID NO: 27599 - protein, 7 aa, Artificial Sequence
  Description of Artificial Sequence: Synthetic peptide
EPLSKQS

SEQ ID NO: 27600 - protein, 7 aa, Artificial Sequence
  Description of Artificial Sequence: Synthetic peptide
ASHLPVN

SEQ ID NO: 27601 - protein, 7 aa, Artificial Sequence
  Description of Artificial Sequence: Synthetic peptide
SSGKSFS

SEQ ID NO: 27602 - protein, 7 aa, Artificial Sequence
  Description of Artificial Sequence: Synthetic peptide
PLSGRIG

SEQ ID NO: 27603 - protein, 7 aa, Artificial Sequence
  Description of Artificial Sequence: Synthetic peptide
GQSNVTL

SEQ ID NO: 27604 - protein, 7 aa, Artificial Sequence
  Description of Artificial Sequence: Synthetic peptide
MNMSARQ

SEQ ID NO: 27605 - protein, 7 aa, Artificial Sequence
  Description of Artificial Sequence: Synthetic peptide
VNQSGFS

SEQ ID NO: 27606 - protein, 7 aa, Artificial Sequence
  Description of Artificial Sequence: Synthetic peptide
SVTSPNK

SEQ ID NO: 27607 - protein, 7 aa, Artificial Sequence
  Description of Artificial Sequence: Synthetic peptide
SSASTYK

SEQ ID NO: 27608 - protein, 7 aa, Artificial Sequence
  Description of Artificial Sequence: Synthetic peptide
LVQGGVN

SEQ ID NO: 27609 - protein, 7 aa, Artificial Sequence
  Description of Artificial Sequence: Synthetic peptide
RPLLSHE

SEQ ID NO: 27610 - protein, 7 aa, Artificial Sequence
  Description of Artificial Sequence: Synthetic peptide
FRTQSVG

SEQ ID NO: 27611 - protein, 7 aa, Artificial Sequence
  Description of Artificial Sequence: Synthetic peptide
GTEGASG

SEQ ID NO: 27612 - protein, 7 aa, Artificial Sequence
  Description of Artificial Sequence: Synthetic peptide
PSRNTSL

SEQ ID NO: 27613 - protein, 7 aa, Artificial Sequence
  Description of Artificial Sequence: Synthetic peptide
KLSQTSQ

SEQ ID NO: 27614 - protein, 7 aa, Artificial Sequence
  Description of Artificial Sequence: Synthetic peptide
NNGKVRS

SEQ ID NO: 27615 - protein, 7 aa, Artificial Sequence
  Description of Artificial Sequence: Synthetic peptide
TARGGPT

SEQ ID NO: 27616 - protein, 7 aa, Artificial Sequence
  Description of Artificial Sequence: Synthetic peptide
VRSRESP

SEQ ID NO: 27617 - protein, 7 aa, Artificial Sequence
  Description of Artificial Sequence: Synthetic peptide
NSAAAMK

SEQ ID NO: 27618 - protein, 7 aa, Artificial Sequence
  Description of Artificial Sequence: Synthetic peptide
SNMPGMV

SEQ ID NO: 27619 - protein, 7 aa, Artificial Sequence
  Description of Artificial Sequence: Synthetic peptide
RANNSQM

SEQ ID NO: 27620 - protein, 7 aa, Artificial Sequence
  Description of Artificial Sequence: Synthetic peptide
MLPQNGR

SEQ ID NO: 27621 - protein, 7 aa, Artificial Sequence
  Description of Artificial Sequence: Synthetic peptide
SSLEKSN

SEQ ID NO: 27622 - protein, 7 aa, Artificial Sequence
  Description of Artificial Sequence: Synthetic peptide
HRVDNQG

SEQ ID NO: 27623 - protein, 7 aa, Artificial Sequence
  Description of Artificial Sequence: Synthetic peptide
ATRGISS

SEQ ID NO: 27624 - protein, 7 aa, Artificial Sequence
  Description of Artificial Sequence: Synthetic peptide
QMKHLQG

SEQ ID NO: 27625 - protein, 7 aa, Artificial Sequence
  Description of Artificial Sequence: Synthetic peptide
NTSTQKI

SEQ ID NO: 27626 - protein, 7 aa, Artificial Sequence
  Description of Artificial Sequence: Synthetic peptide
MKVKLNQ

SEQ ID NO: 27627 - protein, 7 aa, Artificial Sequence
  Description of Artificial Sequence: Synthetic peptide
GPANTSG

SEQ ID NO: 27628 - protein, 7 aa, Artificial Sequence
  Description of Artificial Sequence: Synthetic peptide
QREQLLK

SEQ ID NO: 27629 - protein, 7 aa, Artificial Sequence
  Description of Artificial Sequence: Synthetic peptide
GVNRSSG

SEQ ID NO: 27630 - protein, 7 aa, Artificial Sequence
  Description of Artificial Sequence: Synthetic peptide
DPQVRAL

SEQ ID NO: 27631 - protein, 7 aa, Artificial Sequence
  Description of Artificial Sequence: Synthetic peptide
AGINSQV

SEQ ID NO: 27632 - protein, 7 aa, Artificial Sequence
  Description of Artificial Sequence: Synthetic peptide
RMSPPTG

SEQ ID NO: 27633 - protein, 7 aa, Artificial Sequence
  Description of Artificial Sequence: Synthetic peptide
VRNASSA

SEQ ID NO: 27634 - protein, 7 aa, Artificial Sequence
  Description of Artificial Sequence: Synthetic peptide
NTTPSRG

SEQ ID NO: 27635 - protein, 7 aa, Artificial Sequence
  Description of Artificial Sequence: Synthetic peptide
YVSNSNA

SEQ ID NO: 27636 - protein, 7 aa, Artificial Sequence
  Description of Artificial Sequence: Synthetic peptide
NSSHNVS

SEQ ID NO: 27637 - protein, 7 aa, Artificial Sequence
  Description of Artificial Sequence: Synthetic peptide
WSNGRTS

SEQ ID NO: 27638 - protein, 7 aa, Artificial Sequence
  Description of Artificial Sequence: Synthetic peptide
TISTRQS

SEQ ID NO: 27639 - protein, 7 aa, Artificial Sequence
  Description of Artificial Sequence: Synthetic peptide
MKGNNLS

SEQ ID NO: 27640 - protein, 7 aa, Artificial Sequence
  Description of Artificial Sequence: Synthetic peptide
PGESGKV

SEQ ID NO: 27641 - protein, 7 aa, Artificial Sequence
  Description of Artificial Sequence: Synthetic peptide
GTQKQTS

SEQ ID NO: 27642 - protein, 7 aa, Artificial Sequence
  Description of Artificial Sequence: Synthetic peptide
DTNNRAN

SEQ ID NO: 27643 - protein, 7 aa, Artificial Sequence
  Description of Artificial Sequence: Synthetic peptide
MSGGNMR

SEQ ID NO: 27644 - protein, 7 aa, Artificial Sequence
  Description of Artificial Sequence: Synthetic peptide
NGPIRNS

SEQ ID NO: 27645 - protein, 7 aa, Artificial Sequence
  Description of Artificial Sequence: Synthetic peptide
GSSDKST

SEQ ID NO: 27646 - protein, 7 aa, Artificial Sequence
  Description of Artificial Sequence: Synthetic peptide
PSQTKPS

SEQ ID NO: 27647 - protein, 7 aa, Artificial Sequence
  Description of Artificial Sequence: Synthetic peptide
SVSNTNT

SEQ ID NO: 27648 - protein, 7 aa, Artificial Sequence
  Description of Artificial Sequence: Synthetic peptide
TASGNLS

SEQ ID NO: 27649 - protein, 7 aa, Artificial Sequence
  Description of Artificial Sequence: Synthetic peptide
SYSGTLG

SEQ ID NO: 27650 - protein, 7 aa, Artificial Sequence
  Description of Artificial Sequence: Synthetic peptide
GAKPGLA

SEQ ID NO: 27651 - protein, 7 aa, Artificial Sequence
  Description of Artificial Sequence: Synthetic peptide
LKSTGTT

SEQ ID NO: 27652 - protein, 7 aa, Artificial Sequence
  Description of Artificial Sequence: Synthetic peptide
HGSRSMS

SEQ ID NO: 27653 - protein, 7 aa, Artificial Sequence
  Description of Artificial Sequence: Synthetic peptide
HSSRPLE

SEQ ID NO: 27654 - protein, 7 aa, Artificial Sequence
  Description of Artificial Sequence: Synthetic peptide
GTYGEMR

SEQ ID NO: 27655 - protein, 7 aa, Artificial Sequence
  Description of Artificial Sequence: Synthetic peptide
FNTSKLS

SEQ ID NO: 27656 - protein, 7 aa, Artificial Sequence
  Description of Artificial Sequence: Synthetic peptide
STSRDAT

SEQ ID NO: 27657 - protein, 7 aa, Artificial Sequence
  Description of Artificial Sequence: Synthetic peptide
SNRPSIV

SEQ ID NO: 27658 - protein, 7 aa, Artificial Sequence
  Description of Artificial Sequence: Synthetic peptide
GLAKDQR

SEQ ID NO: 27659 - protein, 7 aa, Artificial Sequence
  Description of Artificial Sequence: Synthetic peptide
SPRASLN

SEQ ID NO: 27660 - protein, 7 aa, Artificial Sequence
  Description of Artificial Sequence: Synthetic peptide
NGSGQNL

SEQ ID NO: 27661 - protein, 7 aa, Artificial Sequence
  Description of Artificial Sequence: Synthetic peptide
KNSSGST

SEQ ID NO: 27662 - protein, 7 aa, Artificial Sequence
  Description of Artificial Sequence: Synthetic peptide
SSPSRSS

SEQ ID NO: 27663 - protein, 7 aa, Artificial Sequence
  Description of Artificial Sequence: Synthetic peptide
KGSAGSV

SEQ ID NO: 27664 - protein, 7 aa, Artificial Sequence
  Description of Artificial Sequence: Synthetic peptide
MGPTTHK

SEQ ID NO: 27665 - protein, 7 aa, Artificial Sequence
  Description of Artificial Sequence: Synthetic peptide
DAGSRSS

SEQ ID NO: 27666 - protein, 7 aa, Artificial Sequence
  Description of Artificial Sequence: Synthetic peptide
TGERQSS

SEQ ID NO: 27667 - protein, 7 aa, Artificial Sequence
  Description of Artificial Sequence: Synthetic peptide
QNVGGIR

SEQ ID NO: 27668 - protein, 7 aa, Artificial Sequence
  Description of Artificial Sequence: Synthetic peptide
TNAKQAI

SEQ ID NO: 27669 - protein, 7 aa, Artificial Sequence
  Description of Artificial Sequence: Synthetic peptide
ATGSPSK

SEQ ID NO: 27670 - protein, 7 aa, Artificial Sequence
  Description of Artificial Sequence: Synthetic peptide
RSSNSDH

SEQ ID NO: 27671 - protein, 7 aa, Artificial Sequence
  Description of Artificial Sequence: Synthetic peptide
GTNSTRG

SEQ ID NO: 27672 - protein, 7 aa, Artificial Sequence
  Description of Artificial Sequence: Synthetic peptide
SSTRALS

SEQ ID NO: 27673 - protein, 7 aa, Artificial Sequence
  Description of Artificial Sequence: Synthetic peptide
PKLHQDR

SEQ ID NO: 27674 - protein, 7 aa, Artificial Sequence
  Description of Artificial Sequence: Synthetic peptide
DSSERIR

SEQ ID NO: 27675 - protein, 7 aa, Artificial Sequence
  Description of Artificial Sequence: Synthetic peptide
KGSNHSG

SEQ ID NO: 27676 - protein, 7 aa, Artificial Sequence
  Description of Artificial Sequence: Synthetic peptide
KTDKTVD

SEQ ID NO: 27677 - protein, 7 aa, Artificial Sequence
  Description of Artificial Sequence: Synthetic peptide
NKSNGQS

SEQ ID NO: 27678 - protein, 7 aa, Artificial Sequence
  Description of Artificial Sequence: Synthetic peptide
GPRSMSN

SEQ ID NO: 27679 - protein, 7 aa, Artificial Sequence
  Description of Artificial Sequence: Synthetic peptide
VLAGSNT

SEQ ID NO: 27680 - protein, 7 aa, Artificial Sequence
  Description of Artificial Sequence: Synthetic peptide
HDRGKNG

SEQ ID NO: 27681 - protein, 7 aa, Artificial Sequence
  Description of Artificial Sequence: Synthetic peptide
LNSRQVT

SEQ ID NO: 27682 - protein, 7 aa, Artificial Sequence
  Description of Artificial Sequence: Synthetic peptide
IQNSSNT

SEQ ID NO: 27683 - protein, 7 aa, Artificial Sequence
  Description of Artificial Sequence: Synthetic peptide
NQSAKST

SEQ ID NO: 27684 - protein, 7 aa, Artificial Sequence
  Description of Artificial Sequence: Synthetic peptide
DTATRNR

SEQ ID NO: 27685 - protein, 7 aa, Artificial Sequence
  Description of Artificial Sequence: Synthetic peptide
SRSNAMA

SEQ ID NO: 27686 - protein, 7 aa, Artificial Sequence
  Description of Artificial Sequence: Synthetic peptide
VASQRTL

SEQ ID NO: 27687 - protein, 7 aa, Artificial Sequence
  Description of Artificial Sequence: Synthetic peptide
FSQHSSN

SEQ ID NO: 27688 - protein, 7 aa, Artificial Sequence
  Description of Artificial Sequence: Synthetic peptide
MKNTTVV

SEQ ID NO: 27689 - protein, 7 aa, Artificial Sequence
  Description of Artificial Sequence: Synthetic peptide
HYTGKQN

SEQ ID NO: 27690 - protein, 7 aa, Artificial Sequence
  Description of Artificial Sequence: Synthetic peptide
YRVTQSS

SEQ ID NO: 27691 - protein, 7 aa, Artificial Sequence
  Description of Artificial Sequence: Synthetic peptide
PSQEGQQ

SEQ ID NO: 27692 - protein, 7 aa, Artificial Sequence
  Description of Artificial Sequence: Synthetic peptide
STDRSFN

SEQ ID NO: 27693 - protein, 7 aa, Artificial Sequence
  Description of Artificial Sequence: Synthetic peptide
NMDGATR

SEQ ID NO: 27694 - protein, 7 aa, Artificial Sequence
  Description of Artificial Sequence: Synthetic peptide
DGSGQNQ

SEQ ID NO: 27695 - protein, 7 aa, Artificial Sequence
  Description of Artificial Sequence: Synthetic peptide
YQANALG

SEQ ID NO: 27696 - protein, 7 aa, Artificial Sequence
  Description of Artificial Sequence: Synthetic peptide
NGSPGFY

SEQ ID NO: 27697 - protein, 7 aa, Artificial Sequence
  Description of Artificial Sequence: Synthetic peptide
RREIASS

SEQ ID NO: 27698 - protein, 7 aa, Artificial Sequence
  Description of Artificial Sequence: Synthetic peptide
FCSPVGK

SEQ ID NO: 27699 - protein, 7 aa, Artificial Sequence
  Description of Artificial Sequence: Synthetic peptide
NVCTNQI

SEQ ID NO: 27700 - protein, 7 aa, Artificial Sequence
  Description of Artificial Sequence: Synthetic peptide
ASSPQEK

SEQ ID NO: 27701 - protein, 7 aa, Artificial Sequence
  Description of Artificial Sequence: Synthetic peptide
GIHKEYL

SEQ ID NO: 27702 - protein, 7 aa, Artificial Sequence
  Description of Artificial Sequence: Synthetic peptide
GDHNRLN

SEQ ID NO: 27703 - protein, 7 aa, Artificial Sequence
  Description of Artificial Sequence: Synthetic peptide
PRDTTGS

SEQ ID NO: 27704 - protein, 7 aa, Artificial Sequence
  Description of Artificial Sequence: Synthetic peptide
GYTVGTN

SEQ ID NO: 27705 - protein, 7 aa, Artificial Sequence
  Description of Artificial Sequence: Synthetic peptide
SRVTSGG

SEQ ID NO: 27706 - protein, 7 aa, Artificial Sequence
  Description of Artificial Sequence: Synthetic peptide
ERKTSNA

SEQ ID NO: 27707 - protein, 7 aa, Artificial Sequence
  Description of Artificial Sequence: Synthetic peptide
NREKLSY

SEQ ID NO: 27708 - protein, 7 aa, Artificial Sequence
  Description of Artificial Sequence: Synthetic peptide
VSSPRQI

SEQ ID NO: 27709 - protein, 7 aa, Artificial Sequence
  Description of Artificial Sequence: Synthetic peptide
SPNANSV

SEQ ID NO: 27710 - protein, 7 aa, Artificial Sequence
  Description of Artificial Sequence: Synthetic peptide
LPITARN

SEQ ID NO: 27711 - protein, 7 aa, Artificial Sequence
  Description of Artificial Sequence: Synthetic peptide
VSKSPST

SEQ ID NO: 27712 - protein, 7 aa, Artificial Sequence
  Description of Artificial Sequence: Synthetic peptide
PLSHSNM

SEQ ID NO: 27713 - protein, 7 aa, Artificial Sequence
  Description of Artificial Sequence: Synthetic peptide
TGAQSTM

SEQ ID NO: 27714 - protein, 7 aa, Artificial Sequence
  Description of Artificial Sequence: Synthetic peptide
FVSREHT

SEQ ID NO: 27715 - protein, 7 aa, Artificial Sequence
  Description of Artificial Sequence: Synthetic peptide
IISQNGL

SEQ ID NO: 27716 - protein, 7 aa, Artificial Sequence
  Description of Artificial Sequence: Synthetic peptide
VGEAGKA

SEQ ID NO: 27717 - protein, 7 aa, Artificial Sequence
  Description of Artificial Sequence: Synthetic peptide
GGHSPNR

SEQ ID NO: 27718 - protein, 7 aa, Artificial Sequence
  Description of Artificial Sequence: Synthetic peptide
TQLGGFK

SEQ ID NO: 27719 - protein, 7 aa, Artificial Sequence
  Description of Artificial Sequence: Synthetic peptide
GKHGTNS

SEQ ID NO: 27720 - protein, 7 aa, Artificial Sequence
  Description of Artificial Sequence: Synthetic peptide
YGLHNAR

SEQ ID NO: 27721 - protein, 7 aa, Artificial Sequence
  Description of Artificial Sequence: Synthetic peptide
TISTRKS

SEQ ID NO: 27722 - protein, 7 aa, Artificial Sequence
  Description of Artificial Sequence: Synthetic peptide
LPSSIVP

SEQ ID NO: 27723 - protein, 7 aa, Artificial Sequence
  Description of Artificial Sequence: Synthetic peptide
RVQSNLK

SEQ ID NO: 27724 - protein, 7 aa, Artificial Sequence
  Description of Artificial Sequence: Synthetic peptide
PLAYENN

SEQ ID NO: 27725 - protein, 7 aa, Artificial Sequence
  Description of Artificial Sequence: Synthetic peptide
GALNSRG

SEQ ID NO: 27726 - protein, 7 aa, Artificial Sequence
  Description of Artificial Sequence: Synthetic peptide
GIATTNR

SEQ ID NO: 27727 - protein, 7 aa, Artificial Sequence
  Description of Artificial Sequence: Synthetic peptide
MRSERAA

SEQ ID NO: 27728 - protein, 7 aa, Artificial Sequence
  Description of Artificial Sequence: Synthetic peptide
PMSHVSG

SEQ ID NO: 27729 - protein, 7 aa, Artificial Sequence
  Description of Artificial Sequence: Synthetic peptide
MSARPVS

SEQ ID NO: 27730 - protein, 7 aa, Artificial Sequence
  Description of Artificial Sequence: Synthetic peptide
RDHSGSR

SEQ ID NO: 27731 - protein, 7 aa, Artificial Sequence
  Description of Artificial Sequence: Synthetic peptide
LTATNPR

SEQ ID NO: 27732 - protein, 7 aa, Artificial Sequence
  Description of Artificial Sequence: Synthetic peptide
NMRASTE

SEQ ID NO: 27733 - protein, 7 aa, Artificial Sequence
  Description of Artificial Sequence: Synthetic peptide
KGTPGHS

SEQ ID NO: 27734 - protein, 7 aa, Artificial Sequence
  Description of Artificial Sequence: Synthetic peptide
ESRKSVS

SEQ ID NO: 27735 - protein, 7 aa, Artificial Sequence
  Description of Artificial Sequence: Synthetic peptide
PADRTHI

SEQ ID NO: 27736 - protein, 7 aa, Artificial Sequence
  Description of Artificial Sequence: Synthetic peptide
RSTDPHG

SEQ ID NO: 27737 - protein, 7 aa, Artificial Sequence
  Description of Artificial Sequence: Synthetic peptide
RSASGQL

SEQ ID NO: 27738 - protein, 7 aa, Artificial Sequence
  Description of Artificial Sequence: Synthetic peptide
GASGKIG

SEQ ID NO: 27739 - protein, 7 aa, Artificial Sequence
  Description of Artificial Sequence: Synthetic peptide
HSTRSSL

SEQ ID NO: 27740 - protein, 7 aa, Artificial Sequence
  Description of Artificial Sequence: Synthetic peptide
GMSSPHI

SEQ ID NO: 27741 - protein, 7 aa, Artificial Sequence
  Description of Artificial Sequence: Synthetic peptide
RSSGGLT

SEQ ID NO: 27742 - protein, 7 aa, Artificial Sequence
  Description of Artificial Sequence: Synthetic peptide
NGATKNS

SEQ ID NO: 27743 - protein, 7 aa, Artificial Sequence
  Description of Artificial Sequence: Synthetic peptide
NGSVQNQ

SEQ ID NO: 27744 - protein, 7 aa, Artificial Sequence
  Description of Artificial Sequence: Synthetic peptide
TTDKSRL

SEQ ID NO: 27745 - protein, 7 aa, Artificial Sequence
  Description of Artificial Sequence: Synthetic peptide
SRSPGTS

SEQ ID NO: 27746 - protein, 7 aa, Artificial Sequence
  Description of Artificial Sequence: Synthetic peptide
SFTKGAG

SEQ ID NO: 27747 - protein, 7 aa, Artificial Sequence
  Description of Artificial Sequence: Synthetic peptide
NVTTPLI

SEQ ID NO: 27748 - protein, 7 aa, Artificial Sequence
  Description of Artificial Sequence: Synthetic peptide
TLGQAVR

SEQ ID NO: 27749 - protein, 7 aa, Artificial Sequence
  Description of Artificial Sequence: Synthetic peptide
STTTASS

SEQ ID NO: 27750 - protein, 7 aa, Artificial Sequence
  Description of Artificial Sequence: Synthetic peptide
SGTIGQV

SEQ ID NO: 27751 - protein, 7 aa, Artificial Sequence
  Description of Artificial Sequence: Synthetic peptide
PSTERNR

SEQ ID NO: 27752 - protein, 7 aa, Artificial Sequence
  Description of Artificial Sequence: Synthetic peptide
LLTSPNS

SEQ ID NO: 27753 - protein, 7 aa, Artificial Sequence
  Description of Artificial Sequence: Synthetic peptide
SRDSSIH

SEQ ID NO: 27754 - protein, 7 aa, Artificial Sequence
  Description of Artificial Sequence: Synthetic peptide
NLASSSY

SEQ ID NO: 27755 - protein, 7 aa, Artificial Sequence
  Description of Artificial Sequence: Synthetic peptide
LRAGTVR

SEQ ID NO: 27756 - protein, 7 aa, Artificial Sequence
  Description of Artificial Sequence: Synthetic peptide
MVSGKSY

SEQ ID NO: 27757 - protein, 7 aa, Artificial Sequence
  Description of Artificial Sequence: Synthetic peptide
VPSTAGK

SEQ ID NO: 27758 - protein, 7 aa, Artificial Sequence
  Description of Artificial Sequence: Synthetic peptide
GFSRPNT

SEQ ID NO: 27759 - protein, 7 aa, Artificial Sequence
  Description of Artificial Sequence: Synthetic peptide
QVGRPNA

SEQ ID NO: 27760 - protein, 7 aa, Artificial Sequence
  Description of Artificial Sequence: Synthetic peptide
DTARPTK

SEQ ID NO: 27761 - protein, 7 aa, Artificial Sequence
  Description of Artificial Sequence: Synthetic peptide
RLDGLSR

SEQ ID NO: 27762 - protein, 7 aa, Artificial Sequence
  Description of Artificial Sequence: Synthetic peptide
DRHNTTS

SEQ ID NO: 27763 - protein, 7 aa, Artificial Sequence
  Description of Artificial Sequence: Synthetic peptide
YAKDQQS

SEQ ID NO: 27764 - protein, 7 aa, Artificial Sequence
  Description of Artificial Sequence: Synthetic peptide
NSTPSTR

SEQ ID NO: 27765 - protein, 7 aa, Artificial Sequence
  Description of Artificial Sequence: Synthetic peptide
APLQSNL

SEQ ID NO: 27766 - protein, 7 aa, Artificial Sequence
  Description of Artificial Sequence: Synthetic peptide
EGISSIS

SEQ ID NO: 27767 - protein, 7 aa, Artificial Sequence
  Description of Artificial Sequence: Synthetic peptide
QSLTRTH

SEQ ID NO: 27768 - protein, 7 aa, Artificial Sequence
  Description of Artificial Sequence: Synthetic peptide
VVSATGT

SEQ ID NO: 27769 - protein, 7 aa, Artificial Sequence
  Description of Artificial Sequence: Synthetic peptide
RNGAMSN

SEQ ID NO: 27770 - protein, 7 aa, Artificial Sequence
  Description of Artificial Sequence: Synthetic peptide
QLNHSAK

SEQ ID NO: 27771 - protein, 7 aa, Artificial Sequence
  Description of Artificial Sequence: Synthetic peptide
SFTGNTV

SEQ ID NO: 27772 - protein, 7 aa, Artificial Sequence
  Description of Artificial Sequence: Synthetic peptide
RDTKSGM

SEQ ID NO: 27773 - protein, 7 aa, Artificial Sequence
  Description of Artificial Sequence: Synthetic peptide
DSRSIKG

SEQ ID NO: 27774 - protein, 7 aa, Artificial Sequence
  Description of Artificial Sequence: Synthetic peptide
SHGPQIT

SEQ ID NO: 27775 - protein, 7 aa, Artificial Sequence
  Description of Artificial Sequence: Synthetic peptide
IVSPVSK

SEQ ID NO: 27776 - protein, 7 aa, Artificial Sequence
  Description of Artificial Sequence: Synthetic peptide
GSPNHSS

SEQ ID NO: 27777 - protein, 7 aa, Artificial Sequence
  Description of Artificial Sequence: Synthetic peptide
SPLLDYK

SEQ ID NO: 27778 - protein, 7 aa, Artificial Sequence
  Description of Artificial Sequence: Synthetic peptide
RMQPSGN

SEQ ID NO: 27779 - protein, 7 aa, Artificial Sequence
  Description of Artificial Sequence: Synthetic peptide
PGPEVGR

SEQ ID NO: 27780 - protein, 7 aa, Artificial Sequence
  Description of Artificial Sequence: Synthetic peptide
STPSNVL

SEQ ID NO: 27781 - protein, 7 aa, Artificial Sequence
  Description of Artificial Sequence: Synthetic peptide
SNSGRGM

SEQ ID NO: 27782 - protein, 7 aa, Artificial Sequence
  Description of Artificial Sequence: Synthetic peptide
ALSSPAN

SEQ ID NO: 27783 - protein, 7 aa, Artificial Sequence
  Description of Artificial Sequence: Synthetic peptide
LGETSMR

SEQ ID NO: 27784 - protein, 7 aa, Artificial Sequence
  Description of Artificial Sequence: Synthetic peptide
LISSKSS

SEQ ID NO: 27785 - protein, 7 aa, Artificial Sequence
  Description of Artificial Sequence: Synthetic peptide
PVRPANL

SEQ ID NO: 27786 - protein, 7 aa, Artificial Sequence
  Description of Artificial Sequence: Synthetic peptide
GIQPGSN

SEQ ID NO: 27787 - protein, 7 aa, Artificial Sequence
  Description of Artificial Sequence: Synthetic peptide
MNSGPKV

SEQ ID NO: 27788 - protein, 7 aa, Artificial Sequence
  Description of Artificial Sequence: Synthetic peptide
LISTAQR

SEQ ID NO: 27789 - protein, 7 aa, Artificial Sequence
  Description of Artificial Sequence: Synthetic peptide
SSDLGKR

SEQ ID NO: 27790 - protein, 7 aa, Artificial Sequence
  Description of Artificial Sequence: Synthetic peptide
DIGNPTN

SEQ ID NO: 27791 - protein, 7 aa, Artificial Sequence
  Description of Artificial Sequence: Synthetic peptide
SGINNPP

SEQ ID NO: 27792 - protein, 7 aa, Artificial Sequence
  Description of Artificial Sequence: Synthetic peptide
SSPSKMA

SEQ ID NO: 27793 - protein, 7 aa, Artificial Sequence
  Description of Artificial Sequence: Synthetic peptide
GRDNSRQ

SEQ ID NO: 27794 - protein, 7 aa, Artificial Sequence
  Description of Artificial Sequence: Synthetic peptide
MSLPGQR

SEQ ID NO: 27795 - protein, 7 aa, Artificial Sequence
  Description of Artificial Sequence: Synthetic peptide
SVDQRRL

SEQ ID NO: 27796 - protein, 7 aa, Artificial Sequence
  Description of Artificial Sequence: Synthetic peptide
GVRSVAG

SEQ ID NO: 27797 - protein, 7 aa, Artificial Sequence
  Description of Artificial Sequence: Synthetic peptide
SDQVRSA

SEQ ID NO: 27798 - protein, 7 aa, Artificial Sequence
  Description of Artificial Sequence: Synthetic peptide
KRMDKSS

SEQ ID NO: 27799 - protein, 7 aa, Artificial Sequence
  Description of Artificial Sequence: Synthetic peptide
HSGTRTS

SEQ ID NO: 27800 - protein, 7 aa, Artificial Sequence
  Description of Artificial Sequence: Synthetic peptide
MPHPSSK

SEQ ID NO: 27801 - protein, 7 aa, Artificial Sequence
  Description of Artificial Sequence: Synthetic peptide
AGASSNT

SEQ ID NO: 27802 - protein, 7 aa, Artificial Sequence
  Description of Artificial Sequence: Synthetic peptide
PSNKTNS

SEQ ID NO: 27803 - protein, 7 aa, Artificial Sequence
  Description of Artificial Sequence: Synthetic peptide
SNVSKPQ

SEQ ID NO: 27804 - protein, 7 aa, Artificial Sequence
  Description of Artificial Sequence: Synthetic peptide
YNVNRNT

SEQ ID NO: 27805 - protein, 7 aa, Artificial Sequence
  Description of Artificial Sequence: Synthetic peptide
PHSTGSI

SEQ ID NO: 27806 - protein, 7 aa, Artificial Sequence
  Description of Artificial Sequence: Synthetic peptide
PRSNTQR

SEQ ID NO: 27807 - protein, 7 aa, Artificial Sequence
  Description of Artificial Sequence: Synthetic peptide
HGQTGMI

SEQ ID NO: 27808 - protein, 7 aa, Artificial Sequence
  Description of Artificial Sequence: Synthetic peptide
HGVNKTE

SEQ ID NO: 27809 - protein, 7 aa, Artificial Sequence
  Description of Artificial Sequence: Synthetic peptide
FSTIKGV

SEQ ID NO: 27810 - protein, 7 aa, Artificial Sequence
  Description of Artificial Sequence: Synthetic peptide
NGSGQNE

SEQ ID NO: 27811 - protein, 7 aa, Artificial Sequence
  Description of Artificial Sequence: Synthetic peptide
RLSSRDS

SEQ ID NO: 27812 - protein, 7 aa, Artificial Sequence
  Description of Artificial Sequence: Synthetic peptide
CHAREHI

SEQ ID NO: 27813 - protein, 7 aa, Artificial Sequence
  Description of Artificial Sequence: Synthetic peptide
MRTSSFY

SEQ ID NO: 27814 - protein, 7 aa, Artificial Sequence
  Description of Artificial Sequence: Synthetic peptide
VSGRPTG

SEQ ID NO: 27815 - protein, 7 aa, Artificial Sequence
  Description of Artificial Sequence: Synthetic peptide
GITKNLA

SEQ ID NO: 27816 - protein, 7 aa, Artificial Sequence
  Description of Artificial Sequence: Synthetic peptide
VRIPKSN

SEQ ID NO: 27817 - protein, 7 aa, Artificial Sequence
  Description of Artificial Sequence: Synthetic peptide
QNLPKAS

SEQ ID NO: 27818 - protein, 7 aa, Artificial Sequence
  Description of Artificial Sequence: Synthetic peptide
LRATSGN

SEQ ID NO: 27819 - protein, 7 aa, Artificial Sequence
  Description of Artificial Sequence: Synthetic peptide
VSGSKVG

SEQ ID NO: 27820 - protein, 7 aa, Artificial Sequence
  Description of Artificial Sequence: Synthetic peptide
RSGNATI

SEQ ID NO: 27821 - protein, 7 aa, Artificial Sequence
  Description of Artificial Sequence: Synthetic peptide
AEKTRSL

SEQ ID NO: 27822 - protein, 7 aa, Artificial Sequence
  Description of Artificial Sequence: Synthetic peptide
GGHKSLN

SEQ ID NO: 27823 - protein, 7 aa, Artificial Sequence
  Description of Artificial Sequence: Synthetic peptide
VGDRSWS

SEQ ID NO: 27824 - protein, 7 aa, Artificial Sequence
  Description of Artificial Sequence: Synthetic peptide
RDSTAAR

SEQ ID NO: 27825 - protein, 7 aa, Artificial Sequence
  Description of Artificial Sequence: Synthetic peptide
MAPRTVP

SEQ ID NO: 27826 - protein, 7 aa, Artificial Sequence
  Description of Artificial Sequence: Synthetic peptide
LLGDTKP

SEQ ID NO: 27827 - protein, 7 aa, Artificial Sequence
  Description of Artificial Sequence: Synthetic peptide
DSHLVDK

SEQ ID NO: 27828 - protein, 7 aa, Artificial Sequence
  Description of Artificial Sequence: Synthetic peptide
RSTNTDN

SEQ ID NO: 27829 - protein, 7 aa, Artificial Sequence
  Description of Artificial Sequence: Synthetic peptide
SSFQANK

SEQ ID NO: 27830 - protein, 7 aa, Artificial Sequence
  Description of Artificial Sequence: Synthetic peptide
PTSNGSL

SEQ ID NO: 27831 - protein, 7 aa, Artificial Sequence
  Description of Artificial Sequence: Synthetic peptide
LSANPHN

SEQ ID NO: 27832 - protein, 7 aa, Artificial Sequence
  Description of Artificial Sequence: Synthetic peptide
QPNSGTT

SEQ ID NO: 27833 - protein, 7 aa, Artificial Sequence
  Description of Artificial Sequence: Synthetic peptide
ATANTHM

SEQ ID NO: 27834 - protein, 7 aa, Artificial Sequence
  Description of Artificial Sequence: Synthetic peptide
PYAGTSP

SEQ ID NO: 27835 - protein, 7 aa, Artificial Sequence
  Description of Artificial Sequence: Synthetic peptide
PLGSRVN

SEQ ID NO: 27836 - protein, 7 aa, Artificial Sequence
  Description of Artificial Sequence: Synthetic peptide
VNTNRAA

SEQ ID NO: 27837 - protein, 7 aa, Artificial Sequence
  Description of Artificial Sequence: Synthetic peptide
SPNSHPS

SEQ ID NO: 27838 - protein, 7 aa, Artificial Sequence
  Description of Artificial Sequence: Synthetic peptide
SLNSREG

SEQ ID NO: 27839 - protein, 7 aa, Artificial Sequence
  Description of Artificial Sequence: Synthetic peptide
CNQSPNR

SEQ ID NO: 27840 - protein, 7 aa, Artificial Sequence
  Description of Artificial Sequence: Synthetic peptide
SFDSKPP

SEQ ID NO: 27841 - protein, 7 aa, Artificial Sequence
  Description of Artificial Sequence: Synthetic peptide
PNGGIPP

SEQ ID NO: 27842 - protein, 7 aa, Artificial Sequence
  Description of Artificial Sequence: Synthetic peptide
QGSFNAL

SEQ ID NO: 27843 - protein, 7 aa, Artificial Sequence
  Description of Artificial Sequence: Synthetic peptide
HTDTSAV

SEQ ID NO: 27844 - protein, 7 aa, Artificial Sequence
  Description of Artificial Sequence: Synthetic peptide
LLDRRAA

SEQ ID NO: 27845 - protein, 7 aa, Artificial Sequence
  Description of Artificial Sequence: Synthetic peptide
RLETKSG

SEQ ID NO: 27846 - protein, 7 aa, Artificial Sequence
  Description of Artificial Sequence: Synthetic peptide
VADKGSM

SEQ ID NO: 27847 - protein, 7 aa, Artificial Sequence
  Description of Artificial Sequence: Synthetic peptide
SMLPGDN

SEQ ID NO: 27848 - protein, 7 aa, Artificial Sequence
  Description of Artificial Sequence: Synthetic peptide
CATRASY

SEQ ID NO: 27849 - protein, 7 aa, Artificial Sequence
  Description of Artificial Sequence: Synthetic peptide
QTPVSAP

SEQ ID NO: 27850 - protein, 7 aa, Artificial Sequence
  Description of Artificial Sequence: Synthetic peptide
TESRSAN

SEQ ID NO: 27851 - protein, 7 aa, Artificial Sequence
  Description of Artificial Sequence: Synthetic peptide
NSVKTPE

SEQ ID NO: 27852 - protein, 7 aa, Artificial Sequence
  Description of Artificial Sequence: Synthetic peptide
PTSFSGT

SEQ ID NO: 27853 - protein, 7 aa, Artificial Sequence
  Description of Artificial Sequence: Synthetic peptide
NTSSSHT

SEQ ID NO: 27854 - protein, 7 aa, Artificial Sequence
  Description of Artificial Sequence: Synthetic peptide
PILDRKS

SEQ ID NO: 27855 - protein, 7 aa, Artificial Sequence
  Description of Artificial Sequence: Synthetic peptide
RTSTSLL

SEQ ID NO: 27856 - protein, 7 aa, Artificial Sequence
  Description of Artificial Sequence: Synthetic peptide
TTSARPN

SEQ ID NO: 27857 - protein, 7 aa, Artificial Sequence
  Description of Artificial Sequence: Synthetic peptide
LSQGRMV

SEQ ID NO: 27858 - protein, 7 aa, Artificial Sequence
  Description of Artificial Sequence: Synthetic peptide
NQSRPGV

SEQ ID NO: 27859 - protein, 7 aa, Artificial Sequence
  Description of Artificial Sequence: Synthetic peptide
TEQARAM

SEQ ID NO: 27860 - protein, 7 aa, Artificial Sequence
  Description of Artificial Sequence: Synthetic peptide
GSSLTSR

SEQ ID NO: 27861 - protein, 7 aa, Artificial Sequence
  Description of Artificial Sequence: Synthetic peptide
RDRPQST

SEQ ID NO: 27862 - protein, 7 aa, Artificial Sequence
  Description of Artificial Sequence: Synthetic peptide
GSGSRLI

SEQ ID NO: 27863 - protein, 7 aa, Artificial Sequence
  Description of Artificial Sequence: Synthetic peptide
GDMGISK

SEQ ID NO: 27864 - protein, 7 aa, Artificial Sequence
  Description of Artificial Sequence: Synthetic peptide
VSGQGNS

SEQ ID NO: 27865 - protein, 7 aa, Artificial Sequence
  Description of Artificial Sequence: Synthetic peptide
ISTPKTA

SEQ ID NO: 27866 - protein, 7 aa, Artificial Sequence
  Description of Artificial Sequence: Synthetic peptide
GPGRNLI

SEQ ID NO: 27867 - protein, 7 aa, Artificial Sequence
  Description of Artificial Sequence: Synthetic peptide
IATKAVA

SEQ ID NO: 27868 - protein, 7 aa, Artificial Sequence
  Description of Artificial Sequence: Synthetic peptide
PPLGSTV

SEQ ID NO: 27869 - protein, 7 aa, Artificial Sequence
  Description of Artificial Sequence: Synthetic peptide
GASTPRL

SEQ ID NO: 27870 - protein, 7 aa, Artificial Sequence
  Description of Artificial Sequence: Synthetic peptide
TSSGGLT

SEQ ID NO: 27871 - protein, 7 aa, Artificial Sequence
  Description of Artificial Sequence: Synthetic peptide
QSDHRSL

SEQ ID NO: 27872 - protein, 7 aa, Artificial Sequence
  Description of Artificial Sequence: Synthetic peptide
YRNTTSA

SEQ ID NO: 27873 - protein, 7 aa, Artificial Sequence
  Description of Artificial Sequence: Synthetic peptide
AMTGSHT

SEQ ID NO: 27874 - protein, 7 aa, Artificial Sequence
  Description of Artificial Sequence: Synthetic peptide
NQSSSAR

SEQ ID NO: 27875 - protein, 7 aa, Artificial Sequence
  Description of Artificial Sequence: Synthetic peptide
VQQSKAY

SEQ ID NO: 27876 - protein, 7 aa, Artificial Sequence
  Description of Artificial Sequence: Synthetic peptide
TGTQGTR

SEQ ID NO: 27877 - protein, 7 aa, Artificial Sequence
  Description of Artificial Sequence: Synthetic peptide
GSRNTST

SEQ ID NO: 27878 - protein, 7 aa, Artificial Sequence
  Description of Artificial Sequence: Synthetic peptide
PGMKVSP

SEQ ID NO: 27879 - protein, 7 aa, Artificial Sequence
  Description of Artificial Sequence: Synthetic peptide
TLENSRR

SEQ ID NO: 27880 - protein, 7 aa, Artificial Sequence
  Description of Artificial Sequence: Synthetic peptide
QITPRSG

SEQ ID NO: 27881 - protein, 7 aa, Artificial Sequence
  Description of Artificial Sequence: Synthetic peptide
RSATSSV

SEQ ID NO: 27882 - protein, 7 aa, Artificial Sequence
  Description of Artificial Sequence: Synthetic peptide
YQKERVV

SEQ ID NO: 27883 - protein, 7 aa, Artificial Sequence
  Description of Artificial Sequence: Synthetic peptide
LRSAPSI

SEQ ID NO: 27884 - protein, 7 aa, Artificial Sequence
  Description of Artificial Sequence: Synthetic peptide
PPAVGSS

SEQ ID NO: 27885 - protein, 7 aa, Artificial Sequence
  Description of Artificial Sequence: Synthetic peptide
SSRGGNT

SEQ ID NO: 27886 - protein, 7 aa, Artificial Sequence
  Description of Artificial Sequence: Synthetic peptide
LQRAPQT

SEQ ID NO: 27887 - protein, 7 aa, Artificial Sequence
  Description of Artificial Sequence: Synthetic peptide
AGTGSSL

SEQ ID NO: 27888 - protein, 7 aa, Artificial Sequence
  Description of Artificial Sequence: Synthetic peptide
NHESSYR

SEQ ID NO: 27889 - protein, 7 aa, Artificial Sequence
  Description of Artificial Sequence: Synthetic peptide
LGTSHQQ

SEQ ID NO: 27890 - protein, 7 aa, Artificial Sequence
  Description of Artificial Sequence: Synthetic peptide
PITRSLL

SEQ ID NO: 27891 - protein, 7 aa, Artificial Sequence
  Description of Artificial Sequence: Synthetic peptide
VQHTHSG

SEQ ID NO: 27892 - protein, 7 aa, Artificial Sequence
  Description of Artificial Sequence: Synthetic peptide
PLPAHSP

SEQ ID NO: 27893 - protein, 7 aa, Artificial Sequence
  Description of Artificial Sequence: Synthetic peptide
IIQDTAR

SEQ ID NO: 27894 - protein, 7 aa, Artificial Sequence
  Description of Artificial Sequence: Synthetic peptide
PSLNKNY

SEQ ID NO: 27895 - protein, 7 aa, Artificial Sequence
  Description of Artificial Sequence: Synthetic peptide
PRLNVGG

SEQ ID NO: 27896 - protein, 7 aa, Artificial Sequence
  Description of Artificial Sequence: Synthetic peptide
TNPNPHR

SEQ ID NO: 27897 - protein, 7 aa, Artificial Sequence
  Description of Artificial Sequence: Synthetic peptide
NREQLRD

SEQ ID NO: 27898 - protein, 7 aa, Artificial Sequence
  Description of Artificial Sequence: Synthetic peptide
SMGHTLN

SEQ ID NO: 27899 - protein, 7 aa, Artificial Sequence
  Description of Artificial Sequence: Synthetic peptide
APTSGPS

SEQ ID NO: 27900 - protein, 7 aa, Artificial Sequence
  Description of Artificial Sequence: Synthetic peptide
QSSNARN

SEQ ID NO: 27901 - protein, 7 aa, Artificial Sequence
  Description of Artificial Sequence: Synthetic peptide
KQHNTLG

SEQ ID NO: 27902 - protein, 7 aa, Artificial Sequence
  Description of Artificial Sequence: Synthetic peptide
SPGTNTS

SEQ ID NO: 27903 - protein, 7 aa, Artificial Sequence
  Description of Artificial Sequence: Synthetic peptide
TQRSQAA

SEQ ID NO: 27904 - protein, 7 aa, Artificial Sequence
  Description of Artificial Sequence: Synthetic peptide
DITRGPS

SEQ ID NO: 27905 - protein, 7 aa, Artificial Sequence
  Description of Artificial Sequence: Synthetic peptide
VQPRTST

SEQ ID NO: 27906 - protein, 7 aa, Artificial Sequence
  Description of Artificial Sequence: Synthetic peptide
DTRGQMR

SEQ ID NO: 27907 - protein, 7 aa, Artificial Sequence
  Description of Artificial Sequence: Synthetic peptide
IRTKESA

SEQ ID NO: 27908 - protein, 7 aa, Artificial Sequence
  Description of Artificial Sequence: Synthetic peptide
VSVDKRP

SEQ ID NO: 27909 - protein, 7 aa, Artificial Sequence
  Description of Artificial Sequence: Synthetic peptide
PTHASSL

SEQ ID NO: 27910 - protein, 7 aa, Artificial Sequence
  Description of Artificial Sequence: Synthetic peptide
HATQSRN

SEQ ID NO: 27911 - protein, 7 aa, Artificial Sequence
  Description of Artificial Sequence: Synthetic peptide
GLARAGH

SEQ ID NO: 27912 - protein, 7 aa, Artificial Sequence
  Description of Artificial Sequence: Synthetic peptide
HASPSTR

SEQ ID NO: 27913 - protein, 7 aa, Artificial Sequence
  Description of Artificial Sequence: Synthetic peptide
GNRQGMG

SEQ ID NO: 27914 - protein, 7 aa, Artificial Sequence
  Description of Artificial Sequence: Synthetic peptide
MSTSSKS

SEQ ID NO: 27915 - protein, 7 aa, Artificial Sequence
  Description of Artificial Sequence: Synthetic peptide
SANNKSG

SEQ ID NO: 27916 - protein, 7 aa, Artificial Sequence
  Description of Artificial Sequence: Synthetic peptide
SQHRPSS

SEQ ID NO: 27917 - protein, 7 aa, Artificial Sequence
  Description of Artificial Sequence: Synthetic peptide
TPQNVRN

SEQ ID NO: 27918 - protein, 7 aa, Artificial Sequence
  Description of Artificial Sequence: Synthetic peptide
TPVNRTH

SEQ ID NO: 27919 - protein, 7 aa, Artificial Sequence
  Description of Artificial Sequence: Synthetic peptide
LTPSKIG

SEQ ID NO: 27920 - protein, 7 aa, Artificial Sequence
  Description of Artificial Sequence: Synthetic peptide
VPHGATS

SEQ ID NO: 27921 - protein, 7 aa, Artificial Sequence
  Description of Artificial Sequence: Synthetic peptide
SGRDKFS

SEQ ID NO: 27922 - protein, 7 aa, Artificial Sequence
  Description of Artificial Sequence: Synthetic peptide
RGDPHRA

SEQ ID NO: 27923 - protein, 7 aa, Artificial Sequence
  Description of Artificial Sequence: Synthetic peptide
PGNSHKI

SEQ ID NO: 27924 - protein, 7 aa, Artificial Sequence
  Description of Artificial Sequence: Synthetic peptide
NPAHGLN

SEQ ID NO: 27925 - protein, 7 aa, Artificial Sequence
  Description of Artificial Sequence: Synthetic peptide
RTASSLP

SEQ ID NO: 27926 - protein, 7 aa, Artificial Sequence
  Description of Artificial Sequence: Synthetic peptide
RRQDTQE

SEQ ID NO: 27927 - protein, 7 aa, Artificial Sequence
  Description of Artificial Sequence: Synthetic peptide
GSEHKKQ

SEQ ID NO: 27928 - protein, 7 aa, Artificial Sequence
  Description of Artificial Sequence: Synthetic peptide
VNEHNVR

SEQ ID NO: 27929 - protein, 7 aa, Artificial Sequence
  Description of Artificial Sequence: Synthetic peptide
PEPAARN

SEQ ID NO: 27930 - protein, 7 aa, Artificial Sequence
  Description of Artificial Sequence: Synthetic peptide
HYNQTGL

SEQ ID NO: 27931 - protein, 7 aa, Artificial Sequence
  Description of Artificial Sequence: Synthetic peptide
SHQTPGY

SEQ ID NO: 27932 - protein, 7 aa, Artificial Sequence
  Description of Artificial Sequence: Synthetic peptide
SLSSKQM

SEQ ID NO: 27933 - protein, 7 aa, Artificial Sequence
  Description of Artificial Sequence: Synthetic peptide
NAQGTAK

SEQ ID NO: 27934 - protein, 7 aa, Artificial Sequence
  Description of Artificial Sequence: Synthetic peptide
VTGSVSD

SEQ ID NO: 27935 - protein, 7 aa, Artificial Sequence
  Description of Artificial Sequence: Synthetic peptide
PGQSTSK

SEQ ID NO: 27936 - protein, 7 aa, Artificial Sequence
  Description of Artificial Sequence: Synthetic peptide
VLDTKDC

SEQ ID NO: 27937 - protein, 7 aa, Artificial Sequence
  Description of Artificial Sequence: Synthetic peptide
TGGNRVL

SEQ ID NO: 27938 - protein, 7 aa, Artificial Sequence
  Description of Artificial Sequence: Synthetic peptide
VSNKSVL

SEQ ID NO: 27939 - protein, 7 aa, Artificial Sequence
  Description of Artificial Sequence: Synthetic peptide
NHRANLI

SEQ ID NO: 27940 - protein, 7 aa, Artificial Sequence
  Description of Artificial Sequence: Synthetic peptide
HVNSGKL

SEQ ID NO: 27941 - protein, 7 aa, Artificial Sequence
  Description of Artificial Sequence: Synthetic peptide
QQFGTLK

SEQ ID NO: 27942 - protein, 7 aa, Artificial Sequence
  Description of Artificial Sequence: Synthetic peptide
WQEERGQ

SEQ ID NO: 27943 - protein, 7 aa, Artificial Sequence
  Description of Artificial Sequence: Synthetic peptide
FTIPRAA

SEQ ID NO: 27944 - protein, 7 aa, Artificial Sequence
  Description of Artificial Sequence: Synthetic peptide
QGKSGEQ

SEQ ID NO: 27945 - protein, 7 aa, Artificial Sequence
  Description of Artificial Sequence: Synthetic peptide
TGTSGSR

SEQ ID NO: 27946 - protein, 7 aa, Artificial Sequence
  Description of Artificial Sequence: Synthetic peptide
TTSKGGI

SEQ ID NO: 27947 - protein, 7 aa, Artificial Sequence
  Description of Artificial Sequence: Synthetic peptide
KPATPNG

SEQ ID NO: 27948 - protein, 7 aa, Artificial Sequence
  Description of Artificial Sequence: Synthetic peptide
QNTNAAI

SEQ ID NO: 27949 - protein, 7 aa, Artificial Sequence
  Description of Artificial Sequence: Synthetic peptide
NSHNGAS

SEQ ID NO: 27950 - protein, 7 aa, Artificial Sequence
  Description of Artificial Sequence: Synthetic peptide
PVSRGSG

SEQ ID NO: 27951 - protein, 7 aa, Artificial Sequence
  Description of Artificial Sequence: Synthetic peptide
SMGNSIS

SEQ ID NO: 27952 - protein, 7 aa, Artificial Sequence
  Description of Artificial Sequence: Synthetic peptide
SGSGQNQ

SEQ ID NO: 27953 - protein, 7 aa, Artificial Sequence
  Description of Artificial Sequence: Synthetic peptide
FRTQSTK

SEQ ID NO: 27954 - protein, 7 aa, Artificial Sequence
  Description of Artificial Sequence: Synthetic peptide
QVPASHG

SEQ ID NO: 27955 - protein, 7 aa, Artificial Sequence
  Description of Artificial Sequence: Synthetic peptide
PNLQSSN

SEQ ID NO: 27956 - protein, 7 aa, Artificial Sequence
  Description of Artificial Sequence: Synthetic peptide
GLGQQTN

SEQ ID NO: 27957 - protein, 7 aa, Artificial Sequence
  Description of Artificial Sequence: Synthetic peptide
KNAPQQA

SEQ ID NO: 27958 - protein, 7 aa, Artificial Sequence
  Description of Artificial Sequence: Synthetic peptide
DIPAKTA

SEQ ID NO: 27959 - protein, 7 aa, Artificial Sequence
  Description of Artificial Sequence: Synthetic peptide
VTPTKHP

SEQ ID NO: 27960 - protein, 7 aa, Artificial Sequence
  Description of Artificial Sequence: Synthetic peptide
RMSNLLG

SEQ ID NO: 27961 - protein, 7 aa, Artificial Sequence
  Description of Artificial Sequence: Synthetic peptide
PNTKPVL

SEQ ID NO: 27962 - protein, 7 aa, Artificial Sequence
  Description of Artificial Sequence: Synthetic peptide
VTGTTSE

SEQ ID NO: 27963 - protein, 7 aa, Artificial Sequence
  Description of Artificial Sequence: Synthetic peptide
VPRAPGM

SEQ ID NO: 27964 - protein, 7 aa, Artificial Sequence
  Description of Artificial Sequence: Synthetic peptide
SASRSAY

SEQ ID NO: 27965 - protein, 7 aa, Artificial Sequence
  Description of Artificial Sequence: Synthetic peptide
RGSGLLL

SEQ ID NO: 27966 - protein, 7 aa, Artificial Sequence
  Description of Artificial Sequence: Synthetic peptide
PTTASRQ

SEQ ID NO: 27967 - protein, 7 aa, Artificial Sequence
  Description of Artificial Sequence: Synthetic peptide
HSTTVAK

SEQ ID NO: 27968 - protein, 7 aa, Artificial Sequence
  Description of Artificial Sequence: Synthetic peptide
NSGKPNA

SEQ ID NO: 27969 - protein, 7 aa, Artificial Sequence
  Description of Artificial Sequence: Synthetic peptide
YGRDKFS

SEQ ID NO: 27970 - protein, 7 aa, Artificial Sequence
  Description of Artificial Sequence: Synthetic peptide
VGPSKIQ

SEQ ID NO: 27971 - protein, 7 aa, Artificial Sequence
  Description of Artificial Sequence: Synthetic peptide
NGSGQYQ

SEQ ID NO: 27972 - protein, 7 aa, Artificial Sequence
  Description of Artificial Sequence: Synthetic peptide
PGTKQSS

SEQ ID NO: 27973 - protein, 7 aa, Artificial Sequence
  Description of Artificial Sequence: Synthetic peptide
FGSSNAV

SEQ ID NO: 27974 - protein, 7 aa, Artificial Sequence
  Description of Artificial Sequence: Synthetic peptide
LSNQNNQ

SEQ ID NO: 27975 - protein, 7 aa, Artificial Sequence
  Description of Artificial Sequence: Synthetic peptide
RTGESYM

SEQ ID NO: 27976 - protein, 7 aa, Artificial Sequence
  Description of Artificial Sequence: Synthetic peptide
SIHSTKA

SEQ ID NO: 27977 - protein, 7 aa, Artificial Sequence
  Description of Artificial Sequence: Synthetic peptide
FSNNGSH

SEQ ID NO: 27978 - protein, 7 aa, Artificial Sequence
  Description of Artificial Sequence: Synthetic peptide
LVSVNQL

SEQ ID NO: 27979 - protein, 7 aa, Artificial Sequence
  Description of Artificial Sequence: Synthetic peptide
SGSTRRD

SEQ ID NO: 27980 - protein, 7 aa, Artificial Sequence
  Description of Artificial Sequence: Synthetic peptide
AGGINKL

SEQ ID NO: 27981 - protein, 7 aa, Artificial Sequence
  Description of Artificial Sequence: Synthetic peptide
TAIGDVS

SEQ ID NO: 27982 - protein, 7 aa, Artificial Sequence
  Description of Artificial Sequence: Synthetic peptide
PYVKSAG

SEQ ID NO: 27983 - protein, 7 aa, Artificial Sequence
  Description of Artificial Sequence: Synthetic peptide
RSPGSNT

SEQ ID NO: 27984 - protein, 7 aa, Artificial Sequence
  Description of Artificial Sequence: Synthetic peptide
MYQKPAS

SEQ ID NO: 27985 - protein, 7 aa, Artificial Sequence
  Description of Artificial Sequence: Synthetic peptide
NSREKGA

SEQ ID NO: 27986 - protein, 7 aa, Artificial Sequence
  Description of Artificial Sequence: Synthetic peptide
SSGNRTT

SEQ ID NO: 27987 - protein, 7 aa, Artificial Sequence
  Description of Artificial Sequence: Synthetic peptide
VASQPVR

SEQ ID NO: 27988 - protein, 7 aa, Artificial Sequence
  Description of Artificial Sequence: Synthetic peptide
MTQHKQA

SEQ ID NO: 27989 - protein, 7 aa, Artificial Sequence
  Description of Artificial Sequence: Synthetic peptide
SSYVGPS

SEQ ID NO: 27990 - protein, 7 aa, Artificial Sequence
  Description of Artificial Sequence: Synthetic peptide
RMRDNPG

SEQ ID NO: 27991 - protein, 7 aa, Artificial Sequence
  Description of Artificial Sequence: Synthetic peptide
MSHTNRP

SEQ ID NO: 27992 - protein, 7 aa, Artificial Sequence
  Description of Artificial Sequence: Synthetic peptide
LRDKTGA

SEQ ID NO: 27993 - protein, 7 aa, Artificial Sequence
  Description of Artificial Sequence: Synthetic peptide
SQQSAAL

SEQ ID NO: 27994 - protein, 7 aa, Artificial Sequence
  Description of Artificial Sequence: Synthetic peptide
QLPALQG

SEQ ID NO: 27995 - protein, 7 aa, Artificial Sequence
  Description of Artificial Sequence: Synthetic peptide
PSGETSK

SEQ ID NO: 27996 - protein, 7 aa, Artificial Sequence
  Description of Artificial Sequence: Synthetic peptide
ARGGVLS

SEQ ID NO: 27997 - protein, 7 aa, Artificial Sequence
  Description of Artificial Sequence: Synthetic peptide
TASGSNA

SEQ ID NO: 27998 - protein, 7 aa, Artificial Sequence
  Description of Artificial Sequence: Synthetic peptide
NSSTSAK

SEQ ID NO: 27999 - protein, 7 aa, Artificial Sequence
  Description of Artificial Sequence: Synthetic peptide
YGSESNK

SEQ ID NO: 28000 - protein, 7 aa, Artificial Sequence
  Description of Artificial Sequence: Synthetic peptide
PHISPKG

SEQ ID NO: 28001 - protein, 7 aa, Artificial Sequence
  Description of Artificial Sequence: Synthetic peptide
PVSDRRG

SEQ ID NO: 28002 - protein, 7 aa, Artificial Sequence
  Description of Artificial Sequence: Synthetic peptide
QSGPGVT

SEQ ID NO: 28003 - protein, 7 aa, Artificial Sequence
  Description of Artificial Sequence: Synthetic peptide
LLSAKGG

SEQ ID NO: 28004 - protein, 7 aa, Artificial Sequence
  Description of Artificial Sequence: Synthetic peptide
VGNRANC

SEQ ID NO: 28005 - protein, 7 aa, Artificial Sequence
  Description of Artificial Sequence: Synthetic peptide
TGSSGRI

SEQ ID NO: 28006 - protein, 7 aa, Artificial Sequence
  Description of Artificial Sequence: Synthetic peptide
EVFSSQK

SEQ ID NO: 28007 - protein, 7 aa, Artificial Sequence
  Description of Artificial Sequence: Synthetic peptide
NSHQKPS

SEQ ID NO: 28008 - protein, 7 aa, Artificial Sequence
  Description of Artificial Sequence: Synthetic peptide
PLSGSKA

SEQ ID NO: 28009 - protein, 7 aa, Artificial Sequence
  Description of Artificial Sequence: Synthetic peptide
TTMSKPS

SEQ ID NO: 28010 - protein, 7 aa, Artificial Sequence
  Description of Artificial Sequence: Synthetic peptide
ALAGTKG

SEQ ID NO: 28011 - protein, 7 aa, Artificial Sequence
  Description of Artificial Sequence: Synthetic peptide
RGDTKNL

SEQ ID NO: 28012 - protein, 7 aa, Artificial Sequence
  Description of Artificial Sequence: Synthetic peptide
SISDKLG

SEQ ID NO: 28013 - protein, 7 aa, Artificial Sequence
  Description of Artificial Sequence: Synthetic peptide
REYNTTS

SEQ ID NO: 28014 - protein, 7 aa, Artificial Sequence
  Description of Artificial Sequence: Synthetic peptide
LSRNGIN

SEQ ID NO: 28015 - protein, 7 aa, Artificial Sequence
  Description of Artificial Sequence: Synthetic peptide
RQNNGIK

SEQ ID NO: 28016 - protein, 7 aa, Artificial Sequence
  Description of Artificial Sequence: Synthetic peptide
SVVSEVR

SEQ ID NO: 28017 - protein, 7 aa, Artificial Sequence
  Description of Artificial Sequence: Synthetic peptide
IGPSGVL

SEQ ID NO: 28018 - protein, 7 aa, Artificial Sequence
  Description of Artificial Sequence: Synthetic peptide
SVTPREY

SEQ ID NO: 28019 - protein, 7 aa, Artificial Sequence
  Description of Artificial Sequence: Synthetic peptide
SGTQTWS

SEQ ID NO: 28020 - protein, 7 aa, Artificial Sequence
  Description of Artificial Sequence: Synthetic peptide
SSSAPRL

SEQ ID NO: 28021 - protein, 7 aa, Artificial Sequence
  Description of Artificial Sequence: Synthetic peptide
PMGRNAG

SEQ ID NO: 28022 - protein, 7 aa, Artificial Sequence
  Description of Artificial Sequence: Synthetic peptide
FRQGGAI

SEQ ID NO: 28023 - protein, 7 aa, Artificial Sequence
  Description of Artificial Sequence: Synthetic peptide
DQVSHKL

SEQ ID NO: 28024 - protein, 7 aa, Artificial Sequence
  Description of Artificial Sequence: Synthetic peptide
SSSPNVK

SEQ ID NO: 28025 - protein, 7 aa, Artificial Sequence
  Description of Artificial Sequence: Synthetic peptide
QPTQRMG

SEQ ID NO: 28026 - protein, 7 aa, Artificial Sequence
  Description of Artificial Sequence: Synthetic peptide
HNVVGRG

SEQ ID NO: 28027 - protein, 7 aa, Artificial Sequence
  Description of Artificial Sequence: Synthetic peptide
GFPNVAT

SEQ ID NO: 28028 - protein, 7 aa, Artificial Sequence
  Description of Artificial Sequence: Synthetic peptide
QPTRSTA

SEQ ID NO: 28029 - protein, 7 aa, Artificial Sequence
  Description of Artificial Sequence: Synthetic peptide
GTDSKRH

SEQ ID NO: 28030 - protein, 7 aa, Artificial Sequence
  Description of Artificial Sequence: Synthetic peptide
TGMSNNR

SEQ ID NO: 28031 - protein, 7 aa, Artificial Sequence
  Description of Artificial Sequence: Synthetic peptide
LGGRSSN

SEQ ID NO: 28032 - protein, 7 aa, Artificial Sequence
  Description of Artificial Sequence: Synthetic peptide
TRESRTN

SEQ ID NO: 28033 - protein, 7 aa, Artificial Sequence
  Description of Artificial Sequence: Synthetic peptide
HQERASM

SEQ ID NO: 28034 - protein, 7 aa, Artificial Sequence
  Description of Artificial Sequence: Synthetic peptide
PQASRGM

SEQ ID NO: 28035 - protein, 7 aa, Artificial Sequence
  Description of Artificial Sequence: Synthetic peptide
KDERKGM

SEQ ID NO: 28036 - protein, 7 aa, Artificial Sequence
  Description of Artificial Sequence: Synthetic peptide
SMGKLSS

SEQ ID NO: 28037 - protein, 7 aa, Artificial Sequence
  Description of Artificial Sequence: Synthetic peptide
KIASKSE

SEQ ID NO: 28038 - protein, 7 aa, Artificial Sequence
  Description of Artificial Sequence: Synthetic peptide
QLPVPSN

SEQ ID NO: 28039 - protein, 7 aa, Artificial Sequence
  Description of Artificial Sequence: Synthetic peptide
GTPNNRS

SEQ ID NO: 28040 - protein, 7 aa, Artificial Sequence
  Description of Artificial Sequence: Synthetic peptide
VMNRTGG

SEQ ID NO: 28041 - protein, 7 aa, Artificial Sequence
  Description of Artificial Sequence: Synthetic peptide
NTVSKSQ

SEQ ID NO: 28042 - protein, 7 aa, Artificial Sequence
  Description of Artificial Sequence: Synthetic peptide
VSSRASS

SEQ ID NO: 28043 - protein, 7 aa, Artificial Sequence
  Description of Artificial Sequence: Synthetic peptide
YVQNGGR

SEQ ID NO: 28044 - protein, 7 aa, Artificial Sequence
  Description of Artificial Sequence: Synthetic peptide
SPGNKLL

SEQ ID NO: 28045 - protein, 7 aa, Artificial Sequence
  Description of Artificial Sequence: Synthetic peptide
SIKSAAA

SEQ ID NO: 28046 - protein, 7 aa, Artificial Sequence
  Description of Artificial Sequence: Synthetic peptide
SRTAHEQ

SEQ ID NO: 28047 - protein, 7 aa, Artificial Sequence
  Description of Artificial Sequence: Synthetic peptide
PLGYKAT

SEQ ID NO: 28048 - protein, 7 aa, Artificial Sequence
  Description of Artificial Sequence: Synthetic peptide
NSGARLS

SEQ ID NO: 28049 - protein, 7 aa, Artificial Sequence
  Description of Artificial Sequence: Synthetic peptide
TATRQPD

SEQ ID NO: 28050 - protein, 7 aa, Artificial Sequence
  Description of Artificial Sequence: Synthetic peptide
QRTSDQT

SEQ ID NO: 28051 - protein, 7 aa, Artificial Sequence
  Description of Artificial Sequence: Synthetic peptide
SGSDKFS

SEQ ID NO: 28052 - protein, 7 aa, Artificial Sequence
  Description of Artificial Sequence: Synthetic peptide
KLATDSF

SEQ ID NO: 28053 - protein, 7 aa, Artificial Sequence
  Description of Artificial Sequence: Synthetic peptide
PQHMTHT

SEQ ID NO: 28054 - protein, 7 aa, Artificial Sequence
  Description of Artificial Sequence: Synthetic peptide
FQTRTVA

SEQ ID NO: 28055 - protein, 7 aa, Artificial Sequence
  Description of Artificial Sequence: Synthetic peptide
GQASHMK

SEQ ID NO: 28056 - protein, 7 aa, Artificial Sequence
  Description of Artificial Sequence: Synthetic peptide
KHLDNES

SEQ ID NO: 28057 - protein, 7 aa, Artificial Sequence
  Description of Artificial Sequence: Synthetic peptide
GSSQRSD

SEQ ID NO: 28058 - protein, 7 aa, Artificial Sequence
  Description of Artificial Sequence: Synthetic peptide
GQGSHMK

SEQ ID NO: 28059 - protein, 7 aa, Artificial Sequence
  Description of Artificial Sequence: Synthetic peptide
NTTAKSS

SEQ ID NO: 28060 - protein, 7 aa, Artificial Sequence
  Description of Artificial Sequence: Synthetic peptide
TSVRSLQ

SEQ ID NO: 28061 - protein, 7 aa, Artificial Sequence
  Description of Artificial Sequence: Synthetic peptide
GSPGVLR

SEQ ID NO: 28062 - protein, 7 aa, Artificial Sequence
  Description of Artificial Sequence: Synthetic peptide
HATSGTR

SEQ ID NO: 28063 - protein, 7 aa, Artificial Sequence
  Description of Artificial Sequence: Synthetic peptide
RTGNNHE

SEQ ID NO: 28064 - protein, 7 aa, Artificial Sequence
  Description of Artificial Sequence: Synthetic peptide
DNISRSR

SEQ ID NO: 28065 - protein, 7 aa, Artificial Sequence
  Description of Artificial Sequence: Synthetic peptide
REGGQMV

SEQ ID NO: 28066 - protein, 7 aa, Artificial Sequence
  Description of Artificial Sequence: Synthetic peptide
PSLQMTR

SEQ ID NO: 28067 - protein, 7 aa, Artificial Sequence
  Description of Artificial Sequence: Synthetic peptide
LPHHTSA

SEQ ID NO: 28068 - protein, 7 aa, Artificial Sequence
  Description of Artificial Sequence: Synthetic peptide
NPPVYTS

SEQ ID NO: 28069 - protein, 7 aa, Artificial Sequence
  Description of Artificial Sequence: Synthetic peptide
KTGAKMG

SEQ ID NO: 28070 - protein, 7 aa, Artificial Sequence
  Description of Artificial Sequence: Synthetic peptide
RDDKQNS

SEQ ID NO: 28071 - protein, 7 aa, Artificial Sequence
  Description of Artificial Sequence: Synthetic peptide
FNQHSSL

SEQ ID NO: 28072 - protein, 7 aa, Artificial Sequence
  Description of Artificial Sequence: Synthetic peptide
MTESSRT

SEQ ID NO: 28073 - protein, 7 aa, Artificial Sequence
  Description of Artificial Sequence: Synthetic peptide
NGTGQNQ

SEQ ID NO: 28074 - protein, 7 aa, Artificial Sequence
  Description of Artificial Sequence: Synthetic peptide
PLSAGKS

SEQ ID NO: 28075 - protein, 7 aa, Artificial Sequence
  Description of Artificial Sequence: Synthetic peptide
GSAQSPR

SEQ ID NO: 28076 - protein, 7 aa, Artificial Sequence
  Description of Artificial Sequence: Synthetic peptide
PASLGQG

SEQ ID NO: 28077 - protein, 7 aa, Artificial Sequence
  Description of Artificial Sequence: Synthetic peptide
SHASSTA

SEQ ID NO: 28078 - protein, 7 aa, Artificial Sequence
  Description of Artificial Sequence: Synthetic peptide
QNTPKST

SEQ ID NO: 28079 - protein, 7 aa, Artificial Sequence
  Description of Artificial Sequence: Synthetic peptide
LRSKESA

SEQ ID NO: 28080 - protein, 7 aa, Artificial Sequence
  Description of Artificial Sequence: Synthetic peptide
SRPGLSQ

SEQ ID NO: 28081 - protein, 7 aa, Artificial Sequence
  Description of Artificial Sequence: Synthetic peptide
EGTRGVG

SEQ ID NO: 28082 - protein, 7 aa, Artificial Sequence
  Description of Artificial Sequence: Synthetic peptide
NSMPTTL

SEQ ID NO: 28083 - protein, 7 aa, Artificial Sequence
  Description of Artificial Sequence: Synthetic peptide
GTTNSRN

SEQ ID NO: 28084 - protein, 7 aa, Artificial Sequence
  Description of Artificial Sequence: Synthetic peptide
STFSPSK

SEQ ID NO: 28085 - protein, 7 aa, Artificial Sequence
  Description of Artificial Sequence: Synthetic peptide
ARDDQRR

SEQ ID NO: 28086 - protein, 7 aa, Artificial Sequence
  Description of Artificial Sequence: Synthetic peptide
SSTSSPY

SEQ ID NO: 28087 - protein, 7 aa, Artificial Sequence
  Description of Artificial Sequence: Synthetic peptide
YRTTHTL

SEQ ID NO: 28088 - protein, 7 aa, Artificial Sequence
  Description of Artificial Sequence: Synthetic peptide
FGPSQLP

SEQ ID NO: 28089 - protein, 7 aa, Artificial Sequence
  Description of Artificial Sequence: Synthetic peptide
GGLSPKV

SEQ ID NO: 28090 - protein, 7 aa, Artificial Sequence
  Description of Artificial Sequence: Synthetic peptide
GKIQDIK

SEQ ID NO: 28091 - protein, 7 aa, Artificial Sequence
  Description of Artificial Sequence: Synthetic peptide
QNLRVGA

SEQ ID NO: 28092 - protein, 7 aa, Artificial Sequence
  Description of Artificial Sequence: Synthetic peptide
RVEKATL

SEQ ID NO: 28093 - protein, 7 aa, Artificial Sequence
  Description of Artificial Sequence: Synthetic peptide
STTGDSK

SEQ ID NO: 28094 - protein, 7 aa, Artificial Sequence
  Description of Artificial Sequence: Synthetic peptide
TVAHPSH

SEQ ID NO: 28095 - protein, 7 aa, Artificial Sequence
  Description of Artificial Sequence: Synthetic peptide
QSKGGSN

SEQ ID NO: 28096 - protein, 7 aa, Artificial Sequence
  Description of Artificial Sequence: Synthetic peptide
RQTTPLG

SEQ ID NO: 28097 - protein, 7 aa, Artificial Sequence
  Description of Artificial Sequence: Synthetic peptide
GCITNCS

SEQ ID NO: 28098 - protein, 7 aa, Artificial Sequence
  Description of Artificial Sequence: Synthetic peptide
SSSDKLR

SEQ ID NO: 28099 - protein, 7 aa, Artificial Sequence
  Description of Artificial Sequence: Synthetic peptide
GITAKLT

SEQ ID NO: 28100 - protein, 7 aa, Artificial Sequence
  Description of Artificial Sequence: Synthetic peptide
AYPSGSS

SEQ ID NO: 28101 - protein, 7 aa, Artificial Sequence
  Description of Artificial Sequence: Synthetic peptide
MGLGSTK

SEQ ID NO: 28102 - protein, 7 aa, Artificial Sequence
  Description of Artificial Sequence: Synthetic peptide
GGQTARI

SEQ ID NO: 28103 - protein, 7 aa, Artificial Sequence
  Description of Artificial Sequence: Synthetic peptide
PLQQNRS

SEQ ID NO: 28104 - protein, 7 aa, Artificial Sequence
  Description of Artificial Sequence: Synthetic peptide
SDRNMSR

SEQ ID NO: 28105 - protein, 7 aa, Artificial Sequence
  Description of Artificial Sequence: Synthetic peptide
VPRVPGM

SEQ ID NO: 28106 - protein, 7 aa, Artificial Sequence
  Description of Artificial Sequence: Synthetic peptide
SVLHSSQ

SEQ ID NO: 28107 - protein, 7 aa, Artificial Sequence
  Description of Artificial Sequence: Synthetic peptide
PTGVNKM

SEQ ID NO: 28108 - protein, 7 aa, Artificial Sequence
  Description of Artificial Sequence: Synthetic peptide
EPTHPRG

SEQ ID NO: 28109 - protein, 7 aa, Artificial Sequence
  Description of Artificial Sequence: Synthetic peptide
KNPSSVN

SEQ ID NO: 28110 - protein, 7 aa, Artificial Sequence
  Description of Artificial Sequence: Synthetic peptide
VHQLPIA

SEQ ID NO: 28111 - protein, 7 aa, Artificial Sequence
  Description of Artificial Sequence: Synthetic peptide
PYNVSQN

SEQ ID NO: 28112 - protein, 7 aa, Artificial Sequence
  Description of Artificial Sequence: Synthetic peptide
LLSSKGN

SEQ ID NO: 28113 - protein, 7 aa, Artificial Sequence
  Description of Artificial Sequence: Synthetic peptide
HSPTGPA

SEQ ID NO: 28114 - protein, 7 aa, Artificial Sequence
  Description of Artificial Sequence: Synthetic peptide
RMKSLDN

SEQ ID NO: 28115 - protein, 7 aa, Artificial Sequence
  Description of Artificial Sequence: Synthetic peptide
AVPAKGA

SEQ ID NO: 28116 - protein, 7 aa, Artificial Sequence
  Description of Artificial Sequence: Synthetic peptide
TPTLAHG

SEQ ID NO: 28117 - protein, 7 aa, Artificial Sequence
  Description of Artificial Sequence: Synthetic peptide
HDIGKQR

SEQ ID NO: 28118 - protein, 7 aa, Artificial Sequence
  Description of Artificial Sequence: Synthetic peptide
RGPTGMM

SEQ ID NO: 28119 - protein, 7 aa, Artificial Sequence
  Description of Artificial Sequence: Synthetic peptide
PTRNGNM

SEQ ID NO: 28120 - protein, 7 aa, Artificial Sequence
  Description of Artificial Sequence: Synthetic peptide
NTRSSSG

SEQ ID NO: 28121 - protein, 7 aa, Artificial Sequence
  Description of Artificial Sequence: Synthetic peptide
AGGPANR

SEQ ID NO: 28122 - protein, 7 aa, Artificial Sequence
  Description of Artificial Sequence: Synthetic peptide
PSHNPTN

SEQ ID NO: 28123 - protein, 7 aa, Artificial Sequence
  Description of Artificial Sequence: Synthetic peptide
SHATAAT

SEQ ID NO: 28124 - protein, 7 aa, Artificial Sequence
  Description of Artificial Sequence: Synthetic peptide
PGTPSSG

SEQ ID NO: 28125 - protein, 7 aa, Artificial Sequence
  Description of Artificial Sequence: Synthetic peptide
RPAGQHS

SEQ ID NO: 28126 - protein, 7 aa, Artificial Sequence
  Description of Artificial Sequence: Synthetic peptide
PRVGNRT

SEQ ID NO: 28127 - protein, 7 aa, Artificial Sequence
  Description of Artificial Sequence: Synthetic peptide
DRKTLSH

SEQ ID NO: 28128 - protein, 7 aa, Artificial Sequence
  Description of Artificial Sequence: Synthetic peptide
YQNVSSK

SEQ ID NO: 28129 - protein, 7 aa, Artificial Sequence
  Description of Artificial Sequence: Synthetic peptide
TGIERPM

SEQ ID NO: 28130 - protein, 7 aa, Artificial Sequence
  Description of Artificial Sequence: Synthetic peptide
AYPKNSN

SEQ ID NO: 28131 - protein, 7 aa, Artificial Sequence
  Description of Artificial Sequence: Synthetic peptide
SGVTTRG

SEQ ID NO: 28132 - protein, 7 aa, Artificial Sequence
  Description of Artificial Sequence: Synthetic peptide
QVPATNR

SEQ ID NO: 28133 - protein, 7 aa, Artificial Sequence
  Description of Artificial Sequence: Synthetic peptide
NQINAPR

SEQ ID NO: 28134 - protein, 7 aa, Artificial Sequence
  Description of Artificial Sequence: Synthetic peptide
FLKGTGS

SEQ ID NO: 28135 - protein, 7 aa, Artificial Sequence
  Description of Artificial Sequence: Synthetic peptide
REDTKMH

SEQ ID NO: 28136 - protein, 7 aa, Artificial Sequence
  Description of Artificial Sequence: Synthetic peptide
RITSSNQ

SEQ ID NO: 28137 - protein, 7 aa, Artificial Sequence
  Description of Artificial Sequence: Synthetic peptide
NTTGHAG

SEQ ID NO: 28138 - protein, 7 aa, Artificial Sequence
  Description of Artificial Sequence: Synthetic peptide
NNPKNVV

SEQ ID NO: 28139 - protein, 7 aa, Artificial Sequence
  Description of Artificial Sequence: Synthetic peptide
SVNSRSE

SEQ ID NO: 28140 - protein, 7 aa, Artificial Sequence
  Description of Artificial Sequence: Synthetic peptide
LLRERHG

SEQ ID NO: 28141 - protein, 7 aa, Artificial Sequence
  Description of Artificial Sequence: Synthetic peptide
HGESRQA

SEQ ID NO: 28142 - protein, 7 aa, Artificial Sequence
  Description of Artificial Sequence: Synthetic peptide
GTRSAVV

SEQ ID NO: 28143 - protein, 7 aa, Artificial Sequence
  Description of Artificial Sequence: Synthetic peptide
TSQVSHG

SEQ ID NO: 28144 - protein, 7 aa, Artificial Sequence
  Description of Artificial Sequence: Synthetic peptide
RDSTKLV

SEQ ID NO: 28145 - protein, 7 aa, Artificial Sequence
  Description of Artificial Sequence: Synthetic peptide
FNSTANR

SEQ ID NO: 28146 - protein, 7 aa, Artificial Sequence
  Description of Artificial Sequence: Synthetic peptide
KTGDQMG

SEQ ID NO: 28147 - protein, 7 aa, Artificial Sequence
  Description of Artificial Sequence: Synthetic peptide
AQSTYQS

SEQ ID NO: 28148 - protein, 7 aa, Artificial Sequence
  Description of Artificial Sequence: Synthetic peptide
GNRSSGL

SEQ ID NO: 28149 - protein, 7 aa, Artificial Sequence
  Description of Artificial Sequence: Synthetic peptide
ASTSRST

SEQ ID NO: 28150 - protein, 7 aa, Artificial Sequence
  Description of Artificial Sequence: Synthetic peptide
QSVKTPE

SEQ ID NO: 28151 - protein, 7 aa, Artificial Sequence
  Description of Artificial Sequence: Synthetic peptide
LKQHSSL

SEQ ID NO: 28152 - protein, 7 aa, Artificial Sequence
  Description of Artificial Sequence: Synthetic peptide
ATGRNTA

SEQ ID NO: 28153 - protein, 7 aa, Artificial Sequence
  Description of Artificial Sequence: Synthetic peptide
MESKANS

SEQ ID NO: 28154 - protein, 7 aa, Artificial Sequence
  Description of Artificial Sequence: Synthetic peptide
NYDSLKK

SEQ ID NO: 28155 - protein, 7 aa, Artificial Sequence
  Description of Artificial Sequence: Synthetic peptide
AHSNNSY

SEQ ID NO: 28156 - protein, 7 aa, Artificial Sequence
  Description of Artificial Sequence: Synthetic peptide
FRAQANV

SEQ ID NO: 28157 - protein, 7 aa, Artificial Sequence
  Description of Artificial Sequence: Synthetic peptide
YSQEVFR

SEQ ID NO: 28158 - protein, 7 aa, Artificial Sequence
  Description of Artificial Sequence: Synthetic peptide
PTSSPQR

SEQ ID NO: 28159 - protein, 7 aa, Artificial Sequence
  Description of Artificial Sequence: Synthetic peptide
ATHNSSQ

SEQ ID NO: 28160 - protein, 7 aa, Artificial Sequence
  Description of Artificial Sequence: Synthetic peptide
PNNATKN

SEQ ID NO: 28161 - protein, 7 aa, Artificial Sequence
  Description of Artificial Sequence: Synthetic peptide
NANSRPV

SEQ ID NO: 28162 - protein, 7 aa, Artificial Sequence
  Description of Artificial Sequence: Synthetic peptide
VSDGISK

SEQ ID NO: 28163 - protein, 7 aa, Artificial Sequence
  Description of Artificial Sequence: Synthetic peptide
STVGHMT

SEQ ID NO: 28164 - protein, 7 aa, Artificial Sequence
  Description of Artificial Sequence: Synthetic peptide
VAPVGMS

SEQ ID NO: 28165 - protein, 7 aa, Artificial Sequence
  Description of Artificial Sequence: Synthetic peptide
SPSFNQG

SEQ ID NO: 28166 - protein, 7 aa, Artificial Sequence
  Description of Artificial Sequence: Synthetic peptide
LLSSKTA

SEQ ID NO: 28167 - protein, 7 aa, Artificial Sequence
  Description of Artificial Sequence: Synthetic peptide
GSGHGTN

SEQ ID NO: 28168 - protein, 7 aa, Artificial Sequence
  Description of Artificial Sequence: Synthetic peptide
RLPSVSS

SEQ ID NO: 28169 - protein, 7 aa, Artificial Sequence
  Description of Artificial Sequence: Synthetic peptide
HDNANYN

SEQ ID NO: 28170 - protein, 7 aa, Artificial Sequence
  Description of Artificial Sequence: Synthetic peptide
QRFQSSQ

SEQ ID NO: 28171 - protein, 7 aa, Artificial Sequence
  Description of Artificial Sequence: Synthetic peptide
TGITKLS

SEQ ID NO: 28172 - protein, 7 aa, Artificial Sequence
  Description of Artificial Sequence: Synthetic peptide
GRTGPLV

SEQ ID NO: 28173 - protein, 7 aa, Artificial Sequence
  Description of Artificial Sequence: Synthetic peptide
HERGQNG

SEQ ID NO: 28174 - protein, 7 aa, Artificial Sequence
  Description of Artificial Sequence: Synthetic peptide
ITPSNIG

SEQ ID NO: 28175 - protein, 7 aa, Artificial Sequence
  Description of Artificial Sequence: Synthetic peptide
HTTGMLG

SEQ ID NO: 28176 - protein, 7 aa, Artificial Sequence
  Description of Artificial Sequence: Synthetic peptide
MPSASLG

SEQ ID NO: 28177 - protein, 7 aa, Artificial Sequence
  Description of Artificial Sequence: Synthetic peptide
TVKSPRS

SEQ ID NO: 28178 - protein, 7 aa, Artificial Sequence
  Description of Artificial Sequence: Synthetic peptide
QSSHEGR

SEQ ID NO: 28179 - protein, 7 aa, Artificial Sequence
  Description of Artificial Sequence: Synthetic peptide
GAERILR

SEQ ID NO: 28180 - protein, 7 aa, Artificial Sequence
  Description of Artificial Sequence: Synthetic peptide
STVVHMT

SEQ ID NO: 28181 - protein, 7 aa, Artificial Sequence
  Description of Artificial Sequence: Synthetic peptide
DYDATSR

SEQ ID NO: 28182 - protein, 7 aa, Artificial Sequence
  Description of Artificial Sequence: Synthetic peptide
RNDQTLK

SEQ ID NO: 28183 - protein, 7 aa, Artificial Sequence
  Description of Artificial Sequence: Synthetic peptide
NRLGQAG

SEQ ID NO: 28184 - protein, 7 aa, Artificial Sequence
  Description of Artificial Sequence: Synthetic peptide
ENWTNRK

SEQ ID NO: 28185 - protein, 7 aa, Artificial Sequence
  Description of Artificial Sequence: Synthetic peptide
SCTTRCL

SEQ ID NO: 28186 - protein, 7 aa, Artificial Sequence
  Description of Artificial Sequence: Synthetic peptide
YTSKSTA

SEQ ID NO: 28187 - protein, 7 aa, Artificial Sequence
  Description of Artificial Sequence: Synthetic peptide
SVHGNQL

SEQ ID NO: 28188 - protein, 7 aa, Artificial Sequence
  Description of Artificial Sequence: Synthetic peptide
GIQSSPT

SEQ ID NO: 28189 - protein, 7 aa, Artificial Sequence
  Description of Artificial Sequence: Synthetic peptide
SNMTSTR

SEQ ID NO: 28190 - protein, 7 aa, Artificial Sequence
  Description of Artificial Sequence: Synthetic peptide
MSTARSA

SEQ ID NO: 28191 - protein, 7 aa, Artificial Sequence
  Description of Artificial Sequence: Synthetic peptide
SYASTQQ

SEQ ID NO: 28192 - protein, 7 aa, Artificial Sequence
  Description of Artificial Sequence: Synthetic peptide
AGSNSQG

SEQ ID NO: 28193 - protein, 7 aa, Artificial Sequence
  Description of Artificial Sequence: Synthetic peptide
PYAGNQR

SEQ ID NO: 28194 - protein, 7 aa, Artificial Sequence
  Description of Artificial Sequence: Synthetic peptide
RRDTNMS

SEQ ID NO: 28195 - protein, 7 aa, Artificial Sequence
  Description of Artificial Sequence: Synthetic peptide
SFAKSAS

SEQ ID NO: 28196 - protein, 7 aa, Artificial Sequence
  Description of Artificial Sequence: Synthetic peptide
GVSATVK

SEQ ID NO: 28197 - protein, 7 aa, Artificial Sequence
  Description of Artificial Sequence: Synthetic peptide
GTSTSLR

SEQ ID NO: 28198 - protein, 7 aa, Artificial Sequence
  Description of Artificial Sequence: Synthetic peptide
RNDTKLF

SEQ ID NO: 28199 - protein, 7 aa, Artificial Sequence
  Description of Artificial Sequence: Synthetic peptide
TPAGPNK

SEQ ID NO: 28200 - protein, 7 aa, Artificial Sequence
  Description of Artificial Sequence: Synthetic peptide
NNPNRDQ

SEQ ID NO: 28201 - protein, 7 aa, Artificial Sequence
  Description of Artificial Sequence: Synthetic peptide
RAETNAI

SEQ ID NO: 28202 - protein, 7 aa, Artificial Sequence
  Description of Artificial Sequence: Synthetic peptide
HELSRTT

SEQ ID NO: 28203 - protein, 7 aa, Artificial Sequence
  Description of Artificial Sequence: Synthetic peptide
AGSQTGV

SEQ ID NO: 28204 - protein, 7 aa, Artificial Sequence
  Description of Artificial Sequence: Synthetic peptide
SYGGQSR

SEQ ID NO: 28205 - protein, 7 aa, Artificial Sequence
  Description of Artificial Sequence: Synthetic peptide
YQPERSS

SEQ ID NO: 28206 - protein, 7 aa, Artificial Sequence
  Description of Artificial Sequence: Synthetic peptide
TANNSIV

SEQ ID NO: 28207 - protein, 7 aa, Artificial Sequence
  Description of Artificial Sequence: Synthetic peptide
IVSGKLT

SEQ ID NO: 28208 - protein, 7 aa, Artificial Sequence
  Description of Artificial Sequence: Synthetic peptide
HITPATS

SEQ ID NO: 28209 - protein, 7 aa, Artificial Sequence
  Description of Artificial Sequence: Synthetic peptide
STSNIAS

SEQ ID NO: 28210 - protein, 7 aa, Artificial Sequence
  Description of Artificial Sequence: Synthetic peptide
QVTAIGA

SEQ ID NO: 28211 - protein, 7 aa, Artificial Sequence
  Description of Artificial Sequence: Synthetic peptide
NTQAGHS

SEQ ID NO: 28212 - protein, 7 aa, Artificial Sequence
  Description of Artificial Sequence: Synthetic peptide
DVHRSSG

SEQ ID NO: 28213 - protein, 7 aa, Artificial Sequence
  Description of Artificial Sequence: Synthetic peptide
QGSSPME

SEQ ID NO: 28214 - protein, 7 aa, Artificial Sequence
  Description of Artificial Sequence: Synthetic peptide
LDASAMR

SEQ ID NO: 28215 - protein, 7 aa, Artificial Sequence
  Description of Artificial Sequence: Synthetic peptide
PVANVSR

SEQ ID NO: 28216 - protein, 7 aa, Artificial Sequence
  Description of Artificial Sequence: Synthetic peptide
FPVTGLS

SEQ ID NO: 28217 - protein, 7 aa, Artificial Sequence
  Description of Artificial Sequence: Synthetic peptide
QMNHLQV

SEQ ID NO: 28218 - protein, 7 aa, Artificial Sequence
  Description of Artificial Sequence: Synthetic peptide
SYGKGSS

SEQ ID NO: 28219 - protein, 7 aa, Artificial Sequence
  Description of Artificial Sequence: Synthetic peptide
RDASGLR

SEQ ID NO: 28220 - protein, 7 aa, Artificial Sequence
  Description of Artificial Sequence: Synthetic peptide
SSSRNVA

SEQ ID NO: 28221 - protein, 7 aa, Artificial Sequence
  Description of Artificial Sequence: Synthetic peptide
ITATHAH

SEQ ID NO: 28222 - protein, 7 aa, Artificial Sequence
  Description of Artificial Sequence: Synthetic peptide
NQQNGSN

SEQ ID NO: 28223 - protein, 7 aa, Artificial Sequence
  Description of Artificial Sequence: Synthetic peptide
GSAGKEM

SEQ ID NO: 28224 - protein, 7 aa, Artificial Sequence
  Description of Artificial Sequence: Synthetic peptide
NVRQTEL

SEQ ID NO: 28225 - protein, 7 aa, Artificial Sequence
  Description of Artificial Sequence: Synthetic peptide
PIHPSSG

SEQ ID NO: 28226 - protein, 7 aa, Artificial Sequence
  Description of Artificial Sequence: Synthetic peptide
DRVGSIS

SEQ ID NO: 28227 - protein, 7 aa, Artificial Sequence
  Description of Artificial Sequence: Synthetic peptide
VGSGRAN

SEQ ID NO: 28228 - protein, 7 aa, Artificial Sequence
  Description of Artificial Sequence: Synthetic peptide
NSSGHYQ

SEQ ID NO: 28229 - protein, 7 aa, Artificial Sequence
  Description of Artificial Sequence: Synthetic peptide
HTSSNSL

SEQ ID NO: 28230 - protein, 7 aa, Artificial Sequence
  Description of Artificial Sequence: Synthetic peptide
LPSNSIH

SEQ ID NO: 28231 - protein, 7 aa, Artificial Sequence
  Description of Artificial Sequence: Synthetic peptide
SDRDRKT

SEQ ID NO: 28232 - protein, 7 aa, Artificial Sequence
  Description of Artificial Sequence: Synthetic peptide
TPGSTIR

SEQ ID NO: 28233 - protein, 7 aa, Artificial Sequence
  Description of Artificial Sequence: Synthetic peptide
SVAGTSR

SEQ ID NO: 28234 - protein, 7 aa, Artificial Sequence
  Description of Artificial Sequence: Synthetic peptide
MRSNPTS

SEQ ID NO: 28235 - protein, 7 aa, Artificial Sequence
  Description of Artificial Sequence: Synthetic peptide
GRPNMTV

SEQ ID NO: 28236 - protein, 7 aa, Artificial Sequence
  Description of Artificial Sequence: Synthetic peptide
DTHVSGR

SEQ ID NO: 28237 - protein, 7 aa, Artificial Sequence
  Description of Artificial Sequence: Synthetic peptide
MGSSVRS

SEQ ID NO: 28238 - protein, 7 aa, Artificial Sequence
  Description of Artificial Sequence: Synthetic peptide
LNVGSVR

SEQ ID NO: 28239 - protein, 7 aa, Artificial Sequence
  Description of Artificial Sequence: Synthetic peptide
PVQHSSN

SEQ ID NO: 28240 - protein, 7 aa, Artificial Sequence
  Description of Artificial Sequence: Synthetic peptide
GDQHKPL

SEQ ID NO: 28241 - protein, 7 aa, Artificial Sequence
  Description of Artificial Sequence: Synthetic peptide
SPARASL

SEQ ID NO: 28242 - protein, 7 aa, Artificial Sequence
  Description of Artificial Sequence: Synthetic peptide
IPLSSQR

SEQ ID NO: 28243 - protein, 7 aa, Artificial Sequence
  Description of Artificial Sequence: Synthetic peptide
CNRSGTL

SEQ ID NO: 28244 - protein, 7 aa, Artificial Sequence
  Description of Artificial Sequence: Synthetic peptide
LPSLPIR

SEQ ID NO: 28245 - protein, 7 aa, Artificial Sequence
  Description of Artificial Sequence: Synthetic peptide
HGSLHPQ

SEQ ID NO: 28246 - protein, 7 aa, Artificial Sequence
  Description of Artificial Sequence: Synthetic peptide
VIRPSSK

SEQ ID NO: 28247 - protein, 7 aa, Artificial Sequence
  Description of Artificial Sequence: Synthetic peptide
LPGVRVA

SEQ ID NO: 28248 - protein, 7 aa, Artificial Sequence
  Description of Artificial Sequence: Synthetic peptide
NINSRLA

SEQ ID NO: 28249 - protein, 7 aa, Artificial Sequence
  Description of Artificial Sequence: Synthetic peptide
QPINVHN

SEQ ID NO: 28250 - protein, 7 aa, Artificial Sequence
  Description of Artificial Sequence: Synthetic peptide
PLNARGS

SEQ ID NO: 28251 - protein, 7 aa, Artificial Sequence
  Description of Artificial Sequence: Synthetic peptide
KQPGSTH

SEQ ID NO: 28252 - protein, 7 aa, Artificial Sequence
  Description of Artificial Sequence: Synthetic peptide
EGTRMAA

SEQ ID NO: 28253 - protein, 7 aa, Artificial Sequence
  Description of Artificial Sequence: Synthetic peptide
RVESPTN

SEQ ID NO: 28254 - protein, 7 aa, Artificial Sequence
  Description of Artificial Sequence: Synthetic peptide
DSVAGFT

SEQ ID NO: 28255 - protein, 7 aa, Artificial Sequence
  Description of Artificial Sequence: Synthetic peptide
NTGSGSR

SEQ ID NO: 28256 - protein, 7 aa, Artificial Sequence
  Description of Artificial Sequence: Synthetic peptide
SKTNAKV

SEQ ID NO: 28257 - protein, 7 aa, Artificial Sequence
  Description of Artificial Sequence: Synthetic peptide
ESATPIR

SEQ ID NO: 28258 - protein, 7 aa, Artificial Sequence
  Description of Artificial Sequence: Synthetic peptide
REVDGIR

SEQ ID NO: 28259 - protein, 7 aa, Artificial Sequence
  Description of Artificial Sequence: Synthetic peptide
CSNHSTR

SEQ ID NO: 28260 - protein, 7 aa, Artificial Sequence
  Description of Artificial Sequence: Synthetic peptide
LKSPKQA

SEQ ID NO: 28261 - protein, 7 aa, Artificial Sequence
  Description of Artificial Sequence: Synthetic peptide
DLTRATS

SEQ ID NO: 28262 - protein, 7 aa, Artificial Sequence
  Description of Artificial Sequence: Synthetic peptide
DLRTNSS

SEQ ID NO: 28263 - protein, 7 aa, Artificial Sequence
  Description of Artificial Sequence: Synthetic peptide
VRSKEAH

SEQ ID NO: 28264 - protein, 7 aa, Artificial Sequence
  Description of Artificial Sequence: Synthetic peptide
VKCSGCS

SEQ ID NO: 28265 - protein, 7 aa, Artificial Sequence
  Description of Artificial Sequence: Synthetic peptide
QHTTTNQ

SEQ ID NO: 28266 - protein, 7 aa, Artificial Sequence
  Description of Artificial Sequence: Synthetic peptide
NGSGQTQ

SEQ ID NO: 28267 - protein, 7 aa, Artificial Sequence
  Description of Artificial Sequence: Synthetic peptide
GNTQTSR

SEQ ID NO: 28268 - protein, 7 aa, Artificial Sequence
  Description of Artificial Sequence: Synthetic peptide
ATNNGSK

SEQ ID NO: 28269 - protein, 7 aa, Artificial Sequence
  Description of Artificial Sequence: Synthetic peptide
DVKSTHA

SEQ ID NO: 28270 - protein, 7 aa, Artificial Sequence
  Description of Artificial Sequence: Synthetic peptide
PVGTKSG

SEQ ID NO: 28271 - protein, 7 aa, Artificial Sequence
  Description of Artificial Sequence: Synthetic peptide
STGSVSK

SEQ ID NO: 28272 - protein, 7 aa, Artificial Sequence
  Description of Artificial Sequence: Synthetic peptide
YRNVNAM

SEQ ID NO: 28273 - protein, 7 aa, Artificial Sequence
  Description of Artificial Sequence: Synthetic peptide
YGASPSL

SEQ ID NO: 28274 - protein, 7 aa, Artificial Sequence
  Description of Artificial Sequence: Synthetic peptide
KNHTAVQ

SEQ ID NO: 28275 - protein, 7 aa, Artificial Sequence
  Description of Artificial Sequence: Synthetic peptide
HLGVPLK

SEQ ID NO: 28276 - protein, 7 aa, Artificial Sequence
  Description of Artificial Sequence: Synthetic peptide
NFGSGPT

SEQ ID NO: 28277 - protein, 7 aa, Artificial Sequence
  Description of Artificial Sequence: Synthetic peptide
DPVTRKS

SEQ ID NO: 28278 - protein, 7 aa, Artificial Sequence
  Description of Artificial Sequence: Synthetic peptide
GTVLSDR

SEQ ID NO: 28279 - protein, 7 aa, Artificial Sequence
  Description of Artificial Sequence: Synthetic peptide
DGSSRVG

SEQ ID NO: 28280 - protein, 7 aa, Artificial Sequence
  Description of Artificial Sequence: Synthetic peptide
SSTSPGR

SEQ ID NO: 28281 - protein, 7 aa, Artificial Sequence
  Description of Artificial Sequence: Synthetic peptide
QPNSASH

SEQ ID NO: 28282 - protein, 7 aa, Artificial Sequence
  Description of Artificial Sequence: Synthetic peptide
VHASNVQ

SEQ ID NO: 28283 - protein, 7 aa, Artificial Sequence
  Description of Artificial Sequence: Synthetic peptide
YGSRENS

SEQ ID NO: 28284 - protein, 7 aa, Artificial Sequence
  Description of Artificial Sequence: Synthetic peptide
NNGHQGK

SEQ ID NO: 28285 - protein, 7 aa, Artificial Sequence
  Description of Artificial Sequence: Synthetic peptide
PSSRQSV

SEQ ID NO: 28286 - protein, 7 aa, Artificial Sequence
  Description of Artificial Sequence: Synthetic peptide
HLAMNRN

SEQ ID NO: 28287 - protein, 7 aa, Artificial Sequence
  Description of Artificial Sequence: Synthetic peptide
FMGRPNV

SEQ ID NO: 28288 - protein, 7 aa, Artificial Sequence
  Description of Artificial Sequence: Synthetic peptide
YNRTSIV

SEQ ID NO: 28289 - protein, 7 aa, Artificial Sequence
  Description of Artificial Sequence: Synthetic peptide
AGSSSPA

SEQ ID NO: 28290 - protein, 7 aa, Artificial Sequence
  Description of Artificial Sequence: Synthetic peptide
GIDTKML

SEQ ID NO: 28291 - protein, 7 aa, Artificial Sequence
  Description of Artificial Sequence: Synthetic peptide
LVYDNTR

SEQ ID NO: 28292 - protein, 7 aa, Artificial Sequence
  Description of Artificial Sequence: Synthetic peptide
LLESTGR

SEQ ID NO: 28293 - protein, 7 aa, Artificial Sequence
  Description of Artificial Sequence: Synthetic peptide
LTPSNIG

SEQ ID NO: 28294 - protein, 7 aa, Artificial Sequence
  Description of Artificial Sequence: Synthetic peptide
SGGTHIA

SEQ ID NO: 28295 - protein, 7 aa, Artificial Sequence
  Description of Artificial Sequence: Synthetic peptide
GLAGSLQ

SEQ ID NO: 28296 - protein, 7 aa, Artificial Sequence
  Description of Artificial Sequence: Synthetic peptide
YTAAPGR

SEQ ID NO: 28297 - protein, 7 aa, Artificial Sequence
  Description of Artificial Sequence: Synthetic peptide
DSVTSSG

SEQ ID NO: 28298 - protein, 7 aa, Artificial Sequence
  Description of Artificial Sequence: Synthetic peptide
RISENMR

SEQ ID NO: 28299 - protein, 7 aa, Artificial Sequence
  Description of Artificial Sequence: Synthetic peptide
GSYSNPT

SEQ ID NO: 28300 - protein, 7 aa, Artificial Sequence
  Description of Artificial Sequence: Synthetic peptide
LPGSRLS

SEQ ID NO: 28301 - protein, 7 aa, Artificial Sequence
  Description of Artificial Sequence: Synthetic peptide
TSNTKSV

SEQ ID NO: 28302 - protein, 7 aa, Artificial Sequence
  Description of Artificial Sequence: Synthetic peptide
SHVNSTR

SEQ ID NO: 28303 - protein, 7 aa, Artificial Sequence
  Description of Artificial Sequence: Synthetic peptide
RNGQRVG

SEQ ID NO: 28304 - protein, 7 aa, Artificial Sequence
  Description of Artificial Sequence: Synthetic peptide
DAGAAPK

SEQ ID NO: 28305 - protein, 7 aa, Artificial Sequence
  Description of Artificial Sequence: Synthetic peptide
TQQKGSN

SEQ ID NO: 28306 - protein, 7 aa, Artificial Sequence
  Description of Artificial Sequence: Synthetic peptide
YRNTHSE

SEQ ID NO: 28307 - protein, 7 aa, Artificial Sequence
  Description of Artificial Sequence: Synthetic peptide
TLHDPRT

SEQ ID NO: 28308 - protein, 7 aa, Artificial Sequence
  Description of Artificial Sequence: Synthetic peptide
TGRGSEV

SEQ ID NO: 28309 - protein, 7 aa, Artificial Sequence
  Description of Artificial Sequence: Synthetic peptide
YNTTRMT

SEQ ID NO: 28310 - protein, 7 aa, Artificial Sequence
  Description of Artificial Sequence: Synthetic peptide
GQNTHLT

SEQ ID NO: 28311 - protein, 7 aa, Artificial Sequence
  Description of Artificial Sequence: Synthetic peptide
PSNTGTI

SEQ ID NO: 28312 - protein, 7 aa, Artificial Sequence
  Description of Artificial Sequence: Synthetic peptide
AMGSSLS

SEQ ID NO: 28313 - protein, 7 aa, Artificial Sequence
  Description of Artificial Sequence: Synthetic peptide
GFERNRE

SEQ ID NO: 28314 - protein, 7 aa, Artificial Sequence
  Description of Artificial Sequence: Synthetic peptide
GSNRNHA

SEQ ID NO: 28315 - protein, 7 aa, Artificial Sequence
  Description of Artificial Sequence: Synthetic peptide
LNGTPQS

SEQ ID NO: 28316 - protein, 7 aa, Artificial Sequence
  Description of Artificial Sequence: Synthetic peptide
RQIGKQV

SEQ ID NO: 28317 - protein, 7 aa, Artificial Sequence
  Description of Artificial Sequence: Synthetic peptide
PTRTASN

SEQ ID NO: 28318 - protein, 7 aa, Artificial Sequence
  Description of Artificial Sequence: Synthetic peptide
SNTRSLS

SEQ ID NO: 28319 - protein, 7 aa, Artificial Sequence
  Description of Artificial Sequence: Synthetic peptide
SRSPPSG

SEQ ID NO: 28320 - protein, 7 aa, Artificial Sequence
  Description of Artificial Sequence: Synthetic peptide
VVSSKGY

SEQ ID NO: 28321 - protein, 7 aa, Artificial Sequence
  Description of Artificial Sequence: Synthetic peptide
VSGHRSV

SEQ ID NO: 28322 - protein, 7 aa, Artificial Sequence
  Description of Artificial Sequence: Synthetic peptide
GNTGSYQ

SEQ ID NO: 28323 - protein, 7 aa, Artificial Sequence
  Description of Artificial Sequence: Synthetic peptide
GHDNGIQ

SEQ ID NO: 28324 - protein, 7 aa, Artificial Sequence
  Description of Artificial Sequence: Synthetic peptide
PLINRTM

SEQ ID NO: 28325 - protein, 7 aa, Artificial Sequence
  Description of Artificial Sequence: Synthetic peptide
GNNRPAS

SEQ ID NO: 28326 - protein, 7 aa, Artificial Sequence
  Description of Artificial Sequence: Synthetic peptide
ERGKNAL

SEQ ID NO: 28327 - protein, 7 aa, Artificial Sequence
  Description of Artificial Sequence: Synthetic peptide
PHQRAGS

SEQ ID NO: 28328 - protein, 7 aa, Artificial Sequence
  Description of Artificial Sequence: Synthetic peptide
SPNKTSL

SEQ ID NO: 28329 - protein, 7 aa, Artificial Sequence
  Description of Artificial Sequence: Synthetic peptide
NNVTKAP

SEQ ID NO: 28330 - protein, 7 aa, Artificial Sequence
  Description of Artificial Sequence: Synthetic peptide
SIKSVTN

SEQ ID NO: 28331 - protein, 7 aa, Artificial Sequence
  Description of Artificial Sequence: Synthetic peptide
HPTMNYS

SEQ ID NO: 28332 - protein, 7 aa, Artificial Sequence
  Description of Artificial Sequence: Synthetic peptide
HMRANVT

SEQ ID NO: 28333 - protein, 7 aa, Artificial Sequence
  Description of Artificial Sequence: Synthetic peptide
LTAKSSQ

SEQ ID NO: 28334 - protein, 7 aa, Artificial Sequence
  Description of Artificial Sequence: Synthetic peptide
SNRTSIV

SEQ ID NO: 28335 - protein, 7 aa, Artificial Sequence
  Description of Artificial Sequence: Synthetic peptide
DTNVDYR

SEQ ID NO: 28336 - protein, 7 aa, Artificial Sequence
  Description of Artificial Sequence: Synthetic peptide
PRSTTGG

SEQ ID NO: 28337 - protein, 7 aa, Artificial Sequence
  Description of Artificial Sequence: Synthetic peptide
MPARNVS

SEQ ID NO: 28338 - protein, 7 aa, Artificial Sequence
  Description of Artificial Sequence: Synthetic peptide
PRMRAVS

SEQ ID NO: 28339 - protein, 7 aa, Artificial Sequence
  Description of Artificial Sequence: Synthetic peptide
FGESRGR

SEQ ID NO: 28340 - protein, 7 aa, Artificial Sequence
  Description of Artificial Sequence: Synthetic peptide
MATAHGG

SEQ ID NO: 28341 - protein, 7 aa, Artificial Sequence
  Description of Artificial Sequence: Synthetic peptide
ALIDRGD

SEQ ID NO: 28342 - protein, 7 aa, Artificial Sequence
  Description of Artificial Sequence: Synthetic peptide
LPQGSIS

SEQ ID NO: 28343 - protein, 7 aa, Artificial Sequence
  Description of Artificial Sequence: Synthetic peptide
KLVNSNG

SEQ ID NO: 28344 - protein, 7 aa, Artificial Sequence
  Description of Artificial Sequence: Synthetic peptide
MNASVNR

SEQ ID NO: 28345 - protein, 7 aa, Artificial Sequence
  Description of Artificial Sequence: Synthetic peptide
LATNRSN

SEQ ID NO: 28346 - protein, 7 aa, Artificial Sequence
  Description of Artificial Sequence: Synthetic peptide
GRQVTPT

SEQ ID NO: 28347 - protein, 7 aa, Artificial Sequence
  Description of Artificial Sequence: Synthetic peptide
LGTSTMK

SEQ ID NO: 28348 - protein, 7 aa, Artificial Sequence
  Description of Artificial Sequence: Synthetic peptide
NPNQSLG

SEQ ID NO: 28349 - protein, 7 aa, Artificial Sequence
  Description of Artificial Sequence: Synthetic peptide
DFSEKRL

SEQ ID NO: 28350 - protein, 7 aa, Artificial Sequence
  Description of Artificial Sequence: Synthetic peptide
TSRVGQV

SEQ ID NO: 28351 - protein, 7 aa, Artificial Sequence
  Description of Artificial Sequence: Synthetic peptide
HTQSATG

SEQ ID NO: 28352 - protein, 7 aa, Artificial Sequence
  Description of Artificial Sequence: Synthetic peptide
ATTKAGI

SEQ ID NO: 28353 - protein, 7 aa, Artificial Sequence
  Description of Artificial Sequence: Synthetic peptide
QQYAKQA

SEQ ID NO: 28354 - protein, 7 aa, Artificial Sequence
  Description of Artificial Sequence: Synthetic peptide
SRHPSTG

SEQ ID NO: 28355 - protein, 7 aa, Artificial Sequence
  Description of Artificial Sequence: Synthetic peptide
LRNPTSK

SEQ ID NO: 28356 - protein, 7 aa, Artificial Sequence
  Description of Artificial Sequence: Synthetic peptide
NSYDPKR

SEQ ID NO: 28357 - protein, 7 aa, Artificial Sequence
  Description of Artificial Sequence: Synthetic peptide
TGLKDQH

SEQ ID NO: 28358 - protein, 7 aa, Artificial Sequence
  Description of Artificial Sequence: Synthetic peptide
ARDTVVR

SEQ ID NO: 28359 - protein, 7 aa, Artificial Sequence
  Description of Artificial Sequence: Synthetic peptide
SHDTSYR

SEQ ID NO: 28360 - protein, 7 aa, Artificial Sequence
  Description of Artificial Sequence: Synthetic peptide
NPRMSMS

SEQ ID NO: 28361 - protein, 7 aa, Artificial Sequence
  Description of Artificial Sequence: Synthetic peptide
LNTGIVR

SEQ ID NO: 28362 - protein, 7 aa, Artificial Sequence
  Description of Artificial Sequence: Synthetic peptide
TSHMQLS

SEQ ID NO: 28363 - protein, 7 aa, Artificial Sequence
  Description of Artificial Sequence: Synthetic peptide
NPVALRD

SEQ ID NO: 28364 - protein, 7 aa, Artificial Sequence
  Description of Artificial Sequence: Synthetic peptide
GNQSPRV

SEQ ID NO: 28365 - protein, 7 aa, Artificial Sequence
  Description of Artificial Sequence: Synthetic peptide
ATNSTPR

SEQ ID NO: 28366 - protein, 7 aa, Artificial Sequence
  Description of Artificial Sequence: Synthetic peptide
HRVDRSC

SEQ ID NO: 28367 - protein, 7 aa, Artificial Sequence
  Description of Artificial Sequence: Synthetic peptide
DRSATVK

SEQ ID NO: 28368 - protein, 7 aa, Artificial Sequence
  Description of Artificial Sequence: Synthetic peptide
VTLPPNA

SEQ ID NO: 28369 - protein, 7 aa, Artificial Sequence
  Description of Artificial Sequence: Synthetic peptide
NIAQKEL

SEQ ID NO: 28370 - protein, 7 aa, Artificial Sequence
  Description of Artificial Sequence: Synthetic peptide
HTTGILG

SEQ ID NO: 28371 - protein, 7 aa, Artificial Sequence
  Description of Artificial Sequence: Synthetic peptide
GIMATRG

SEQ ID NO: 28372 - protein, 7 aa, Artificial Sequence
  Description of Artificial Sequence: Synthetic peptide
TTSRPNV

SEQ ID NO: 28373 - protein, 7 aa, Artificial Sequence
  Description of Artificial Sequence: Synthetic peptide
PMARSAG

SEQ ID NO: 28374 - protein, 7 aa, Artificial Sequence
  Description of Artificial Sequence: Synthetic peptide
QSNDRAK

SEQ ID NO: 28375 - protein, 7 aa, Artificial Sequence
  Description of Artificial Sequence: Synthetic peptide
NSAGTRV

SEQ ID NO: 28376 - protein, 7 aa, Artificial Sequence
  Description of Artificial Sequence: Synthetic peptide
GPNQSGR

SEQ ID NO: 28377 - protein, 7 aa, Artificial Sequence
  Description of Artificial Sequence: Synthetic peptide
PQTSPRT

SEQ ID NO: 28378 - protein, 7 aa, Artificial Sequence
  Description of Artificial Sequence: Synthetic peptide
ADSNRPG

SEQ ID NO: 28379 - protein, 7 aa, Artificial Sequence
  Description of Artificial Sequence: Synthetic peptide
WDSKTPR

SEQ ID NO: 28380 - protein, 7 aa, Artificial Sequence
  Description of Artificial Sequence: Synthetic peptide
PSTSGAM

SEQ ID NO: 28381 - protein, 7 aa, Artificial Sequence
  Description of Artificial Sequence: Synthetic peptide
ILGNKSS

SEQ ID NO: 28382 - protein, 7 aa, Artificial Sequence
  Description of Artificial Sequence: Synthetic peptide
FNSSSSK

SEQ ID NO: 28383 - protein, 7 aa, Artificial Sequence
  Description of Artificial Sequence: Synthetic peptide
VDVRGMS

SEQ ID NO: 28384 - protein, 7 aa, Artificial Sequence
  Description of Artificial Sequence: Synthetic peptide
SSDSGRL

SEQ ID NO: 28385 - protein, 7 aa, Artificial Sequence
  Description of Artificial Sequence: Synthetic peptide
DSPNRGR

SEQ ID NO: 28386 - protein, 7 aa, Artificial Sequence
  Description of Artificial Sequence: Synthetic peptide
VTQSSSK

SEQ ID NO: 28387 - protein, 7 aa, Artificial Sequence
  Description of Artificial Sequence: Synthetic peptide
PGIRPEL

SEQ ID NO: 28388 - protein, 7 aa, Artificial Sequence
  Description of Artificial Sequence: Synthetic peptide
RTDHGGV

SEQ ID NO: 28389 - protein, 7 aa, Artificial Sequence
  Description of Artificial Sequence: Synthetic peptide
NVNSQML

SEQ ID NO: 28390 - protein, 7 aa, Artificial Sequence
  Description of Artificial Sequence: Synthetic peptide
AVRAHQQ

SEQ ID NO: 28391 - protein, 7 aa, Artificial Sequence
  Description of Artificial Sequence: Synthetic peptide
VPGKSAQ

SEQ ID NO: 28392 - protein, 7 aa, Artificial Sequence
  Description of Artificial Sequence: Synthetic peptide
LTPSNMG

SEQ ID NO: 28393 - protein, 7 aa, Artificial Sequence
  Description of Artificial Sequence: Synthetic peptide
GNGTRQN

SEQ ID NO: 28394 - protein, 7 aa, Artificial Sequence
  Description of Artificial Sequence: Synthetic peptide
GDITRLG

SEQ ID NO: 28395 - protein, 7 aa, Artificial Sequence
  Description of Artificial Sequence: Synthetic peptide
NSRESQG

SEQ ID NO: 28396 - protein, 7 aa, Artificial Sequence
  Description of Artificial Sequence: Synthetic peptide
PATRQPD

SEQ ID NO: 28397 - protein, 7 aa, Artificial Sequence
  Description of Artificial Sequence: Synthetic peptide
VTTSRGV

SEQ ID NO: 28398 - protein, 7 aa, Artificial Sequence
  Description of Artificial Sequence: Synthetic peptide
AGAPKTD

SEQ ID NO: 28399 - protein, 7 aa, Artificial Sequence
  Description of Artificial Sequence: Synthetic peptide
NRVEHTQ

SEQ ID NO: 28400 - protein, 7 aa, Artificial Sequence
  Description of Artificial Sequence: Synthetic peptide
QISASTR

SEQ ID NO: 28401 - protein, 7 aa, Artificial Sequence
  Description of Artificial Sequence: Synthetic peptide
QNVSTMN

SEQ ID NO: 28402 - protein, 7 aa, Artificial Sequence
  Description of Artificial Sequence: Synthetic peptide
VPLQKPS

SEQ ID NO: 28403 - protein, 7 aa, Artificial Sequence
  Description of Artificial Sequence: Synthetic peptide
VTRSRLD

SEQ ID NO: 28404 - protein, 7 aa, Artificial Sequence
  Description of Artificial Sequence: Synthetic peptide
YRTATSH

SEQ ID NO: 28405 - protein, 7 aa, Artificial Sequence
  Description of Artificial Sequence: Synthetic peptide
DVMPSGR

SEQ ID NO: 28406 - protein, 7 aa, Artificial Sequence
  Description of Artificial Sequence: Synthetic peptide
LDGRQHS

SEQ ID NO: 28407 - protein, 7 aa, Artificial Sequence
  Description of Artificial Sequence: Synthetic peptide
LRPNGQL

SEQ ID NO: 28408 - protein, 7 aa, Artificial Sequence
  Description of Artificial Sequence: Synthetic peptide
RGVGKLT

SEQ ID NO: 28409 - protein, 7 aa, Artificial Sequence
  Description of Artificial Sequence: Synthetic peptide
TSTSRSS

SEQ ID NO: 28410 - protein, 7 aa, Artificial Sequence
  Description of Artificial Sequence: Synthetic peptide
EPLQGSR

SEQ ID NO: 28411 - protein, 7 aa, Artificial Sequence
  Description of Artificial Sequence: Synthetic peptide
SQTVKTG

SEQ ID NO: 28412 - protein, 7 aa, Artificial Sequence
  Description of Artificial Sequence: Synthetic peptide
STSKDYT

SEQ ID NO: 28413 - protein, 7 aa, Artificial Sequence
  Description of Artificial Sequence: Synthetic peptide
RDTNRFG

SEQ ID NO: 28414 - protein, 7 aa, Artificial Sequence
  Description of Artificial Sequence: Synthetic peptide
SQIPPST

SEQ ID NO: 28415 - protein, 7 aa, Artificial Sequence
  Description of Artificial Sequence: Synthetic peptide
ASTPNNT

SEQ ID NO: 28416 - protein, 7 aa, Artificial Sequence
  Description of Artificial Sequence: Synthetic peptide
IHQKVNV

SEQ ID NO: 28417 - protein, 7 aa, Artificial Sequence
  Description of Artificial Sequence: Synthetic peptide
NHGSGTA

SEQ ID NO: 28418 - protein, 7 aa, Artificial Sequence
  Description of Artificial Sequence: Synthetic peptide
KCNSACQ

SEQ ID NO: 28419 - protein, 7 aa, Artificial Sequence
  Description of Artificial Sequence: Synthetic peptide
ASLKTQM

SEQ ID NO: 28420 - protein, 7 aa, Artificial Sequence
  Description of Artificial Sequence: Synthetic peptide
KLGQDVR

SEQ ID NO: 28421 - protein, 7 aa, Artificial Sequence
  Description of Artificial Sequence: Synthetic peptide
TPSVSTK

SEQ ID NO: 28422 - protein, 7 aa, Artificial Sequence
  Description of Artificial Sequence: Synthetic peptide
HTPEVGK

SEQ ID NO: 28423 - protein, 7 aa, Artificial Sequence
  Description of Artificial Sequence: Synthetic peptide
GIGSAAV

SEQ ID NO: 28424 - protein, 7 aa, Artificial Sequence
  Description of Artificial Sequence: Synthetic peptide
GGQASGR

SEQ ID NO: 28425 - protein, 7 aa, Artificial Sequence
  Description of Artificial Sequence: Synthetic peptide
RNDSRPP

SEQ ID NO: 28426 - protein, 7 aa, Artificial Sequence
  Description of Artificial Sequence: Synthetic peptide
WGGSADR

SEQ ID NO: 28427 - protein, 7 aa, Artificial Sequence
  Description of Artificial Sequence: Synthetic peptide
SGGKGPT

SEQ ID NO: 28428 - protein, 7 aa, Artificial Sequence
  Description of Artificial Sequence: Synthetic peptide
SSPLEHS

SEQ ID NO: 28429 - protein, 7 aa, Artificial Sequence
  Description of Artificial Sequence: Synthetic peptide
PMDYSRS

SEQ ID NO: 28430 - protein, 7 aa, Artificial Sequence
  Description of Artificial Sequence: Synthetic peptide
LINPAGS

SEQ ID NO: 28431 - protein, 7 aa, Artificial Sequence
  Description of Artificial Sequence: Synthetic peptide
PWGTNLD

SEQ ID NO: 28432 - protein, 7 aa, Artificial Sequence
  Description of Artificial Sequence: Synthetic peptide
QQASLSS

SEQ ID NO: 28433 - protein, 7 aa, Artificial Sequence
  Description of Artificial Sequence: Synthetic peptide
GSNINNG

SEQ ID NO: 28434 - protein, 7 aa, Artificial Sequence
  Description of Artificial Sequence: Synthetic peptide
PISHTTG

SEQ ID NO: 28435 - protein, 7 aa, Artificial Sequence
  Description of Artificial Sequence: Synthetic peptide
FASRPVQ

SEQ ID NO: 28436 - protein, 7 aa, Artificial Sequence
  Description of Artificial Sequence: Synthetic peptide
LGVHHTN

SEQ ID NO: 28437 - protein, 7 aa, Artificial Sequence
  Description of Artificial Sequence: Synthetic peptide
GYNKSLA

SEQ ID NO: 28438 - protein, 7 aa, Artificial Sequence
  Description of Artificial Sequence: Synthetic peptide
CPIRMSN

SEQ ID NO: 28439 - protein, 7 aa, Artificial Sequence
  Description of Artificial Sequence: Synthetic peptide
WSPERTI

SEQ ID NO: 28440 - protein, 7 aa, Artificial Sequence
  Description of Artificial Sequence: Synthetic peptide
MYSDRCA

SEQ ID NO: 28441 - protein, 7 aa, Artificial Sequence
  Description of Artificial Sequence: Synthetic peptide
HQTRTAA

SEQ ID NO: 28442 - protein, 7 aa, Artificial Sequence
  Description of Artificial Sequence: Synthetic peptide
VGSQTNS

SEQ ID NO: 28443 - protein, 7 aa, Artificial Sequence
  Description of Artificial Sequence: Synthetic peptide
SQPNSAY

SEQ ID NO: 28444 - protein, 7 aa, Artificial Sequence
  Description of Artificial Sequence: Synthetic peptide
GGVPSRL

SEQ ID NO: 28445 - protein, 7 aa, Artificial Sequence
  Description of Artificial Sequence: Synthetic peptide
TTVGSGY

SEQ ID NO: 28446 - protein, 7 aa, Artificial Sequence
  Description of Artificial Sequence: Synthetic peptide
KGSGQNQ

SEQ ID NO: 28447 - protein, 7 aa, Artificial Sequence
  Description of Artificial Sequence: Synthetic peptide
LNSGNGS

SEQ ID NO: 28448 - protein, 7 aa, Artificial Sequence
  Description of Artificial Sequence: Synthetic peptide
HTANSQS

SEQ ID NO: 28449 - protein, 7 aa, Artificial Sequence
  Description of Artificial Sequence: Synthetic peptide
SYPSQLN

SEQ ID NO: 28450 - protein, 7 aa, Artificial Sequence
  Description of Artificial Sequence: Synthetic peptide
SGASSNS

SEQ ID NO: 28451 - protein, 7 aa, Artificial Sequence
  Description of Artificial Sequence: Synthetic peptide
RLDRQQG

SEQ ID NO: 28452 - protein, 7 aa, Artificial Sequence
  Description of Artificial Sequence: Synthetic peptide
LVAGSPQ

SEQ ID NO: 28453 - protein, 7 aa, Artificial Sequence
  Description of Artificial Sequence: Synthetic peptide
TVPGRST

SEQ ID NO: 28454 - protein, 7 aa, Artificial Sequence
  Description of Artificial Sequence: Synthetic peptide
PSHGQNR

SEQ ID NO: 28455 - protein, 7 aa, Artificial Sequence
  Description of Artificial Sequence: Synthetic peptide
ENNSRAT

SEQ ID NO: 28456 - protein, 7 aa, Artificial Sequence
  Description of Artificial Sequence: Synthetic peptide
NNAATHS

SEQ ID NO: 28457 - protein, 7 aa, Artificial Sequence
  Description of Artificial Sequence: Synthetic peptide
NGSTSSG

SEQ ID NO: 28458 - protein, 7 aa, Artificial Sequence
  Description of Artificial Sequence: Synthetic peptide
HGMEVAR

SEQ ID NO: 28459 - protein, 7 aa, Artificial Sequence
  Description of Artificial Sequence: Synthetic peptide
CISPSSR

SEQ ID NO: 28460 - protein, 7 aa, Artificial Sequence
  Description of Artificial Sequence: Synthetic peptide
NPSMAMK

SEQ ID NO: 28461 - protein, 7 aa, Artificial Sequence
  Description of Artificial Sequence: Synthetic peptide
SKSQPPK

SEQ ID NO: 28462 - protein, 7 aa, Artificial Sequence
  Description of Artificial Sequence: Synthetic peptide
LNSMSPR

SEQ ID NO: 28463 - protein, 7 aa, Artificial Sequence
  Description of Artificial Sequence: Synthetic peptide
TQQNGRN

SEQ ID NO: 28464 - protein, 7 aa, Artificial Sequence
  Description of Artificial Sequence: Synthetic peptide
VSTPRLS

SEQ ID NO: 28465 - protein, 7 aa, Artificial Sequence
  Description of Artificial Sequence: Synthetic peptide
VTANRST

SEQ ID NO: 28466 - protein, 7 aa, Artificial Sequence
  Description of Artificial Sequence: Synthetic peptide
TQGSRLS

SEQ ID NO: 28467 - protein, 7 aa, Artificial Sequence
  Description of Artificial Sequence: Synthetic peptide
SNGSRLA

SEQ ID NO: 28468 - protein, 7 aa, Artificial Sequence
  Description of Artificial Sequence: Synthetic peptide
FSSKTSP

SEQ ID NO: 28469 - protein, 7 aa, Artificial Sequence
  Description of Artificial Sequence: Synthetic peptide
VSDSNTK

SEQ ID NO: 28470 - protein, 7 aa, Artificial Sequence
  Description of Artificial Sequence: Synthetic peptide
GALATYR

SEQ ID NO: 28471 - protein, 7 aa, Artificial Sequence
  Description of Artificial Sequence: Synthetic peptide
HRTSRDG

SEQ ID NO: 28472 - protein, 7 aa, Artificial Sequence
  Description of Artificial Sequence: Synthetic peptide
MRQTASL

SEQ ID NO: 28473 - protein, 7 aa, Artificial Sequence
  Description of Artificial Sequence: Synthetic peptide
SVTGGRG

SEQ ID NO: 28474 - protein, 7 aa, Artificial Sequence
  Description of Artificial Sequence: Synthetic peptide
TTQSRSL

SEQ ID NO: 28475 - protein, 7 aa, Artificial Sequence
  Description of Artificial Sequence: Synthetic peptide
LNRGKPV

SEQ ID NO: 28476 - protein, 7 aa, Artificial Sequence
  Description of Artificial Sequence: Synthetic peptide
SRLEKSN

SEQ ID NO: 28477 - protein, 7 aa, Artificial Sequence
  Description of Artificial Sequence: Synthetic peptide
RVRADDD

SEQ ID NO: 28478 - protein, 7 aa, Artificial Sequence
  Description of Artificial Sequence: Synthetic peptide
VSTGSFT

SEQ ID NO: 28479 - protein, 7 aa, Artificial Sequence
  Description of Artificial Sequence: Synthetic peptide
SGVERVN

SEQ ID NO: 28480 - protein, 7 aa, Artificial Sequence
  Description of Artificial Sequence: Synthetic peptide
PSNSKCG

SEQ ID NO: 28481 - protein, 7 aa, Artificial Sequence
  Description of Artificial Sequence: Synthetic peptide
YHLNSQS

SEQ ID NO: 28482 - protein, 7 aa, Artificial Sequence
  Description of Artificial Sequence: Synthetic peptide
NTSTNGI

SEQ ID NO: 28483 - protein, 7 aa, Artificial Sequence
  Description of Artificial Sequence: Synthetic peptide
SHNRTND

SEQ ID NO: 28484 - protein, 7 aa, Artificial Sequence
  Description of Artificial Sequence: Synthetic peptide
GSQRAPG

SEQ ID NO: 28485 - protein, 7 aa, Artificial Sequence
  Description of Artificial Sequence: Synthetic peptide
LGTSTIL

SEQ ID NO: 28486 - protein, 7 aa, Artificial Sequence
  Description of Artificial Sequence: Synthetic peptide
MMNRSAS

SEQ ID NO: 28487 - protein, 7 aa, Artificial Sequence
  Description of Artificial Sequence: Synthetic peptide
FANTANR

SEQ ID NO: 28488 - protein, 7 aa, Artificial Sequence
  Description of Artificial Sequence: Synthetic peptide
TSNSNIA

SEQ ID NO: 28489 - protein, 7 aa, Artificial Sequence
  Description of Artificial Sequence: Synthetic peptide
LDKEPRG

SEQ ID NO: 28490 - protein, 7 aa, Artificial Sequence
  Description of Artificial Sequence: Synthetic peptide
YGNPRQA

SEQ ID NO: 28491 - protein, 7 aa, Artificial Sequence
  Description of Artificial Sequence: Synthetic peptide
IQSPGNM

SEQ ID NO: 28492 - protein, 7 aa, Artificial Sequence
  Description of Artificial Sequence: Synthetic peptide
DPVRKTS

SEQ ID NO: 28493 - protein, 7 aa, Artificial Sequence
  Description of Artificial Sequence: Synthetic peptide
CCTVPLV

SEQ ID NO: 28494 - protein, 7 aa, Artificial Sequence
  Description of Artificial Sequence: Synthetic peptide
KNIGSHG

SEQ ID NO: 28495 - protein, 7 aa, Artificial Sequence
  Description of Artificial Sequence: Synthetic peptide
AASMEYS

SEQ ID NO: 28496 - protein, 7 aa, Artificial Sequence
  Description of Artificial Sequence: Synthetic peptide
SNGTKRQ

SEQ ID NO: 28497 - protein, 7 aa, Artificial Sequence
  Description of Artificial Sequence: Synthetic peptide
NVESKSC

SEQ ID NO: 28498 - protein, 7 aa, Artificial Sequence
  Description of Artificial Sequence: Synthetic peptide
MLPQHGR

SEQ ID NO: 28499 - protein, 7 aa, Artificial Sequence
  Description of Artificial Sequence: Synthetic peptide
TGSGSNH

SEQ ID NO: 28500 - protein, 7 aa, Artificial Sequence
  Description of Artificial Sequence: Synthetic peptide
LRNGIAS

SEQ ID NO: 28501 - protein, 7 aa, Artificial Sequence
  Description of Artificial Sequence: Synthetic peptide
MRSGTHN

SEQ ID NO: 28502 - protein, 7 aa, Artificial Sequence
  Description of Artificial Sequence: Synthetic peptide
TSNTKQG

SEQ ID NO: 28503 - protein, 7 aa, Artificial Sequence
  Description of Artificial Sequence: Synthetic peptide
PGMAGRG

SEQ ID NO: 28504 - protein, 7 aa, Artificial Sequence
  Description of Artificial Sequence: Synthetic peptide
PSNRQIA

SEQ ID NO: 28505 - protein, 7 aa, Artificial Sequence
  Description of Artificial Sequence: Synthetic peptide
DGLRNSL

SEQ ID NO: 28506 - protein, 7 aa, Artificial Sequence
  Description of Artificial Sequence: Synthetic peptide
PSTPTIK

SEQ ID NO: 28507 - protein, 7 aa, Artificial Sequence
  Description of Artificial Sequence: Synthetic peptide
EVHAKNN

SEQ ID NO: 28508 - protein, 7 aa, Artificial Sequence
  Description of Artificial Sequence: Synthetic peptide
NNAHRVA

SEQ ID NO: 28509 - protein, 7 aa, Artificial Sequence
  Description of Artificial Sequence: Synthetic peptide
KDNTPGR

SEQ ID NO: 28510 - protein, 7 aa, Artificial Sequence
  Description of Artificial Sequence: Synthetic peptide
SLGRDHA

SEQ ID NO: 28511 - protein, 7 aa, Artificial Sequence
  Description of Artificial Sequence: Synthetic peptide
TNIQASK

SEQ ID NO: 28512 - protein, 7 aa, Artificial Sequence
  Description of Artificial Sequence: Synthetic peptide
QGTHTLR

SEQ ID NO: 28513 - protein, 7 aa, Artificial Sequence
  Description of Artificial Sequence: Synthetic peptide
TGSGTIL

SEQ ID NO: 28514 - protein, 7 aa, Artificial Sequence
  Description of Artificial Sequence: Synthetic peptide
AQHELRA

SEQ ID NO: 28515 - protein, 7 aa, Artificial Sequence
  Description of Artificial Sequence: Synthetic peptide
HVDTRHV

SEQ ID NO: 28516 - protein, 7 aa, Artificial Sequence
  Description of Artificial Sequence: Synthetic peptide
SGGKSAL

SEQ ID NO: 28517 - protein, 7 aa, Artificial Sequence
  Description of Artificial Sequence: Synthetic peptide
MAGNPHS

SEQ ID NO: 28518 - protein, 7 aa, Artificial Sequence
  Description of Artificial Sequence: Synthetic peptide
NRVQPAS

SEQ ID NO: 28519 - protein, 7 aa, Artificial Sequence
  Description of Artificial Sequence: Synthetic peptide
EAKANGK

SEQ ID NO: 28520 - protein, 7 aa, Artificial Sequence
  Description of Artificial Sequence: Synthetic peptide
GTVRTLH

SEQ ID NO: 28521 - protein, 7 aa, Artificial Sequence
  Description of Artificial Sequence: Synthetic peptide
QTSATQR

SEQ ID NO: 28522 - protein, 7 aa, Artificial Sequence
  Description of Artificial Sequence: Synthetic peptide
PGGKSQL

SEQ ID NO: 28523 - protein, 7 aa, Artificial Sequence
  Description of Artificial Sequence: Synthetic peptide
RTVPSSL

SEQ ID NO: 28524 - protein, 7 aa, Artificial Sequence
  Description of Artificial Sequence: Synthetic peptide
VLSSSPK

SEQ ID NO: 28525 - protein, 7 aa, Artificial Sequence
  Description of Artificial Sequence: Synthetic peptide
CGRSGGG

SEQ ID NO: 28526 - protein, 7 aa, Artificial Sequence
  Description of Artificial Sequence: Synthetic peptide
QNSKGYV

SEQ ID NO: 28527 - protein, 7 aa, Artificial Sequence
  Description of Artificial Sequence: Synthetic peptide
YQNKSLT

SEQ ID NO: 28528 - protein, 7 aa, Artificial Sequence
  Description of Artificial Sequence: Synthetic peptide
TSRTSYE

SEQ ID NO: 28529 - protein, 7 aa, Artificial Sequence
  Description of Artificial Sequence: Synthetic peptide
MQTSQST

SEQ ID NO: 28530 - protein, 7 aa, Artificial Sequence
  Description of Artificial Sequence: Synthetic peptide
NGCGQNQ

SEQ ID NO: 28531 - protein, 7 aa, Artificial Sequence
  Description of Artificial Sequence: Synthetic peptide
SFPPGNV

SEQ ID NO: 28532 - protein, 7 aa, Artificial Sequence
  Description of Artificial Sequence: Synthetic peptide
PTGAHVT

SEQ ID NO: 28533 - protein, 7 aa, Artificial Sequence
  Description of Artificial Sequence: Synthetic peptide
DSKQNLT

SEQ ID NO: 28534 - protein, 7 aa, Artificial Sequence
  Description of Artificial Sequence: Synthetic peptide
LIRGGNN

SEQ ID NO: 28535 - protein, 7 aa, Artificial Sequence
  Description of Artificial Sequence: Synthetic peptide
GLKNEPA

SEQ ID NO: 28536 - protein, 7 aa, Artificial Sequence
  Description of Artificial Sequence: Synthetic peptide
HASRVNI

SEQ ID NO: 28537 - protein, 7 aa, Artificial Sequence
  Description of Artificial Sequence: Synthetic peptide
LNLKPIN

SEQ ID NO: 28538 - protein, 7 aa, Artificial Sequence
  Description of Artificial Sequence: Synthetic peptide
TTQTPYK

SEQ ID NO: 28539 - protein, 7 aa, Artificial Sequence
  Description of Artificial Sequence: Synthetic peptide
IGLGNTP

SEQ ID NO: 28540 - protein, 7 aa, Artificial Sequence
  Description of Artificial Sequence: Synthetic peptide
NCSGQKQ

SEQ ID NO: 28541 - protein, 7 aa, Artificial Sequence
  Description of Artificial Sequence: Synthetic peptide
SQVSHSV

SEQ ID NO: 28542 - protein, 7 aa, Artificial Sequence
  Description of Artificial Sequence: Synthetic peptide
WNKTSPQ

SEQ ID NO: 28543 - protein, 7 aa, Artificial Sequence
  Description of Artificial Sequence: Synthetic peptide
QGSGSNH

SEQ ID NO: 28544 - protein, 7 aa, Artificial Sequence
  Description of Artificial Sequence: Synthetic peptide
ALRNQSQ

SEQ ID NO: 28545 - protein, 7 aa, Artificial Sequence
  Description of Artificial Sequence: Synthetic peptide
PADHGKL

SEQ ID NO: 28546 - protein, 7 aa, Artificial Sequence
  Description of Artificial Sequence: Synthetic peptide
DSIGSSK

SEQ ID NO: 28547 - protein, 7 aa, Artificial Sequence
  Description of Artificial Sequence: Synthetic peptide
NGITKSS

SEQ ID NO: 28548 - protein, 7 aa, Artificial Sequence
  Description of Artificial Sequence: Synthetic peptide
PLQATGK

SEQ ID NO: 28549 - protein, 7 aa, Artificial Sequence
  Description of Artificial Sequence: Synthetic peptide
SRVRDSH

SEQ ID NO: 28550 - protein, 7 aa, Artificial Sequence
  Description of Artificial Sequence: Synthetic peptide
SYGKESS

SEQ ID NO: 28551 - protein, 7 aa, Artificial Sequence
  Description of Artificial Sequence: Synthetic peptide
RLVDSHK

SEQ ID NO: 28552 - protein, 7 aa, Artificial Sequence
  Description of Artificial Sequence: Synthetic peptide
YVSSGKA

SEQ ID NO: 28553 - protein, 7 aa, Artificial Sequence
  Description of Artificial Sequence: Synthetic peptide
QSTVESR

SEQ ID NO: 28554 - protein, 7 aa, Artificial Sequence
  Description of Artificial Sequence: Synthetic peptide
SSSTSPR

SEQ ID NO: 28555 - protein, 7 aa, Artificial Sequence
  Description of Artificial Sequence: Synthetic peptide
RPGGKDG

SEQ ID NO: 28556 - protein, 7 aa, Artificial Sequence
  Description of Artificial Sequence: Synthetic peptide
SPTRPMN

SEQ ID NO: 28557 - protein, 7 aa, Artificial Sequence
  Description of Artificial Sequence: Synthetic peptide
SSQMHGS

SEQ ID NO: 28558 - protein, 7 aa, Artificial Sequence
  Description of Artificial Sequence: Synthetic peptide
TGRAPSS

SEQ ID NO: 28559 - protein, 7 aa, Artificial Sequence
  Description of Artificial Sequence: Synthetic peptide
QSNTSPT

SEQ ID NO: 28560 - protein, 7 aa, Artificial Sequence
  Description of Artificial Sequence: Synthetic peptide
GTISHMT

SEQ ID NO: 28561 - protein, 7 aa, Artificial Sequence
  Description of Artificial Sequence: Synthetic peptide
IPASSSG

SEQ ID NO: 28562 - protein, 7 aa, Artificial Sequence
  Description of Artificial Sequence: Synthetic peptide
LATANSR

SEQ ID NO: 28563 - protein, 7 aa, Artificial Sequence
  Description of Artificial Sequence: Synthetic peptide
GTADRHL

SEQ ID NO: 28564 - protein, 7 aa, Artificial Sequence
  Description of Artificial Sequence: Synthetic peptide
THQSSTS

SEQ ID NO: 28565 - protein, 7 aa, Artificial Sequence
  Description of Artificial Sequence: Synthetic peptide
SPNNRGM

SEQ ID NO: 28566 - protein, 7 aa, Artificial Sequence
  Description of Artificial Sequence: Synthetic peptide
GGGTSFG

SEQ ID NO: 28567 - protein, 7 aa, Artificial Sequence
  Description of Artificial Sequence: Synthetic peptide
RPHDNDN

SEQ ID NO: 28568 - protein, 7 aa, Artificial Sequence
  Description of Artificial Sequence: Synthetic peptide
YPNGKSS

SEQ ID NO: 28569 - protein, 7 aa, Artificial Sequence
  Description of Artificial Sequence: Synthetic peptide
IRSKESE

SEQ ID NO: 28570 - protein, 7 aa, Artificial Sequence
  Description of Artificial Sequence: Synthetic peptide
GQVKQAL

SEQ ID NO: 28571 - protein, 7 aa, Artificial Sequence
  Description of Artificial Sequence: Synthetic peptide
KQPVSTH

SEQ ID NO: 28572 - protein, 7 aa, Artificial Sequence
  Description of Artificial Sequence: Synthetic peptide
TQQNGSN

SEQ ID NO: 28573 - protein, 7 aa, Artificial Sequence
  Description of Artificial Sequence: Synthetic peptide
GGDNKLT

SEQ ID NO: 28574 - protein, 7 aa, Artificial Sequence
  Description of Artificial Sequence: Synthetic peptide
YSGGNMS

SEQ ID NO: 28575 - protein, 7 aa, Artificial Sequence
  Description of Artificial Sequence: Synthetic peptide
SHDSRVA

SEQ ID NO: 28576 - protein, 7 aa, Artificial Sequence
  Description of Artificial Sequence: Synthetic peptide
QYNQAGL

SEQ ID NO: 28577 - protein, 7 aa, Artificial Sequence
  Description of Artificial Sequence: Synthetic peptide
SNSASYG

SEQ ID NO: 28578 - protein, 7 aa, Artificial Sequence
  Description of Artificial Sequence: Synthetic peptide
FTVTGLS

SEQ ID NO: 28579 - protein, 7 aa, Artificial Sequence
  Description of Artificial Sequence: Synthetic peptide
HGRTSVL

SEQ ID NO: 28580 - protein, 7 aa, Artificial Sequence
  Description of Artificial Sequence: Synthetic peptide
MGNAGVR

SEQ ID NO: 28581 - protein, 7 aa, Artificial Sequence
  Description of Artificial Sequence: Synthetic peptide
DCVSRCK

SEQ ID NO: 28582 - protein, 7 aa, Artificial Sequence
  Description of Artificial Sequence: Synthetic peptide
GVNIHAS

SEQ ID NO: 28583 - protein, 7 aa, Artificial Sequence
  Description of Artificial Sequence: Synthetic peptide
RNSASIF

SEQ ID NO: 28584 - protein, 7 aa, Artificial Sequence
  Description of Artificial Sequence: Synthetic peptide
QANTSTD

SEQ ID NO: 28585 - protein, 7 aa, Artificial Sequence
  Description of Artificial Sequence: Synthetic peptide
IANAHYN

SEQ ID NO: 28586 - protein, 7 aa, Artificial Sequence
  Description of Artificial Sequence: Synthetic peptide
TTTTRPS

SEQ ID NO: 28587 - protein, 7 aa, Artificial Sequence
  Description of Artificial Sequence: Synthetic peptide
VLNAKSS

SEQ ID NO: 28588 - protein, 7 aa, Artificial Sequence
  Description of Artificial Sequence: Synthetic peptide
PGQSTSS

SEQ ID NO: 28589 - protein, 7 aa, Artificial Sequence
  Description of Artificial Sequence: Synthetic peptide
GDAGSFS

SEQ ID NO: 28590 - protein, 7 aa, Artificial Sequence
  Description of Artificial Sequence: Synthetic peptide
VQGSLPS

SEQ ID NO: 28591 - protein, 7 aa, Artificial Sequence
  Description of Artificial Sequence: Synthetic peptide
AHRNISS

SEQ ID NO: 28592 - protein, 7 aa, Artificial Sequence
  Description of Artificial Sequence: Synthetic peptide
VGNNNRL

SEQ ID NO: 28593 - protein, 7 aa, Artificial Sequence
  Description of Artificial Sequence: Synthetic peptide
PQSRKGE

SEQ ID NO: 28594 - protein, 7 aa, Artificial Sequence
  Description of Artificial Sequence: Synthetic peptide
IGSGQNQ

SEQ ID NO: 28595 - protein, 7 aa, Artificial Sequence
  Description of Artificial Sequence: Synthetic peptide
RIPNNPS

SEQ ID NO: 28596 - protein, 7 aa, Artificial Sequence
  Description of Artificial Sequence: Synthetic peptide
KNQAPLL

SEQ ID NO: 28597 - protein, 7 aa, Artificial Sequence
  Description of Artificial Sequence: Synthetic peptide
SSRASQD

SEQ ID NO: 28598 - protein, 7 aa, Artificial Sequence
  Description of Artificial Sequence: Synthetic peptide
RTGREVD

SEQ ID NO: 28599 - protein, 7 aa, Artificial Sequence
  Description of Artificial Sequence: Synthetic peptide
NNVPLIK

SEQ ID NO: 28600 - protein, 7 aa, Artificial Sequence
  Description of Artificial Sequence: Synthetic peptide
YGSNTPT

SEQ ID NO: 28601 - protein, 7 aa, Artificial Sequence
  Description of Artificial Sequence: Synthetic peptide
RPSSVKD

SEQ ID NO: 28602 - protein, 7 aa, Artificial Sequence
  Description of Artificial Sequence: Synthetic peptide
YSRTQQS

SEQ ID NO: 28603 - protein, 7 aa, Artificial Sequence
  Description of Artificial Sequence: Synthetic peptide
RDVGSAA

SEQ ID NO: 28604 - protein, 7 aa, Artificial Sequence
  Description of Artificial Sequence: Synthetic peptide
QGQNRTV

SEQ ID NO: 28605 - protein, 7 aa, Artificial Sequence
  Description of Artificial Sequence: Synthetic peptide
SQSSPVA

SEQ ID NO: 28606 - protein, 7 aa, Artificial Sequence
  Description of Artificial Sequence: Synthetic peptide
STHDHSR

SEQ ID NO: 28607 - protein, 7 aa, Artificial Sequence
  Description of Artificial Sequence: Synthetic peptide
RNVSGMN

SEQ ID NO: 28608 - protein, 7 aa, Artificial Sequence
  Description of Artificial Sequence: Synthetic peptide
IRAKESA

SEQ ID NO: 28609 - protein, 7 aa, Artificial Sequence
  Description of Artificial Sequence: Synthetic peptide
HANSPAT

SEQ ID NO: 28610 - protein, 7 aa, Artificial Sequence
  Description of Artificial Sequence: Synthetic peptide
RMTTMQA

SEQ ID NO: 28611 - protein, 7 aa, Artificial Sequence
  Description of Artificial Sequence: Synthetic peptide
SGTTRTL

SEQ ID NO: 28612 - protein, 7 aa, Artificial Sequence
  Description of Artificial Sequence: Synthetic peptide
GLDHLRT

SEQ ID NO: 28613 - protein, 7 aa, Artificial Sequence
  Description of Artificial Sequence: Synthetic peptide
LSLNKSQ

SEQ ID NO: 28614 - protein, 7 aa, Artificial Sequence
  Description of Artificial Sequence: Synthetic peptide
GAAVQAN

SEQ ID NO: 28615 - protein, 7 aa, Artificial Sequence
  Description of Artificial Sequence: Synthetic peptide
FNSNRDS

SEQ ID NO: 28616 - protein, 7 aa, Artificial Sequence
  Description of Artificial Sequence: Synthetic peptide
VHTGQNG

SEQ ID NO: 28617 - protein, 7 aa, Artificial Sequence
  Description of Artificial Sequence: Synthetic peptide
ESNRSQV

SEQ ID NO: 28618 - protein, 7 aa, Artificial Sequence
  Description of Artificial Sequence: Synthetic peptide
AGTNSRQ

SEQ ID NO: 28619 - protein, 7 aa, Artificial Sequence
  Description of Artificial Sequence: Synthetic peptide
SAVGKAS

SEQ ID NO: 28620 - protein, 7 aa, Artificial Sequence
  Description of Artificial Sequence: Synthetic peptide
TVLGARG

SEQ ID NO: 28621 - protein, 7 aa, Artificial Sequence
  Description of Artificial Sequence: Synthetic peptide
NRQSSPT

SEQ ID NO: 28622 - protein, 7 aa, Artificial Sequence
  Description of Artificial Sequence: Synthetic peptide
MNTSRSS

SEQ ID NO: 28623 - protein, 7 aa, Artificial Sequence
  Description of Artificial Sequence: Synthetic peptide
ANGTKSS

SEQ ID NO: 28624 - protein, 7 aa, Artificial Sequence
  Description of Artificial Sequence: Synthetic peptide
SPLQSIV

SEQ ID NO: 28625 - protein, 7 aa, Artificial Sequence
  Description of Artificial Sequence: Synthetic peptide
YRVGSIS

SEQ ID NO: 28626 - protein, 7 aa, Artificial Sequence
  Description of Artificial Sequence: Synthetic peptide
NSGHSHD

SEQ ID NO: 28627 - protein, 7 aa, Artificial Sequence
  Description of Artificial Sequence: Synthetic peptide
QNRNTVG

SEQ ID NO: 28628 - protein, 7 aa, Artificial Sequence
  Description of Artificial Sequence: Synthetic peptide
PTKANVT

SEQ ID NO: 28629 - protein, 7 aa, Artificial Sequence
  Description of Artificial Sequence: Synthetic peptide
FRVTGST

SEQ ID NO: 28630 - protein, 7 aa, Artificial Sequence
  Description of Artificial Sequence: Synthetic peptide
ITSGSTR

SEQ ID NO: 28631 - protein, 7 aa, Artificial Sequence
  Description of Artificial Sequence: Synthetic peptide
SPTSPMN

SEQ ID NO: 28632 - protein, 7 aa, Artificial Sequence
  Description of Artificial Sequence: Synthetic peptide
ELAAPSK

SEQ ID NO: 28633 - protein, 7 aa, Artificial Sequence
  Description of Artificial Sequence: Synthetic peptide
PPNLKLS

SEQ ID NO: 28634 - protein, 7 aa, Artificial Sequence
  Description of Artificial Sequence: Synthetic peptide
NSNSHGS

SEQ ID NO: 28635 - protein, 7 aa, Artificial Sequence
  Description of Artificial Sequence: Synthetic peptide
NLGQNLS

SEQ ID NO: 28636 - protein, 7 aa, Artificial Sequence
  Description of Artificial Sequence: Synthetic peptide
NLGATAS

SEQ ID NO: 28637 - protein, 7 aa, Artificial Sequence
  Description of Artificial Sequence: Synthetic peptide
NMPMRSG

SEQ ID NO: 28638 - protein, 7 aa, Artificial Sequence
  Description of Artificial Sequence: Synthetic peptide
SLPLAIN

SEQ ID NO: 28639 - protein, 7 aa, Artificial Sequence
  Description of Artificial Sequence: Synthetic peptide
PQNNQAH

SEQ ID NO: 28640 - protein, 7 aa, Artificial Sequence
  Description of Artificial Sequence: Synthetic peptide
SSEAATR

SEQ ID NO: 28641 - protein, 7 aa, Artificial Sequence
  Description of Artificial Sequence: Synthetic peptide
SVSSPRD

SEQ ID NO: 28642 - protein, 7 aa, Artificial Sequence
  Description of Artificial Sequence: Synthetic peptide
PGYGSNH

SEQ ID NO: 28643 - protein, 7 aa, Artificial Sequence
  Description of Artificial Sequence: Synthetic peptide
KIPNYDR

SEQ ID NO: 28644 - protein, 7 aa, Artificial Sequence
  Description of Artificial Sequence: Synthetic peptide
PLQTSRT

SEQ ID NO: 28645 - protein, 7 aa, Artificial Sequence
  Description of Artificial Sequence: Synthetic peptide
RDPKAGV

SEQ ID NO: 28646 - protein, 7 aa, Artificial Sequence
  Description of Artificial Sequence: Synthetic peptide
NATANGQ

SEQ ID NO: 28647 - protein, 7 aa, Artificial Sequence
  Description of Artificial Sequence: Synthetic peptide
TGSGRLL

SEQ ID NO: 28648 - protein, 7 aa, Artificial Sequence
  Description of Artificial Sequence: Synthetic peptide
ITGSLSK

SEQ ID NO: 28649 - protein, 7 aa, Artificial Sequence
  Description of Artificial Sequence: Synthetic peptide
WSLGSQS

SEQ ID NO: 28650 - protein, 7 aa, Artificial Sequence
  Description of Artificial Sequence: Synthetic peptide
TPTPVNQ

SEQ ID NO: 28651 - protein, 7 aa, Artificial Sequence
  Description of Artificial Sequence: Synthetic peptide
SDMSGQR

SEQ ID NO: 28652 - protein, 7 aa, Artificial Sequence
  Description of Artificial Sequence: Synthetic peptide
PGDSGKV

SEQ ID NO: 28653 - protein, 7 aa, Artificial Sequence
  Description of Artificial Sequence: Synthetic peptide
GVNRIPA

SEQ ID NO: 28654 - protein, 7 aa, Artificial Sequence
  Description of Artificial Sequence: Synthetic peptide
ERAKGSS

SEQ ID NO: 28655 - protein, 7 aa, Artificial Sequence
  Description of Artificial Sequence: Synthetic peptide
AVSKGGP

SEQ ID NO: 28656 - protein, 7 aa, Artificial Sequence
  Description of Artificial Sequence: Synthetic peptide
GTNPGTL

SEQ ID NO: 28657 - protein, 7 aa, Artificial Sequence
  Description of Artificial Sequence: Synthetic peptide
AYGKGSS

SEQ ID NO: 28658 - protein, 7 aa, Artificial Sequence
  Description of Artificial Sequence: Synthetic peptide
LSIKGAS

SEQ ID NO: 28659 - protein, 7 aa, Artificial Sequence
  Description of Artificial Sequence: Synthetic peptide
SQWQSSS

SEQ ID NO: 28660 - protein, 7 aa, Artificial Sequence
  Description of Artificial Sequence: Synthetic peptide
SNTRDIK

SEQ ID NO: 28661 - protein, 7 aa, Artificial Sequence
  Description of Artificial Sequence: Synthetic peptide
NSSHNSP

SEQ ID NO: 28662 - protein, 7 aa, Artificial Sequence
  Description of Artificial Sequence: Synthetic peptide
TTHSSIN

SEQ ID NO: 28663 - protein, 7 aa, Artificial Sequence
  Description of Artificial Sequence: Synthetic peptide
FARSASS

SEQ ID NO: 28664 - protein, 7 aa, Artificial Sequence
  Description of Artificial Sequence: Synthetic peptide
KQTMGTL

SEQ ID NO: 28665 - protein, 7 aa, Artificial Sequence
  Description of Artificial Sequence: Synthetic peptide
AMSDTYH

SEQ ID NO: 28666 - protein, 7 aa, Artificial Sequence
  Description of Artificial Sequence: Synthetic peptide
PSSNHVK

SEQ ID NO: 28667 - protein, 7 aa, Artificial Sequence
  Description of Artificial Sequence: Synthetic peptide
VSAGARS

SEQ ID NO: 28668 - protein, 7 aa, Artificial Sequence
  Description of Artificial Sequence: Synthetic peptide
QNGDAMG

SEQ ID NO: 28669 - protein, 7 aa, Artificial Sequence
  Description of Artificial Sequence: Synthetic peptide
FSRSPAV

SEQ ID NO: 28670 - protein, 7 aa, Artificial Sequence
  Description of Artificial Sequence: Synthetic peptide
SDVRARS

SEQ ID NO: 28671 - protein, 7 aa, Artificial Sequence
  Description of Artificial Sequence: Synthetic peptide
PLRIGTQ

SEQ ID NO: 28672 - protein, 7 aa, Artificial Sequence
  Description of Artificial Sequence: Synthetic peptide
LPARSDG

SEQ ID NO: 28673 - protein, 7 aa, Artificial Sequence
  Description of Artificial Sequence: Synthetic peptide
VLKSNGY

SEQ ID NO: 28674 - protein, 7 aa, Artificial Sequence
  Description of Artificial Sequence: Synthetic peptide
TTNRSDR

SEQ ID NO: 28675 - protein, 7 aa, Artificial Sequence
  Description of Artificial Sequence: Synthetic peptide
SHSSSHK

SEQ ID NO: 28676 - protein, 7 aa, Artificial Sequence
  Description of Artificial Sequence: Synthetic peptide
ACQPQSL

SEQ ID NO: 28677 - protein, 7 aa, Artificial Sequence
  Description of Artificial Sequence: Synthetic peptide
RNNNTPG

SEQ ID NO: 28678 - protein, 7 aa, Artificial Sequence
  Description of Artificial Sequence: Synthetic peptide
FVSSDLR

SEQ ID NO: 28679 - protein, 7 aa, Artificial Sequence
  Description of Artificial Sequence: Synthetic peptide
VPLAGRP

SEQ ID NO: 28680 - protein, 7 aa, Artificial Sequence
  Description of Artificial Sequence: Synthetic peptide
YFNSPSN

SEQ ID NO: 28681 - protein, 7 aa, Artificial Sequence
  Description of Artificial Sequence: Synthetic peptide
LGSINPV

SEQ ID NO: 28682 - protein, 7 aa, Artificial Sequence
  Description of Artificial Sequence: Synthetic peptide
TVVQPHA

SEQ ID NO: 28683 - protein, 7 aa, Artificial Sequence
  Description of Artificial Sequence: Synthetic peptide
VSTGKSV

SEQ ID NO: 28684 - protein, 7 aa, Artificial Sequence
  Description of Artificial Sequence: Synthetic peptide
GGSNSRL

SEQ ID NO: 28685 - protein, 7 aa, Artificial Sequence
  Description of Artificial Sequence: Synthetic peptide
SSPTNMA

SEQ ID NO: 28686 - protein, 7 aa, Artificial Sequence
  Description of Artificial Sequence: Synthetic peptide
HSTSLSK

SEQ ID NO: 28687 - protein, 7 aa, Artificial Sequence
  Description of Artificial Sequence: Synthetic peptide
PVLNKAT

SEQ ID NO: 28688 - protein, 7 aa, Artificial Sequence
  Description of Artificial Sequence: Synthetic peptide
AVNTKAL

SEQ ID NO: 28689 - protein, 7 aa, Artificial Sequence
  Description of Artificial Sequence: Synthetic peptide
GQPNSAR

SEQ ID NO: 28690 - protein, 7 aa, Artificial Sequence
  Description of Artificial Sequence: Synthetic peptide
QNRVSNG

SEQ ID NO: 28691 - protein, 7 aa, Artificial Sequence
  Description of Artificial Sequence: Synthetic peptide
RHSNSVL

SEQ ID NO: 28692 - protein, 7 aa, Artificial Sequence
  Description of Artificial Sequence: Synthetic peptide
DSSTRGQ

SEQ ID NO: 28693 - protein, 7 aa, Artificial Sequence
  Description of Artificial Sequence: Synthetic peptide
LSNRTQQ

SEQ ID NO: 28694 - protein, 7 aa, Artificial Sequence
  Description of Artificial Sequence: Synthetic peptide
PSSPNSI

SEQ ID NO: 28695 - protein, 7 aa, Artificial Sequence
  Description of Artificial Sequence: Synthetic peptide
SAGGAVS

SEQ ID NO: 28696 - protein, 7 aa, Artificial Sequence
  Description of Artificial Sequence: Synthetic peptide
GSPAAGR

SEQ ID NO: 28697 - protein, 7 aa, Artificial Sequence
  Description of Artificial Sequence: Synthetic peptide
SRPHTDG

SEQ ID NO: 28698 - protein, 7 aa, Artificial Sequence
  Description of Artificial Sequence: Synthetic peptide
TSRGNLS

SEQ ID NO: 28699 - protein, 7 aa, Artificial Sequence
  Description of Artificial Sequence: Synthetic peptide
PLVPRGT

SEQ ID NO: 28700 - protein, 7 aa, Artificial Sequence
  Description of Artificial Sequence: Synthetic peptide
GSSPKLT

SEQ ID NO: 28701 - protein, 7 aa, Artificial Sequence
  Description of Artificial Sequence: Synthetic peptide
SASGNRC

SEQ ID NO: 28702 - protein, 7 aa, Artificial Sequence
  Description of Artificial Sequence: Synthetic peptide
RQTDKLS

SEQ ID NO: 28703 - protein, 7 aa, Artificial Sequence
  Description of Artificial Sequence: Synthetic peptide
GPSSINR

SEQ ID NO: 28704 - protein, 7 aa, Artificial Sequence
  Description of Artificial Sequence: Synthetic peptide
EGNRSNM

SEQ ID NO: 28705 - protein, 7 aa, Artificial Sequence
  Description of Artificial Sequence: Synthetic peptide
TSQTKIV

SEQ ID NO: 28706 - protein, 7 aa, Artificial Sequence
  Description of Artificial Sequence: Synthetic peptide
PSSPTDR

SEQ ID NO: 28707 - protein, 7 aa, Artificial Sequence
  Description of Artificial Sequence: Synthetic peptide
TSRQSFV

SEQ ID NO: 28708 - protein, 7 aa, Artificial Sequence
  Description of Artificial Sequence: Synthetic peptide
RSPSTNP

SEQ ID NO: 28709 - protein, 7 aa, Artificial Sequence
  Description of Artificial Sequence: Synthetic peptide
CSSGRQS

SEQ ID NO: 28710 - protein, 7 aa, Artificial Sequence
  Description of Artificial Sequence: Synthetic peptide
RNRESIA

SEQ ID NO: 28711 - protein, 7 aa, Artificial Sequence
  Description of Artificial Sequence: Synthetic peptide
ARTNSAP

SEQ ID NO: 28712 - protein, 7 aa, Artificial Sequence
  Description of Artificial Sequence: Synthetic peptide
VSGMSGS

SEQ ID NO: 28713 - protein, 7 aa, Artificial Sequence
  Description of Artificial Sequence: Synthetic peptide
QLSGARS

SEQ ID NO: 28714 - protein, 7 aa, Artificial Sequence
  Description of Artificial Sequence: Synthetic peptide
NSASLNH

SEQ ID NO: 28715 - protein, 7 aa, Artificial Sequence
  Description of Artificial Sequence: Synthetic peptide
PSTNRTG

SEQ ID NO: 28716 - protein, 7 aa, Artificial Sequence
  Description of Artificial Sequence: Synthetic peptide
CLPGAAM

SEQ ID NO: 28717 - protein, 7 aa, Artificial Sequence
  Description of Artificial Sequence: Synthetic peptide
AGAGKVY

SEQ ID NO: 28718 - protein, 7 aa, Artificial Sequence
  Description of Artificial Sequence: Synthetic peptide
SLGSRPS

SEQ ID NO: 28719 - protein, 7 aa, Artificial Sequence
  Description of Artificial Sequence: Synthetic peptide
SIGKGYN

SEQ ID NO: 28720 - protein, 7 aa, Artificial Sequence
  Description of Artificial Sequence: Synthetic peptide
DKTNLSS

SEQ ID NO: 28721 - protein, 7 aa, Artificial Sequence
  Description of Artificial Sequence: Synthetic peptide
SLSKSQS

SEQ ID NO: 28722 - protein, 7 aa, Artificial Sequence
  Description of Artificial Sequence: Synthetic peptide
VRTAGSD

SEQ ID NO: 28723 - protein, 7 aa, Artificial Sequence
  Description of Artificial Sequence: Synthetic peptide
DQNRVPY

SEQ ID NO: 28724 - protein, 7 aa, Artificial Sequence
  Description of Artificial Sequence: Synthetic peptide
SGRQDVL

SEQ ID NO: 28725 - protein, 7 aa, Artificial Sequence
  Description of Artificial Sequence: Synthetic peptide
RQYTGDS

SEQ ID NO: 28726 - protein, 7 aa, Artificial Sequence
  Description of Artificial Sequence: Synthetic peptide
HRDTNGK

SEQ ID NO: 28727 - protein, 7 aa, Artificial Sequence
  Description of Artificial Sequence: Synthetic peptide
GLMAQRS

SEQ ID NO: 28728 - protein, 7 aa, Artificial Sequence
  Description of Artificial Sequence: Synthetic peptide
PGLSNSR

SEQ ID NO: 28729 - protein, 7 aa, Artificial Sequence
  Description of Artificial Sequence: Synthetic peptide
AIPGTMA

SEQ ID NO: 28730 - protein, 7 aa, Artificial Sequence
  Description of Artificial Sequence: Synthetic peptide
PGLRDTA

SEQ ID NO: 28731 - protein, 7 aa, Artificial Sequence
  Description of Artificial Sequence: Synthetic peptide
SGPQIIR

SEQ ID NO: 28732 - protein, 7 aa, Artificial Sequence
  Description of Artificial Sequence: Synthetic peptide
RLPQMTC

SEQ ID NO: 28733 - protein, 7 aa, Artificial Sequence
  Description of Artificial Sequence: Synthetic peptide
SSTPRSV

SEQ ID NO: 28734 - protein, 7 aa, Artificial Sequence
  Description of Artificial Sequence: Synthetic peptide
LNRGNGS

SEQ ID NO: 28735 - protein, 7 aa, Artificial Sequence
  Description of Artificial Sequence: Synthetic peptide
PSTRQSN

SEQ ID NO: 28736 - protein, 7 aa, Artificial Sequence
  Description of Artificial Sequence: Synthetic peptide
ARVGSIS

SEQ ID NO: 28737 - protein, 7 aa, Artificial Sequence
  Description of Artificial Sequence: Synthetic peptide
NRLTNVS

SEQ ID NO: 28738 - protein, 7 aa, Artificial Sequence
  Description of Artificial Sequence: Synthetic peptide
QTHAPTS

SEQ ID NO: 28739 - protein, 7 aa, Artificial Sequence
  Description of Artificial Sequence: Synthetic peptide
SGNLQHA

SEQ ID NO: 28740 - protein, 7 aa, Artificial Sequence
  Description of Artificial Sequence: Synthetic peptide
RTTNATY

SEQ ID NO: 28741 - protein, 7 aa, Artificial Sequence
  Description of Artificial Sequence: Synthetic peptide
AQARLMN

SEQ ID NO: 28742 - protein, 7 aa, Artificial Sequence
  Description of Artificial Sequence: Synthetic peptide
AGAGMYA

SEQ ID NO: 28743 - protein, 7 aa, Artificial Sequence
  Description of Artificial Sequence: Synthetic peptide
NRLPATK

SEQ ID NO: 28744 - protein, 7 aa, Artificial Sequence
  Description of Artificial Sequence: Synthetic peptide
YGDGKSY

SEQ ID NO: 28745 - protein, 7 aa, Artificial Sequence
  Description of Artificial Sequence: Synthetic peptide
STSNGTL

SEQ ID NO: 28746 - protein, 7 aa, Artificial Sequence
  Description of Artificial Sequence: Synthetic peptide
FGTNKVD

SEQ ID NO: 28747 - protein, 7 aa, Artificial Sequence
  Description of Artificial Sequence: Synthetic peptide
ISNRSSS

SEQ ID NO: 28748 - protein, 7 aa, Artificial Sequence
  Description of Artificial Sequence: Synthetic peptide
FVSGKVQ

SEQ ID NO: 28749 - protein, 7 aa, Artificial Sequence
  Description of Artificial Sequence: Synthetic peptide
IAGQSYR

SEQ ID NO: 28750 - protein, 7 aa, Artificial Sequence
  Description of Artificial Sequence: Synthetic peptide
RSYDKSS

SEQ ID NO: 28751 - protein, 7 aa, Artificial Sequence
  Description of Artificial Sequence: Synthetic peptide
AQVDKRS

SEQ ID NO: 28752 - protein, 7 aa, Artificial Sequence
  Description of Artificial Sequence: Synthetic peptide
RSYEGMQ

SEQ ID NO: 28753 - protein, 7 aa, Artificial Sequence
  Description of Artificial Sequence: Synthetic peptide
VPITSRQ

SEQ ID NO: 28754 - protein, 7 aa, Artificial Sequence
  Description of Artificial Sequence: Synthetic peptide
HNSGNGS

SEQ ID NO: 28755 - protein, 7 aa, Artificial Sequence
  Description of Artificial Sequence: Synthetic peptide
SSGVTGR

SEQ ID NO: 28756 - protein, 7 aa, Artificial Sequence
  Description of Artificial Sequence: Synthetic peptide
SSEQTTR

SEQ ID NO: 28757 - protein, 7 aa, Artificial Sequence
  Description of Artificial Sequence: Synthetic peptide
IPHAGTA

SEQ ID NO: 28758 - protein, 7 aa, Artificial Sequence
  Description of Artificial Sequence: Synthetic peptide
HVSGPRL

SEQ ID NO: 28759 - protein, 7 aa, Artificial Sequence
  Description of Artificial Sequence: Synthetic peptide
VSHQTVL

SEQ ID NO: 28760 - protein, 7 aa, Artificial Sequence
  Description of Artificial Sequence: Synthetic peptide
RIPPQQD

SEQ ID NO: 28761 - protein, 7 aa, Artificial Sequence
  Description of Artificial Sequence: Synthetic peptide
QEARVYS

SEQ ID NO: 28762 - protein, 7 aa, Artificial Sequence
  Description of Artificial Sequence: Synthetic peptide
QMKHLQV

SEQ ID NO: 28763 - protein, 7 aa, Artificial Sequence
  Description of Artificial Sequence: Synthetic peptide
AVQAQRT

SEQ ID NO: 28764 - protein, 7 aa, Artificial Sequence
  Description of Artificial Sequence: Synthetic peptide
RVMRESQ

SEQ ID NO: 28765 - protein, 7 aa, Artificial Sequence
  Description of Artificial Sequence: Synthetic peptide
SDPPPGQ

SEQ ID NO: 28766 - protein, 7 aa, Artificial Sequence
  Description of Artificial Sequence: Synthetic peptide
GAKESQS

SEQ ID NO: 28767 - protein, 7 aa, Artificial Sequence
  Description of Artificial Sequence: Synthetic peptide
RTNKSVT

SEQ ID NO: 28768 - protein, 7 aa, Artificial Sequence
  Description of Artificial Sequence: Synthetic peptide
LSTSRTA

SEQ ID NO: 28769 - protein, 7 aa, Artificial Sequence
  Description of Artificial Sequence: Synthetic peptide
STPIRSV

SEQ ID NO: 28770 - protein, 7 aa, Artificial Sequence
  Description of Artificial Sequence: Synthetic peptide
DRAGKQS

SEQ ID NO: 28771 - protein, 7 aa, Artificial Sequence
  Description of Artificial Sequence: Synthetic peptide
TRNQSVT

SEQ ID NO: 28772 - protein, 7 aa, Artificial Sequence
  Description of Artificial Sequence: Synthetic peptide
ERAGLNS

SEQ ID NO: 28773 - protein, 7 aa, Artificial Sequence
  Description of Artificial Sequence: Synthetic peptide
NFTTSGQ

SEQ ID NO: 28774 - protein, 7 aa, Artificial Sequence
  Description of Artificial Sequence: Synthetic peptide
SQQSPSM

SEQ ID NO: 28775 - protein, 7 aa, Artificial Sequence
  Description of Artificial Sequence: Synthetic peptide
RTSEHDR

SEQ ID NO: 28776 - protein, 7 aa, Artificial Sequence
  Description of Artificial Sequence: Synthetic peptide
FRQTSGN

SEQ ID NO: 28777 - protein, 7 aa, Artificial Sequence
  Description of Artificial Sequence: Synthetic peptide
FRNTHSE

SEQ ID NO: 28778 - protein, 7 aa, Artificial Sequence
  Description of Artificial Sequence: Synthetic peptide
GPNISLG

SEQ ID NO: 28779 - protein, 7 aa, Artificial Sequence
  Description of Artificial Sequence: Synthetic peptide
MGQVGVR

SEQ ID NO: 28780 - protein, 7 aa, Artificial Sequence
  Description of Artificial Sequence: Synthetic peptide
VNMRNTM

SEQ ID NO: 28781 - protein, 7 aa, Artificial Sequence
  Description of Artificial Sequence: Synthetic peptide
TNGGRVT

SEQ ID NO: 28782 - protein, 7 aa, Artificial Sequence
  Description of Artificial Sequence: Synthetic peptide
SRVDVRS

SEQ ID NO: 28783 - protein, 7 aa, Artificial Sequence
  Description of Artificial Sequence: Synthetic peptide
KVHRSDN

SEQ ID NO: 28784 - protein, 7 aa, Artificial Sequence
  Description of Artificial Sequence: Synthetic peptide
STPHHTT

SEQ ID NO: 28785 - protein, 7 aa, Artificial Sequence
  Description of Artificial Sequence: Synthetic peptide
PLPNRNQ

SEQ ID NO: 28786 - protein, 7 aa, Artificial Sequence
  Description of Artificial Sequence: Synthetic peptide
VSSPRMS

SEQ ID NO: 28787 - protein, 7 aa, Artificial Sequence
  Description of Artificial Sequence: Synthetic peptide
PKGAHVT

SEQ ID NO: 28788 - protein, 7 aa, Artificial Sequence
  Description of Artificial Sequence: Synthetic peptide
SYPQQSA

SEQ ID NO: 28789 - protein, 7 aa, Artificial Sequence
  Description of Artificial Sequence: Synthetic peptide
GTNTGIV

SEQ ID NO: 28790 - protein, 7 aa, Artificial Sequence
  Description of Artificial Sequence: Synthetic peptide
PITHPLR

SEQ ID NO: 28791 - protein, 7 aa, Artificial Sequence
  Description of Artificial Sequence: Synthetic peptide
GLHSVAK

SEQ ID NO: 28792 - protein, 7 aa, Artificial Sequence
  Description of Artificial Sequence: Synthetic peptide
PSARMSG

SEQ ID NO: 28793 - protein, 7 aa, Artificial Sequence
  Description of Artificial Sequence: Synthetic peptide
NRVTQSS

SEQ ID NO: 28794 - protein, 7 aa, Artificial Sequence
  Description of Artificial Sequence: Synthetic peptide
SLPNTNG

SEQ ID NO: 28795 - protein, 7 aa, Artificial Sequence
  Description of Artificial Sequence: Synthetic peptide
SGGGTRT

SEQ ID NO: 28796 - protein, 7 aa, Artificial Sequence
  Description of Artificial Sequence: Synthetic peptide
VNLSPNH

SEQ ID NO: 28797 - protein, 7 aa, Artificial Sequence
  Description of Artificial Sequence: Synthetic peptide
VTHGPSH

SEQ ID NO: 28798 - protein, 7 aa, Artificial Sequence
  Description of Artificial Sequence: Synthetic peptide
LLNSTGM

SEQ ID NO: 28799 - protein, 7 aa, Artificial Sequence
  Description of Artificial Sequence: Synthetic peptide
NSVVSVS

SEQ ID NO: 28800 - protein, 7 aa, Artificial Sequence
  Description of Artificial Sequence: Synthetic peptide
VRGSSNG

SEQ ID NO: 28801 - protein, 7 aa, Artificial Sequence
  Description of Artificial Sequence: Synthetic peptide
SVNTKAL

SEQ ID NO: 28802 - protein, 7 aa, Artificial Sequence
  Description of Artificial Sequence: Synthetic peptide
RLEGSMA

SEQ ID NO: 28803 - protein, 7 aa, Artificial Sequence
  Description of Artificial Sequence: Synthetic peptide
LGNAHQL

SEQ ID NO: 28804 - protein, 7 aa, Artificial Sequence
  Description of Artificial Sequence: Synthetic peptide
MSDTSTR

SEQ ID NO: 28805 - protein, 7 aa, Artificial Sequence
  Description of Artificial Sequence: Synthetic peptide
STSRVLN

SEQ ID NO: 28806 - protein, 7 aa, Artificial Sequence
  Description of Artificial Sequence: Synthetic peptide
DRLGNTM

SEQ ID NO: 28807 - protein, 7 aa, Artificial Sequence
  Description of Artificial Sequence: Synthetic peptide
QNLPRTC

SEQ ID NO: 28808 - protein, 7 aa, Artificial Sequence
  Description of Artificial Sequence: Synthetic peptide
EGSSGRR

SEQ ID NO: 28809 - protein, 7 aa, Artificial Sequence
  Description of Artificial Sequence: Synthetic peptide
RLSNAYA

SEQ ID NO: 28810 - protein, 7 aa, Artificial Sequence
  Description of Artificial Sequence: Synthetic peptide
TGLSHMG

SEQ ID NO: 28811 - protein, 7 aa, Artificial Sequence
  Description of Artificial Sequence: Synthetic peptide
STSGTSS

SEQ ID NO: 28812 - protein, 7 aa, Artificial Sequence
  Description of Artificial Sequence: Synthetic peptide
ERNGNFT

SEQ ID NO: 28813 - protein, 7 aa, Artificial Sequence
  Description of Artificial Sequence: Synthetic peptide
GRLNMLS

SEQ ID NO: 28814 - protein, 7 aa, Artificial Sequence
  Description of Artificial Sequence: Synthetic peptide
CSQRQCN

SEQ ID NO: 28815 - protein, 7 aa, Artificial Sequence
  Description of Artificial Sequence: Synthetic peptide
FNQAGVN

SEQ ID NO: 28816 - protein, 7 aa, Artificial Sequence
  Description of Artificial Sequence: Synthetic peptide
TGNASRV

SEQ ID NO: 28817 - protein, 7 aa, Artificial Sequence
  Description of Artificial Sequence: Synthetic peptide
GSTGQLM

SEQ ID NO: 28818 - protein, 7 aa, Artificial Sequence
  Description of Artificial Sequence: Synthetic peptide
YASGKHS

SEQ ID NO: 28819 - protein, 7 aa, Artificial Sequence
  Description of Artificial Sequence: Synthetic peptide
SRNTLGS

SEQ ID NO: 28820 - protein, 7 aa, Artificial Sequence
  Description of Artificial Sequence: Synthetic peptide
NGYGQNQ

SEQ ID NO: 28821 - protein, 7 aa, Artificial Sequence
  Description of Artificial Sequence: Synthetic peptide
SANLHGK

SEQ ID NO: 28822 - protein, 7 aa, Artificial Sequence
  Description of Artificial Sequence: Synthetic peptide
DVNPSAK

SEQ ID NO: 28823 - protein, 7 aa, Artificial Sequence
  Description of Artificial Sequence: Synthetic peptide
SLTTQNS

SEQ ID NO: 28824 - protein, 7 aa, Artificial Sequence
  Description of Artificial Sequence: Synthetic peptide
SKSVAQS

SEQ ID NO: 28825 - protein, 7 aa, Artificial Sequence
  Description of Artificial Sequence: Synthetic peptide
HASTPAR

SEQ ID NO: 28826 - protein, 7 aa, Artificial Sequence
  Description of Artificial Sequence: Synthetic peptide
YQMTTPQ

SEQ ID NO: 28827 - protein, 7 aa, Artificial Sequence
  Description of Artificial Sequence: Synthetic peptide
PSHGPPA

SEQ ID NO: 28828 - protein, 7 aa, Artificial Sequence
  Description of Artificial Sequence: Synthetic peptide
TYSSKAD

SEQ ID NO: 28829 - protein, 7 aa, Artificial Sequence
  Description of Artificial Sequence: Synthetic peptide
PVTRSKD

SEQ ID NO: 28830 - protein, 7 aa, Artificial Sequence
  Description of Artificial Sequence: Synthetic peptide
TQMGKSN

SEQ ID NO: 28831 - protein, 7 aa, Artificial Sequence
  Description of Artificial Sequence: Synthetic peptide
FGSRNEG

SEQ ID NO: 28832 - protein, 7 aa, Artificial Sequence
  Description of Artificial Sequence: Synthetic peptide
GSHTNTS

SEQ ID NO: 28833 - protein, 7 aa, Artificial Sequence
  Description of Artificial Sequence: Synthetic peptide
GAYNHVT

SEQ ID NO: 28834 - protein, 7 aa, Artificial Sequence
  Description of Artificial Sequence: Synthetic peptide
PYQSHSP

SEQ ID NO: 28835 - protein, 7 aa, Artificial Sequence
  Description of Artificial Sequence: Synthetic peptide
GSISTAH

SEQ ID NO: 28836 - protein, 7 aa, Artificial Sequence
  Description of Artificial Sequence: Synthetic peptide
GRDTRSS

SEQ ID NO: 28837 - protein, 7 aa, Artificial Sequence
  Description of Artificial Sequence: Synthetic peptide
YGQTKTQ

SEQ ID NO: 28838 - protein, 7 aa, Artificial Sequence
  Description of Artificial Sequence: Synthetic peptide
TTAPGLR

SEQ ID NO: 28839 - protein, 7 aa, Artificial Sequence
  Description of Artificial Sequence: Synthetic peptide
TKYEGYT

SEQ ID NO: 28840 - protein, 7 aa, Artificial Sequence
  Description of Artificial Sequence: Synthetic peptide
TNAARDS

SEQ ID NO: 28841 - protein, 7 aa, Artificial Sequence
  Description of Artificial Sequence: Synthetic peptide
IQQGSRT

SEQ ID NO: 28842 - protein, 7 aa, Artificial Sequence
  Description of Artificial Sequence: Synthetic peptide
HRSGNQG

SEQ ID NO: 28843 - protein, 7 aa, Artificial Sequence
  Description of Artificial Sequence: Synthetic peptide
SPMRSQV

SEQ ID NO: 28844 - protein, 7 aa, Artificial Sequence
  Description of Artificial Sequence: Synthetic peptide
ARSPPSG

SEQ ID NO: 28845 - protein, 7 aa, Artificial Sequence
  Description of Artificial Sequence: Synthetic peptide
EPSRSST

SEQ ID NO: 28846 - protein, 7 aa, Artificial Sequence
  Description of Artificial Sequence: Synthetic peptide
SSPQAHN

SEQ ID NO: 28847 - protein, 7 aa, Artificial Sequence
  Description of Artificial Sequence: Synthetic peptide
VSYARTE

SEQ ID NO: 28848 - protein, 7 aa, Artificial Sequence
  Description of Artificial Sequence: Synthetic peptide
SSGLGFS

SEQ ID NO: 28849 - protein, 7 aa, Artificial Sequence
  Description of Artificial Sequence: Synthetic peptide
RYTGQSS

SEQ ID NO: 28850 - protein, 7 aa, Artificial Sequence
  Description of Artificial Sequence: Synthetic peptide
PARSTLS

SEQ ID NO: 28851 - protein, 7 aa, Artificial Sequence
  Description of Artificial Sequence: Synthetic peptide
SGGSSVL

SEQ ID NO: 28852 - protein, 7 aa, Artificial Sequence
  Description of Artificial Sequence: Synthetic peptide
SSRSTAS

SEQ ID NO: 28853 - protein, 7 aa, Artificial Sequence
  Description of Artificial Sequence: Synthetic peptide
SAYERTS

SEQ ID NO: 28854 - protein, 7 aa, Artificial Sequence
  Description of Artificial Sequence: Synthetic peptide
TANSPAT

SEQ ID NO: 28855 - protein, 7 aa, Artificial Sequence
  Description of Artificial Sequence: Synthetic peptide
PVNLQNG

SEQ ID NO: 28856 - protein, 7 aa, Artificial Sequence
  Description of Artificial Sequence: Synthetic peptide
MTPGRVA

SEQ ID NO: 28857 - protein, 7 aa, Artificial Sequence
  Description of Artificial Sequence: Synthetic peptide
PYAPRKD

SEQ ID NO: 28858 - protein, 7 aa, Artificial Sequence
  Description of Artificial Sequence: Synthetic peptide
ISQSTTR

SEQ ID NO: 28859 - protein, 7 aa, Artificial Sequence
  Description of Artificial Sequence: Synthetic peptide
EKLRTSQ

SEQ ID NO: 28860 - protein, 7 aa, Artificial Sequence
  Description of Artificial Sequence: Synthetic peptide
VNKINGS

SEQ ID NO: 28861 - protein, 7 aa, Artificial Sequence
  Description of Artificial Sequence: Synthetic peptide
NRSNNSV

SEQ ID NO: 28862 - protein, 7 aa, Artificial Sequence
  Description of Artificial Sequence: Synthetic peptide
CQSSRVT

SEQ ID NO: 28863 - protein, 7 aa, Artificial Sequence
  Description of Artificial Sequence: Synthetic peptide
TQGASNL

SEQ ID NO: 28864 - protein, 7 aa, Artificial Sequence
  Description of Artificial Sequence: Synthetic peptide
NTTGSGL

SEQ ID NO: 28865 - protein, 7 aa, Artificial Sequence
  Description of Artificial Sequence: Synthetic peptide
EIRAHTT

SEQ ID NO: 28866 - protein, 7 aa, Artificial Sequence
  Description of Artificial Sequence: Synthetic peptide
SLPGESK

SEQ ID NO: 28867 - protein, 7 aa, Artificial Sequence
  Description of Artificial Sequence: Synthetic peptide
ITGNRHS

SEQ ID NO: 28868 - protein, 7 aa, Artificial Sequence
  Description of Artificial Sequence: Synthetic peptide
NSGPPKP

SEQ ID NO: 28869 - protein, 7 aa, Artificial Sequence
  Description of Artificial Sequence: Synthetic peptide
WSKGSGT

SEQ ID NO: 28870 - protein, 7 aa, Artificial Sequence
  Description of Artificial Sequence: Synthetic peptide
SGAPGSS

SEQ ID NO: 28871 - protein, 7 aa, Artificial Sequence
  Description of Artificial Sequence: Synthetic peptide
SISKTQA

SEQ ID NO: 28872 - protein, 7 aa, Artificial Sequence
  Description of Artificial Sequence: Synthetic peptide
ENTKTYS

SEQ ID NO: 28873 - protein, 7 aa, Artificial Sequence
  Description of Artificial Sequence: Synthetic peptide
KELGSPS

SEQ ID NO: 28874 - protein, 7 aa, Artificial Sequence
  Description of Artificial Sequence: Synthetic peptide
YRASGIS

SEQ ID NO: 28875 - protein, 7 aa, Artificial Sequence
  Description of Artificial Sequence: Synthetic peptide
VHGNPRN

SEQ ID NO: 28876 - protein, 7 aa, Artificial Sequence
  Description of Artificial Sequence: Synthetic peptide
HKHPNAY

SEQ ID NO: 28877 - protein, 7 aa, Artificial Sequence
  Description of Artificial Sequence: Synthetic peptide
QGHTRFT

SEQ ID NO: 28878 - protein, 7 aa, Artificial Sequence
  Description of Artificial Sequence: Synthetic peptide
TGRGPDV

SEQ ID NO: 28879 - protein, 7 aa, Artificial Sequence
  Description of Artificial Sequence: Synthetic peptide
PDSLHAN

SEQ ID NO: 28880 - protein, 7 aa, Artificial Sequence
  Description of Artificial Sequence: Synthetic peptide
TQNTKSI

SEQ ID NO: 28881 - protein, 7 aa, Artificial Sequence
  Description of Artificial Sequence: Synthetic peptide
SNLPRNL

SEQ ID NO: 28882 - protein, 7 aa, Artificial Sequence
  Description of Artificial Sequence: Synthetic peptide
NGPGQNQ

SEQ ID NO: 28883 - protein, 7 aa, Artificial Sequence
  Description of Artificial Sequence: Synthetic peptide
LGTTQPK

SEQ ID NO: 28884 - protein, 7 aa, Artificial Sequence
  Description of Artificial Sequence: Synthetic peptide
PLASPMV

SEQ ID NO: 28885 - protein, 7 aa, Artificial Sequence
  Description of Artificial Sequence: Synthetic peptide
LGPGKNT

SEQ ID NO: 28886 - protein, 7 aa, Artificial Sequence
  Description of Artificial Sequence: Synthetic peptide
GHGNKGA

SEQ ID NO: 28887 - protein, 7 aa, Artificial Sequence
  Description of Artificial Sequence: Synthetic peptide
PSIPRNV

SEQ ID NO: 28888 - protein, 7 aa, Artificial Sequence
  Description of Artificial Sequence: Synthetic peptide
NLHATPL

SEQ ID NO: 28889 - protein, 7 aa, Artificial Sequence
  Description of Artificial Sequence: Synthetic peptide
VLHNASS

SEQ ID NO: 28890 - protein, 7 aa, Artificial Sequence
  Description of Artificial Sequence: Synthetic peptide
QLGTNNS

SEQ ID NO: 28891 - protein, 7 aa, Artificial Sequence
  Description of Artificial Sequence: Synthetic peptide
NNRSGMG

SEQ ID NO: 28892 - protein, 7 aa, Artificial Sequence
  Description of Artificial Sequence: Synthetic peptide
GANTNPG

SEQ ID NO: 28893 - protein, 7 aa, Artificial Sequence
  Description of Artificial Sequence: Synthetic peptide
RPQTSIS

SEQ ID NO: 28894 - protein, 7 aa, Artificial Sequence
  Description of Artificial Sequence: Synthetic peptide
VPVTKSS

SEQ ID NO: 28895 - protein, 7 aa, Artificial Sequence
  Description of Artificial Sequence: Synthetic peptide
YRNVNSS

SEQ ID NO: 28896 - protein, 7 aa, Artificial Sequence
  Description of Artificial Sequence: Synthetic peptide
VQTHQVR

SEQ ID NO: 28897 - protein, 7 aa, Artificial Sequence
  Description of Artificial Sequence: Synthetic peptide
VATRGDH

SEQ ID NO: 28898 - protein, 7 aa, Artificial Sequence
  Description of Artificial Sequence: Synthetic peptide
TGMRNIG

SEQ ID NO: 28899 - protein, 7 aa, Artificial Sequence
  Description of Artificial Sequence: Synthetic peptide
REPARGD

SEQ ID NO: 28900 - protein, 7 aa, Artificial Sequence
  Description of Artificial Sequence: Synthetic peptide
GAERTVL

SEQ ID NO: 28901 - protein, 7 aa, Artificial Sequence
  Description of Artificial Sequence: Synthetic peptide
KADATRT

SEQ ID NO: 28902 - protein, 7 aa, Artificial Sequence
  Description of Artificial Sequence: Synthetic peptide
DNHSTLI

SEQ ID NO: 28903 - protein, 7 aa, Artificial Sequence
  Description of Artificial Sequence: Synthetic peptide
RNTSDLA

SEQ ID NO: 28904 - protein, 7 aa, Artificial Sequence
  Description of Artificial Sequence: Synthetic peptide
TKGGSQL

SEQ ID NO: 28905 - protein, 7 aa, Artificial Sequence
  Description of Artificial Sequence: Synthetic peptide
IHQGSSR

SEQ ID NO: 28906 - protein, 7 aa, Artificial Sequence
  Description of Artificial Sequence: Synthetic peptide
NGVPQPK

SEQ ID NO: 28907 - protein, 7 aa, Artificial Sequence
  Description of Artificial Sequence: Synthetic peptide
NNLAGSK

SEQ ID NO: 28908 - protein, 7 aa, Artificial Sequence
  Description of Artificial Sequence: Synthetic peptide
AISRQGM

SEQ ID NO: 28909 - protein, 7 aa, Artificial Sequence
  Description of Artificial Sequence: Synthetic peptide
PANSPAT

SEQ ID NO: 28910 - protein, 7 aa, Artificial Sequence
  Description of Artificial Sequence: Synthetic peptide
RERTGFN

SEQ ID NO: 28911 - protein, 7 aa, Artificial Sequence
  Description of Artificial Sequence: Synthetic peptide
PLSKSAL

SEQ ID NO: 28912 - protein, 7 aa, Artificial Sequence
  Description of Artificial Sequence: Synthetic peptide
GDKNHGS

SEQ ID NO: 28913 - protein, 7 aa, Artificial Sequence
  Description of Artificial Sequence: Synthetic peptide
NNSISNP

SEQ ID NO: 28914 - protein, 7 aa, Artificial Sequence
  Description of Artificial Sequence: Synthetic peptide
IHATSLA

SEQ ID NO: 28915 - protein, 7 aa, Artificial Sequence
  Description of Artificial Sequence: Synthetic peptide
CAGLSSS

SEQ ID NO: 28916 - protein, 7 aa, Artificial Sequence
  Description of Artificial Sequence: Synthetic peptide
DLPHHTR

SEQ ID NO: 28917 - protein, 7 aa, Artificial Sequence
  Description of Artificial Sequence: Synthetic peptide
VSRSATN

SEQ ID NO: 28918 - protein, 7 aa, Artificial Sequence
  Description of Artificial Sequence: Synthetic peptide
AKTAKNV

SEQ ID NO: 28919 - protein, 7 aa, Artificial Sequence
  Description of Artificial Sequence: Synthetic peptide
GSFKPDS

SEQ ID NO: 28920 - protein, 7 aa, Artificial Sequence
  Description of Artificial Sequence: Synthetic peptide
PLGNRPS

SEQ ID NO: 28921 - protein, 7 aa, Artificial Sequence
  Description of Artificial Sequence: Synthetic peptide
NLNSVSK

SEQ ID NO: 28922 - protein, 7 aa, Artificial Sequence
  Description of Artificial Sequence: Synthetic peptide
RPYETQL

SEQ ID NO: 28923 - protein, 7 aa, Artificial Sequence
  Description of Artificial Sequence: Synthetic peptide
NANQNQM

SEQ ID NO: 28924 - protein, 7 aa, Artificial Sequence
  Description of Artificial Sequence: Synthetic peptide
DGKSPRV

SEQ ID NO: 28925 - protein, 7 aa, Artificial Sequence
  Description of Artificial Sequence: Synthetic peptide
PVGSVRG

SEQ ID NO: 28926 - protein, 7 aa, Artificial Sequence
  Description of Artificial Sequence: Synthetic peptide
NGSGHNQ

SEQ ID NO: 28927 - protein, 7 aa, Artificial Sequence
  Description of Artificial Sequence: Synthetic peptide
TLPTSIR

SEQ ID NO: 28928 - protein, 7 aa, Artificial Sequence
  Description of Artificial Sequence: Synthetic peptide
RDRTNAA

SEQ ID NO: 28929 - protein, 7 aa, Artificial Sequence
  Description of Artificial Sequence: Synthetic peptide
NNGRPIA

SEQ ID NO: 28930 - protein, 7 aa, Artificial Sequence
  Description of Artificial Sequence: Synthetic peptide
SSPVRNT

SEQ ID NO: 28931 - protein, 7 aa, Artificial Sequence
  Description of Artificial Sequence: Synthetic peptide
GKTNVSS

SEQ ID NO: 28932 - protein, 7 aa, Artificial Sequence
  Description of Artificial Sequence: Synthetic peptide
EPVPKTR

SEQ ID NO: 28933 - protein, 7 aa, Artificial Sequence
  Description of Artificial Sequence: Synthetic peptide
QGRANGS

SEQ ID NO: 28934 - protein, 7 aa, Artificial Sequence
  Description of Artificial Sequence: Synthetic peptide
PGSGSNN

SEQ ID NO: 28935 - protein, 7 aa, Artificial Sequence
  Description of Artificial Sequence: Synthetic peptide
LGVRDNT

SEQ ID NO: 28936 - protein, 7 aa, Artificial Sequence
  Description of Artificial Sequence: Synthetic peptide
NSVAGMG

SEQ ID NO: 28937 - protein, 7 aa, Artificial Sequence
  Description of Artificial Sequence: Synthetic peptide
VNENRVS

SEQ ID NO: 28938 - protein, 7 aa, Artificial Sequence
  Description of Artificial Sequence: Synthetic peptide
GKTGPNS

SEQ ID NO: 28939 - protein, 7 aa, Artificial Sequence
  Description of Artificial Sequence: Synthetic peptide
GLESMRQ

SEQ ID NO: 28940 - protein, 7 aa, Artificial Sequence
  Description of Artificial Sequence: Synthetic peptide
GGHPPTS

SEQ ID NO: 28941 - protein, 7 aa, Artificial Sequence
  Description of Artificial Sequence: Synthetic peptide
ASVSQRS

SEQ ID NO: 28942 - protein, 7 aa, Artificial Sequence
  Description of Artificial Sequence: Synthetic peptide
SNTNAAM

SEQ ID NO: 28943 - protein, 7 aa, Artificial Sequence
  Description of Artificial Sequence: Synthetic peptide
RMGVSNT

SEQ ID NO: 28944 - protein, 7 aa, Artificial Sequence
  Description of Artificial Sequence: Synthetic peptide
ALAYNKG

SEQ ID NO: 28945 - protein, 7 aa, Artificial Sequence
  Description of Artificial Sequence: Synthetic peptide
KIGSMSG

SEQ ID NO: 28946 - protein, 7 aa, Artificial Sequence
  Description of Artificial Sequence: Synthetic peptide
GASSYMK

SEQ ID NO: 28947 - protein, 7 aa, Artificial Sequence
  Description of Artificial Sequence: Synthetic peptide
RVATNNP

SEQ ID NO: 28948 - protein, 7 aa, Artificial Sequence
  Description of Artificial Sequence: Synthetic peptide
RVTDAHL

SEQ ID NO: 28949 - protein, 7 aa, Artificial Sequence
  Description of Artificial Sequence: Synthetic peptide
YRSKPLT

SEQ ID NO: 28950 - protein, 7 aa, Artificial Sequence
  Description of Artificial Sequence: Synthetic peptide
PQSSHQT

SEQ ID NO: 28951 - protein, 7 aa, Artificial Sequence
  Description of Artificial Sequence: Synthetic peptide
NGSQGRQ

SEQ ID NO: 28952 - protein, 7 aa, Artificial Sequence
  Description of Artificial Sequence: Synthetic peptide
GSLGGLN

SEQ ID NO: 28953 - protein, 7 aa, Artificial Sequence
  Description of Artificial Sequence: Synthetic peptide
QSTPRMG

SEQ ID NO: 28954 - protein, 7 aa, Artificial Sequence
  Description of Artificial Sequence: Synthetic peptide
PHQGKHN

SEQ ID NO: 28955 - protein, 7 aa, Artificial Sequence
  Description of Artificial Sequence: Synthetic peptide
GSGNKVN

SEQ ID NO: 28956 - protein, 7 aa, Artificial Sequence
  Description of Artificial Sequence: Synthetic peptide
SLRGSTA

SEQ ID NO: 28957 - protein, 7 aa, Artificial Sequence
  Description of Artificial Sequence: Synthetic peptide
MLNSRTS

SEQ ID NO: 28958 - protein, 7 aa, Artificial Sequence
  Description of Artificial Sequence: Synthetic peptide
RLTQSSQ

SEQ ID NO: 28959 - protein, 7 aa, Artificial Sequence
  Description of Artificial Sequence: Synthetic peptide
VGTKAAT

SEQ ID NO: 28960 - protein, 7 aa, Artificial Sequence
  Description of Artificial Sequence: Synthetic peptide
VNTSHTN

SEQ ID NO: 28961 - protein, 7 aa, Artificial Sequence
  Description of Artificial Sequence: Synthetic peptide
SRVSLSS

SEQ ID NO: 28962 - protein, 7 aa, Artificial Sequence
  Description of Artificial Sequence: Synthetic peptide
HKTTSMA

SEQ ID NO: 28963 - protein, 7 aa, Artificial Sequence
  Description of Artificial Sequence: Synthetic peptide
PHTNNPD

SEQ ID NO: 28964 - protein, 7 aa, Artificial Sequence
  Description of Artificial Sequence: Synthetic peptide
AQRSTMV

SEQ ID NO: 28965 - protein, 7 aa, Artificial Sequence
  Description of Artificial Sequence: Synthetic peptide
PTMQGVH

SEQ ID NO: 28966 - protein, 7 aa, Artificial Sequence
  Description of Artificial Sequence: Synthetic peptide
SNLGQYG

SEQ ID NO: 28967 - protein, 7 aa, Artificial Sequence
  Description of Artificial Sequence: Synthetic peptide
PSGHDTV

SEQ ID NO: 28968 - protein, 7 aa, Artificial Sequence
  Description of Artificial Sequence: Synthetic peptide
VGRSSNP

SEQ ID NO: 28969 - protein, 7 aa, Artificial Sequence
  Description of Artificial Sequence: Synthetic peptide
GGNDRFR

SEQ ID NO: 28970 - protein, 7 aa, Artificial Sequence
  Description of Artificial Sequence: Synthetic peptide
RPKESGY

SEQ ID NO: 28971 - protein, 7 aa, Artificial Sequence
  Description of Artificial Sequence: Synthetic peptide
PGTTSAM

SEQ ID NO: 28972 - protein, 7 aa, Artificial Sequence
  Description of Artificial Sequence: Synthetic peptide
TSHVNIA

SEQ ID NO: 28973 - protein, 7 aa, Artificial Sequence
  Description of Artificial Sequence: Synthetic peptide
RTLNLNT

SEQ ID NO: 28974 - protein, 7 aa, Artificial Sequence
  Description of Artificial Sequence: Synthetic peptide
ALSSQKG

SEQ ID NO: 28975 - protein, 7 aa, Artificial Sequence
  Description of Artificial Sequence: Synthetic peptide
RSQGSYA

SEQ ID NO: 28976 - protein, 7 aa, Artificial Sequence
  Description of Artificial Sequence: Synthetic peptide
VHTSGVQ

SEQ ID NO: 28977 - protein, 7 aa, Artificial Sequence
  Description of Artificial Sequence: Synthetic peptide
EHETSSR

SEQ ID NO: 28978 - protein, 7 aa, Artificial Sequence
  Description of Artificial Sequence: Synthetic peptide
PKGVHSM

SEQ ID NO: 28979 - protein, 7 aa, Artificial Sequence
  Description of Artificial Sequence: Synthetic peptide
NGSEQNQ

SEQ ID NO: 28980 - protein, 7 aa, Artificial Sequence
  Description of Artificial Sequence: Synthetic peptide
DSRNNMT

SEQ ID NO: 28981 - protein, 7 aa, Artificial Sequence
  Description of Artificial Sequence: Synthetic peptide
ESSSSMG

SEQ ID NO: 28982 - protein, 7 aa, Artificial Sequence
  Description of Artificial Sequence: Synthetic peptide
GISTLSR

SEQ ID NO: 28983 - protein, 7 aa, Artificial Sequence
  Description of Artificial Sequence: Synthetic peptide
HKSGLVD

SEQ ID NO: 28984 - protein, 7 aa, Artificial Sequence
  Description of Artificial Sequence: Synthetic peptide
CGNAPRT

SEQ ID NO: 28985 - protein, 7 aa, Artificial Sequence
  Description of Artificial Sequence: Synthetic peptide
LTRPKII

SEQ ID NO: 28986 - protein, 7 aa, Artificial Sequence
  Description of Artificial Sequence: Synthetic peptide
HVSGKAV

SEQ ID NO: 28987 - protein, 7 aa, Artificial Sequence
  Description of Artificial Sequence: Synthetic peptide
RQVSTPL

SEQ ID NO: 28988 - protein, 7 aa, Artificial Sequence
  Description of Artificial Sequence: Synthetic peptide
HGTSPLR

SEQ ID NO: 28989 - protein, 7 aa, Artificial Sequence
  Description of Artificial Sequence: Synthetic peptide
GPLTRSG

SEQ ID NO: 28990 - protein, 7 aa, Artificial Sequence
  Description of Artificial Sequence: Synthetic peptide
QLGSTTR

SEQ ID NO: 28991 - protein, 7 aa, Artificial Sequence
  Description of Artificial Sequence: Synthetic peptide
ERTGRPG

SEQ ID NO: 28992 - protein, 7 aa, Artificial Sequence
  Description of Artificial Sequence: Synthetic peptide
GQVNHTT

SEQ ID NO: 28993 - protein, 7 aa, Artificial Sequence
  Description of Artificial Sequence: Synthetic peptide
RPDRTTL

SEQ ID NO: 28994 - protein, 7 aa, Artificial Sequence
  Description of Artificial Sequence: Synthetic peptide
PISSRAG

SEQ ID NO: 28995 - protein, 7 aa, Artificial Sequence
  Description of Artificial Sequence: Synthetic peptide
EATSSTK

SEQ ID NO: 28996 - protein, 7 aa, Artificial Sequence
  Description of Artificial Sequence: Synthetic peptide
RGAADSN

SEQ ID NO: 28997 - protein, 7 aa, Artificial Sequence
  Description of Artificial Sequence: Synthetic peptide
EPAYSVK

SEQ ID NO: 28998 - protein, 7 aa, Artificial Sequence
  Description of Artificial Sequence: Synthetic peptide
QSSQSGP

SEQ ID NO: 28999 - protein, 7 aa, Artificial Sequence
  Description of Artificial Sequence: Synthetic peptide
VPSQNRA

SEQ ID NO: 29000 - protein, 7 aa, Artificial Sequence
  Description of Artificial Sequence: Synthetic peptide
NQKTRTD

SEQ ID NO: 29001 - protein, 7 aa, Artificial Sequence
  Description of Artificial Sequence: Synthetic peptide
VNDHNVR

SEQ ID NO: 29002 - protein, 7 aa, Artificial Sequence
  Description of Artificial Sequence: Synthetic peptide
VAPPKIE

SEQ ID NO: 29003 - protein, 7 aa, Artificial Sequence
  Description of Artificial Sequence: Synthetic peptide
KVSKPAY

SEQ ID NO: 29004 - protein, 7 aa, Artificial Sequence
  Description of Artificial Sequence: Synthetic peptide
YRNIEAH

SEQ ID NO: 29005 - protein, 7 aa, Artificial Sequence
  Description of Artificial Sequence: Synthetic peptide
TTSRVSA

SEQ ID NO: 29006 - protein, 7 aa, Artificial Sequence
  Description of Artificial Sequence: Synthetic peptide
NSRVGQS

SEQ ID NO: 29007 - protein, 7 aa, Artificial Sequence
  Description of Artificial Sequence: Synthetic peptide
SSPSNMA

SEQ ID NO: 29008 - protein, 7 aa, Artificial Sequence
  Description of Artificial Sequence: Synthetic peptide
PLSKDRL

SEQ ID NO: 29009 - protein, 7 aa, Artificial Sequence
  Description of Artificial Sequence: Synthetic peptide
AGARSMQ

SEQ ID NO: 29010 - protein, 7 aa, Artificial Sequence
  Description of Artificial Sequence: Synthetic peptide
SGGDYAK

SEQ ID NO: 29011 - protein, 7 aa, Artificial Sequence
  Description of Artificial Sequence: Synthetic peptide
MGHKVEA

SEQ ID NO: 29012 - protein, 7 aa, Artificial Sequence
  Description of Artificial Sequence: Synthetic peptide
GQAMPFK

SEQ ID NO: 29013 - protein, 7 aa, Artificial Sequence
  Description of Artificial Sequence: Synthetic peptide
PVSGATI

SEQ ID NO: 29014 - protein, 7 aa, Artificial Sequence
  Description of Artificial Sequence: Synthetic peptide
GHSQSHQ

SEQ ID NO: 29015 - protein, 7 aa, Artificial Sequence
  Description of Artificial Sequence: Synthetic peptide
FGRATSG

SEQ ID NO: 29016 - protein, 7 aa, Artificial Sequence
  Description of Artificial Sequence: Synthetic peptide
SSANHPR

SEQ ID NO: 29017 - protein, 7 aa, Artificial Sequence
  Description of Artificial Sequence: Synthetic peptide
ISSGTHG

SEQ ID NO: 29018 - protein, 7 aa, Artificial Sequence
  Description of Artificial Sequence: Synthetic peptide
NIASKGP

SEQ ID NO: 29019 - protein, 7 aa, Artificial Sequence
  Description of Artificial Sequence: Synthetic peptide
PLDKSMM

SEQ ID NO: 29020 - protein, 7 aa, Artificial Sequence
  Description of Artificial Sequence: Synthetic peptide
AGSAPRV

SEQ ID NO: 29021 - protein, 7 aa, Artificial Sequence
  Description of Artificial Sequence: Synthetic peptide
RSTNDGR

SEQ ID NO: 29022 - protein, 7 aa, Artificial Sequence
  Description of Artificial Sequence: Synthetic peptide
SPSSPHD

SEQ ID NO: 29023 - protein, 7 aa, Artificial Sequence
  Description of Artificial Sequence: Synthetic peptide
STKSKPI

SEQ ID NO: 29024 - protein, 7 aa, Artificial Sequence
  Description of Artificial Sequence: Synthetic peptide
TERTKAT

SEQ ID NO: 29025 - protein, 7 aa, Artificial Sequence
  Description of Artificial Sequence: Synthetic peptide
KQTHSGS

SEQ ID NO: 29026 - protein, 7 aa, Artificial Sequence
  Description of Artificial Sequence: Synthetic peptide
ETRKQGV

SEQ ID NO: 29027 - protein, 7 aa, Artificial Sequence
  Description of Artificial Sequence: Synthetic peptide
PLPKNSS

SEQ ID NO: 29028 - protein, 7 aa, Artificial Sequence
  Description of Artificial Sequence: Synthetic peptide
RSSPASL

SEQ ID NO: 29029 - protein, 7 aa, Artificial Sequence
  Description of Artificial Sequence: Synthetic peptide
SQRALSS

SEQ ID NO: 29030 - protein, 7 aa, Artificial Sequence
  Description of Artificial Sequence: Synthetic peptide
PPQQSPL

SEQ ID NO: 29031 - protein, 7 aa, Artificial Sequence
  Description of Artificial Sequence: Synthetic peptide
KGNSGAP

SEQ ID NO: 29032 - protein, 7 aa, Artificial Sequence
  Description of Artificial Sequence: Synthetic peptide
IRLGSTN

SEQ ID NO: 29033 - protein, 7 aa, Artificial Sequence
  Description of Artificial Sequence: Synthetic peptide
PDVKVTR

SEQ ID NO: 29034 - protein, 7 aa, Artificial Sequence
  Description of Artificial Sequence: Synthetic peptide
SPGKLTT

SEQ ID NO: 29035 - protein, 7 aa, Artificial Sequence
  Description of Artificial Sequence: Synthetic peptide
GTNPSLA

SEQ ID NO: 29036 - protein, 7 aa, Artificial Sequence
  Description of Artificial Sequence: Synthetic peptide
SMVSTPM

SEQ ID NO: 29037 - protein, 7 aa, Artificial Sequence
  Description of Artificial Sequence: Synthetic peptide
PLRGGSS

SEQ ID NO: 29038 - protein, 7 aa, Artificial Sequence
  Description of Artificial Sequence: Synthetic peptide
RPRDRTD

SEQ ID NO: 29039 - protein, 7 aa, Artificial Sequence
  Description of Artificial Sequence: Synthetic peptide
PTLSGSR

SEQ ID NO: 29040 - protein, 7 aa, Artificial Sequence
  Description of Artificial Sequence: Synthetic peptide
LATSSVR

SEQ ID NO: 29041 - protein, 7 aa, Artificial Sequence
  Description of Artificial Sequence: Synthetic peptide
TTLPSSK

SEQ ID NO: 29042 - protein, 7 aa, Artificial Sequence
  Description of Artificial Sequence: Synthetic peptide
DLTNHTK

SEQ ID NO: 29043 - protein, 7 aa, Artificial Sequence
  Description of Artificial Sequence: Synthetic peptide
HTPAVGK

SEQ ID NO: 29044 - protein, 7 aa, Artificial Sequence
  Description of Artificial Sequence: Synthetic peptide
NRVKPMV

SEQ ID NO: 29045 - protein, 7 aa, Artificial Sequence
  Description of Artificial Sequence: Synthetic peptide
SGAGSAG

SEQ ID NO: 29046 - protein, 7 aa, Artificial Sequence
  Description of Artificial Sequence: Synthetic peptide
TLSSTGG

SEQ ID NO: 29047 - protein, 7 aa, Artificial Sequence
  Description of Artificial Sequence: Synthetic peptide
SLTTKAN

SEQ ID NO: 29048 - protein, 7 aa, Artificial Sequence
  Description of Artificial Sequence: Synthetic peptide
SRSNATA

SEQ ID NO: 29049 - protein, 7 aa, Artificial Sequence
  Description of Artificial Sequence: Synthetic peptide
PSSTPKL

SEQ ID NO: 29050 - protein, 7 aa, Artificial Sequence
  Description of Artificial Sequence: Synthetic peptide
RQTVSSH

SEQ ID NO: 29051 - protein, 7 aa, Artificial Sequence
  Description of Artificial Sequence: Synthetic peptide
RHESKAY

SEQ ID NO: 29052 - protein, 7 aa, Artificial Sequence
  Description of Artificial Sequence: Synthetic peptide
TTYGGNR

SEQ ID NO: 29053 - protein, 7 aa, Artificial Sequence
  Description of Artificial Sequence: Synthetic peptide
AFSHSSG

SEQ ID NO: 29054 - protein, 7 aa, Artificial Sequence
  Description of Artificial Sequence: Synthetic peptide
QETRGNS

SEQ ID NO: 29055 - protein, 7 aa, Artificial Sequence
  Description of Artificial Sequence: Synthetic peptide
DPRAQSH

SEQ ID NO: 29056 - protein, 7 aa, Artificial Sequence
  Description of Artificial Sequence: Synthetic peptide
SLGSNAN

SEQ ID NO: 29057 - protein, 7 aa, Artificial Sequence
  Description of Artificial Sequence: Synthetic peptide
GLSSGKT

SEQ ID NO: 29058 - protein, 7 aa, Artificial Sequence
  Description of Artificial Sequence: Synthetic peptide
YATDGLK

SEQ ID NO: 29059 - protein, 7 aa, Artificial Sequence
  Description of Artificial Sequence: Synthetic peptide
TQGLGHL

SEQ ID NO: 29060 - protein, 7 aa, Artificial Sequence
  Description of Artificial Sequence: Synthetic peptide
ACNTSRC

SEQ ID NO: 29061 - protein, 7 aa, Artificial Sequence
  Description of Artificial Sequence: Synthetic peptide
NNGASVV

SEQ ID NO: 29062 - protein, 7 aa, Artificial Sequence
  Description of Artificial Sequence: Synthetic peptide
KILNVGT

SEQ ID NO: 29063 - protein, 7 aa, Artificial Sequence
  Description of Artificial Sequence: Synthetic peptide
QSISHTR

SEQ ID NO: 29064 - protein, 7 aa, Artificial Sequence
  Description of Artificial Sequence: Synthetic peptide
SVQKSVN

SEQ ID NO: 29065 - protein, 7 aa, Artificial Sequence
  Description of Artificial Sequence: Synthetic peptide
RESSPSL

SEQ ID NO: 29066 - protein, 7 aa, Artificial Sequence
  Description of Artificial Sequence: Synthetic peptide
SGSGIMM

SEQ ID NO: 29067 - protein, 7 aa, Artificial Sequence
  Description of Artificial Sequence: Synthetic peptide
GSRDKST

SEQ ID NO: 29068 - protein, 7 aa, Artificial Sequence
  Description of Artificial Sequence: Synthetic peptide
SADRTSN

SEQ ID NO: 29069 - protein, 7 aa, Artificial Sequence
  Description of Artificial Sequence: Synthetic peptide
SIHSDRT

SEQ ID NO: 29070 - protein, 7 aa, Artificial Sequence
  Description of Artificial Sequence: Synthetic peptide
LRSGDVR

SEQ ID NO: 29071 - protein, 7 aa, Artificial Sequence
  Description of Artificial Sequence: Synthetic peptide
AQQRAQA

SEQ ID NO: 29072 - protein, 7 aa, Artificial Sequence
  Description of Artificial Sequence: Synthetic peptide
PAAMSSV

SEQ ID NO: 29073 - protein, 7 aa, Artificial Sequence
  Description of Artificial Sequence: Synthetic peptide
DAQRRGV

SEQ ID NO: 29074 - protein, 7 aa, Artificial Sequence
  Description of Artificial Sequence: Synthetic peptide
TMVHGNT

SEQ ID NO: 29075 - protein, 7 aa, Artificial Sequence
  Description of Artificial Sequence: Synthetic peptide
ERPGGTP

SEQ ID NO: 29076 - protein, 7 aa, Artificial Sequence
  Description of Artificial Sequence: Synthetic peptide
AGVTTVN

SEQ ID NO: 29077 - protein, 7 aa, Artificial Sequence
  Description of Artificial Sequence: Synthetic peptide
RNVDKSS

SEQ ID NO: 29078 - protein, 7 aa, Artificial Sequence
  Description of Artificial Sequence: Synthetic peptide
YIHNPTG

SEQ ID NO: 29079 - protein, 7 aa, Artificial Sequence
  Description of Artificial Sequence: Synthetic peptide
SMSEHLK

SEQ ID NO: 29080 - protein, 7 aa, Artificial Sequence
  Description of Artificial Sequence: Synthetic peptide
SRANSVP

SEQ ID NO: 29081 - protein, 7 aa, Artificial Sequence
  Description of Artificial Sequence: Synthetic peptide
TSAAPHA

SEQ ID NO: 29082 - protein, 7 aa, Artificial Sequence
  Description of Artificial Sequence: Synthetic peptide
GHLSPSS

SEQ ID NO: 29083 - protein, 7 aa, Artificial Sequence
  Description of Artificial Sequence: Synthetic peptide
PTQNGRS

SEQ ID NO: 29084 - protein, 7 aa, Artificial Sequence
  Description of Artificial Sequence: Synthetic peptide
KTPTHTM

SEQ ID NO: 29085 - protein, 7 aa, Artificial Sequence
  Description of Artificial Sequence: Synthetic peptide
NSVERTR

SEQ ID NO: 29086 - protein, 7 aa, Artificial Sequence
  Description of Artificial Sequence: Synthetic peptide
SITDRHS

SEQ ID NO: 29087 - protein, 7 aa, Artificial Sequence
  Description of Artificial Sequence: Synthetic peptide
PFGSSAR

SEQ ID NO: 29088 - protein, 7 aa, Artificial Sequence
  Description of Artificial Sequence: Synthetic peptide
ISGSGYH

SEQ ID NO: 29089 - protein, 7 aa, Artificial Sequence
  Description of Artificial Sequence: Synthetic peptide
NVDNRGF

SEQ ID NO: 29090 - protein, 7 aa, Artificial Sequence
  Description of Artificial Sequence: Synthetic peptide
SRAPNTL

SEQ ID NO: 29091 - protein, 7 aa, Artificial Sequence
  Description of Artificial Sequence: Synthetic peptide
NRNGFNN

SEQ ID NO: 29092 - protein, 7 aa, Artificial Sequence
  Description of Artificial Sequence: Synthetic peptide
NAEPTSS

SEQ ID NO: 29093 - protein, 7 aa, Artificial Sequence
  Description of Artificial Sequence: Synthetic peptide
MNRNGSL

SEQ ID NO: 29094 - protein, 7 aa, Artificial Sequence
  Description of Artificial Sequence: Synthetic peptide
HQPEKIA

SEQ ID NO: 29095 - protein, 7 aa, Artificial Sequence
  Description of Artificial Sequence: Synthetic peptide
SYSELVR

SEQ ID NO: 29096 - protein, 7 aa, Artificial Sequence
  Description of Artificial Sequence: Synthetic peptide
PVVTGVP

SEQ ID NO: 29097 - protein, 7 aa, Artificial Sequence
  Description of Artificial Sequence: Synthetic peptide
ADLTRSS

SEQ ID NO: 29098 - protein, 7 aa, Artificial Sequence
  Description of Artificial Sequence: Synthetic peptide
RYDKQNS

SEQ ID NO: 29099 - protein, 7 aa, Artificial Sequence
  Description of Artificial Sequence: Synthetic peptide
WGRSSMD

SEQ ID NO: 29100 - protein, 7 aa, Artificial Sequence
  Description of Artificial Sequence: Synthetic peptide
NVRSGTP

SEQ ID NO: 29101 - protein, 7 aa, Artificial Sequence
  Description of Artificial Sequence: Synthetic peptide
RAGSAVE

SEQ ID NO: 29102 - protein, 7 aa, Artificial Sequence
  Description of Artificial Sequence: Synthetic peptide
ANGHPQS

SEQ ID NO: 29103 - protein, 7 aa, Artificial Sequence
  Description of Artificial Sequence: Synthetic peptide
YTSTNRP

SEQ ID NO: 29104 - protein, 7 aa, Artificial Sequence
  Description of Artificial Sequence: Synthetic peptide
HNLNGFH

SEQ ID NO: 29105 - protein, 7 aa, Artificial Sequence
  Description of Artificial Sequence: Synthetic peptide
DMRATVM

SEQ ID NO: 29106 - protein, 7 aa, Artificial Sequence
  Description of Artificial Sequence: Synthetic peptide
YLGRVPP

SEQ ID NO: 29107 - protein, 7 aa, Artificial Sequence
  Description of Artificial Sequence: Synthetic peptide
LSGHASG

SEQ ID NO: 29108 - protein, 7 aa, Artificial Sequence
  Description of Artificial Sequence: Synthetic peptide
SIPTSAR

SEQ ID NO: 29109 - protein, 7 aa, Artificial Sequence
  Description of Artificial Sequence: Synthetic peptide
SRNAANA

SEQ ID NO: 29110 - protein, 7 aa, Artificial Sequence
  Description of Artificial Sequence: Synthetic peptide
QMPGHTG

SEQ ID NO: 29111 - protein, 7 aa, Artificial Sequence
  Description of Artificial Sequence: Synthetic peptide
WAGNKSV

SEQ ID NO: 29112 - protein, 7 aa, Artificial Sequence
  Description of Artificial Sequence: Synthetic peptide
TLPRTSG

SEQ ID NO: 29113 - protein, 7 aa, Artificial Sequence
  Description of Artificial Sequence: Synthetic peptide
VQRNSNT

SEQ ID NO: 29114 - protein, 7 aa, Artificial Sequence
  Description of Artificial Sequence: Synthetic peptide
HITSNHA

SEQ ID NO: 29115 - protein, 7 aa, Artificial Sequence
  Description of Artificial Sequence: Synthetic peptide
INVSRST

SEQ ID NO: 29116 - protein, 7 aa, Artificial Sequence
  Description of Artificial Sequence: Synthetic peptide
LTNRSSS

SEQ ID NO: 29117 - protein, 7 aa, Artificial Sequence
  Description of Artificial Sequence: Synthetic peptide
TRDSQVL

SEQ ID NO: 29118 - protein, 7 aa, Artificial Sequence
  Description of Artificial Sequence: Synthetic peptide
RTVNSAN

SEQ ID NO: 29119 - protein, 7 aa, Artificial Sequence
  Description of Artificial Sequence: Synthetic peptide
TTNNIQG

SEQ ID NO: 29120 - protein, 7 aa, Artificial Sequence
  Description of Artificial Sequence: Synthetic peptide
GINSRGS

SEQ ID NO: 29121 - protein, 7 aa, Artificial Sequence
  Description of Artificial Sequence: Synthetic peptide
LGSSGSR

SEQ ID NO: 29122 - protein, 7 aa, Artificial Sequence
  Description of Artificial Sequence: Synthetic peptide
TQRSQTA

SEQ ID NO: 29123 - protein, 7 aa, Artificial Sequence
  Description of Artificial Sequence: Synthetic peptide
GSAGNML

SEQ ID NO: 29124 - protein, 7 aa, Artificial Sequence
  Description of Artificial Sequence: Synthetic peptide
APSAGNS

SEQ ID NO: 29125 - protein, 7 aa, Artificial Sequence
  Description of Artificial Sequence: Synthetic peptide
GVSQGNR

SEQ ID NO: 29126 - protein, 7 aa, Artificial Sequence
  Description of Artificial Sequence: Synthetic peptide
LTTGNHI

SEQ ID NO: 29127 - protein, 7 aa, Artificial Sequence
  Description of Artificial Sequence: Synthetic peptide
TRSTSAT

SEQ ID NO: 29128 - protein, 7 aa, Artificial Sequence
  Description of Artificial Sequence: Synthetic peptide
LQKPSLV

SEQ ID NO: 29129 - protein, 7 aa, Artificial Sequence
  Description of Artificial Sequence: Synthetic peptide
GYASVPR

SEQ ID NO: 29130 - protein, 7 aa, Artificial Sequence
  Description of Artificial Sequence: Synthetic peptide
HYGPDSK

SEQ ID NO: 29131 - protein, 7 aa, Artificial Sequence
  Description of Artificial Sequence: Synthetic peptide
NRVNNEM

SEQ ID NO: 29132 - protein, 7 aa, Artificial Sequence
  Description of Artificial Sequence: Synthetic peptide
GLLGAST

SEQ ID NO: 29133 - protein, 7 aa, Artificial Sequence
  Description of Artificial Sequence: Synthetic peptide
SGSEHLR

SEQ ID NO: 29134 - protein, 7 aa, Artificial Sequence
  Description of Artificial Sequence: Synthetic peptide
APPNGSL

SEQ ID NO: 29135 - protein, 7 aa, Artificial Sequence
  Description of Artificial Sequence: Synthetic peptide
GRESNLS

SEQ ID NO: 29136 - protein, 7 aa, Artificial Sequence
  Description of Artificial Sequence: Synthetic peptide
LNQHSSL

SEQ ID NO: 29137 - protein, 7 aa, Artificial Sequence
  Description of Artificial Sequence: Synthetic peptide
MGGVTSS

SEQ ID NO: 29138 - protein, 7 aa, Artificial Sequence
  Description of Artificial Sequence: Synthetic peptide
NGSGQHQ

SEQ ID NO: 29139 - protein, 7 aa, Artificial Sequence
  Description of Artificial Sequence: Synthetic peptide
KSDAHTA

SEQ ID NO: 29140 - protein, 7 aa, Artificial Sequence
  Description of Artificial Sequence: Synthetic peptide
GPNPING

SEQ ID NO: 29141 - protein, 7 aa, Artificial Sequence
  Description of Artificial Sequence: Synthetic peptide
LMQTHGS

SEQ ID NO: 29142 - protein, 7 aa, Artificial Sequence
  Description of Artificial Sequence: Synthetic peptide
GSRDNSR

SEQ ID NO: 29143 - protein, 7 aa, Artificial Sequence
  Description of Artificial Sequence: Synthetic peptide
CRSNAKC

SEQ ID NO: 29144 - protein, 7 aa, Artificial Sequence
  Description of Artificial Sequence: Synthetic peptide
LDSRATE

SEQ ID NO: 29145 - protein, 7 aa, Artificial Sequence
  Description of Artificial Sequence: Synthetic peptide
ASSSKSV

SEQ ID NO: 29146 - protein, 7 aa, Artificial Sequence
  Description of Artificial Sequence: Synthetic peptide
SVHSNAI

SEQ ID NO: 29147 - protein, 7 aa, Artificial Sequence
  Description of Artificial Sequence: Synthetic peptide
RTQAHNV

SEQ ID NO: 29148 - protein, 7 aa, Artificial Sequence
  Description of Artificial Sequence: Synthetic peptide
TSSARVT

SEQ ID NO: 29149 - protein, 7 aa, Artificial Sequence
  Description of Artificial Sequence: Synthetic peptide
DGRTHSC

SEQ ID NO: 29150 - protein, 7 aa, Artificial Sequence
  Description of Artificial Sequence: Synthetic peptide
WAVSRPT

SEQ ID NO: 29151 - protein, 7 aa, Artificial Sequence
  Description of Artificial Sequence: Synthetic peptide
DPLRNSN

SEQ ID NO: 29152 - protein, 7 aa, Artificial Sequence
  Description of Artificial Sequence: Synthetic peptide
LSSSHTL

SEQ ID NO: 29153 - protein, 7 aa, Artificial Sequence
  Description of Artificial Sequence: Synthetic peptide
SHPSSFG

SEQ ID NO: 29154 - protein, 7 aa, Artificial Sequence
  Description of Artificial Sequence: Synthetic peptide
STMHKNV

SEQ ID NO: 29155 - protein, 7 aa, Artificial Sequence
  Description of Artificial Sequence: Synthetic peptide
STDLKSR

SEQ ID NO: 29156 - protein, 7 aa, Artificial Sequence
  Description of Artificial Sequence: Synthetic peptide
RPVVAST

SEQ ID NO: 29157 - protein, 7 aa, Artificial Sequence
  Description of Artificial Sequence: Synthetic peptide
QLRVGNG

SEQ ID NO: 29158 - protein, 7 aa, Artificial Sequence
  Description of Artificial Sequence: Synthetic peptide
GAISNEH

SEQ ID NO: 29159 - protein, 7 aa, Artificial Sequence
  Description of Artificial Sequence: Synthetic peptide
HKTGANV

SEQ ID NO: 29160 - protein, 7 aa, Artificial Sequence
  Description of Artificial Sequence: Synthetic peptide
SGPTQIR

SEQ ID NO: 29161 - protein, 7 aa, Artificial Sequence
  Description of Artificial Sequence: Synthetic peptide
MSSTRSI

SEQ ID NO: 29162 - protein, 7 aa, Artificial Sequence
  Description of Artificial Sequence: Synthetic peptide
NAVRSEN

SEQ ID NO: 29163 - protein, 7 aa, Artificial Sequence
  Description of Artificial Sequence: Synthetic peptide
YSMRPTE

SEQ ID NO: 29164 - protein, 7 aa, Artificial Sequence
  Description of Artificial Sequence: Synthetic peptide
EGPSSPH

SEQ ID NO: 29165 - protein, 7 aa, Artificial Sequence
  Description of Artificial Sequence: Synthetic peptide
GGVGGKS

SEQ ID NO: 29166 - protein, 7 aa, Artificial Sequence
  Description of Artificial Sequence: Synthetic peptide
DSTHRAT

SEQ ID NO: 29167 - protein, 7 aa, Artificial Sequence
  Description of Artificial Sequence: Synthetic peptide
MSANQHR

SEQ ID NO: 29168 - protein, 7 aa, Artificial Sequence
  Description of Artificial Sequence: Synthetic peptide
PASNVRG

SEQ ID NO: 29169 - protein, 7 aa, Artificial Sequence
  Description of Artificial Sequence: Synthetic peptide
PSVRTLG

SEQ ID NO: 29170 - protein, 7 aa, Artificial Sequence
  Description of Artificial Sequence: Synthetic peptide
QAQGSMQ

SEQ ID NO: 29171 - protein, 7 aa, Artificial Sequence
  Description of Artificial Sequence: Synthetic peptide
QRVHPSG

SEQ ID NO: 29172 - protein, 7 aa, Artificial Sequence
  Description of Artificial Sequence: Synthetic peptide
DPHSGGK

SEQ ID NO: 29173 - protein, 7 aa, Artificial Sequence
  Description of Artificial Sequence: Synthetic peptide
YLTSTSN

SEQ ID NO: 29174 - protein, 7 aa, Artificial Sequence
  Description of Artificial Sequence: Synthetic peptide
RVITGQH

SEQ ID NO: 29175 - protein, 7 aa, Artificial Sequence
  Description of Artificial Sequence: Synthetic peptide
SPHKQAN

SEQ ID NO: 29176 - protein, 7 aa, Artificial Sequence
  Description of Artificial Sequence: Synthetic peptide
KVSSATP

SEQ ID NO: 29177 - protein, 7 aa, Artificial Sequence
  Description of Artificial Sequence: Synthetic peptide
GTARGVA

SEQ ID NO: 29178 - protein, 7 aa, Artificial Sequence
  Description of Artificial Sequence: Synthetic peptide
PYARNAE

SEQ ID NO: 29179 - protein, 7 aa, Artificial Sequence
  Description of Artificial Sequence: Synthetic peptide
FVNTSAQ

SEQ ID NO: 29180 - protein, 7 aa, Artificial Sequence
  Description of Artificial Sequence: Synthetic peptide
GRNSHFV

SEQ ID NO: 29181 - protein, 7 aa, Artificial Sequence
  Description of Artificial Sequence: Synthetic peptide
DMSVHNV

SEQ ID NO: 29182 - protein, 7 aa, Artificial Sequence
  Description of Artificial Sequence: Synthetic peptide
PMLQHRA

SEQ ID NO: 29183 - protein, 7 aa, Artificial Sequence
  Description of Artificial Sequence: Synthetic peptide
LSQSNTH

SEQ ID NO: 29184 - protein, 7 aa, Artificial Sequence
  Description of Artificial Sequence: Synthetic peptide
RAPKSSS

SEQ ID NO: 29185 - protein, 7 aa, Artificial Sequence
  Description of Artificial Sequence: Synthetic peptide
QPGVSGR

SEQ ID NO: 29186 - protein, 7 aa, Artificial Sequence
  Description of Artificial Sequence: Synthetic peptide
PSEVRSS

SEQ ID NO: 29187 - protein, 7 aa, Artificial Sequence
  Description of Artificial Sequence: Synthetic peptide
GITHGSH

SEQ ID NO: 29188 - protein, 7 aa, Artificial Sequence
  Description of Artificial Sequence: Synthetic peptide
NNSSGAQ

SEQ ID NO: 29189 - protein, 7 aa, Artificial Sequence
  Description of Artificial Sequence: Synthetic peptide
FSVQGQC

SEQ ID NO: 29190 - protein, 7 aa, Artificial Sequence
  Description of Artificial Sequence: Synthetic peptide
PKVHPLK

SEQ ID NO: 29191 - protein, 7 aa, Artificial Sequence
  Description of Artificial Sequence: Synthetic peptide
TNSQVPR

SEQ ID NO: 29192 - protein, 7 aa, Artificial Sequence
  Description of Artificial Sequence: Synthetic peptide
YGSGQNQ

SEQ ID NO: 29193 - protein, 7 aa, Artificial Sequence
  Description of Artificial Sequence: Synthetic peptide
SQVSKPQ

SEQ ID NO: 29194 - protein, 7 aa, Artificial Sequence
  Description of Artificial Sequence: Synthetic peptide
SSPSHMA

SEQ ID NO: 29195 - protein, 7 aa, Artificial Sequence
  Description of Artificial Sequence: Synthetic peptide
DRQGLSG

SEQ ID NO: 29196 - protein, 7 aa, Artificial Sequence
  Description of Artificial Sequence: Synthetic peptide
TRQGMGS

SEQ ID NO: 29197 - protein, 7 aa, Artificial Sequence
  Description of Artificial Sequence: Synthetic peptide
KGFKTES

SEQ ID NO: 29198 - protein, 7 aa, Artificial Sequence
  Description of Artificial Sequence: Synthetic peptide
TGQQTAT

SEQ ID NO: 29199 - protein, 7 aa, Artificial Sequence
  Description of Artificial Sequence: Synthetic peptide
VHEAPLR

SEQ ID NO: 29200 - protein, 7 aa, Artificial Sequence
  Description of Artificial Sequence: Synthetic peptide
VTKSGNG

SEQ ID NO: 29201 - protein, 7 aa, Artificial Sequence
  Description of Artificial Sequence: Synthetic peptide
SGQHSLN

SEQ ID NO: 29202 - protein, 7 aa, Artificial Sequence
  Description of Artificial Sequence: Synthetic peptide
REVSSYK

SEQ ID NO: 29203 - protein, 7 aa, Artificial Sequence
  Description of Artificial Sequence: Synthetic peptide
HARSPPV

SEQ ID NO: 29204 - protein, 7 aa, Artificial Sequence
  Description of Artificial Sequence: Synthetic peptide
HNLPQHD

SEQ ID NO: 29205 - protein, 7 aa, Artificial Sequence
  Description of Artificial Sequence: Synthetic peptide
EFTKVGA

SEQ ID NO: 29206 - protein, 7 aa, Artificial Sequence
  Description of Artificial Sequence: Synthetic peptide
VSNSPSR

SEQ ID NO: 29207 - protein, 7 aa, Artificial Sequence
  Description of Artificial Sequence: Synthetic peptide
SISPNRT

SEQ ID NO: 29208 - protein, 7 aa, Artificial Sequence
  Description of Artificial Sequence: Synthetic peptide
VFNHASK

SEQ ID NO: 29209 - protein, 7 aa, Artificial Sequence
  Description of Artificial Sequence: Synthetic peptide
GLMTHSI

SEQ ID NO: 29210 - protein, 7 aa, Artificial Sequence
  Description of Artificial Sequence: Synthetic peptide
SFGTENR

SEQ ID NO: 29211 - protein, 7 aa, Artificial Sequence
  Description of Artificial Sequence: Synthetic peptide
KHGGSSV

SEQ ID NO: 29212 - protein, 7 aa, Artificial Sequence
  Description of Artificial Sequence: Synthetic peptide
EVRADPR

SEQ ID NO: 29213 - protein, 7 aa, Artificial Sequence
  Description of Artificial Sequence: Synthetic peptide
GHMGSIG

SEQ ID NO: 29214 - protein, 7 aa, Artificial Sequence
  Description of Artificial Sequence: Synthetic peptide
LHQLSAG

SEQ ID NO: 29215 - protein, 7 aa, Artificial Sequence
  Description of Artificial Sequence: Synthetic peptide
THTNRLG

SEQ ID NO: 29216 - protein, 7 aa, Artificial Sequence
  Description of Artificial Sequence: Synthetic peptide
RSERTHS

SEQ ID NO: 29217 - protein, 7 aa, Artificial Sequence
  Description of Artificial Sequence: Synthetic peptide
SRINTSP

SEQ ID NO: 29218 - protein, 7 aa, Artificial Sequence
  Description of Artificial Sequence: Synthetic peptide
RQLVDPP

SEQ ID NO: 29219 - protein, 7 aa, Artificial Sequence
  Description of Artificial Sequence: Synthetic peptide
ARSRSTD

SEQ ID NO: 29220 - protein, 7 aa, Artificial Sequence
  Description of Artificial Sequence: Synthetic peptide
RTGHYQD

SEQ ID NO: 29221 - protein, 7 aa, Artificial Sequence
  Description of Artificial Sequence: Synthetic peptide
PSLQLMG

SEQ ID NO: 29222 - protein, 7 aa, Artificial Sequence
  Description of Artificial Sequence: Synthetic peptide
ASSSRPS

SEQ ID NO: 29223 - protein, 7 aa, Artificial Sequence
  Description of Artificial Sequence: Synthetic peptide
GPSSPRL

SEQ ID NO: 29224 - protein, 7 aa, Artificial Sequence
  Description of Artificial Sequence: Synthetic peptide
GRETVSR

SEQ ID NO: 29225 - protein, 7 aa, Artificial Sequence
  Description of Artificial Sequence: Synthetic peptide
QSYDSHR

SEQ ID NO: 29226 - protein, 7 aa, Artificial Sequence
  Description of Artificial Sequence: Synthetic peptide
GGQNSSK

SEQ ID NO: 29227 - protein, 7 aa, Artificial Sequence
  Description of Artificial Sequence: Synthetic peptide
GVQTARI

SEQ ID NO: 29228 - protein, 7 aa, Artificial Sequence
  Description of Artificial Sequence: Synthetic peptide
TGIAPVG

SEQ ID NO: 29229 - protein, 7 aa, Artificial Sequence
  Description of Artificial Sequence: Synthetic peptide
RSGGSLS

SEQ ID NO: 29230 - protein, 7 aa, Artificial Sequence
  Description of Artificial Sequence: Synthetic peptide
MGVGMNG

SEQ ID NO: 29231 - protein, 7 aa, Artificial Sequence
  Description of Artificial Sequence: Synthetic peptide
VRSQAMS

SEQ ID NO: 29232 - protein, 7 aa, Artificial Sequence
  Description of Artificial Sequence: Synthetic peptide
STATNVY

SEQ ID NO: 29233 - protein, 7 aa, Artificial Sequence
  Description of Artificial Sequence: Synthetic peptide
GTRNAIV

SEQ ID NO: 29234 - protein, 7 aa, Artificial Sequence
  Description of Artificial Sequence: Synthetic peptide
ARSVKSV

SEQ ID NO: 29235 - protein, 7 aa, Artificial Sequence
  Description of Artificial Sequence: Synthetic peptide
SSQAKLV

SEQ ID NO: 29236 - protein, 7 aa, Artificial Sequence
  Description of Artificial Sequence: Synthetic peptide
GSVNRSS

SEQ ID NO: 29237 - protein, 7 aa, Artificial Sequence
  Description of Artificial Sequence: Synthetic peptide
HTSPPFT

SEQ ID NO: 29238 - protein, 7 aa, Artificial Sequence
  Description of Artificial Sequence: Synthetic peptide
PSTSSAG

SEQ ID NO: 29239 - protein, 7 aa, Artificial Sequence
  Description of Artificial Sequence: Synthetic peptide
TGTATLR

SEQ ID NO: 29240 - protein, 7 aa, Artificial Sequence
  Description of Artificial Sequence: Synthetic peptide
ISKASTH

SEQ ID NO: 29241 - protein, 7 aa, Artificial Sequence
  Description of Artificial Sequence: Synthetic peptide
ELRTNAL

SEQ ID NO: 29242 - protein, 7 aa, Artificial Sequence
  Description of Artificial Sequence: Synthetic peptide
GQTMSTM

SEQ ID NO: 29243 - protein, 7 aa, Artificial Sequence
  Description of Artificial Sequence: Synthetic peptide
GVNNNIN

SEQ ID NO: 29244 - protein, 7 aa, Artificial Sequence
  Description of Artificial Sequence: Synthetic peptide
SGSSTFR

SEQ ID NO: 29245 - protein, 7 aa, Artificial Sequence
  Description of Artificial Sequence: Synthetic peptide
RSANTNA

SEQ ID NO: 29246 - protein, 7 aa, Artificial Sequence
  Description of Artificial Sequence: Synthetic peptide
GVLGSPK

SEQ ID NO: 29247 - protein, 7 aa, Artificial Sequence
  Description of Artificial Sequence: Synthetic peptide
VMSANTH

SEQ ID NO: 29248 - protein, 7 aa, Artificial Sequence
  Description of Artificial Sequence: Synthetic peptide
SRIGMST

SEQ ID NO: 29249 - protein, 7 aa, Artificial Sequence
  Description of Artificial Sequence: Synthetic peptide
QHSPRNG

SEQ ID NO: 29250 - protein, 7 aa, Artificial Sequence
  Description of Artificial Sequence: Synthetic peptide
PHGDKTS

SEQ ID NO: 29251 - protein, 7 aa, Artificial Sequence
  Description of Artificial Sequence: Synthetic peptide
REPMKGS

SEQ ID NO: 29252 - protein, 7 aa, Artificial Sequence
  Description of Artificial Sequence: Synthetic peptide
MRSKESA

SEQ ID NO: 29253 - protein, 7 aa, Artificial Sequence
  Description of Artificial Sequence: Synthetic peptide
WGTRSTV

SEQ ID NO: 29254 - protein, 7 aa, Artificial Sequence
  Description of Artificial Sequence: Synthetic peptide
RNTSADR

SEQ ID NO: 29255 - protein, 7 aa, Artificial Sequence
  Description of Artificial Sequence: Synthetic peptide
SSSNKHV

SEQ ID NO: 29256 - protein, 7 aa, Artificial Sequence
  Description of Artificial Sequence: Synthetic peptide
CNGSRLA

SEQ ID NO: 29257 - protein, 7 aa, Artificial Sequence
  Description of Artificial Sequence: Synthetic peptide
QMGSMSG

SEQ ID NO: 29258 - protein, 7 aa, Artificial Sequence
  Description of Artificial Sequence: Synthetic peptide
PSGPVRG

SEQ ID NO: 29259 - protein, 7 aa, Artificial Sequence
  Description of Artificial Sequence: Synthetic peptide
DPLRHSV

SEQ ID NO: 29260 - protein, 7 aa, Artificial Sequence
  Description of Artificial Sequence: Synthetic peptide
PPVARSG

SEQ ID NO: 29261 - protein, 7 aa, Artificial Sequence
  Description of Artificial Sequence: Synthetic peptide
GRPQMPN

SEQ ID NO: 29262 - protein, 7 aa, Artificial Sequence
  Description of Artificial Sequence: Synthetic peptide
RSNPTLV

SEQ ID NO: 29263 - protein, 7 aa, Artificial Sequence
  Description of Artificial Sequence: Synthetic peptide
GLQSKQL

SEQ ID NO: 29264 - protein, 7 aa, Artificial Sequence
  Description of Artificial Sequence: Synthetic peptide
HRTTPVS

SEQ ID NO: 29265 - protein, 7 aa, Artificial Sequence
  Description of Artificial Sequence: Synthetic peptide
TPHSSKG

SEQ ID NO: 29266 - protein, 7 aa, Artificial Sequence
  Description of Artificial Sequence: Synthetic peptide
QGTTARS

SEQ ID NO: 29267 - protein, 7 aa, Artificial Sequence
  Description of Artificial Sequence: Synthetic peptide
SVSTNFS

SEQ ID NO: 29268 - protein, 7 aa, Artificial Sequence
  Description of Artificial Sequence: Synthetic peptide
PMVNTSL

SEQ ID NO: 29269 - protein, 7 aa, Artificial Sequence
  Description of Artificial Sequence: Synthetic peptide
FNSGSGR

SEQ ID NO: 29270 - protein, 7 aa, Artificial Sequence
  Description of Artificial Sequence: Synthetic peptide
LSAARSQ

SEQ ID NO: 29271 - protein, 7 aa, Artificial Sequence
  Description of Artificial Sequence: Synthetic peptide
AQINTPT

SEQ ID NO: 29272 - protein, 7 aa, Artificial Sequence
  Description of Artificial Sequence: Synthetic peptide
NDQAKLT

SEQ ID NO: 29273 - protein, 7 aa, Artificial Sequence
  Description of Artificial Sequence: Synthetic peptide
EASSSMG

SEQ ID NO: 29274 - protein, 7 aa, Artificial Sequence
  Description of Artificial Sequence: Synthetic peptide
QSHGITN

SEQ ID NO: 29275 - protein, 7 aa, Artificial Sequence
  Description of Artificial Sequence: Synthetic peptide
ATSNGTL

SEQ ID NO: 29276 - protein, 7 aa, Artificial Sequence
  Description of Artificial Sequence: Synthetic peptide
VQYSQMR

SEQ ID NO: 29277 - protein, 7 aa, Artificial Sequence
  Description of Artificial Sequence: Synthetic peptide
SNSRQAD

SEQ ID NO: 29278 - protein, 7 aa, Artificial Sequence
  Description of Artificial Sequence: Synthetic peptide
SISGERD

SEQ ID NO: 29279 - protein, 7 aa, Artificial Sequence
  Description of Artificial Sequence: Synthetic peptide
GRSSHMD

SEQ ID NO: 29280 - protein, 7 aa, Artificial Sequence
  Description of Artificial Sequence: Synthetic peptide
KDASSWL

SEQ ID NO: 29281 - protein, 7 aa, Artificial Sequence
  Description of Artificial Sequence: Synthetic peptide
DPVLKPA

SEQ ID NO: 29282 - protein, 7 aa, Artificial Sequence
  Description of Artificial Sequence: Synthetic peptide
FGQKPWK

SEQ ID NO: 29283 - protein, 7 aa, Artificial Sequence
  Description of Artificial Sequence: Synthetic peptide
QVTTIGA

SEQ ID NO: 29284 - protein, 7 aa, Artificial Sequence
  Description of Artificial Sequence: Synthetic peptide
PGSGRNH

SEQ ID NO: 29285 - protein, 7 aa, Artificial Sequence
  Description of Artificial Sequence: Synthetic peptide
GGQAGTI

SEQ ID NO: 29286 - protein, 7 aa, Artificial Sequence
  Description of Artificial Sequence: Synthetic peptide
MQRNGHV

SEQ ID NO: 29287 - protein, 7 aa, Artificial Sequence
  Description of Artificial Sequence: Synthetic peptide
GAREASR

SEQ ID NO: 29288 - protein, 7 aa, Artificial Sequence
  Description of Artificial Sequence: Synthetic peptide
DRADANS

SEQ ID NO: 29289 - protein, 7 aa, Artificial Sequence
  Description of Artificial Sequence: Synthetic peptide
PTVRSST

SEQ ID NO: 29290 - protein, 7 aa, Artificial Sequence
  Description of Artificial Sequence: Synthetic peptide
DSPNRGS

SEQ ID NO: 29291 - protein, 7 aa, Artificial Sequence
  Description of Artificial Sequence: Synthetic peptide
EISRPAS

SEQ ID NO: 29292 - protein, 7 aa, Artificial Sequence
  Description of Artificial Sequence: Synthetic peptide
GIAGVTR

SEQ ID NO: 29293 - protein, 7 aa, Artificial Sequence
  Description of Artificial Sequence: Synthetic peptide
LARNTTY

SEQ ID NO: 29294 - protein, 7 aa, Artificial Sequence
  Description of Artificial Sequence: Synthetic peptide
SDVRLSG

SEQ ID NO: 29295 - protein, 7 aa, Artificial Sequence
  Description of Artificial Sequence: Synthetic peptide
PANHKTM

SEQ ID NO: 29296 - protein, 7 aa, Artificial Sequence
  Description of Artificial Sequence: Synthetic peptide
MGAGALT

SEQ ID NO: 29297 - protein, 7 aa, Artificial Sequence
  Description of Artificial Sequence: Synthetic peptide
TASPNNR

SEQ ID NO: 29298 - protein, 7 aa, Artificial Sequence
  Description of Artificial Sequence: Synthetic peptide
NGSAQNQ

SEQ ID NO: 29299 - protein, 7 aa, Artificial Sequence
  Description of Artificial Sequence: Synthetic peptide
GITQSGG

SEQ ID NO: 29300 - protein, 7 aa, Artificial Sequence
  Description of Artificial Sequence: Synthetic peptide
RDPKSST

SEQ ID NO: 29301 - protein, 7 aa, Artificial Sequence
  Description of Artificial Sequence: Synthetic peptide
VRLGSVK

SEQ ID NO: 29302 - protein, 7 aa, Artificial Sequence
  Description of Artificial Sequence: Synthetic peptide
NSHTPVR

SEQ ID NO: 29303 - protein, 7 aa, Artificial Sequence
  Description of Artificial Sequence: Synthetic peptide
SANTRVQ

SEQ ID NO: 29304 - protein, 7 aa, Artificial Sequence
  Description of Artificial Sequence: Synthetic peptide
SGRDKIS

SEQ ID NO: 29305 - protein, 7 aa, Artificial Sequence
  Description of Artificial Sequence: Synthetic peptide
VSGTPRV

SEQ ID NO: 29306 - protein, 7 aa, Artificial Sequence
  Description of Artificial Sequence: Synthetic peptide
VPVNNER

SEQ ID NO: 29307 - protein, 7 aa, Artificial Sequence
  Description of Artificial Sequence: Synthetic peptide
GNEHLRV

SEQ ID NO: 29308 - protein, 7 aa, Artificial Sequence
  Description of Artificial Sequence: Synthetic peptide
SGSSKPT

SEQ ID NO: 29309 - protein, 7 aa, Artificial Sequence
  Description of Artificial Sequence: Synthetic peptide
ADRTKMS

SEQ ID NO: 29310 - protein, 7 aa, Artificial Sequence
  Description of Artificial Sequence: Synthetic peptide
SGATTPR

SEQ ID NO: 29311 - protein, 7 aa, Artificial Sequence
  Description of Artificial Sequence: Synthetic peptide
HAHSNVG

SEQ ID NO: 29312 - protein, 7 aa, Artificial Sequence
  Description of Artificial Sequence: Synthetic peptide
HPTRSTA

SEQ ID NO: 29313 - protein, 7 aa, Artificial Sequence
  Description of Artificial Sequence: Synthetic peptide
MSTSSSR

SEQ ID NO: 29314 - protein, 7 aa, Artificial Sequence
  Description of Artificial Sequence: Synthetic peptide
SAIRNVT

SEQ ID NO: 29315 - protein, 7 aa, Artificial Sequence
  Description of Artificial Sequence: Synthetic peptide
TNDRNAR

SEQ ID NO: 29316 - protein, 7 aa, Artificial Sequence
  Description of Artificial Sequence: Synthetic peptide
SDINRST

SEQ ID NO: 29317 - protein, 7 aa, Artificial Sequence
  Description of Artificial Sequence: Synthetic peptide
RSTRISE

SEQ ID NO: 29318 - protein, 7 aa, Artificial Sequence
  Description of Artificial Sequence: Synthetic peptide
SRGQLSQ

SEQ ID NO: 29319 - protein, 7 aa, Artificial Sequence
  Description of Artificial Sequence: Synthetic peptide
ARSTHLE

SEQ ID NO: 29320 - protein, 7 aa, Artificial Sequence
  Description of Artificial Sequence: Synthetic peptide
DYHNSKL

SEQ ID NO: 29321 - protein, 7 aa, Artificial Sequence
  Description of Artificial Sequence: Synthetic peptide
QPNTTYR

SEQ ID NO: 29322 - protein, 7 aa, Artificial Sequence
  Description of Artificial Sequence: Synthetic peptide
QSGTKQG

SEQ ID NO: 29323 - protein, 7 aa, Artificial Sequence
  Description of Artificial Sequence: Synthetic peptide
GYGSKVS

SEQ ID NO: 29324 - protein, 7 aa, Artificial Sequence
  Description of Artificial Sequence: Synthetic peptide
DRVLSQG

SEQ ID NO: 29325 - protein, 7 aa, Artificial Sequence
  Description of Artificial Sequence: Synthetic peptide
GQNTVSR

SEQ ID NO: 29326 - protein, 7 aa, Artificial Sequence
  Description of Artificial Sequence: Synthetic peptide
AMGHPLA

SEQ ID NO: 29327 - protein, 7 aa, Artificial Sequence
  Description of Artificial Sequence: Synthetic peptide
AHQRPIQ

SEQ ID NO: 29328 - protein, 7 aa, Artificial Sequence
  Description of Artificial Sequence: Synthetic peptide
SSSTHAV

SEQ ID NO: 29329 - protein, 7 aa, Artificial Sequence
  Description of Artificial Sequence: Synthetic peptide
GGTNNLN

SEQ ID NO: 29330 - protein, 7 aa, Artificial Sequence
  Description of Artificial Sequence: Synthetic peptide
RSRAESD

SEQ ID NO: 29331 - protein, 7 aa, Artificial Sequence
  Description of Artificial Sequence: Synthetic peptide
MNRTGIK

SEQ ID NO: 29332 - protein, 7 aa, Artificial Sequence
  Description of Artificial Sequence: Synthetic peptide
MSRSDPP

SEQ ID NO: 29333 - protein, 7 aa, Artificial Sequence
  Description of Artificial Sequence: Synthetic peptide
SSSVMVR

SEQ ID NO: 29334 - protein, 7 aa, Artificial Sequence
  Description of Artificial Sequence: Synthetic peptide
TRVVPRL

SEQ ID NO: 29335 - protein, 7 aa, Artificial Sequence
  Description of Artificial Sequence: Synthetic peptide
HGQKLFD

SEQ ID NO: 29336 - protein, 7 aa, Artificial Sequence
  Description of Artificial Sequence: Synthetic peptide
SASRTMG

SEQ ID NO: 29337 - protein, 7 aa, Artificial Sequence
  Description of Artificial Sequence: Synthetic peptide
RAPGSNT

SEQ ID NO: 29338 - protein, 7 aa, Artificial Sequence
  Description of Artificial Sequence: Synthetic peptide
SRVTSVS

SEQ ID NO: 29339 - protein, 7 aa, Artificial Sequence
  Description of Artificial Sequence: Synthetic peptide
ANSRDAK

SEQ ID NO: 29340 - protein, 7 aa, Artificial Sequence
  Description of Artificial Sequence: Synthetic peptide
SDHSRSL

SEQ ID NO: 29341 - protein, 7 aa, Artificial Sequence
  Description of Artificial Sequence: Synthetic peptide
GTSNRYT

SEQ ID NO: 29342 - protein, 7 aa, Artificial Sequence
  Description of Artificial Sequence: Synthetic peptide
GIPRTSS

SEQ ID NO: 29343 - protein, 7 aa, Artificial Sequence
  Description of Artificial Sequence: Synthetic peptide
RGKSNID

SEQ ID NO: 29344 - protein, 7 aa, Artificial Sequence
  Description of Artificial Sequence: Synthetic peptide
HAETNLR

SEQ ID NO: 29345 - protein, 7 aa, Artificial Sequence
  Description of Artificial Sequence: Synthetic peptide
AGENKLS

SEQ ID NO: 29346 - protein, 7 aa, Artificial Sequence
  Description of Artificial Sequence: Synthetic peptide
GVNTGTQ

SEQ ID NO: 29347 - protein, 7 aa, Artificial Sequence
  Description of Artificial Sequence: Synthetic peptide
PVGSRGG

SEQ ID NO: 29348 - protein, 7 aa, Artificial Sequence
  Description of Artificial Sequence: Synthetic peptide
STMKSAA

SEQ ID NO: 29349 - protein, 7 aa, Artificial Sequence
  Description of Artificial Sequence: Synthetic peptide
LNKSTLP

SEQ ID NO: 29350 - protein, 7 aa, Artificial Sequence
  Description of Artificial Sequence: Synthetic peptide
HDSRSNA

SEQ ID NO: 29351 - protein, 7 aa, Artificial Sequence
  Description of Artificial Sequence: Synthetic peptide
GPKSPGT

SEQ ID NO: 29352 - protein, 7 aa, Artificial Sequence
  Description of Artificial Sequence: Synthetic peptide
GENSAKR

SEQ ID NO: 29353 - protein, 7 aa, Artificial Sequence
  Description of Artificial Sequence: Synthetic peptide
VPGSQIG

SEQ ID NO: 29354 - protein, 7 aa, Artificial Sequence
  Description of Artificial Sequence: Synthetic peptide
GFPSGTR

SEQ ID NO: 29355 - protein, 7 aa, Artificial Sequence
  Description of Artificial Sequence: Synthetic peptide
LDFKTLP

SEQ ID NO: 29356 - protein, 7 aa, Artificial Sequence
  Description of Artificial Sequence: Synthetic peptide
HQGNVIS

SEQ ID NO: 29357 - protein, 7 aa, Artificial Sequence
  Description of Artificial Sequence: Synthetic peptide
PMAQQRA

SEQ ID NO: 29358 - protein, 7 aa, Artificial Sequence
  Description of Artificial Sequence: Synthetic peptide
VEQLGGR

SEQ ID NO: 29359 - protein, 7 aa, Artificial Sequence
  Description of Artificial Sequence: Synthetic peptide
GRSDHTK

SEQ ID NO: 29360 - protein, 7 aa, Artificial Sequence
  Description of Artificial Sequence: Synthetic peptide
HANSRPV

SEQ ID NO: 29361 - protein, 7 aa, Artificial Sequence
  Description of Artificial Sequence: Synthetic peptide
NIHKQSA

SEQ ID NO: 29362 - protein, 7 aa, Artificial Sequence
  Description of Artificial Sequence: Synthetic peptide
EHMTPRS

SEQ ID NO: 29363 - protein, 7 aa, Artificial Sequence
  Description of Artificial Sequence: Synthetic peptide
GVTGTHV

SEQ ID NO: 29364 - protein, 7 aa, Artificial Sequence
  Description of Artificial Sequence: Synthetic peptide
PRTNNPS

SEQ ID NO: 29365 - protein, 7 aa, Artificial Sequence
  Description of Artificial Sequence: Synthetic peptide
SASNVSR

SEQ ID NO: 29366 - protein, 7 aa, Artificial Sequence
  Description of Artificial Sequence: Synthetic peptide
SGTSRFS

SEQ ID NO: 29367 - protein, 7 aa, Artificial Sequence
  Description of Artificial Sequence: Synthetic peptide
HRTNGLT

SEQ ID NO: 29368 - protein, 7 aa, Artificial Sequence
  Description of Artificial Sequence: Synthetic peptide
RTSNKDL

SEQ ID NO: 29369 - protein, 7 aa, Artificial Sequence
  Description of Artificial Sequence: Synthetic peptide
NGSGKNQ

SEQ ID NO: 29370 - protein, 7 aa, Artificial Sequence
  Description of Artificial Sequence: Synthetic peptide
ARTTKIQ

SEQ ID NO: 29371 - protein, 7 aa, Artificial Sequence
  Description of Artificial Sequence: Synthetic peptide
LGSSTIL

SEQ ID NO: 29372 - protein, 7 aa, Artificial Sequence
  Description of Artificial Sequence: Synthetic peptide
SDSRSGM

SEQ ID NO: 29373 - protein, 7 aa, Artificial Sequence
  Description of Artificial Sequence: Synthetic peptide
GVGTPRS

SEQ ID NO: 29374 - protein, 7 aa, Artificial Sequence
  Description of Artificial Sequence: Synthetic peptide
SPMGVTR

SEQ ID NO: 29375 - protein, 7 aa, Artificial Sequence
  Description of Artificial Sequence: Synthetic peptide
HGSKPYI

SEQ ID NO: 29376 - protein, 7 aa, Artificial Sequence
  Description of Artificial Sequence: Synthetic peptide
DSRPRLA

SEQ ID NO: 29377 - protein, 7 aa, Artificial Sequence
  Description of Artificial Sequence: Synthetic peptide
QSSIHTK

SEQ ID NO: 29378 - protein, 7 aa, Artificial Sequence
  Description of Artificial Sequence: Synthetic peptide
MSSSMTL

SEQ ID NO: 29379 - protein, 7 aa, Artificial Sequence
  Description of Artificial Sequence: Synthetic peptide
PGIGTPF

SEQ ID NO: 29380 - protein, 7 aa, Artificial Sequence
  Description of Artificial Sequence: Synthetic peptide
SVAGMQR

SEQ ID NO: 29381 - protein, 7 aa, Artificial Sequence
  Description of Artificial Sequence: Synthetic peptide
HGSSVHS

SEQ ID NO: 29382 - protein, 7 aa, Artificial Sequence
  Description of Artificial Sequence: Synthetic peptide
HVNQAAR

SEQ ID NO: 29383 - protein, 7 aa, Artificial Sequence
  Description of Artificial Sequence: Synthetic peptide
PGRPQTD

SEQ ID NO: 29384 - protein, 7 aa, Artificial Sequence
  Description of Artificial Sequence: Synthetic peptide
MALQPNR

SEQ ID NO: 29385 - protein, 7 aa, Artificial Sequence
  Description of Artificial Sequence: Synthetic peptide
STMTTSR

SEQ ID NO: 29386 - protein, 7 aa, Artificial Sequence
  Description of Artificial Sequence: Synthetic peptide
SHGESQR

SEQ ID NO: 29387 - protein, 7 aa, Artificial Sequence
  Description of Artificial Sequence: Synthetic peptide
QDATPRS

SEQ ID NO: 29388 - protein, 7 aa, Artificial Sequence
  Description of Artificial Sequence: Synthetic peptide
CGNTGRS

SEQ ID NO: 29389 - protein, 7 aa, Artificial Sequence
  Description of Artificial Sequence: Synthetic peptide
PNGSPLS

SEQ ID NO: 29390 - protein, 7 aa, Artificial Sequence
  Description of Artificial Sequence: Synthetic peptide
ELHSKNA

SEQ ID NO: 29391 - protein, 7 aa, Artificial Sequence
  Description of Artificial Sequence: Synthetic peptide
PMSGTRL

SEQ ID NO: 29392 - protein, 7 aa, Artificial Sequence
  Description of Artificial Sequence: Synthetic peptide
IGITNHS

SEQ ID NO: 29393 - protein, 7 aa, Artificial Sequence
  Description of Artificial Sequence: Synthetic peptide
SRVGTAC

SEQ ID NO: 29394 - protein, 7 aa, Artificial Sequence
  Description of Artificial Sequence: Synthetic peptide
NRVERAV

SEQ ID NO: 29395 - protein, 7 aa, Artificial Sequence
  Description of Artificial Sequence: Synthetic peptide
SMSPRNG

SEQ ID NO: 29396 - protein, 7 aa, Artificial Sequence
  Description of Artificial Sequence: Synthetic peptide
ANLTQSR

SEQ ID NO: 29397 - protein, 7 aa, Artificial Sequence
  Description of Artificial Sequence: Synthetic peptide
GPSTHSG

SEQ ID NO: 29398 - protein, 7 aa, Artificial Sequence
  Description of Artificial Sequence: Synthetic peptide
LRNASSA

SEQ ID NO: 29399 - protein, 7 aa, Artificial Sequence
  Description of Artificial Sequence: Synthetic peptide
DPHNTSR

SEQ ID NO: 29400 - protein, 7 aa, Artificial Sequence
  Description of Artificial Sequence: Synthetic peptide
TPTGHRS

SEQ ID NO: 29401 - protein, 7 aa, Artificial Sequence
  Description of Artificial Sequence: Synthetic peptide
NGSGQKQ

SEQ ID NO: 29402 - protein, 7 aa, Artificial Sequence
  Description of Artificial Sequence: Synthetic peptide
RMPSGNS

SEQ ID NO: 29403 - protein, 7 aa, Artificial Sequence
  Description of Artificial Sequence: Synthetic peptide
RVSSPSN

SEQ ID NO: 29404 - protein, 7 aa, Artificial Sequence
  Description of Artificial Sequence: Synthetic peptide
RSTQSSP

SEQ ID NO: 29405 - protein, 7 aa, Artificial Sequence
  Description of Artificial Sequence: Synthetic peptide
YQTPAYR

SEQ ID NO: 29406 - protein, 7 aa, Artificial Sequence
  Description of Artificial Sequence: Synthetic peptide
HLHASPA

SEQ ID NO: 29407 - protein, 7 aa, Artificial Sequence
  Description of Artificial Sequence: Synthetic peptide
RTSSTYS

SEQ ID NO: 29408 - protein, 7 aa, Artificial Sequence
  Description of Artificial Sequence: Synthetic peptide
RHYKGDS

SEQ ID NO: 29409 - protein, 7 aa, Artificial Sequence
  Description of Artificial Sequence: Synthetic peptide
HTATPLL

SEQ ID NO: 29410 - protein, 7 aa, Artificial Sequence
  Description of Artificial Sequence: Synthetic peptide
ATRDSHS

SEQ ID NO: 29411 - protein, 7 aa, Artificial Sequence
  Description of Artificial Sequence: Synthetic peptide
SRVTGGT

SEQ ID NO: 29412 - protein, 7 aa, Artificial Sequence
  Description of Artificial Sequence: Synthetic peptide
NTYQSKN

SEQ ID NO: 29413 - protein, 7 aa, Artificial Sequence
  Description of Artificial Sequence: Synthetic peptide
VVHQPST

SEQ ID NO: 29414 - protein, 7 aa, Artificial Sequence
  Description of Artificial Sequence: Synthetic peptide
HRYQQET

SEQ ID NO: 29415 - protein, 7 aa, Artificial Sequence
  Description of Artificial Sequence: Synthetic peptide
ANGSGVG

SEQ ID NO: 29416 - protein, 7 aa, Artificial Sequence
  Description of Artificial Sequence: Synthetic peptide
DINRQRT

SEQ ID NO: 29417 - protein, 7 aa, Artificial Sequence
  Description of Artificial Sequence: Synthetic peptide
LASSSFN

SEQ ID NO: 29418 - protein, 7 aa, Artificial Sequence
  Description of Artificial Sequence: Synthetic peptide
RSISSAV

SEQ ID NO: 29419 - protein, 7 aa, Artificial Sequence
  Description of Artificial Sequence: Synthetic peptide
GQTRESS

SEQ ID NO: 29420 - protein, 7 aa, Artificial Sequence
  Description of Artificial Sequence: Synthetic peptide
PRHAPLL

SEQ ID NO: 29421 - protein, 7 aa, Artificial Sequence
  Description of Artificial Sequence: Synthetic peptide
NTLPPCK

SEQ ID NO: 29422 - protein, 7 aa, Artificial Sequence
  Description of Artificial Sequence: Synthetic peptide
GLVETSR

SEQ ID NO: 29423 - protein, 7 aa, Artificial Sequence
  Description of Artificial Sequence: Synthetic peptide
TSSPQPS

SEQ ID NO: 29424 - protein, 7 aa, Artificial Sequence
  Description of Artificial Sequence: Synthetic peptide
QPSEKSL

SEQ ID NO: 29425 - protein, 7 aa, Artificial Sequence
  Description of Artificial Sequence: Synthetic peptide
FPNVNSA

SEQ ID NO: 29426 - protein, 7 aa, Artificial Sequence
  Description of Artificial Sequence: Synthetic peptide
GGNPSGS

SEQ ID NO: 29427 - protein, 7 aa, Artificial Sequence
  Description of Artificial Sequence: Synthetic peptide
QLRSDQT

SEQ ID NO: 29428 - protein, 7 aa, Artificial Sequence
  Description of Artificial Sequence: Synthetic peptide
ATHSKAS

SEQ ID NO: 29429 - protein, 7 aa, Artificial Sequence
  Description of Artificial Sequence: Synthetic peptide
DANSTHA

SEQ ID NO: 29430 - protein, 7 aa, Artificial Sequence
  Description of Artificial Sequence: Synthetic peptide
LGVKTPT

SEQ ID NO: 29431 - protein, 7 aa, Artificial Sequence
  Description of Artificial Sequence: Synthetic peptide
LTTSVYK

SEQ ID NO: 29432 - protein, 7 aa, Artificial Sequence
  Description of Artificial Sequence: Synthetic peptide
IISQHGM

SEQ ID NO: 29433 - protein, 7 aa, Artificial Sequence
  Description of Artificial Sequence: Synthetic peptide
NSGTRAN

SEQ ID NO: 29434 - protein, 7 aa, Artificial Sequence
  Description of Artificial Sequence: Synthetic peptide
TNAASHT

SEQ ID NO: 29435 - protein, 7 aa, Artificial Sequence
  Description of Artificial Sequence: Synthetic peptide
ELRNGHK

SEQ ID NO: 29436 - protein, 7 aa, Artificial Sequence
  Description of Artificial Sequence: Synthetic peptide
CPQRAST

SEQ ID NO: 29437 - protein, 7 aa, Artificial Sequence
  Description of Artificial Sequence: Synthetic peptide
FLTGRQS

SEQ ID NO: 29438 - protein, 7 aa, Artificial Sequence
  Description of Artificial Sequence: Synthetic peptide
VSDSNSL

SEQ ID NO: 29439 - protein, 7 aa, Artificial Sequence
  Description of Artificial Sequence: Synthetic peptide
WAAGSHK

SEQ ID NO: 29440 - protein, 7 aa, Artificial Sequence
  Description of Artificial Sequence: Synthetic peptide
GPGSPWK

SEQ ID NO: 29441 - protein, 7 aa, Artificial Sequence
  Description of Artificial Sequence: Synthetic peptide
PFSPTVS

SEQ ID NO: 29442 - protein, 7 aa, Artificial Sequence
  Description of Artificial Sequence: Synthetic peptide
HSTPSTM

SEQ ID NO: 29443 - protein, 7 aa, Artificial Sequence
  Description of Artificial Sequence: Synthetic peptide
VRAASNP

SEQ ID NO: 29444 - protein, 7 aa, Artificial Sequence
  Description of Artificial Sequence: Synthetic peptide
HLVRSSC

SEQ ID NO: 29445 - protein, 7 aa, Artificial Sequence
  Description of Artificial Sequence: Synthetic peptide
PMSHTLG

SEQ ID NO: 29446 - protein, 7 aa, Artificial Sequence
  Description of Artificial Sequence: Synthetic peptide
SSAGHSK

SEQ ID NO: 29447 - protein, 7 aa, Artificial Sequence
  Description of Artificial Sequence: Synthetic peptide
HTTGIIG

SEQ ID NO: 29448 - protein, 7 aa, Artificial Sequence
  Description of Artificial Sequence: Synthetic peptide
CTNDRGV

SEQ ID NO: 29449 - protein, 7 aa, Artificial Sequence
  Description of Artificial Sequence: Synthetic peptide
TGLRHMG

SEQ ID NO: 29450 - protein, 7 aa, Artificial Sequence
  Description of Artificial Sequence: Synthetic peptide
RNQGALQ

SEQ ID NO: 29451 - protein, 7 aa, Artificial Sequence
  Description of Artificial Sequence: Synthetic peptide
YNGGNRS

SEQ ID NO: 29452 - protein, 7 aa, Artificial Sequence
  Description of Artificial Sequence: Synthetic peptide
SRNTQSM

SEQ ID NO: 29453 - protein, 7 aa, Artificial Sequence
  Description of Artificial Sequence: Synthetic peptide
LVSSKSS

SEQ ID NO: 29454 - protein, 7 aa, Artificial Sequence
  Description of Artificial Sequence: Synthetic peptide
RASQSVG

SEQ ID NO: 29455 - protein, 7 aa, Artificial Sequence
  Description of Artificial Sequence: Synthetic peptide
RIGQGSS

SEQ ID NO: 29456 - protein, 7 aa, Artificial Sequence
  Description of Artificial Sequence: Synthetic peptide
VTTSTGR

SEQ ID NO: 29457 - protein, 7 aa, Artificial Sequence
  Description of Artificial Sequence: Synthetic peptide
SQSPNRG

SEQ ID NO: 29458 - protein, 7 aa, Artificial Sequence
  Description of Artificial Sequence: Synthetic peptide
RTTNHQS

SEQ ID NO: 29459 - protein, 7 aa, Artificial Sequence
  Description of Artificial Sequence: Synthetic peptide
VRTNAKG

SEQ ID NO: 29460 - protein, 7 aa, Artificial Sequence
  Description of Artificial Sequence: Synthetic peptide
ANIRSTG

SEQ ID NO: 29461 - protein, 7 aa, Artificial Sequence
  Description of Artificial Sequence: Synthetic peptide
PNLNSRG

SEQ ID NO: 29462 - protein, 7 aa, Artificial Sequence
  Description of Artificial Sequence: Synthetic peptide
RFSDSNT

SEQ ID NO: 29463 - protein, 7 aa, Artificial Sequence
  Description of Artificial Sequence: Synthetic peptide
QHTNNPD

SEQ ID NO: 29464 - protein, 7 aa, Artificial Sequence
  Description of Artificial Sequence: Synthetic peptide
AHKSAMN

SEQ ID NO: 29465 - protein, 7 aa, Artificial Sequence
  Description of Artificial Sequence: Synthetic peptide
RDTRESQ

SEQ ID NO: 29466 - protein, 7 aa, Artificial Sequence
  Description of Artificial Sequence: Synthetic peptide
GSNRMSS

SEQ ID NO: 29467 - protein, 7 aa, Artificial Sequence
  Description of Artificial Sequence: Synthetic peptide
PGLTPKQ

SEQ ID NO: 29468 - protein, 7 aa, Artificial Sequence
  Description of Artificial Sequence: Synthetic peptide
TNGQAAR

SEQ ID NO: 29469 - protein, 7 aa, Artificial Sequence
  Description of Artificial Sequence: Synthetic peptide
ASSRESL

SEQ ID NO: 29470 - protein, 7 aa, Artificial Sequence
  Description of Artificial Sequence: Synthetic peptide
ALRTSNY

SEQ ID NO: 29471 - protein, 7 aa, Artificial Sequence
  Description of Artificial Sequence: Synthetic peptide
GRPGISK

SEQ ID NO: 29472 - protein, 7 aa, Artificial Sequence
  Description of Artificial Sequence: Synthetic peptide
PQHRSIP

SEQ ID NO: 29473 - protein, 7 aa, Artificial Sequence
  Description of Artificial Sequence: Synthetic peptide
APHSAAN

SEQ ID NO: 29474 - protein, 7 aa, Artificial Sequence
  Description of Artificial Sequence: Synthetic peptide
NGASPKR

SEQ ID NO: 29475 - protein, 7 aa, Artificial Sequence
  Description of Artificial Sequence: Synthetic peptide
VSMNTTR

SEQ ID NO: 29476 - protein, 7 aa, Artificial Sequence
  Description of Artificial Sequence: Synthetic peptide
IPSGVHS

SEQ ID NO: 29477 - protein, 7 aa, Artificial Sequence
  Description of Artificial Sequence: Synthetic peptide
PVTRLSE

SEQ ID NO: 29478 - protein, 7 aa, Artificial Sequence
  Description of Artificial Sequence: Synthetic peptide
NATSPRK

SEQ ID NO: 29479 - protein, 7 aa, Artificial Sequence
  Description of Artificial Sequence: Synthetic peptide
GNRGSVI

SEQ ID NO: 29480 - protein, 7 aa, Artificial Sequence
  Description of Artificial Sequence: Synthetic peptide
YPKTNVT

SEQ ID NO: 29481 - protein, 7 aa, Artificial Sequence
  Description of Artificial Sequence: Synthetic peptide
QRVNTAS

SEQ ID NO: 29482 - protein, 7 aa, Artificial Sequence
  Description of Artificial Sequence: Synthetic peptide
SNDNSLR

SEQ ID NO: 29483 - protein, 7 aa, Artificial Sequence
  Description of Artificial Sequence: Synthetic peptide
NGSGQIQ

SEQ ID NO: 29484 - protein, 7 aa, Artificial Sequence
  Description of Artificial Sequence: Synthetic peptide
HTMTART

SEQ ID NO: 29485 - protein, 7 aa, Artificial Sequence
  Description of Artificial Sequence: Synthetic peptide
MRSKASM

SEQ ID NO: 29486 - protein, 7 aa, Artificial Sequence
  Description of Artificial Sequence: Synthetic peptide
VPQVSSA

SEQ ID NO: 29487 - protein, 7 aa, Artificial Sequence
  Description of Artificial Sequence: Synthetic peptide
ASTAINQ

SEQ ID NO: 29488 - protein, 7 aa, Artificial Sequence
  Description of Artificial Sequence: Synthetic peptide
SSTTSTS

SEQ ID NO: 29489 - protein, 7 aa, Artificial Sequence
  Description of Artificial Sequence: Synthetic peptide
TTYGSLG

SEQ ID NO: 29490 - protein, 7 aa, Artificial Sequence
  Description of Artificial Sequence: Synthetic peptide
LPNSRAS

SEQ ID NO: 29491 - protein, 7 aa, Artificial Sequence
  Description of Artificial Sequence: Synthetic peptide
MFQKQGN

SEQ ID NO: 29492 - protein, 7 aa, Artificial Sequence
  Description of Artificial Sequence: Synthetic peptide
GERLSRS

SEQ ID NO: 29493 - protein, 7 aa, Artificial Sequence
  Description of Artificial Sequence: Synthetic peptide
SISHTPV

SEQ ID NO: 29494 - protein, 7 aa, Artificial Sequence
  Description of Artificial Sequence: Synthetic peptide
VQRRSNE

SEQ ID NO: 29495 - protein, 7 aa, Artificial Sequence
  Description of Artificial Sequence: Synthetic peptide
MLSSSRS

SEQ ID NO: 29496 - protein, 7 aa, Artificial Sequence
  Description of Artificial Sequence: Synthetic peptide
VNTTRAE

SEQ ID NO: 29497 - protein, 7 aa, Artificial Sequence
  Description of Artificial Sequence: Synthetic peptide
YAMERVG

SEQ ID NO: 29498 - protein, 7 aa, Artificial Sequence
  Description of Artificial Sequence: Synthetic peptide
DISRSHG

SEQ ID NO: 29499 - protein, 7 aa, Artificial Sequence
  Description of Artificial Sequence: Synthetic peptide
MGREMKG

SEQ ID NO: 29500 - protein, 7 aa, Artificial Sequence
  Description of Artificial Sequence: Synthetic peptide
HASDRKM

SEQ ID NO: 29501 - protein, 7 aa, Artificial Sequence
  Description of Artificial Sequence: Synthetic peptide
LINATHR

SEQ ID NO: 29502 - protein, 7 aa, Artificial Sequence
  Description of Artificial Sequence: Synthetic peptide
WNPMSSG

SEQ ID NO: 29503 - protein, 7 aa, Artificial Sequence
  Description of Artificial Sequence: Synthetic peptide
SDTKPFT

SEQ ID NO: 29504 - protein, 7 aa, Artificial Sequence
  Description of Artificial Sequence: Synthetic peptide
GPIRPFQ

SEQ ID NO: 29505 - protein, 7 aa, Artificial Sequence
  Description of Artificial Sequence: Synthetic peptide
SGTTTFG

SEQ ID NO: 29506 - protein, 7 aa, Artificial Sequence
  Description of Artificial Sequence: Synthetic peptide
PQESRGM

SEQ ID NO: 29507 - protein, 7 aa, Artificial Sequence
  Description of Artificial Sequence: Synthetic peptide
SGSTKGQ

SEQ ID NO: 29508 - protein, 7 aa, Artificial Sequence
  Description of Artificial Sequence: Synthetic peptide
GASENMR

SEQ ID NO: 29509 - protein, 7 aa, Artificial Sequence
  Description of Artificial Sequence: Synthetic peptide
PLTTRPS

SEQ ID NO: 29510 - protein, 7 aa, Artificial Sequence
  Description of Artificial Sequence: Synthetic peptide
ERFTSSS

SEQ ID NO: 29511 - protein, 7 aa, Artificial Sequence
  Description of Artificial Sequence: Synthetic peptide
SFSPASN

SEQ ID NO: 29512 - protein, 7 aa, Artificial Sequence
  Description of Artificial Sequence: Synthetic peptide
DRSATAT

SEQ ID NO: 29513 - protein, 7 aa, Artificial Sequence
  Description of Artificial Sequence: Synthetic peptide
YGSRPPS

SEQ ID NO: 29514 - protein, 7 aa, Artificial Sequence
  Description of Artificial Sequence: Synthetic peptide
QVTVRPV

SEQ ID NO: 29515 - protein, 7 aa, Artificial Sequence
  Description of Artificial Sequence: Synthetic peptide
IASSGMH

SEQ ID NO: 29516 - protein, 7 aa, Artificial Sequence
  Description of Artificial Sequence: Synthetic peptide
MLSGSRN

SEQ ID NO: 29517 - protein, 7 aa, Artificial Sequence
  Description of Artificial Sequence: Synthetic peptide
TSSGNLS

SEQ ID NO: 29518 - protein, 7 aa, Artificial Sequence
  Description of Artificial Sequence: Synthetic peptide
QRVSSTL

SEQ ID NO: 29519 - protein, 7 aa, Artificial Sequence
  Description of Artificial Sequence: Synthetic peptide
SSSHATR

SEQ ID NO: 29520 - protein, 7 aa, Artificial Sequence
  Description of Artificial Sequence: Synthetic peptide
PTGKLRQ

SEQ ID NO: 29521 - protein, 7 aa, Artificial Sequence
  Description of Artificial Sequence: Synthetic peptide
QAQHTRS

SEQ ID NO: 29522 - protein, 7 aa, Artificial Sequence
  Description of Artificial Sequence: Synthetic peptide
LPRGAHS

SEQ ID NO: 29523 - protein, 7 aa, Artificial Sequence
  Description of Artificial Sequence: Synthetic peptide
QGGTSRP

SEQ ID NO: 29524 - protein, 7 aa, Artificial Sequence
  Description of Artificial Sequence: Synthetic peptide
GHGNNGA

SEQ ID NO: 29525 - protein, 7 aa, Artificial Sequence
  Description of Artificial Sequence: Synthetic peptide
SSSRGQN

SEQ ID NO: 29526 - protein, 7 aa, Artificial Sequence
  Description of Artificial Sequence: Synthetic peptide
PHTMERT

SEQ ID NO: 29527 - protein, 7 aa, Artificial Sequence
  Description of Artificial Sequence: Synthetic peptide
AIRSDYV

SEQ ID NO: 29528 - protein, 7 aa, Artificial Sequence
  Description of Artificial Sequence: Synthetic peptide
GDTRLNA

SEQ ID NO: 29529 - protein, 7 aa, Artificial Sequence
  Description of Artificial Sequence: Synthetic peptide
TPTTSAN

SEQ ID NO: 29530 - protein, 7 aa, Artificial Sequence
  Description of Artificial Sequence: Synthetic peptide
PHVARQM

SEQ ID NO: 29531 - protein, 7 aa, Artificial Sequence
  Description of Artificial Sequence: Synthetic peptide
VGGGRDN

SEQ ID NO: 29532 - protein, 7 aa, Artificial Sequence
  Description of Artificial Sequence: Synthetic peptide
HNTAHAS

SEQ ID NO: 29533 - protein, 7 aa, Artificial Sequence
  Description of Artificial Sequence: Synthetic peptide
QNIGRPS

SEQ ID NO: 29534 - protein, 7 aa, Artificial Sequence
  Description of Artificial Sequence: Synthetic peptide
LKPDRNA

SEQ ID NO: 29535 - protein, 7 aa, Artificial Sequence
  Description of Artificial Sequence: Synthetic peptide
FHANSTV

SEQ ID NO: 29536 - protein, 7 aa, Artificial Sequence
  Description of Artificial Sequence: Synthetic peptide
FGRTNQG

SEQ ID NO: 29537 - protein, 7 aa, Artificial Sequence
  Description of Artificial Sequence: Synthetic peptide
MRSEPIA

SEQ ID NO: 29538 - protein, 7 aa, Artificial Sequence
  Description of Artificial Sequence: Synthetic peptide
PLVSVGR

SEQ ID NO: 29539 - protein, 7 aa, Artificial Sequence
  Description of Artificial Sequence: Synthetic peptide
PLRDSMP

SEQ ID NO: 29540 - protein, 7 aa, Artificial Sequence
  Description of Artificial Sequence: Synthetic peptide
NLNSLKM

SEQ ID NO: 29541 - protein, 7 aa, Artificial Sequence
  Description of Artificial Sequence: Synthetic peptide
PVLGSRY

SEQ ID NO: 29542 - protein, 7 aa, Artificial Sequence
  Description of Artificial Sequence: Synthetic peptide
AQARQTA

SEQ ID NO: 29543 - protein, 7 aa, Artificial Sequence
  Description of Artificial Sequence: Synthetic peptide
PRSSGGF

SEQ ID NO: 29544 - protein, 7 aa, Artificial Sequence
  Description of Artificial Sequence: Synthetic peptide
GKSQMQL

SEQ ID NO: 29545 - protein, 7 aa, Artificial Sequence
  Description of Artificial Sequence: Synthetic peptide
SNTNSAN

SEQ ID NO: 29546 - protein, 7 aa, Artificial Sequence
  Description of Artificial Sequence: Synthetic peptide
YRATSGQ

SEQ ID NO: 29547 - protein, 7 aa, Artificial Sequence
  Description of Artificial Sequence: Synthetic peptide
SSLKPTL

SEQ ID NO: 29548 - protein, 7 aa, Artificial Sequence
  Description of Artificial Sequence: Synthetic peptide
RSTVSPN

SEQ ID NO: 29549 - protein, 7 aa, Artificial Sequence
  Description of Artificial Sequence: Synthetic peptide
CSGSPCR

SEQ ID NO: 29550 - protein, 7 aa, Artificial Sequence
  Description of Artificial Sequence: Synthetic peptide
SSRTQSL

SEQ ID NO: 29551 - protein, 7 aa, Artificial Sequence
  Description of Artificial Sequence: Synthetic peptide
STNPANR

SEQ ID NO: 29552 - protein, 7 aa, Artificial Sequence
  Description of Artificial Sequence: Synthetic peptide
APPATAP

SEQ ID NO: 29553 - protein, 7 aa, Artificial Sequence
  Description of Artificial Sequence: Synthetic peptide
YSDNKTT

SEQ ID NO: 29554 - protein, 7 aa, Artificial Sequence
  Description of Artificial Sequence: Synthetic peptide
MPLKPHL

SEQ ID NO: 29555 - protein, 7 aa, Artificial Sequence
  Description of Artificial Sequence: Synthetic peptide
SDSRNPV

SEQ ID NO: 29556 - protein, 7 aa, Artificial Sequence
  Description of Artificial Sequence: Synthetic peptide
FLSSRAS

SEQ ID NO: 29557 - protein, 7 aa, Artificial Sequence
  Description of Artificial Sequence: Synthetic peptide
HRVEGSL

SEQ ID NO: 29558 - protein, 7 aa, Artificial Sequence
  Description of Artificial Sequence: Synthetic peptide
SSVRPYA

SEQ ID NO: 29559 - protein, 7 aa, Artificial Sequence
  Description of Artificial Sequence: Synthetic peptide
TVLTKQH

SEQ ID NO: 29560 - protein, 7 aa, Artificial Sequence
  Description of Artificial Sequence: Synthetic peptide
NRQVPGL

SEQ ID NO: 29561 - protein, 7 aa, Artificial Sequence
  Description of Artificial Sequence: Synthetic peptide
SHMTGVT

SEQ ID NO: 29562 - protein, 7 aa, Artificial Sequence
  Description of Artificial Sequence: Synthetic peptide
RVLTSNA

SEQ ID NO: 29563 - protein, 7 aa, Artificial Sequence
  Description of Artificial Sequence: Synthetic peptide
LIRSSSI

SEQ ID NO: 29564 - protein, 7 aa, Artificial Sequence
  Description of Artificial Sequence: Synthetic peptide
NIKGAST

SEQ ID NO: 29565 - protein, 7 aa, Artificial Sequence
  Description of Artificial Sequence: Synthetic peptide
SDRSVDG

SEQ ID NO: 29566 - protein, 7 aa, Artificial Sequence
  Description of Artificial Sequence: Synthetic peptide
RNVSQPI

SEQ ID NO: 29567 - protein, 7 aa, Artificial Sequence
  Description of Artificial Sequence: Synthetic peptide
HGVGSMV

SEQ ID NO: 29568 - protein, 7 aa, Artificial Sequence
  Description of Artificial Sequence: Synthetic peptide
AYSNIQN

SEQ ID NO: 29569 - protein, 7 aa, Artificial Sequence
  Description of Artificial Sequence: Synthetic peptide
TLPTKYP

SEQ ID NO: 29570 - protein, 7 aa, Artificial Sequence
  Description of Artificial Sequence: Synthetic peptide
AEYTGMA

SEQ ID NO: 29571 - protein, 7 aa, Artificial Sequence
  Description of Artificial Sequence: Synthetic peptide
YGFSSVN

SEQ ID NO: 29572 - protein, 7 aa, Artificial Sequence
  Description of Artificial Sequence: Synthetic peptide
FRYKETL

SEQ ID NO: 29573 - protein, 7 aa, Artificial Sequence
  Description of Artificial Sequence: Synthetic peptide
PRTGTLM

SEQ ID NO: 29574 - protein, 7 aa, Artificial Sequence
  Description of Artificial Sequence: Synthetic peptide
CITKNLA

SEQ ID NO: 29575 - protein, 7 aa, Artificial Sequence
  Description of Artificial Sequence: Synthetic peptide
SSSFTNK

SEQ ID NO: 29576 - protein, 7 aa, Artificial Sequence
  Description of Artificial Sequence: Synthetic peptide
HTDINHQ

SEQ ID NO: 29577 - protein, 7 aa, Artificial Sequence
  Description of Artificial Sequence: Synthetic peptide
AGRASNT

SEQ ID NO: 29578 - protein, 7 aa, Artificial Sequence
  Description of Artificial Sequence: Synthetic peptide
SISHARE

SEQ ID NO: 29579 - protein, 7 aa, Artificial Sequence
  Description of Artificial Sequence: Synthetic peptide
PVNSVSK

SEQ ID NO: 29580 - protein, 7 aa, Artificial Sequence
  Description of Artificial Sequence: Synthetic peptide
DKTTRVY

SEQ ID NO: 29581 - protein, 7 aa, Artificial Sequence
  Description of Artificial Sequence: Synthetic peptide
ITPGGHS

SEQ ID NO: 29582 - protein, 7 aa, Artificial Sequence
  Description of Artificial Sequence: Synthetic peptide
VHSSSTK

SEQ ID NO: 29583 - protein, 7 aa, Artificial Sequence
  Description of Artificial Sequence: Synthetic peptide
LPQRGVS

SEQ ID NO: 29584 - protein, 7 aa, Artificial Sequence
  Description of Artificial Sequence: Synthetic peptide
GPMRPFQ

SEQ ID NO: 29585 - protein, 7 aa, Artificial Sequence
  Description of Artificial Sequence: Synthetic peptide
DTTISKG

SEQ ID NO: 29586 - protein, 7 aa, Artificial Sequence
  Description of Artificial Sequence: Synthetic peptide
HVPSKLA

SEQ ID NO: 29587 - protein, 7 aa, Artificial Sequence
  Description of Artificial Sequence: Synthetic peptide
PNHQSLT

SEQ ID NO: 29588 - protein, 7 aa, Artificial Sequence
  Description of Artificial Sequence: Synthetic peptide
GQVSQMK

SEQ ID NO: 29589 - protein, 7 aa, Artificial Sequence
  Description of Artificial Sequence: Synthetic peptide
TSTRTAP

SEQ ID NO: 29590 - protein, 7 aa, Artificial Sequence
  Description of Artificial Sequence: Synthetic peptide
LSSDKNV

SEQ ID NO: 29591 - protein, 7 aa, Artificial Sequence
  Description of Artificial Sequence: Synthetic peptide
HQRNVNS

SEQ ID NO: 29592 - protein, 7 aa, Artificial Sequence
  Description of Artificial Sequence: Synthetic peptide
SKPANNV

SEQ ID NO: 29593 - protein, 7 aa, Artificial Sequence
  Description of Artificial Sequence: Synthetic peptide
QKTTIDG

SEQ ID NO: 29594 - protein, 7 aa, Artificial Sequence
  Description of Artificial Sequence: Synthetic peptide
MMVSSRS

SEQ ID NO: 29595 - protein, 7 aa, Artificial Sequence
  Description of Artificial Sequence: Synthetic peptide
PQTNNPD

SEQ ID NO: 29596 - protein, 7 aa, Artificial Sequence
  Description of Artificial Sequence: Synthetic peptide
RADHLGR

SEQ ID NO: 29597 - protein, 7 aa, Artificial Sequence
  Description of Artificial Sequence: Synthetic peptide
PSKISNA

SEQ ID NO: 29598 - protein, 7 aa, Artificial Sequence
  Description of Artificial Sequence: Synthetic peptide
PQPFGKY

SEQ ID NO: 29599 - protein, 7 aa, Artificial Sequence
  Description of Artificial Sequence: Synthetic peptide
RSTLGSG

SEQ ID NO: 29600 - protein, 7 aa, Artificial Sequence
  Description of Artificial Sequence: Synthetic peptide
ARTKGNV

SEQ ID NO: 29601 - protein, 7 aa, Artificial Sequence
  Description of Artificial Sequence: Synthetic peptide
EPPHKIL

SEQ ID NO: 29602 - protein, 7 aa, Artificial Sequence
  Description of Artificial Sequence: Synthetic peptide
ATGNGRG

SEQ ID NO: 29603 - protein, 7 aa, Artificial Sequence
  Description of Artificial Sequence: Synthetic peptide
FLGKSGA

SEQ ID NO: 29604 - protein, 7 aa, Artificial Sequence
  Description of Artificial Sequence: Synthetic peptide
GSTSGLD

SEQ ID NO: 29605 - protein, 7 aa, Artificial Sequence
  Description of Artificial Sequence: Synthetic peptide
RGSSSPS

SEQ ID NO: 29606 - protein, 7 aa, Artificial Sequence
  Description of Artificial Sequence: Synthetic peptide
RPIASSG

SEQ ID NO: 29607 - protein, 7 aa, Artificial Sequence
  Description of Artificial Sequence: Synthetic peptide
HVTKSTA

SEQ ID NO: 29608 - protein, 7 aa, Artificial Sequence
  Description of Artificial Sequence: Synthetic peptide
ATSPRLS

SEQ ID NO: 29609 - protein, 7 aa, Artificial Sequence
  Description of Artificial Sequence: Synthetic peptide
RSGTSHS

SEQ ID NO: 29610 - protein, 7 aa, Artificial Sequence
  Description of Artificial Sequence: Synthetic peptide
NGSGLNQ

SEQ ID NO: 29611 - protein, 7 aa, Artificial Sequence
  Description of Artificial Sequence: Synthetic peptide
MMGGVKN

SEQ ID NO: 29612 - protein, 7 aa, Artificial Sequence
  Description of Artificial Sequence: Synthetic peptide
KRPSPDI

SEQ ID NO: 29613 - protein, 7 aa, Artificial Sequence
  Description of Artificial Sequence: Synthetic peptide
SYAKLTA

SEQ ID NO: 29614 - protein, 7 aa, Artificial Sequence
  Description of Artificial Sequence: Synthetic peptide
RITLNSA

SEQ ID NO: 29615 - protein, 7 aa, Artificial Sequence
  Description of Artificial Sequence: Synthetic peptide
YSGLTGS

SEQ ID NO: 29616 - protein, 7 aa, Artificial Sequence
  Description of Artificial Sequence: Synthetic peptide
GAGTSLH

SEQ ID NO: 29617 - protein, 7 aa, Artificial Sequence
  Description of Artificial Sequence: Synthetic peptide
NLGRQVG

SEQ ID NO: 29618 - protein, 7 aa, Artificial Sequence
  Description of Artificial Sequence: Synthetic peptide
IRSKESA

SEQ ID NO: 29619 - protein, 7 aa, Artificial Sequence
  Description of Artificial Sequence: Synthetic peptide
LHDGQTR

SEQ ID NO: 29620 - protein, 7 aa, Artificial Sequence
  Description of Artificial Sequence: Synthetic peptide
KENPVRS

SEQ ID NO: 29621 - protein, 7 aa, Artificial Sequence
  Description of Artificial Sequence: Synthetic peptide
SSKGILA

SEQ ID NO: 29622 - protein, 7 aa, Artificial Sequence
  Description of Artificial Sequence: Synthetic peptide
RTLRSVD

SEQ ID NO: 29623 - protein, 7 aa, Artificial Sequence
  Description of Artificial Sequence: Synthetic peptide
GYTDKHV

SEQ ID NO: 29624 - protein, 7 aa, Artificial Sequence
  Description of Artificial Sequence: Synthetic peptide
GQGVTAK

SEQ ID NO: 29625 - protein, 7 aa, Artificial Sequence
  Description of Artificial Sequence: Synthetic peptide
IRAEVSG

SEQ ID NO: 29626 - protein, 7 aa, Artificial Sequence
  Description of Artificial Sequence: Synthetic peptide
GLRTSSH

SEQ ID NO: 29627 - protein, 7 aa, Artificial Sequence
  Description of Artificial Sequence: Synthetic peptide
GVRGLNV

SEQ ID NO: 29628 - protein, 7 aa, Artificial Sequence
  Description of Artificial Sequence: Synthetic peptide
KVGSPTA

SEQ ID NO: 29629 - protein, 7 aa, Artificial Sequence
  Description of Artificial Sequence: Synthetic peptide
RGSPQSQ

SEQ ID NO: 29630 - protein, 7 aa, Artificial Sequence
  Description of Artificial Sequence: Synthetic peptide
DRKHTST

SEQ ID NO: 29631 - protein, 7 aa, Artificial Sequence
  Description of Artificial Sequence: Synthetic peptide
APSARPS

SEQ ID NO: 29632 - protein, 7 aa, Artificial Sequence
  Description of Artificial Sequence: Synthetic peptide
GFTGSHV

SEQ ID NO: 29633 - protein, 7 aa, Artificial Sequence
  Description of Artificial Sequence: Synthetic peptide
QSGNTIQ

SEQ ID NO: 29634 - protein, 7 aa, Artificial Sequence
  Description of Artificial Sequence: Synthetic peptide
STLRNST

SEQ ID NO: 29635 - protein, 7 aa, Artificial Sequence
  Description of Artificial Sequence: Synthetic peptide
RVVNRGD

SEQ ID NO: 29636 - protein, 7 aa, Artificial Sequence
  Description of Artificial Sequence: Synthetic peptide
WQTGSTM

SEQ ID NO: 29637 - protein, 7 aa, Artificial Sequence
  Description of Artificial Sequence: Synthetic peptide
ENRTSVQ

SEQ ID NO: 29638 - protein, 7 aa, Artificial Sequence
  Description of Artificial Sequence: Synthetic peptide
HLPQTQS

SEQ ID NO: 29639 - protein, 7 aa, Artificial Sequence
  Description of Artificial Sequence: Synthetic peptide
TAPSHTN

SEQ ID NO: 29640 - protein, 7 aa, Artificial Sequence
  Description of Artificial Sequence: Synthetic peptide
ANMGLVK

SEQ ID NO: 29641 - protein, 7 aa, Artificial Sequence
  Description of Artificial Sequence: Synthetic peptide
THGPNVR

SEQ ID NO: 29642 - protein, 7 aa, Artificial Sequence
  Description of Artificial Sequence: Synthetic peptide
DRRSAPS

SEQ ID NO: 29643 - protein, 7 aa, Artificial Sequence
  Description of Artificial Sequence: Synthetic peptide
AKTQSVN

SEQ ID NO: 29644 - protein, 7 aa, Artificial Sequence
  Description of Artificial Sequence: Synthetic peptide
AQPTGTA

SEQ ID NO: 29645 - protein, 7 aa, Artificial Sequence
  Description of Artificial Sequence: Synthetic peptide
SRNSKPV

SEQ ID NO: 29646 - protein, 7 aa, Artificial Sequence
  Description of Artificial Sequence: Synthetic peptide
QRGTKLA

SEQ ID NO: 29647 - protein, 7 aa, Artificial Sequence
  Description of Artificial Sequence: Synthetic peptide
GVLGSKN

SEQ ID NO: 29648 - protein, 7 aa, Artificial Sequence
  Description of Artificial Sequence: Synthetic peptide
TPGASLS

SEQ ID NO: 29649 - protein, 7 aa, Artificial Sequence
  Description of Artificial Sequence: Synthetic peptide
KPQGSLV

SEQ ID NO: 29650 - protein, 7 aa, Artificial Sequence
  Description of Artificial Sequence: Synthetic peptide
PGSIGQH

SEQ ID NO: 29651 - protein, 7 aa, Artificial Sequence
  Description of Artificial Sequence: Synthetic peptide
FSLKGGN

SEQ ID NO: 29652 - protein, 7 aa, Artificial Sequence
  Description of Artificial Sequence: Synthetic peptide
LAQERGT

SEQ ID NO: 29653 - protein, 7 aa, Artificial Sequence
  Description of Artificial Sequence: Synthetic peptide
VPSQSLH

SEQ ID NO: 29654 - protein, 7 aa, Artificial Sequence
  Description of Artificial Sequence: Synthetic peptide
AFPASNC

SEQ ID NO: 29655 - protein, 7 aa, Artificial Sequence
  Description of Artificial Sequence: Synthetic peptide
CRSAPTR

SEQ ID NO: 29656 - protein, 7 aa, Artificial Sequence
  Description of Artificial Sequence: Synthetic peptide
GGSATAV

SEQ ID NO: 29657 - protein, 7 aa, Artificial Sequence
  Description of Artificial Sequence: Synthetic peptide
KIPKGTS

SEQ ID NO: 29658 - protein, 7 aa, Artificial Sequence
  Description of Artificial Sequence: Synthetic peptide
QKQIKVG

SEQ ID NO: 29659 - protein, 7 aa, Artificial Sequence
  Description of Artificial Sequence: Synthetic peptide
NGSARMT

SEQ ID NO: 29660 - protein, 7 aa, Artificial Sequence
  Description of Artificial Sequence: Synthetic peptide
VAARASM

SEQ ID NO: 29661 - protein, 7 aa, Artificial Sequence
  Description of Artificial Sequence: Synthetic peptide
QVSPASR

SEQ ID NO: 29662 - protein, 7 aa, Artificial Sequence
  Description of Artificial Sequence: Synthetic peptide
GIQSGLG

SEQ ID NO: 29663 - protein, 7 aa, Artificial Sequence
  Description of Artificial Sequence: Synthetic peptide
YKPGLQS

SEQ ID NO: 29664 - protein, 7 aa, Artificial Sequence
  Description of Artificial Sequence: Synthetic peptide
RSVGNSM

SEQ ID NO: 29665 - protein, 7 aa, Artificial Sequence
  Description of Artificial Sequence: Synthetic peptide
CLSSSAK

SEQ ID NO: 29666 - protein, 7 aa, Artificial Sequence
  Description of Artificial Sequence: Synthetic peptide
DNPRQAY

SEQ ID NO: 29667 - protein, 7 aa, Artificial Sequence
  Description of Artificial Sequence: Synthetic peptide
FNGLSTQ

SEQ ID NO: 29668 - protein, 7 aa, Artificial Sequence
  Description of Artificial Sequence: Synthetic peptide
SVSTKSA

SEQ ID NO: 29669 - protein, 7 aa, Artificial Sequence
  Description of Artificial Sequence: Synthetic peptide
TSTSPMK

SEQ ID NO: 29670 - protein, 7 aa, Artificial Sequence
  Description of Artificial Sequence: Synthetic peptide
ARNPQVS

SEQ ID NO: 29671 - protein, 7 aa, Artificial Sequence
  Description of Artificial Sequence: Synthetic peptide
LPTVTRS

SEQ ID NO: 29672 - protein, 7 aa, Artificial Sequence
  Description of Artificial Sequence: Synthetic peptide
RSHESMH

SEQ ID NO: 29673 - protein, 7 aa, Artificial Sequence
  Description of Artificial Sequence: Synthetic peptide
MSTHSSG

SEQ ID NO: 29674 - protein, 7 aa, Artificial Sequence
  Description of Artificial Sequence: Synthetic peptide
HRTSPVS

SEQ ID NO: 29675 - protein, 7 aa, Artificial Sequence
  Description of Artificial Sequence: Synthetic peptide
ITSASPC

SEQ ID NO: 29676 - protein, 7 aa, Artificial Sequence
  Description of Artificial Sequence: Synthetic peptide
SSMRESS

SEQ ID NO: 29677 - protein, 7 aa, Artificial Sequence
  Description of Artificial Sequence: Synthetic peptide
SGFQHTK

SEQ ID NO: 29678 - protein, 7 aa, Artificial Sequence
  Description of Artificial Sequence: Synthetic peptide
SGMSRHV

SEQ ID NO: 29679 - protein, 7 aa, Artificial Sequence
  Description of Artificial Sequence: Synthetic peptide
SRNGGPL

SEQ ID NO: 29680 - protein, 7 aa, Artificial Sequence
  Description of Artificial Sequence: Synthetic peptide
GSNSAYT

SEQ ID NO: 29681 - protein, 7 aa, Artificial Sequence
  Description of Artificial Sequence: Synthetic peptide
VQGTGNT

SEQ ID NO: 29682 - protein, 7 aa, Artificial Sequence
  Description of Artificial Sequence: Synthetic peptide
MVSSKSS

SEQ ID NO: 29683 - protein, 7 aa, Artificial Sequence
  Description of Artificial Sequence: Synthetic peptide
RSNTPPK

SEQ ID NO: 29684 - protein, 7 aa, Artificial Sequence
  Description of Artificial Sequence: Synthetic peptide
AMSSNNG

SEQ ID NO: 29685 - protein, 7 aa, Artificial Sequence
  Description of Artificial Sequence: Synthetic peptide
DKASSVS

SEQ ID NO: 29686 - protein, 7 aa, Artificial Sequence
  Description of Artificial Sequence: Synthetic peptide
CSPPTRG

SEQ ID NO: 29687 - protein, 7 aa, Artificial Sequence
  Description of Artificial Sequence: Synthetic peptide
MNGKDVV

SEQ ID NO: 29688 - protein, 7 aa, Artificial Sequence
  Description of Artificial Sequence: Synthetic peptide
RTQSLTA

SEQ ID NO: 29689 - protein, 7 aa, Artificial Sequence
  Description of Artificial Sequence: Synthetic peptide
RSTDTHG

SEQ ID NO: 29690 - protein, 7 aa, Artificial Sequence
  Description of Artificial Sequence: Synthetic peptide
GSDQRRM

SEQ ID NO: 29691 - protein, 7 aa, Artificial Sequence
  Description of Artificial Sequence: Synthetic peptide
DHRSKVL

SEQ ID NO: 29692 - protein, 7 aa, Artificial Sequence
  Description of Artificial Sequence: Synthetic peptide
SSLTTPH

SEQ ID NO: 29693 - protein, 7 aa, Artificial Sequence
  Description of Artificial Sequence: Synthetic peptide
LASGTPS

SEQ ID NO: 29694 - protein, 7 aa, Artificial Sequence
  Description of Artificial Sequence: Synthetic peptide
LVRQSSA

SEQ ID NO: 29695 - protein, 7 aa, Artificial Sequence
  Description of Artificial Sequence: Synthetic peptide
ASPNRGS

SEQ ID NO: 29696 - protein, 7 aa, Artificial Sequence
  Description of Artificial Sequence: Synthetic peptide
SPHTHQK

SEQ ID NO: 29697 - protein, 7 aa, Artificial Sequence
  Description of Artificial Sequence: Synthetic peptide
VRTGTSN

SEQ ID NO: 29698 - protein, 7 aa, Artificial Sequence
  Description of Artificial Sequence: Synthetic peptide
PLNTHQS

SEQ ID NO: 29699 - protein, 7 aa, Artificial Sequence
  Description of Artificial Sequence: Synthetic peptide
GNHTTGK

SEQ ID NO: 29700 - protein, 7 aa, Artificial Sequence
  Description of Artificial Sequence: Synthetic peptide
SQPAGRS

SEQ ID NO: 29701 - protein, 7 aa, Artificial Sequence
  Description of Artificial Sequence: Synthetic peptide
SLQGNRM

SEQ ID NO: 29702 - protein, 7 aa, Artificial Sequence
  Description of Artificial Sequence: Synthetic peptide
TPHGTRV

SEQ ID NO: 29703 - protein, 7 aa, Artificial Sequence
  Description of Artificial Sequence: Synthetic peptide
SQPIGAR

SEQ ID NO: 29704 - protein, 7 aa, Artificial Sequence
  Description of Artificial Sequence: Synthetic peptide
VGLRSNT

SEQ ID NO: 29705 - protein, 7 aa, Artificial Sequence
  Description of Artificial Sequence: Synthetic peptide
ARNPTST

SEQ ID NO: 29706 - protein, 7 aa, Artificial Sequence
  Description of Artificial Sequence: Synthetic peptide
ITATAES

SEQ ID NO: 29707 - protein, 7 aa, Artificial Sequence
  Description of Artificial Sequence: Synthetic peptide
ASTNSMQ

SEQ ID NO: 29708 - protein, 7 aa, Artificial Sequence
  Description of Artificial Sequence: Synthetic peptide
NEARSAN

SEQ ID NO: 29709 - protein, 7 aa, Artificial Sequence
  Description of Artificial Sequence: Synthetic peptide
RSSDRSA

SEQ ID NO: 29710 - protein, 7 aa, Artificial Sequence
  Description of Artificial Sequence: Synthetic peptide
RGSANFL

SEQ ID NO: 29711 - protein, 7 aa, Artificial Sequence
  Description of Artificial Sequence: Synthetic peptide
LTPRGQM

SEQ ID NO: 29712 - protein, 7 aa, Artificial Sequence
  Description of Artificial Sequence: Synthetic peptide
NGNSLTR

SEQ ID NO: 29713 - protein, 7 aa, Artificial Sequence
  Description of Artificial Sequence: Synthetic peptide
AYSETRG

SEQ ID NO: 29714 - protein, 7 aa, Artificial Sequence
  Description of Artificial Sequence: Synthetic peptide
NIAQKDL

SEQ ID NO: 29715 - protein, 7 aa, Artificial Sequence
  Description of Artificial Sequence: Synthetic peptide
YSTSESK

SEQ ID NO: 29716 - protein, 7 aa, Artificial Sequence
  Description of Artificial Sequence: Synthetic peptide
MGNPRHV

SEQ ID NO: 29717 - protein, 7 aa, Artificial Sequence
  Description of Artificial Sequence: Synthetic peptide
SRSKESA

SEQ ID NO: 29718 - protein, 7 aa, Artificial Sequence
  Description of Artificial Sequence: Synthetic peptide
QANTIGK

SEQ ID NO: 29719 - protein, 7 aa, Artificial Sequence
  Description of Artificial Sequence: Synthetic peptide
TSAPRSC

SEQ ID NO: 29720 - protein, 7 aa, Artificial Sequence
  Description of Artificial Sequence: Synthetic peptide
YINSPSN

SEQ ID NO: 29721 - protein, 7 aa, Artificial Sequence
  Description of Artificial Sequence: Synthetic peptide
NKSNTFL

SEQ ID NO: 29722 - protein, 7 aa, Artificial Sequence
  Description of Artificial Sequence: Synthetic peptide
ARDERAF

SEQ ID NO: 29723 - protein, 7 aa, Artificial Sequence
  Description of Artificial Sequence: Synthetic peptide
NPGESHR

SEQ ID NO: 29724 - protein, 7 aa, Artificial Sequence
  Description of Artificial Sequence: Synthetic peptide
SHSSPYK

SEQ ID NO: 29725 - protein, 7 aa, Artificial Sequence
  Description of Artificial Sequence: Synthetic peptide
STSSSAS

SEQ ID NO: 29726 - protein, 7 aa, Artificial Sequence
  Description of Artificial Sequence: Synthetic peptide
IGQSTNG

SEQ ID NO: 29727 - protein, 7 aa, Artificial Sequence
  Description of Artificial Sequence: Synthetic peptide
TMPAQRS

SEQ ID NO: 29728 - protein, 7 aa, Artificial Sequence
  Description of Artificial Sequence: Synthetic peptide
CIGNKTN

SEQ ID NO: 29729 - protein, 7 aa, Artificial Sequence
  Description of Artificial Sequence: Synthetic peptide
PADNHRP

SEQ ID NO: 29730 - protein, 7 aa, Artificial Sequence
  Description of Artificial Sequence: Synthetic peptide
NSNLSTQ

SEQ ID NO: 29731 - protein, 7 aa, Artificial Sequence
  Description of Artificial Sequence: Synthetic peptide
DGVGMYA

SEQ ID NO: 29732 - protein, 7 aa, Artificial Sequence
  Description of Artificial Sequence: Synthetic peptide
HMKHLQV

SEQ ID NO: 29733 - protein, 7 aa, Artificial Sequence
  Description of Artificial Sequence: Synthetic peptide
ATVGHMT

SEQ ID NO: 29734 - protein, 7 aa, Artificial Sequence
  Description of Artificial Sequence: Synthetic peptide
DQGNGYG

SEQ ID NO: 29735 - protein, 7 aa, Artificial Sequence
  Description of Artificial Sequence: Synthetic peptide
DVAQDRS

SEQ ID NO: 29736 - protein, 7 aa, Artificial Sequence
  Description of Artificial Sequence: Synthetic peptide
RLTGIST

SEQ ID NO: 29737 - protein, 7 aa, Artificial Sequence
  Description of Artificial Sequence: Synthetic peptide
GRLTSSI

SEQ ID NO: 29738 - protein, 7 aa, Artificial Sequence
  Description of Artificial Sequence: Synthetic peptide
RFQNNTG

SEQ ID NO: 29739 - protein, 7 aa, Artificial Sequence
  Description of Artificial Sequence: Synthetic peptide
GPSQQVI

SEQ ID NO: 29740 - protein, 7 aa, Artificial Sequence
  Description of Artificial Sequence: Synthetic peptide
GRSPTAS

SEQ ID NO: 29741 - protein, 7 aa, Artificial Sequence
  Description of Artificial Sequence: Synthetic peptide
ENDHNVR

SEQ ID NO: 29742 - protein, 7 aa, Artificial Sequence
  Description of Artificial Sequence: Synthetic peptide
LGPHPTH

SEQ ID NO: 29743 - protein, 7 aa, Artificial Sequence
  Description of Artificial Sequence: Synthetic peptide
DDRSARG

SEQ ID NO: 29744 - protein, 7 aa, Artificial Sequence
  Description of Artificial Sequence: Synthetic peptide
TGMSHMG

SEQ ID NO: 29745 - protein, 7 aa, Artificial Sequence
  Description of Artificial Sequence: Synthetic peptide
TGASPLA

SEQ ID NO: 29746 - protein, 7 aa, Artificial Sequence
  Description of Artificial Sequence: Synthetic peptide
TSTRSSC

SEQ ID NO: 29747 - protein, 7 aa, Artificial Sequence
  Description of Artificial Sequence: Synthetic peptide
CLVRPMA

SEQ ID NO: 29748 - protein, 7 aa, Artificial Sequence
  Description of Artificial Sequence: Synthetic peptide
KLNMKGP

SEQ ID NO: 29749 - protein, 7 aa, Artificial Sequence
  Description of Artificial Sequence: Synthetic peptide
CLPNHCN

SEQ ID NO: 29750 - protein, 7 aa, Artificial Sequence
  Description of Artificial Sequence: Synthetic peptide
GWNHENV

SEQ ID NO: 29751 - protein, 7 aa, Artificial Sequence
  Description of Artificial Sequence: Synthetic peptide
FAMPREN

SEQ ID NO: 29752 - protein, 7 aa, Artificial Sequence
  Description of Artificial Sequence: Synthetic peptide
GLRNDTV

SEQ ID NO: 29753 - protein, 7 aa, Artificial Sequence
  Description of Artificial Sequence: Synthetic peptide
QQGRTAG

SEQ ID NO: 29754 - protein, 7 aa, Artificial Sequence
  Description of Artificial Sequence: Synthetic peptide
GQGVRAM

SEQ ID NO: 29755 - protein, 7 aa, Artificial Sequence
  Description of Artificial Sequence: Synthetic peptide
SISTRTG

SEQ ID NO: 29756 - protein, 7 aa, Artificial Sequence
  Description of Artificial Sequence: Synthetic peptide
QSSRTVT

SEQ ID NO: 29757 - protein, 7 aa, Artificial Sequence
  Description of Artificial Sequence: Synthetic peptide
PSTHKAQ

SEQ ID NO: 29758 - protein, 7 aa, Artificial Sequence
  Description of Artificial Sequence: Synthetic peptide
ANTSGQA

SEQ ID NO: 29759 - protein, 7 aa, Artificial Sequence
  Description of Artificial Sequence: Synthetic peptide
DKTQKQL

SEQ ID NO: 29760 - protein, 7 aa, Artificial Sequence
  Description of Artificial Sequence: Synthetic peptide
SGASPAR

SEQ ID NO: 29761 - protein, 7 aa, Artificial Sequence
  Description of Artificial Sequence: Synthetic peptide
GKPTQQG

SEQ ID NO: 29762 - protein, 7 aa, Artificial Sequence
  Description of Artificial Sequence: Synthetic peptide
RGVSTPT

SEQ ID NO: 29763 - protein, 7 aa, Artificial Sequence
  Description of Artificial Sequence: Synthetic peptide
YASSRDG

SEQ ID NO: 29764 - protein, 7 aa, Artificial Sequence
  Description of Artificial Sequence: Synthetic peptide
APSAGMS

SEQ ID NO: 29765 - protein, 7 aa, Artificial Sequence
  Description of Artificial Sequence: Synthetic peptide
IGSNARQ

SEQ ID NO: 29766 - protein, 7 aa, Artificial Sequence
  Description of Artificial Sequence: Synthetic peptide
GGSNLRT

SEQ ID NO: 29767 - protein, 7 aa, Artificial Sequence
  Description of Artificial Sequence: Synthetic peptide
TQSSSRT

SEQ ID NO: 29768 - protein, 7 aa, Artificial Sequence
  Description of Artificial Sequence: Synthetic peptide
GLPLRSV

SEQ ID NO: 29769 - protein, 7 aa, Artificial Sequence
  Description of Artificial Sequence: Synthetic peptide
SSVGRLN

SEQ ID NO: 29770 - protein, 7 aa, Artificial Sequence
  Description of Artificial Sequence: Synthetic peptide
DMGSSLS

SEQ ID NO: 29771 - protein, 7 aa, Artificial Sequence
  Description of Artificial Sequence: Synthetic peptide
VTNSAPT

SEQ ID NO: 29772 - protein, 7 aa, Artificial Sequence
  Description of Artificial Sequence: Synthetic peptide
AMGSRLS

SEQ ID NO: 29773 - protein, 7 aa, Artificial Sequence
  Description of Artificial Sequence: Synthetic peptide
TPALKNA

SEQ ID NO: 29774 - protein, 7 aa, Artificial Sequence
  Description of Artificial Sequence: Synthetic peptide
SGGQAMG

SEQ ID NO: 29775 - protein, 7 aa, Artificial Sequence
  Description of Artificial Sequence: Synthetic peptide
SRETVPT

SEQ ID NO: 29776 - protein, 7 aa, Artificial Sequence
  Description of Artificial Sequence: Synthetic peptide
INQSTYK

SEQ ID NO: 29777 - protein, 7 aa, Artificial Sequence
  Description of Artificial Sequence: Synthetic peptide
HASSPCI

SEQ ID NO: 29778 - protein, 7 aa, Artificial Sequence
  Description of Artificial Sequence: Synthetic peptide
SKNVSSK

SEQ ID NO: 29779 - protein, 7 aa, Artificial Sequence
  Description of Artificial Sequence: Synthetic peptide
HGSLESA

SEQ ID NO: 29780 - protein, 7 aa, Artificial Sequence
  Description of Artificial Sequence: Synthetic peptide
HRTAPVS

SEQ ID NO: 29781 - protein, 7 aa, Artificial Sequence
  Description of Artificial Sequence: Synthetic peptide
NISTMSK

SEQ ID NO: 29782 - protein, 7 aa, Artificial Sequence
  Description of Artificial Sequence: Synthetic peptide
LGMRDNT

SEQ ID NO: 29783 - protein, 7 aa, Artificial Sequence
  Description of Artificial Sequence: Synthetic peptide
DLQTSAK

SEQ ID NO: 29784 - protein, 7 aa, Artificial Sequence
  Description of Artificial Sequence: Synthetic peptide
QSNPRPG

SEQ ID NO: 29785 - protein, 7 aa, Artificial Sequence
  Description of Artificial Sequence: Synthetic peptide
HSSKSHD

SEQ ID NO: 29786 - protein, 7 aa, Artificial Sequence
  Description of Artificial Sequence: Synthetic peptide
SSTSLGS

SEQ ID NO: 29787 - protein, 7 aa, Artificial Sequence
  Description of Artificial Sequence: Synthetic peptide
PRHTVSP

SEQ ID NO: 29788 - protein, 7 aa, Artificial Sequence
  Description of Artificial Sequence: Synthetic peptide
VNGATAV

SEQ ID NO: 29789 - protein, 7 aa, Artificial Sequence
  Description of Artificial Sequence: Synthetic peptide
PVMTRTP

SEQ ID NO: 29790 - protein, 7 aa, Artificial Sequence
  Description of Artificial Sequence: Synthetic peptide
CTTRQGN

SEQ ID NO: 29791 - protein, 7 aa, Artificial Sequence
  Description of Artificial Sequence: Synthetic peptide
VMGAGAS

SEQ ID NO: 29792 - protein, 7 aa, Artificial Sequence
  Description of Artificial Sequence: Synthetic peptide
PAAHNAV

SEQ ID NO: 29793 - protein, 7 aa, Artificial Sequence
  Description of Artificial Sequence: Synthetic peptide
LGKPAQP

SEQ ID NO: 29794 - protein, 7 aa, Artificial Sequence
  Description of Artificial Sequence: Synthetic peptide
FRTTAST

SEQ ID NO: 29795 - protein, 7 aa, Artificial Sequence
  Description of Artificial Sequence: Synthetic peptide
IRTKDSR

SEQ ID NO: 29796 - protein, 7 aa, Artificial Sequence
  Description of Artificial Sequence: Synthetic peptide
SHTPKLV

SEQ ID NO: 29797 - protein, 7 aa, Artificial Sequence
  Description of Artificial Sequence: Synthetic peptide
PAGRSSN

SEQ ID NO: 29798 - protein, 7 aa, Artificial Sequence
  Description of Artificial Sequence: Synthetic peptide
RSLPNVA

SEQ ID NO: 29799 - protein, 7 aa, Artificial Sequence
  Description of Artificial Sequence: Synthetic peptide
VRSNVSG

SEQ ID NO: 29800 - protein, 7 aa, Artificial Sequence
  Description of Artificial Sequence: Synthetic peptide
SDKGNTR

SEQ ID NO: 29801 - protein, 7 aa, Artificial Sequence
  Description of Artificial Sequence: Synthetic peptide
MNTQGPI

SEQ ID NO: 29802 - protein, 7 aa, Artificial Sequence
  Description of Artificial Sequence: Synthetic peptide
SSQTRGL

SEQ ID NO: 29803 - protein, 7 aa, Artificial Sequence
  Description of Artificial Sequence: Synthetic peptide
PDNRVRA

SEQ ID NO: 29804 - protein, 7 aa, Artificial Sequence
  Description of Artificial Sequence: Synthetic peptide
YPRQRTE

SEQ ID NO: 29805 - protein, 7 aa, Artificial Sequence
  Description of Artificial Sequence: Synthetic peptide
LKPQMHT

SEQ ID NO: 29806 - protein, 7 aa, Artificial Sequence
  Description of Artificial Sequence: Synthetic peptide
ALTGKLS

SEQ ID NO: 29807 - protein, 7 aa, Artificial Sequence
  Description of Artificial Sequence: Synthetic peptide
PTQHQRG

SEQ ID NO: 29808 - protein, 7 aa, Artificial Sequence
  Description of Artificial Sequence: Synthetic peptide
SRVDQYK

SEQ ID NO: 29809 - protein, 7 aa, Artificial Sequence
  Description of Artificial Sequence: Synthetic peptide
IGTTPPK

SEQ ID NO: 29810 - protein, 7 aa, Artificial Sequence
  Description of Artificial Sequence: Synthetic peptide
GSTKPSP

SEQ ID NO: 29811 - protein, 7 aa, Artificial Sequence
  Description of Artificial Sequence: Synthetic peptide
SIPSTVR

SEQ ID NO: 29812 - protein, 7 aa, Artificial Sequence
  Description of Artificial Sequence: Synthetic peptide
SSSVTAR

SEQ ID NO: 29813 - protein, 7 aa, Artificial Sequence
  Description of Artificial Sequence: Synthetic peptide
SSGGNMS

SEQ ID NO: 29814 - protein, 7 aa, Artificial Sequence
  Description of Artificial Sequence: Synthetic peptide
SVGAPTL

SEQ ID NO: 29815 - protein, 7 aa, Artificial Sequence
  Description of Artificial Sequence: Synthetic peptide
ITSVKTA

SEQ ID NO: 29816 - protein, 7 aa, Artificial Sequence
  Description of Artificial Sequence: Synthetic peptide
RSYDPNR

SEQ ID NO: 29817 - protein, 7 aa, Artificial Sequence
  Description of Artificial Sequence: Synthetic peptide
NKMTSVS

SEQ ID NO: 29818 - protein, 7 aa, Artificial Sequence
  Description of Artificial Sequence: Synthetic peptide
LAMERQR

SEQ ID NO: 29819 - protein, 7 aa, Artificial Sequence
  Description of Artificial Sequence: Synthetic peptide
GKGVGQR

SEQ ID NO: 29820 - protein, 7 aa, Artificial Sequence
  Description of Artificial Sequence: Synthetic peptide
PVDTSHK

SEQ ID NO: 29821 - protein, 7 aa, Artificial Sequence
  Description of Artificial Sequence: Synthetic peptide
RTTSSLV

SEQ ID NO: 29822 - protein, 7 aa, Artificial Sequence
  Description of Artificial Sequence: Synthetic peptide
VPSRAAT

SEQ ID NO: 29823 - protein, 7 aa, Artificial Sequence
  Description of Artificial Sequence: Synthetic peptide
AATNSLT

SEQ ID NO: 29824 - protein, 7 aa, Artificial Sequence
  Description of Artificial Sequence: Synthetic peptide
SATGSRL

SEQ ID NO: 29825 - protein, 7 aa, Artificial Sequence
  Description of Artificial Sequence: Synthetic peptide
SVVSHKS

SEQ ID NO: 29826 - protein, 7 aa, Artificial Sequence
  Description of Artificial Sequence: Synthetic peptide
SRTAGVQ

SEQ ID NO: 29827 - protein, 7 aa, Artificial Sequence
  Description of Artificial Sequence: Synthetic peptide
TVNTRSA

SEQ ID NO: 29828 - protein, 7 aa, Artificial Sequence
  Description of Artificial Sequence: Synthetic peptide
WTVSRSG

SEQ ID NO: 29829 - protein, 7 aa, Artificial Sequence
  Description of Artificial Sequence: Synthetic peptide
NLTSSSS

SEQ ID NO: 29830 - protein, 7 aa, Artificial Sequence
  Description of Artificial Sequence: Synthetic peptide
RAHPTLG

SEQ ID NO: 29831 - protein, 7 aa, Artificial Sequence
  Description of Artificial Sequence: Synthetic peptide
PMINSSD

SEQ ID NO: 29832 - protein, 7 aa, Artificial Sequence
  Description of Artificial Sequence: Synthetic peptide
STVATSF

SEQ ID NO: 29833 - protein, 7 aa, Artificial Sequence
  Description of Artificial Sequence: Synthetic peptide
TSGSARG

SEQ ID NO: 29834 - protein, 7 aa, Artificial Sequence
  Description of Artificial Sequence: Synthetic peptide
STTNKAH

SEQ ID NO: 29835 - protein, 7 aa, Artificial Sequence
  Description of Artificial Sequence: Synthetic peptide
NLHLAGT

SEQ ID NO: 29836 - protein, 7 aa, Artificial Sequence
  Description of Artificial Sequence: Synthetic peptide
RNVSHPG

SEQ ID NO: 29837 - protein, 7 aa, Artificial Sequence
  Description of Artificial Sequence: Synthetic peptide
STGKATC

SEQ ID NO: 29838 - protein, 7 aa, Artificial Sequence
  Description of Artificial Sequence: Synthetic peptide
KNYDNAV

SEQ ID NO: 29839 - protein, 7 aa, Artificial Sequence
  Description of Artificial Sequence: Synthetic peptide
TEARSAN

SEQ ID NO: 29840 - protein, 7 aa, Artificial Sequence
  Description of Artificial Sequence: Synthetic peptide
RTLSNHG

SEQ ID NO: 29841 - protein, 7 aa, Artificial Sequence
  Description of Artificial Sequence: Synthetic peptide
SSAPSLS

SEQ ID NO: 29842 - protein, 7 aa, Artificial Sequence
  Description of Artificial Sequence: Synthetic peptide
GNMRNLA

SEQ ID NO: 29843 - protein, 7 aa, Artificial Sequence
  Description of Artificial Sequence: Synthetic peptide
NVVGTGA

SEQ ID NO: 29844 - protein, 7 aa, Artificial Sequence
  Description of Artificial Sequence: Synthetic peptide
ETTVRAS

SEQ ID NO: 29845 - protein, 7 aa, Artificial Sequence
  Description of Artificial Sequence: Synthetic peptide
TSSTTSL

SEQ ID NO: 29846 - protein, 7 aa, Artificial Sequence
  Description of Artificial Sequence: Synthetic peptide
RPSNASG

SEQ ID NO: 29847 - protein, 7 aa, Artificial Sequence
  Description of Artificial Sequence: Synthetic peptide
GDHNRMN

SEQ ID NO: 29848 - protein, 7 aa, Artificial Sequence
  Description of Artificial Sequence: Synthetic peptide
DRMGTAH

SEQ ID NO: 29849 - protein, 7 aa, Artificial Sequence
  Description of Artificial Sequence: Synthetic peptide
VASSPLR

SEQ ID NO: 29850 - protein, 7 aa, Artificial Sequence
  Description of Artificial Sequence: Synthetic peptide
MATSTVK

SEQ ID NO: 29851 - protein, 7 aa, Artificial Sequence
  Description of Artificial Sequence: Synthetic peptide
RTLSNNG

SEQ ID NO: 29852 - protein, 7 aa, Artificial Sequence
  Description of Artificial Sequence: Synthetic peptide
GMIPSSR

SEQ ID NO: 29853 - protein, 7 aa, Artificial Sequence
  Description of Artificial Sequence: Synthetic peptide
PSHMASA

SEQ ID NO: 29854 - protein, 7 aa, Artificial Sequence
  Description of Artificial Sequence: Synthetic peptide
HSHGKSI

SEQ ID NO: 29855 - protein, 7 aa, Artificial Sequence
  Description of Artificial Sequence: Synthetic peptide
GNSMAGT

SEQ ID NO: 29856 - protein, 7 aa, Artificial Sequence
  Description of Artificial Sequence: Synthetic peptide
VSTKSAP

SEQ ID NO: 29857 - protein, 7 aa, Artificial Sequence
  Description of Artificial Sequence: Synthetic peptide
GVNIHAT

SEQ ID NO: 29858 - protein, 7 aa, Artificial Sequence
  Description of Artificial Sequence: Synthetic peptide
DVLSKRQ

SEQ ID NO: 29859 - protein, 7 aa, Artificial Sequence
  Description of Artificial Sequence: Synthetic peptide
TDTNRMY

SEQ ID NO: 29860 - protein, 7 aa, Artificial Sequence
  Description of Artificial Sequence: Synthetic peptide
ANHSIRS

SEQ ID NO: 29861 - protein, 7 aa, Artificial Sequence
  Description of Artificial Sequence: Synthetic peptide
HGDSGKV

SEQ ID NO: 29862 - protein, 7 aa, Artificial Sequence
  Description of Artificial Sequence: Synthetic peptide
RMQVSPF

SEQ ID NO: 29863 - protein, 7 aa, Artificial Sequence
  Description of Artificial Sequence: Synthetic peptide
MLNTSHY

SEQ ID NO: 29864 - protein, 7 aa, Artificial Sequence
  Description of Artificial Sequence: Synthetic peptide
SLSTGSG

SEQ ID NO: 29865 - protein, 7 aa, Artificial Sequence
  Description of Artificial Sequence: Synthetic peptide
KSSSHAT

SEQ ID NO: 29866 - protein, 7 aa, Artificial Sequence
  Description of Artificial Sequence: Synthetic peptide
MVPNGRA

SEQ ID NO: 29867 - protein, 7 aa, Artificial Sequence
  Description of Artificial Sequence: Synthetic peptide
LNQHSSI

SEQ ID NO: 29868 - protein, 7 aa, Artificial Sequence
  Description of Artificial Sequence: Synthetic peptide
YNKNAQL

SEQ ID NO: 29869 - protein, 7 aa, Artificial Sequence
  Description of Artificial Sequence: Synthetic peptide
HPETAFK

SEQ ID NO: 29870 - protein, 7 aa, Artificial Sequence
  Description of Artificial Sequence: Synthetic peptide
SQQTTEA

SEQ ID NO: 29871 - protein, 7 aa, Artificial Sequence
  Description of Artificial Sequence: Synthetic peptide
TLGQEVR

SEQ ID NO: 29872 - protein, 7 aa, Artificial Sequence
  Description of Artificial Sequence: Synthetic peptide
RGATSTS

SEQ ID NO: 29873 - protein, 7 aa, Artificial Sequence
  Description of Artificial Sequence: Synthetic peptide
RHTIDSP

SEQ ID NO: 29874 - protein, 7 aa, Artificial Sequence
  Description of Artificial Sequence: Synthetic peptide
RSSNGYL

SEQ ID NO: 29875 - protein, 7 aa, Artificial Sequence
  Description of Artificial Sequence: Synthetic peptide
ILPRGVD

SEQ ID NO: 29876 - protein, 7 aa, Artificial Sequence
  Description of Artificial Sequence: Synthetic peptide
TNMQSVL

SEQ ID NO: 29877 - protein, 7 aa, Artificial Sequence
  Description of Artificial Sequence: Synthetic peptide
GVYGQSL

SEQ ID NO: 29878 - protein, 7 aa, Artificial Sequence
  Description of Artificial Sequence: Synthetic peptide
GSNRILG

SEQ ID NO: 29879 - protein, 7 aa, Artificial Sequence
  Description of Artificial Sequence: Synthetic peptide
SCSRDST

SEQ ID NO: 29880 - protein, 7 aa, Artificial Sequence
  Description of Artificial Sequence: Synthetic peptide
NSRQGTN

SEQ ID NO: 29881 - protein, 7 aa, Artificial Sequence
  Description of Artificial Sequence: Synthetic peptide
QSTERLA

SEQ ID NO: 29882 - protein, 7 aa, Artificial Sequence
  Description of Artificial Sequence: Synthetic peptide
PFTRNAL

SEQ ID NO: 29883 - protein, 7 aa, Artificial Sequence
  Description of Artificial Sequence: Synthetic peptide
GRSMERS

SEQ ID NO: 29884 - protein, 7 aa, Artificial Sequence
  Description of Artificial Sequence: Synthetic peptide
GDKTQAM

SEQ ID NO: 29885 - protein, 7 aa, Artificial Sequence
  Description of Artificial Sequence: Synthetic peptide
HGSSSFT

SEQ ID NO: 29886 - protein, 7 aa, Artificial Sequence
  Description of Artificial Sequence: Synthetic peptide
NRGKASS

SEQ ID NO: 29887 - protein, 7 aa, Artificial Sequence
  Description of Artificial Sequence: Synthetic peptide
SSPTRSL

SEQ ID NO: 29888 - protein, 7 aa, Artificial Sequence
  Description of Artificial Sequence: Synthetic peptide
ADGRNSS

SEQ ID NO: 29889 - protein, 7 aa, Artificial Sequence
  Description of Artificial Sequence: Synthetic peptide
STHHPAS

SEQ ID NO: 29890 - protein, 7 aa, Artificial Sequence
  Description of Artificial Sequence: Synthetic peptide
NGSGQDQ

SEQ ID NO: 29891 - protein, 7 aa, Artificial Sequence
  Description of Artificial Sequence: Synthetic peptide
NPSHTSV

SEQ ID NO: 29892 - protein, 7 aa, Artificial Sequence
  Description of Artificial Sequence: Synthetic peptide
TRSNSAV

SEQ ID NO: 29893 - protein, 7 aa, Artificial Sequence
  Description of Artificial Sequence: Synthetic peptide
MSTGVSP

SEQ ID NO: 29894 - protein, 7 aa, Artificial Sequence
  Description of Artificial Sequence: Synthetic peptide
PMDVRSD

SEQ ID NO: 29895 - protein, 7 aa, Artificial Sequence
  Description of Artificial Sequence: Synthetic peptide
PQNLAHV

SEQ ID NO: 29896 - protein, 7 aa, Artificial Sequence
  Description of Artificial Sequence: Synthetic peptide
KNPSSAP

SEQ ID NO: 29897 - protein, 7 aa, Artificial Sequence
  Description of Artificial Sequence: Synthetic peptide
PVPYRAD

SEQ ID NO: 29898 - protein, 7 aa, Artificial Sequence
  Description of Artificial Sequence: Synthetic peptide
AQRNISS

SEQ ID NO: 29899 - protein, 7 aa, Artificial Sequence
  Description of Artificial Sequence: Synthetic peptide
SQNVSSK

SEQ ID NO: 29900 - protein, 7 aa, Artificial Sequence
  Description of Artificial Sequence: Synthetic peptide
YPSSVQQ

SEQ ID NO: 29901 - protein, 7 aa, Artificial Sequence
  Description of Artificial Sequence: Synthetic peptide
STAYNTN

SEQ ID NO: 29902 - protein, 7 aa, Artificial Sequence
  Description of Artificial Sequence: Synthetic peptide
RMREKPY

SEQ ID NO: 29903 - protein, 7 aa, Artificial Sequence
  Description of Artificial Sequence: Synthetic peptide
TLRGGSS

SEQ ID NO: 29904 - protein, 7 aa, Artificial Sequence
  Description of Artificial Sequence: Synthetic peptide
VSSMKSG

SEQ ID NO: 29905 - protein, 7 aa, Artificial Sequence
  Description of Artificial Sequence: Synthetic peptide
LTQRDFS

SEQ ID NO: 29906 - protein, 7 aa, Artificial Sequence
  Description of Artificial Sequence: Synthetic peptide
DVLSKSQ

SEQ ID NO: 29907 - protein, 7 aa, Artificial Sequence
  Description of Artificial Sequence: Synthetic peptide
CVTGGLT

SEQ ID NO: 29908 - protein, 7 aa, Artificial Sequence
  Description of Artificial Sequence: Synthetic peptide
KQPASTH

SEQ ID NO: 29909 - protein, 7 aa, Artificial Sequence
  Description of Artificial Sequence: Synthetic peptide
HLRGGSS

SEQ ID NO: 29910 - protein, 7 aa, Artificial Sequence
  Description of Artificial Sequence: Synthetic peptide
DDRSNLS

SEQ ID NO: 29911 - protein, 7 aa, Artificial Sequence
  Description of Artificial Sequence: Synthetic peptide
SGSPLCG

SEQ ID NO: 29912 - protein, 7 aa, Artificial Sequence
  Description of Artificial Sequence: Synthetic peptide
HIGTGAR

SEQ ID NO: 29913 - protein, 7 aa, Artificial Sequence
  Description of Artificial Sequence: Synthetic peptide
PRTNVMP

SEQ ID NO: 29914 - protein, 7 aa, Artificial Sequence
  Description of Artificial Sequence: Synthetic peptide
PGGGRAI

SEQ ID NO: 29915 - protein, 7 aa, Artificial Sequence
  Description of Artificial Sequence: Synthetic peptide
YQVPLAK

SEQ ID NO: 29916 - protein, 7 aa, Artificial Sequence
  Description of Artificial Sequence: Synthetic peptide
MTGHSSV

SEQ ID NO: 29917 - protein, 7 aa, Artificial Sequence
  Description of Artificial Sequence: Synthetic peptide
LQVNMAR

SEQ ID NO: 29918 - protein, 7 aa, Artificial Sequence
  Description of Artificial Sequence: Synthetic peptide
HTAHSSL

SEQ ID NO: 29919 - protein, 7 aa, Artificial Sequence
  Description of Artificial Sequence: Synthetic peptide
GSSPSLR

SEQ ID NO: 29920 - protein, 7 aa, Artificial Sequence
  Description of Artificial Sequence: Synthetic peptide
SGTSIRT

SEQ ID NO: 29921 - protein, 7 aa, Artificial Sequence
  Description of Artificial Sequence: Synthetic peptide
HRSNSTT

SEQ ID NO: 29922 - protein, 7 aa, Artificial Sequence
  Description of Artificial Sequence: Synthetic peptide
TTNTVSR

SEQ ID NO: 29923 - protein, 7 aa, Artificial Sequence
  Description of Artificial Sequence: Synthetic peptide
GYSNQMT

SEQ ID NO: 29924 - protein, 7 aa, Artificial Sequence
  Description of Artificial Sequence: Synthetic peptide
KQPDSTH

SEQ ID NO: 29925 - protein, 7 aa, Artificial Sequence
  Description of Artificial Sequence: Synthetic peptide
RSNGSAA

SEQ ID NO: 29926 - protein, 7 aa, Artificial Sequence
  Description of Artificial Sequence: Synthetic peptide
TTSNKDS

SEQ ID NO: 29927 - protein, 7 aa, Artificial Sequence
  Description of Artificial Sequence: Synthetic peptide
NGLPGAM

SEQ ID NO: 29928 - protein, 7 aa, Artificial Sequence
  Description of Artificial Sequence: Synthetic peptide
RAGGNAV

SEQ ID NO: 29929 - protein, 7 aa, Artificial Sequence
  Description of Artificial Sequence: Synthetic peptide
MGPNHLP

SEQ ID NO: 29930 - protein, 7 aa, Artificial Sequence
  Description of Artificial Sequence: Synthetic peptide
SLSKQAA

SEQ ID NO: 29931 - protein, 7 aa, Artificial Sequence
  Description of Artificial Sequence: Synthetic peptide
IGNLPSR

SEQ ID NO: 29932 - protein, 7 aa, Artificial Sequence
  Description of Artificial Sequence: Synthetic peptide
NQMAHLK

SEQ ID NO: 29933 - protein, 7 aa, Artificial Sequence
  Description of Artificial Sequence: Synthetic peptide
SVEKAQS

SEQ ID NO: 29934 - protein, 7 aa, Artificial Sequence
  Description of Artificial Sequence: Synthetic peptide
AMSASRN

SEQ ID NO: 29935 - protein, 7 aa, Artificial Sequence
  Description of Artificial Sequence: Synthetic peptide
RTNHVEA

SEQ ID NO: 29936 - protein, 7 aa, Artificial Sequence
  Description of Artificial Sequence: Synthetic peptide
SFSSTMG

SEQ ID NO: 29937 - protein, 7 aa, Artificial Sequence
  Description of Artificial Sequence: Synthetic peptide
GRVNSGI

SEQ ID NO: 29938 - protein, 7 aa, Artificial Sequence
  Description of Artificial Sequence: Synthetic peptide
SLVSRST

SEQ ID NO: 29939 - protein, 7 aa, Artificial Sequence
  Description of Artificial Sequence: Synthetic peptide
LGLRDNT

SEQ ID NO: 29940 - protein, 7 aa, Artificial Sequence
  Description of Artificial Sequence: Synthetic peptide
HTMRSSV

SEQ ID NO: 29941 - protein, 7 aa, Artificial Sequence
  Description of Artificial Sequence: Synthetic peptide
WGTGIGS

SEQ ID NO: 29942 - protein, 7 aa, Artificial Sequence
  Description of Artificial Sequence: Synthetic peptide
QTRSNGN

SEQ ID NO: 29943 - protein, 7 aa, Artificial Sequence
  Description of Artificial Sequence: Synthetic peptide
RMARPAV

SEQ ID NO: 29944 - protein, 7 aa, Artificial Sequence
  Description of Artificial Sequence: Synthetic peptide
GNTNSFL

SEQ ID NO: 29945 - protein, 7 aa, Artificial Sequence
  Description of Artificial Sequence: Synthetic peptide
APVQPFR

SEQ ID NO: 29946 - protein, 7 aa, Artificial Sequence
  Description of Artificial Sequence: Synthetic peptide
ISVGNTS

SEQ ID NO: 29947 - protein, 7 aa, Artificial Sequence
  Description of Artificial Sequence: Synthetic peptide
RDVRMSD

SEQ ID NO: 29948 - protein, 7 aa, Artificial Sequence
  Description of Artificial Sequence: Synthetic peptide
SRESSPL

SEQ ID NO: 29949 - protein, 7 aa, Artificial Sequence
  Description of Artificial Sequence: Synthetic peptide
GSLTPKA

SEQ ID NO: 29950 - protein, 7 aa, Artificial Sequence
  Description of Artificial Sequence: Synthetic peptide
NGSGQNP

SEQ ID NO: 29951 - protein, 7 aa, Artificial Sequence
  Description of Artificial Sequence: Synthetic peptide
KSTHGMT

SEQ ID NO: 29952 - protein, 7 aa, Artificial Sequence
  Description of Artificial Sequence: Synthetic peptide
EQVPKHR

SEQ ID NO: 29953 - protein, 7 aa, Artificial Sequence
  Description of Artificial Sequence: Synthetic peptide
TQNSSLS

SEQ ID NO: 29954 - protein, 7 aa, Artificial Sequence
  Description of Artificial Sequence: Synthetic peptide
TSNTPSI

SEQ ID NO: 29955 - protein, 7 aa, Artificial Sequence
  Description of Artificial Sequence: Synthetic peptide
PVSTHSS

SEQ ID NO: 29956 - protein, 7 aa, Artificial Sequence
  Description of Artificial Sequence: Synthetic peptide
TRPNLQT

SEQ ID NO: 29957 - protein, 7 aa, Artificial Sequence
  Description of Artificial Sequence: Synthetic peptide
LASSRSG

SEQ ID NO: 29958 - protein, 7 aa, Artificial Sequence
  Description of Artificial Sequence: Synthetic peptide
QGQTAMR

SEQ ID NO: 29959 - protein, 7 aa, Artificial Sequence
  Description of Artificial Sequence: Synthetic peptide
VRNASSD

SEQ ID NO: 29960 - protein, 7 aa, Artificial Sequence
  Description of Artificial Sequence: Synthetic peptide
TMSTRQS

SEQ ID NO: 29961 - protein, 7 aa, Artificial Sequence
  Description of Artificial Sequence: Synthetic peptide
GSSRSLG

SEQ ID NO: 29962 - protein, 7 aa, Artificial Sequence
  Description of Artificial Sequence: Synthetic peptide
PAHQKLS

SEQ ID NO: 29963 - protein, 7 aa, Artificial Sequence
  Description of Artificial Sequence: Synthetic peptide
GTVNAKG

SEQ ID NO: 29964 - protein, 7 aa, Artificial Sequence
  Description of Artificial Sequence: Synthetic peptide
GQVKALG

SEQ ID NO: 29965 - protein, 7 aa, Artificial Sequence
  Description of Artificial Sequence: Synthetic peptide
GDRPSAK

SEQ ID NO: 29966 - protein, 7 aa, Artificial Sequence
  Description of Artificial Sequence: Synthetic peptide
STYPKSS

SEQ ID NO: 29967 - protein, 7 aa, Artificial Sequence
  Description of Artificial Sequence: Synthetic peptide
GQAGGSK

SEQ ID NO: 29968 - protein, 7 aa, Artificial Sequence
  Description of Artificial Sequence: Synthetic peptide
TGTKSDN

SEQ ID NO: 29969 - protein, 7 aa, Artificial Sequence
  Description of Artificial Sequence: Synthetic peptide
MLGSSNK

SEQ ID NO: 29970 - protein, 7 aa, Artificial Sequence
  Description of Artificial Sequence: Synthetic peptide
LQQHNTK

SEQ ID NO: 29971 - protein, 7 aa, Artificial Sequence
  Description of Artificial Sequence: Synthetic peptide
DSKHTST

SEQ ID NO: 29972 - protein, 7 aa, Artificial Sequence
  Description of Artificial Sequence: Synthetic peptide
SAHGRTN

SEQ ID NO: 29973 - protein, 7 aa, Artificial Sequence
  Description of Artificial Sequence: Synthetic peptide
TPQMTPV

SEQ ID NO: 29974 - protein, 7 aa, Artificial Sequence
  Description of Artificial Sequence: Synthetic peptide
MTGRLTT

SEQ ID NO: 29975 - protein, 7 aa, Artificial Sequence
  Description of Artificial Sequence: Synthetic peptide
MSMKQVT

SEQ ID NO: 29976 - protein, 7 aa, Artificial Sequence
  Description of Artificial Sequence: Synthetic peptide
VHVTSQT

SEQ ID NO: 29977 - protein, 7 aa, Artificial Sequence
  Description of Artificial Sequence: Synthetic peptide
LMSAATT

SEQ ID NO: 29978 - protein, 7 aa, Artificial Sequence
  Description of Artificial Sequence: Synthetic peptide
KVINPAQ

SEQ ID NO: 29979 - protein, 7 aa, Artificial Sequence
  Description of Artificial Sequence: Synthetic peptide
IKLDKQI

SEQ ID NO: 29980 - protein, 7 aa, Artificial Sequence
  Description of Artificial Sequence: Synthetic peptide
FGESTMR

SEQ ID NO: 29981 - protein, 7 aa, Artificial Sequence
  Description of Artificial Sequence: Synthetic peptide
DPLRSMH

SEQ ID NO: 29982 - protein, 7 aa, Artificial Sequence
  Description of Artificial Sequence: Synthetic peptide
CVSNVTN

SEQ ID NO: 29983 - protein, 7 aa, Artificial Sequence
  Description of Artificial Sequence: Synthetic peptide
NGSGTNQ

SEQ ID NO: 29984 - protein, 7 aa, Artificial Sequence
  Description of Artificial Sequence: Synthetic peptide
LLSQHSD

SEQ ID NO: 29985 - protein, 7 aa, Artificial Sequence
  Description of Artificial Sequence: Synthetic peptide
GGLHGSG

SEQ ID NO: 29986 - protein, 7 aa, Artificial Sequence
  Description of Artificial Sequence: Synthetic peptide
PVNNVGL

SEQ ID NO: 29987 - protein, 7 aa, Artificial Sequence
  Description of Artificial Sequence: Synthetic peptide
AVTTKAL

SEQ ID NO: 29988 - protein, 7 aa, Artificial Sequence
  Description of Artificial Sequence: Synthetic peptide
SSYTPSG

SEQ ID NO: 29989 - protein, 7 aa, Artificial Sequence
  Description of Artificial Sequence: Synthetic peptide
SSTKSSL

SEQ ID NO: 29990 - protein, 7 aa, Artificial Sequence
  Description of Artificial Sequence: Synthetic peptide
RNSEYTG

SEQ ID NO: 29991 - protein, 7 aa, Artificial Sequence
  Description of Artificial Sequence: Synthetic peptide
EVRRQST

SEQ ID NO: 29992 - protein, 7 aa, Artificial Sequence
  Description of Artificial Sequence: Synthetic peptide
MNSNHRN

SEQ ID NO: 29993 - protein, 7 aa, Artificial Sequence
  Description of Artificial Sequence: Synthetic peptide
PHSGNRH

SEQ ID NO: 29994 - protein, 7 aa, Artificial Sequence
  Description of Artificial Sequence: Synthetic peptide
SLASHTR

SEQ ID NO: 29995 - protein, 7 aa, Artificial Sequence
  Description of Artificial Sequence: Synthetic peptide
AEHQSGK

SEQ ID NO: 29996 - protein, 7 aa, Artificial Sequence
  Description of Artificial Sequence: Synthetic peptide
SSKAAIT

SEQ ID NO: 29997 - protein, 7 aa, Artificial Sequence
  Description of Artificial Sequence: Synthetic peptide
PQYGDKE

SEQ ID NO: 29998 - protein, 7 aa, Artificial Sequence
  Description of Artificial Sequence: Synthetic peptide
FGNPGIR

SEQ ID NO: 29999 - protein, 7 aa, Artificial Sequence
  Description of Artificial Sequence: Synthetic peptide
DSGFKSP

SEQ ID NO: 30000 - protein, 7 aa, Artificial Sequence
  Description of Artificial Sequence: Synthetic peptide
RALSKGG

SEQ ID NO: 30001 - protein, 7 aa, Artificial Sequence
  Description of Artificial Sequence: Synthetic peptide
SIRGGKD

SEQ ID NO: 30002 - protein, 7 aa, Artificial Sequence
  Description of Artificial Sequence: Synthetic peptide
VNANKAC

SEQ ID NO: 30003 - protein, 7 aa, Artificial Sequence
  Description of Artificial Sequence: Synthetic peptide
PDIGKQR

SEQ ID NO: 30004 - protein, 7 aa, Artificial Sequence
  Description of Artificial Sequence: Synthetic peptide
PRENKFS

SEQ ID NO: 30005 - protein, 7 aa, Artificial Sequence
  Description of Artificial Sequence: Synthetic peptide
GRAHNVI

SEQ ID NO: 30006 - protein, 7 aa, Artificial Sequence
  Description of Artificial Sequence: Synthetic peptide
SSWQNSL

SEQ ID NO: 30007 - protein, 7 aa, Artificial Sequence
  Description of Artificial Sequence: Synthetic peptide
HAKHVVG

SEQ ID NO: 30008 - protein, 7 aa, Artificial Sequence
  Description of Artificial Sequence: Synthetic peptide
PPRQKLG

SEQ ID NO: 30009 - protein, 7 aa, Artificial Sequence
  Description of Artificial Sequence: Synthetic peptide
CAGPENV

SEQ ID NO: 30010 - protein, 7 aa, Artificial Sequence
  Description of Artificial Sequence: Synthetic peptide
YKHSVVL

SEQ ID NO: 30011 - protein, 7 aa, Artificial Sequence
  Description of Artificial Sequence: Synthetic peptide
PGSEGRC

SEQ ID NO: 30012 - protein, 7 aa, Artificial Sequence
  Description of Artificial Sequence: Synthetic peptide
VTPARII

SEQ ID NO: 30013 - protein, 7 aa, Artificial Sequence
  Description of Artificial Sequence: Synthetic peptide
PWVQIDG

SEQ ID NO: 30014 - protein, 7 aa, Artificial Sequence
  Description of Artificial Sequence: Synthetic peptide
RGTKPAA

SEQ ID NO: 30015 - protein, 7 aa, Artificial Sequence
  Description of Artificial Sequence: Synthetic peptide
GRHGAPT

SEQ ID NO: 30016 - protein, 7 aa, Artificial Sequence
  Description of Artificial Sequence: Synthetic peptide
TPSMRNT

SEQ ID NO: 30017 - protein, 7 aa, Artificial Sequence
  Description of Artificial Sequence: Synthetic peptide
LGLGGRG

SEQ ID NO: 30018 - protein, 7 aa, Artificial Sequence
  Description of Artificial Sequence: Synthetic peptide
GALERHS

SEQ ID NO: 30019 - protein, 7 aa, Artificial Sequence
  Description of Artificial Sequence: Synthetic peptide
RSVGAKA

SEQ ID NO: 30020 - protein, 7 aa, Artificial Sequence
  Description of Artificial Sequence: Synthetic peptide
NSTSTSQ

SEQ ID NO: 30021 - protein, 7 aa, Artificial Sequence
  Description of Artificial Sequence: Synthetic peptide
TTHNIKG

SEQ ID NO: 30022 - protein, 7 aa, Artificial Sequence
  Description of Artificial Sequence: Synthetic peptide
PTASNRS

SEQ ID NO: 30023 - protein, 7 aa, Artificial Sequence
  Description of Artificial Sequence: Synthetic peptide
RTSTAPQ

SEQ ID NO: 30024 - protein, 7 aa, Artificial Sequence
  Description of Artificial Sequence: Synthetic peptide
HANNRSV

SEQ ID NO: 30025 - protein, 7 aa, Artificial Sequence
  Description of Artificial Sequence: Synthetic peptide
ERYTTSK

SEQ ID NO: 30026 - protein, 7 aa, Artificial Sequence
  Description of Artificial Sequence: Synthetic peptide
SGSLSSA

SEQ ID NO: 30027 - protein, 7 aa, Artificial Sequence
  Description of Artificial Sequence: Synthetic peptide
SSSTSHK

SEQ ID NO: 30028 - protein, 7 aa, Artificial Sequence
  Description of Artificial Sequence: Synthetic peptide
GGLDHHA

SEQ ID NO: 30029 - protein, 7 aa, Artificial Sequence
  Description of Artificial Sequence: Synthetic peptide
MNTSINN

SEQ ID NO: 30030 - protein, 7 aa, Artificial Sequence
  Description of Artificial Sequence: Synthetic peptide
TEFSRTN

SEQ ID NO: 30031 - protein, 7 aa, Artificial Sequence
  Description of Artificial Sequence: Synthetic peptide
SPNANRV

SEQ ID NO: 30032 - protein, 7 aa, Artificial Sequence
  Description of Artificial Sequence: Synthetic peptide
TPHQRSS

SEQ ID NO: 30033 - protein, 7 aa, Artificial Sequence
  Description of Artificial Sequence: Synthetic peptide
RTNPGYA

SEQ ID NO: 30034 - protein, 7 aa, Artificial Sequence
  Description of Artificial Sequence: Synthetic peptide
RSGNGSL

SEQ ID NO: 30035 - protein, 7 aa, Artificial Sequence
  Description of Artificial Sequence: Synthetic peptide
YDPTPRG

SEQ ID NO: 30036 - protein, 7 aa, Artificial Sequence
  Description of Artificial Sequence: Synthetic peptide
SYGHPGA

SEQ ID NO: 30037 - protein, 7 aa, Artificial Sequence
  Description of Artificial Sequence: Synthetic peptide
DTVSRHV

SEQ ID NO: 30038 - protein, 7 aa, Artificial Sequence
  Description of Artificial Sequence: Synthetic peptide
TRDSSLH

SEQ ID NO: 30039 - protein, 7 aa, Artificial Sequence
  Description of Artificial Sequence: Synthetic peptide
PGSGSKH

SEQ ID NO: 30040 - protein, 7 aa, Artificial Sequence
  Description of Artificial Sequence: Synthetic peptide
KMTPQST

SEQ ID NO: 30041 - protein, 7 aa, Artificial Sequence
  Description of Artificial Sequence: Synthetic peptide
RHQGTLQ

SEQ ID NO: 30042 - protein, 7 aa, Artificial Sequence
  Description of Artificial Sequence: Synthetic peptide
DARTMAA

SEQ ID NO: 30043 - protein, 7 aa, Artificial Sequence
  Description of Artificial Sequence: Synthetic peptide
KSPSSIL

SEQ ID NO: 30044 - protein, 7 aa, Artificial Sequence
  Description of Artificial Sequence: Synthetic peptide
HLSHASS

SEQ ID NO: 30045 - protein, 7 aa, Artificial Sequence
  Description of Artificial Sequence: Synthetic peptide
CPPLPVN

SEQ ID NO: 30046 - protein, 7 aa, Artificial Sequence
  Description of Artificial Sequence: Synthetic peptide
STPVTMN

SEQ ID NO: 30047 - protein, 7 aa, Artificial Sequence
  Description of Artificial Sequence: Synthetic peptide
SGPNSRV

SEQ ID NO: 30048 - protein, 7 aa, Artificial Sequence
  Description of Artificial Sequence: Synthetic peptide
SRGVSSA

SEQ ID NO: 30049 - protein, 7 aa, Artificial Sequence
  Description of Artificial Sequence: Synthetic peptide
GNPSPLV

SEQ ID NO: 30050 - protein, 7 aa, Artificial Sequence
  Description of Artificial Sequence: Synthetic peptide
STRPPAN

SEQ ID NO: 30051 - protein, 7 aa, Artificial Sequence
  Description of Artificial Sequence: Synthetic peptide
THRTQNS

SEQ ID NO: 30052 - protein, 7 aa, Artificial Sequence
  Description of Artificial Sequence: Synthetic peptide
MSHTKSN

SEQ ID NO: 30053 - protein, 7 aa, Artificial Sequence
  Description of Artificial Sequence: Synthetic peptide
GRANGQT

SEQ ID NO: 30054 - protein, 7 aa, Artificial Sequence
  Description of Artificial Sequence: Synthetic peptide
HSSRSTV

SEQ ID NO: 30055 - protein, 7 aa, Artificial Sequence
  Description of Artificial Sequence: Synthetic peptide
SAHNASR

SEQ ID NO: 30056 - protein, 7 aa, Artificial Sequence
  Description of Artificial Sequence: Synthetic peptide
GQAVNTA

SEQ ID NO: 30057 - protein, 7 aa, Artificial Sequence
  Description of Artificial Sequence: Synthetic peptide
RDATSIG

SEQ ID NO: 30058 - protein, 7 aa, Artificial Sequence
  Description of Artificial Sequence: Synthetic peptide
YNIKQGS

SEQ ID NO: 30059 - protein, 7 aa, Artificial Sequence
  Description of Artificial Sequence: Synthetic peptide
GAVSGKL

SEQ ID NO: 30060 - protein, 7 aa, Artificial Sequence
  Description of Artificial Sequence: Synthetic peptide
PNPLQKD

SEQ ID NO: 30061 - protein, 7 aa, Artificial Sequence
  Description of Artificial Sequence: Synthetic peptide
GNDVRIS

SEQ ID NO: 30062 - protein, 7 aa, Artificial Sequence
  Description of Artificial Sequence: Synthetic peptide
SIPHGVR

SEQ ID NO: 30063 - protein, 7 aa, Artificial Sequence
  Description of Artificial Sequence: Synthetic peptide
TAMGDVS

SEQ ID NO: 30064 - protein, 7 aa, Artificial Sequence
  Description of Artificial Sequence: Synthetic peptide
GSTTSGR

SEQ ID NO: 30065 - protein, 7 aa, Artificial Sequence
  Description of Artificial Sequence: Synthetic peptide
AVSSKVG

SEQ ID NO: 30066 - protein, 7 aa, Artificial Sequence
  Description of Artificial Sequence: Synthetic peptide
TPSVTNM

SEQ ID NO: 30067 - protein, 7 aa, Artificial Sequence
  Description of Artificial Sequence: Synthetic peptide
APQLKGY

SEQ ID NO: 30068 - protein, 7 aa, Artificial Sequence
  Description of Artificial Sequence: Synthetic peptide
TDTSRRQ

SEQ ID NO: 30069 - protein, 7 aa, Artificial Sequence
  Description of Artificial Sequence: Synthetic peptide
PGSGSNH

SEQ ID NO: 30070 - protein, 7 aa, Artificial Sequence
  Description of Artificial Sequence: Synthetic peptide
NTGMSVN

SEQ ID NO: 30071 - protein, 7 aa, Artificial Sequence
  Description of Artificial Sequence: Synthetic peptide
MAHDGYR

SEQ ID NO: 30072 - protein, 7 aa, Artificial Sequence
  Description of Artificial Sequence: Synthetic peptide
SPGNKST

SEQ ID NO: 30073 - protein, 7 aa, Artificial Sequence
  Description of Artificial Sequence: Synthetic peptide
MGVHSIA

SEQ ID NO: 30074 - protein, 7 aa, Artificial Sequence
  Description of Artificial Sequence: Synthetic peptide
QKGNNLP

SEQ ID NO: 30075 - protein, 7 aa, Artificial Sequence
  Description of Artificial Sequence: Synthetic peptide
GLHRSNG

SEQ ID NO: 30076 - protein, 7 aa, Artificial Sequence
  Description of Artificial Sequence: Synthetic peptide
SLYPSKG

SEQ ID NO: 30077 - protein, 7 aa, Artificial Sequence
  Description of Artificial Sequence: Synthetic peptide
APNGMQA

SEQ ID NO: 30078 - protein, 7 aa, Artificial Sequence
  Description of Artificial Sequence: Synthetic peptide
VGHGSDM

SEQ ID NO: 30079 - protein, 7 aa, Artificial Sequence
  Description of Artificial Sequence: Synthetic peptide
NGFNSNN

SEQ ID NO: 30080 - protein, 7 aa, Artificial Sequence
  Description of Artificial Sequence: Synthetic peptide
QGLSTKS

SEQ ID NO: 30081 - protein, 7 aa, Artificial Sequence
  Description of Artificial Sequence: Synthetic peptide
PGIATGR

SEQ ID NO: 30082 - protein, 7 aa, Artificial Sequence
  Description of Artificial Sequence: Synthetic peptide
ATMRSNE

SEQ ID NO: 30083 - protein, 7 aa, Artificial Sequence
  Description of Artificial Sequence: Synthetic peptide
PTHERAK

SEQ ID NO: 30084 - protein, 7 aa, Artificial Sequence
  Description of Artificial Sequence: Synthetic peptide
GTGVPGK

SEQ ID NO: 30085 - protein, 7 aa, Artificial Sequence
  Description of Artificial Sequence: Synthetic peptide
PDSTFSS

SEQ ID NO: 30086 - protein, 7 aa, Artificial Sequence
  Description of Artificial Sequence: Synthetic peptide
LGTKMCA

SEQ ID NO: 30087 - protein, 7 aa, Artificial Sequence
  Description of Artificial Sequence: Synthetic peptide
VRISTQA

SEQ ID NO: 30088 - protein, 7 aa, Artificial Sequence
  Description of Artificial Sequence: Synthetic peptide
TNPTGYR

SEQ ID NO: 30089 - protein, 7 aa, Artificial Sequence
  Description of Artificial Sequence: Synthetic peptide
LGDRSFI

SEQ ID NO: 30090 - protein, 7 aa, Artificial Sequence
  Description of Artificial Sequence: Synthetic peptide
ILDSHNR

SEQ ID NO: 30091 - protein, 7 aa, Artificial Sequence
  Description of Artificial Sequence: Synthetic peptide
GHAAGVS

SEQ ID NO: 30092 - protein, 7 aa, Artificial Sequence
  Description of Artificial Sequence: Synthetic peptide
NSSGQNP

SEQ ID NO: 30093 - protein, 7 aa, Artificial Sequence
  Description of Artificial Sequence: Synthetic peptide
SVHQNRA

SEQ ID NO: 30094 - protein, 7 aa, Artificial Sequence
  Description of Artificial Sequence: Synthetic peptide
VSTTPAL

SEQ ID NO: 30095 - protein, 7 aa, Artificial Sequence
  Description of Artificial Sequence: Synthetic peptide
ITTRSSM

SEQ ID NO: 30096 - protein, 7 aa, Artificial Sequence
  Description of Artificial Sequence: Synthetic peptide
GVERMRG

SEQ ID NO: 30097 - protein, 7 aa, Artificial Sequence
  Description of Artificial Sequence: Synthetic peptide
PSNKAGT

SEQ ID NO: 30098 - protein, 7 aa, Artificial Sequence
  Description of Artificial Sequence: Synthetic peptide
HYGETRN

SEQ ID NO: 30099 - protein, 7 aa, Artificial Sequence
  Description of Artificial Sequence: Synthetic peptide
VGHKGGP

SEQ ID NO: 30100 - protein, 7 aa, Artificial Sequence
  Description of Artificial Sequence: Synthetic peptide
HVAQLGS

SEQ ID NO: 30101 - protein, 7 aa, Artificial Sequence
  Description of Artificial Sequence: Synthetic peptide
FTIPRAD

SEQ ID NO: 30102 - protein, 7 aa, Artificial Sequence
  Description of Artificial Sequence: Synthetic peptide
GQTHAVR

SEQ ID NO: 30103 - protein, 7 aa, Artificial Sequence
  Description of Artificial Sequence: Synthetic peptide
EISQQGT

SEQ ID NO: 30104 - protein, 7 aa, Artificial Sequence
  Description of Artificial Sequence: Synthetic peptide
IQSSDRL

SEQ ID NO: 30105 - protein, 7 aa, Artificial Sequence
  Description of Artificial Sequence: Synthetic peptide
SLSSNPS

SEQ ID NO: 30106 - protein, 7 aa, Artificial Sequence
  Description of Artificial Sequence: Synthetic peptide
ASRDRAG

SEQ ID NO: 30107 - protein, 7 aa, Artificial Sequence
  Description of Artificial Sequence: Synthetic peptide
PISPRMS

SEQ ID NO: 30108 - protein, 7 aa, Artificial Sequence
  Description of Artificial Sequence: Synthetic peptide
GPAVTNR

SEQ ID NO: 30109 - protein, 7 aa, Artificial Sequence
  Description of Artificial Sequence: Synthetic peptide
ATHTSVS

SEQ ID NO: 30110 - protein, 7 aa, Artificial Sequence
  Description of Artificial Sequence: Synthetic peptide
THSKSFV

SEQ ID NO: 30111 - protein, 7 aa, Artificial Sequence
  Description of Artificial Sequence: Synthetic peptide
RVSHAQD

SEQ ID NO: 30112 - protein, 7 aa, Artificial Sequence
  Description of Artificial Sequence: Synthetic peptide
VSNSQSL

SEQ ID NO: 30113 - protein, 7 aa, Artificial Sequence
  Description of Artificial Sequence: Synthetic peptide
GTMSNGH

SEQ ID NO: 30114 - protein, 7 aa, Artificial Sequence
  Description of Artificial Sequence: Synthetic peptide
FTIPRAV

SEQ ID NO: 30115 - protein, 7 aa, Artificial Sequence
  Description of Artificial Sequence: Synthetic peptide
STTLRNS

SEQ ID NO: 30116 - protein, 7 aa, Artificial Sequence
  Description of Artificial Sequence: Synthetic peptide
MISGATR

SEQ ID NO: 30117 - protein, 7 aa, Artificial Sequence
  Description of Artificial Sequence: Synthetic peptide
TGPHIKA

SEQ ID NO: 30118 - protein, 7 aa, Artificial Sequence
  Description of Artificial Sequence: Synthetic peptide
HVHDGRT

SEQ ID NO: 30119 - protein, 7 aa, Artificial Sequence
  Description of Artificial Sequence: Synthetic peptide
SNNSGSC

SEQ ID NO: 30120 - protein, 7 aa, Artificial Sequence
  Description of Artificial Sequence: Synthetic peptide
QTMPKLA

SEQ ID NO: 30121 - protein, 7 aa, Artificial Sequence
  Description of Artificial Sequence: Synthetic peptide
LGRSPPA

SEQ ID NO: 30122 - protein, 7 aa, Artificial Sequence
  Description of Artificial Sequence: Synthetic peptide
HRASTDA

SEQ ID NO: 30123 - protein, 7 aa, Artificial Sequence
  Description of Artificial Sequence: Synthetic peptide
SRSVNFG

SEQ ID NO: 30124 - protein, 7 aa, Artificial Sequence
  Description of Artificial Sequence: Synthetic peptide
ASGNGRP

SEQ ID NO: 30125 - protein, 7 aa, Artificial Sequence
  Description of Artificial Sequence: Synthetic peptide
GHSTVGS

SEQ ID NO: 30126 - protein, 7 aa, Artificial Sequence
  Description of Artificial Sequence: Synthetic peptide
ERHVPSS

SEQ ID NO: 30127 - protein, 7 aa, Artificial Sequence
  Description of Artificial Sequence: Synthetic peptide
RPATSTP

SEQ ID NO: 30128 - protein, 7 aa, Artificial Sequence
  Description of Artificial Sequence: Synthetic peptide
VKVDGQI

SEQ ID NO: 30129 - protein, 7 aa, Artificial Sequence
  Description of Artificial Sequence: Synthetic peptide
QGKTAPY

SEQ ID NO: 30130 - protein, 7 aa, Artificial Sequence
  Description of Artificial Sequence: Synthetic peptide
ARNRVGI

SEQ ID NO: 30131 - protein, 7 aa, Artificial Sequence
  Description of Artificial Sequence: Synthetic peptide
LPTSSVA

SEQ ID NO: 30132 - protein, 7 aa, Artificial Sequence
  Description of Artificial Sequence: Synthetic peptide
SGKDRLH

SEQ ID NO: 30133 - protein, 7 aa, Artificial Sequence
  Description of Artificial Sequence: Synthetic peptide
RLHNMSA

SEQ ID NO: 30134 - protein, 7 aa, Artificial Sequence
  Description of Artificial Sequence: Synthetic peptide
SDNKGSV

SEQ ID NO: 30135 - protein, 7 aa, Artificial Sequence
  Description of Artificial Sequence: Synthetic peptide
TNTAGWS

SEQ ID NO: 30136 - protein, 7 aa, Artificial Sequence
  Description of Artificial Sequence: Synthetic peptide
RTGHSAG

SEQ ID NO: 30137 - protein, 7 aa, Artificial Sequence
  Description of Artificial Sequence: Synthetic peptide
ALKQTAA

SEQ ID NO: 30138 - protein, 7 aa, Artificial Sequence
  Description of Artificial Sequence: Synthetic peptide
MNGSPRI

SEQ ID NO: 30139 - protein, 7 aa, Artificial Sequence
  Description of Artificial Sequence: Synthetic peptide
AYSTTNR

SEQ ID NO: 30140 - protein, 7 aa, Artificial Sequence
  Description of Artificial Sequence: Synthetic peptide
IRTNSTL

SEQ ID NO: 30141 - protein, 7 aa, Artificial Sequence
  Description of Artificial Sequence: Synthetic peptide
GNGTRHV

SEQ ID NO: 30142 - protein, 7 aa, Artificial Sequence
  Description of Artificial Sequence: Synthetic peptide
SYADKQG

SEQ ID NO: 30143 - protein, 7 aa, Artificial Sequence
  Description of Artificial Sequence: Synthetic peptide
GTQAAHV

SEQ ID NO: 30144 - protein, 7 aa, Artificial Sequence
  Description of Artificial Sequence: Synthetic peptide
LNGSATA

SEQ ID NO: 30145 - protein, 7 aa, Artificial Sequence
  Description of Artificial Sequence: Synthetic peptide
LVRATHE

SEQ ID NO: 30146 - protein, 7 aa, Artificial Sequence
  Description of Artificial Sequence: Synthetic peptide
RLGNSHA

SEQ ID NO: 30147 - protein, 7 aa, Artificial Sequence
  Description of Artificial Sequence: Synthetic peptide
PMRGTLA

SEQ ID NO: 30148 - protein, 7 aa, Artificial Sequence
  Description of Artificial Sequence: Synthetic peptide
VGSRNVG

SEQ ID NO: 30149 - protein, 7 aa, Artificial Sequence
  Description of Artificial Sequence: Synthetic peptide
PRHVPLL

SEQ ID NO: 30150 - protein, 7 aa, Artificial Sequence
  Description of Artificial Sequence: Synthetic peptide
SSHSNSE

SEQ ID NO: 30151 - protein, 7 aa, Artificial Sequence
  Description of Artificial Sequence: Synthetic peptide
SLRTPSG

SEQ ID NO: 30152 - protein, 7 aa, Artificial Sequence
  Description of Artificial Sequence: Synthetic peptide
LPTTASS

SEQ ID NO: 30153 - protein, 7 aa, Artificial Sequence
  Description of Artificial Sequence: Synthetic peptide
GAGTSYH

SEQ ID NO: 30154 - protein, 7 aa, Artificial Sequence
  Description of Artificial Sequence: Synthetic peptide
STSGIRS

SEQ ID NO: 30155 - protein, 7 aa, Artificial Sequence
  Description of Artificial Sequence: Synthetic peptide
IGLNRTG

SEQ ID NO: 30156 - protein, 7 aa, Artificial Sequence
  Description of Artificial Sequence: Synthetic peptide
ANRTRQD

SEQ ID NO: 30157 - protein, 7 aa, Artificial Sequence
  Description of Artificial Sequence: Synthetic peptide
PVREGSI

SEQ ID NO: 30158 - protein, 7 aa, Artificial Sequence
  Description of Artificial Sequence: Synthetic peptide
PGNEIGR

SEQ ID NO: 30159 - protein, 7 aa, Artificial Sequence
  Description of Artificial Sequence: Synthetic peptide
SPFQSSH

SEQ ID NO: 30160 - protein, 7 aa, Artificial Sequence
  Description of Artificial Sequence: Synthetic peptide
AMSEHLK

SEQ ID NO: 30161 - protein, 7 aa, Artificial Sequence
  Description of Artificial Sequence: Synthetic peptide
HLDRLSK

SEQ ID NO: 30162 - protein, 7 aa, Artificial Sequence
  Description of Artificial Sequence: Synthetic peptide
EVTNAPK

SEQ ID NO: 30163 - protein, 7 aa, Artificial Sequence
  Description of Artificial Sequence: Synthetic peptide
SSNEKDR

SEQ ID NO: 30164 - protein, 7 aa, Artificial Sequence
  Description of Artificial Sequence: Synthetic peptide
SLSRLSG

SEQ ID NO: 30165 - protein, 7 aa, Artificial Sequence
  Description of Artificial Sequence: Synthetic peptide
GLPLRPN

SEQ ID NO: 30166 - protein, 7 aa, Artificial Sequence
  Description of Artificial Sequence: Synthetic peptide
ETRPAIC

SEQ ID NO: 30167 - protein, 7 aa, Artificial Sequence
  Description of Artificial Sequence: Synthetic peptide
NSSGQNQ

SEQ ID NO: 30168 - protein, 7 aa, Artificial Sequence
  Description of Artificial Sequence: Synthetic peptide
SRSAPRL

SEQ ID NO: 30169 - protein, 7 aa, Artificial Sequence
  Description of Artificial Sequence: Synthetic peptide
ATGRSPN

SEQ ID NO: 30170 - protein, 7 aa, Artificial Sequence
  Description of Artificial Sequence: Synthetic peptide
CQPRSAN

SEQ ID NO: 30171 - protein, 7 aa, Artificial Sequence
  Description of Artificial Sequence: Synthetic peptide
ATSATRM

SEQ ID NO: 30172 - protein, 7 aa, Artificial Sequence
  Description of Artificial Sequence: Synthetic peptide
LTVRSQS

SEQ ID NO: 30173 - protein, 7 aa, Artificial Sequence
  Description of Artificial Sequence: Synthetic peptide
SNTHSPS

SEQ ID NO: 30174 - protein, 7 aa, Artificial Sequence
  Description of Artificial Sequence: Synthetic peptide
IRSTSGG

SEQ ID NO: 30175 - protein, 7 aa, Artificial Sequence
  Description of Artificial Sequence: Synthetic peptide
TATKADR

SEQ ID NO: 30176 - protein, 7 aa, Artificial Sequence
  Description of Artificial Sequence: Synthetic peptide
SQSTQFG

SEQ ID NO: 30177 - protein, 7 aa, Artificial Sequence
  Description of Artificial Sequence: Synthetic peptide
AQASRTT

SEQ ID NO: 30178 - protein, 7 aa, Artificial Sequence
  Description of Artificial Sequence: Synthetic peptide
GGRSVGL

SEQ ID NO: 30179 - protein, 7 aa, Artificial Sequence
  Description of Artificial Sequence: Synthetic peptide
THAAHSS

SEQ ID NO: 30180 - protein, 7 aa, Artificial Sequence
  Description of Artificial Sequence: Synthetic peptide
MGHAKTA

SEQ ID NO: 30181 - protein, 7 aa, Artificial Sequence
  Description of Artificial Sequence: Synthetic peptide
GMHSVAK

SEQ ID NO: 30182 - protein, 7 aa, Artificial Sequence
  Description of Artificial Sequence: Synthetic peptide
PYSRPAQ

SEQ ID NO: 30183 - protein, 7 aa, Artificial Sequence
  Description of Artificial Sequence: Synthetic peptide
QVSPLIL

SEQ ID NO: 30184 - protein, 7 aa, Artificial Sequence
  Description of Artificial Sequence: Synthetic peptide
RYPPATH

SEQ ID NO: 30185 - protein, 7 aa, Artificial Sequence
  Description of Artificial Sequence: Synthetic peptide
NLGTNVL

SEQ ID NO: 30186 - protein, 7 aa, Artificial Sequence
  Description of Artificial Sequence: Synthetic peptide
NGAGQNQ

SEQ ID NO: 30187 - protein, 7 aa, Artificial Sequence
  Description of Artificial Sequence: Synthetic peptide
NISTRQS

SEQ ID NO: 30188 - protein, 7 aa, Artificial Sequence
  Description of Artificial Sequence: Synthetic peptide
GTVDKAS

SEQ ID NO: 30189 - protein, 7 aa, Artificial Sequence
  Description of Artificial Sequence: Synthetic peptide
NAMNTRG

SEQ ID NO: 30190 - protein, 7 aa, Artificial Sequence
  Description of Artificial Sequence: Synthetic peptide
HLRGSNT

SEQ ID NO: 30191 - protein, 7 aa, Artificial Sequence
  Description of Artificial Sequence: Synthetic peptide
SHQRPIQ

SEQ ID NO: 30192 - protein, 7 aa, Artificial Sequence
  Description of Artificial Sequence: Synthetic peptide
RPSGSEP

SEQ ID NO: 30193 - protein, 7 aa, Artificial Sequence
  Description of Artificial Sequence: Synthetic peptide
SASPSLS

SEQ ID NO: 30194 - protein, 7 aa, Artificial Sequence
  Description of Artificial Sequence: Synthetic peptide
HQSGSTC

SEQ ID NO: 30195 - protein, 7 aa, Artificial Sequence
  Description of Artificial Sequence: Synthetic peptide
SSVSRSH

SEQ ID NO: 30196 - protein, 7 aa, Artificial Sequence
  Description of Artificial Sequence: Synthetic peptide
RAGNAPT

SEQ ID NO: 30197 - protein, 7 aa, Artificial Sequence
  Description of Artificial Sequence: Synthetic peptide
WLSQQSS

SEQ ID NO: 30198 - protein, 7 aa, Artificial Sequence
  Description of Artificial Sequence: Synthetic peptide
KANMSNQ

SEQ ID NO: 30199 - protein, 7 aa, Artificial Sequence
  Description of Artificial Sequence: Synthetic peptide
LENRALS

SEQ ID NO: 30200 - protein, 7 aa, Artificial Sequence
  Description of Artificial Sequence: Synthetic peptide
STTGDRL

SEQ ID NO: 30201 - protein, 7 aa, Artificial Sequence
  Description of Artificial Sequence: Synthetic peptide
FIGTRSA

SEQ ID NO: 30202 - protein, 7 aa, Artificial Sequence
  Description of Artificial Sequence: Synthetic peptide
DVRARTA

SEQ ID NO: 30203 - protein, 7 aa, Artificial Sequence
  Description of Artificial Sequence: Synthetic peptide
QSRVSVN

SEQ ID NO: 30204 - protein, 7 aa, Artificial Sequence
  Description of Artificial Sequence: Synthetic peptide
RARLGDS

SEQ ID NO: 30205 - protein, 7 aa, Artificial Sequence
  Description of Artificial Sequence: Synthetic peptide
TLYSNKG

SEQ ID NO: 30206 - protein, 7 aa, Artificial Sequence
  Description of Artificial Sequence: Synthetic peptide
ALVTRPT

SEQ ID NO: 30207 - protein, 7 aa, Artificial Sequence
  Description of Artificial Sequence: Synthetic peptide
HTDTRAV

SEQ ID NO: 30208 - protein, 7 aa, Artificial Sequence
  Description of Artificial Sequence: Synthetic peptide
GGSRPFL

SEQ ID NO: 30209 - protein, 7 aa, Artificial Sequence
  Description of Artificial Sequence: Synthetic peptide
CNSHNAA

SEQ ID NO: 30210 - protein, 7 aa, Artificial Sequence
  Description of Artificial Sequence: Synthetic peptide
LGSNRYS

SEQ ID NO: 30211 - protein, 7 aa, Artificial Sequence
  Description of Artificial Sequence: Synthetic peptide
FGSSTIL

SEQ ID NO: 30212 - protein, 7 aa, Artificial Sequence
  Description of Artificial Sequence: Synthetic peptide
GTSPSTM

SEQ ID NO: 30213 - protein, 7 aa, Artificial Sequence
  Description of Artificial Sequence: Synthetic peptide
SVQGERM

SEQ ID NO: 30214 - protein, 7 aa, Artificial Sequence
  Description of Artificial Sequence: Synthetic peptide
GALHTRD

SEQ ID NO: 30215 - protein, 7 aa, Artificial Sequence
  Description of Artificial Sequence: Synthetic peptide
GMGNDPR

SEQ ID NO: 30216 - protein, 7 aa, Artificial Sequence
  Description of Artificial Sequence: Synthetic peptide
GTALIAA

SEQ ID NO: 30217 - protein, 7 aa, Artificial Sequence
  Description of Artificial Sequence: Synthetic peptide
LQNKLVV

SEQ ID NO: 30218 - protein, 7 aa, Artificial Sequence
  Description of Artificial Sequence: Synthetic peptide
QAKNIHS

SEQ ID NO: 30219 - protein, 7 aa, Artificial Sequence
  Description of Artificial Sequence: Synthetic peptide
VTPSRGF

SEQ ID NO: 30220 - protein, 7 aa, Artificial Sequence
  Description of Artificial Sequence: Synthetic peptide
MQAKSGH

SEQ ID NO: 30221 - protein, 7 aa, Artificial Sequence
  Description of Artificial Sequence: Synthetic peptide
SLSGVMT

SEQ ID NO: 30222 - protein, 7 aa, Artificial Sequence
  Description of Artificial Sequence: Synthetic peptide
CMSTRLT

SEQ ID NO: 30223 - protein, 7 aa, Artificial Sequence
  Description of Artificial Sequence: Synthetic peptide
VPRGPGM

SEQ ID NO: 30224 - protein, 7 aa, Artificial Sequence
  Description of Artificial Sequence: Synthetic peptide
SIQRTSS

SEQ ID NO: 30225 - protein, 7 aa, Artificial Sequence
  Description of Artificial Sequence: Synthetic peptide
AATNSFG

SEQ ID NO: 30226 - protein, 7 aa, Artificial Sequence
  Description of Artificial Sequence: Synthetic peptide
HIQGPHN

SEQ ID NO: 30227 - protein, 7 aa, Artificial Sequence
  Description of Artificial Sequence: Synthetic peptide
INTSSDS

SEQ ID NO: 30228 - protein, 7 aa, Artificial Sequence
  Description of Artificial Sequence: Synthetic peptide
ERARPVL

SEQ ID NO: 30229 - protein, 7 aa, Artificial Sequence
  Description of Artificial Sequence: Synthetic peptide
HPSRPVL

SEQ ID NO: 30230 - protein, 7 aa, Artificial Sequence
  Description of Artificial Sequence: Synthetic peptide
RTSPTLV

SEQ ID NO: 30231 - protein, 7 aa, Artificial Sequence
  Description of Artificial Sequence: Synthetic peptide
SRSTGTL

SEQ ID NO: 30232 - protein, 7 aa, Artificial Sequence
  Description of Artificial Sequence: Synthetic peptide
TRGSPLM

SEQ ID NO: 30233 - protein, 7 aa, Artificial Sequence
  Description of Artificial Sequence: Synthetic peptide
STSTVHS

SEQ ID NO: 30234 - protein, 7 aa, Artificial Sequence
  Description of Artificial Sequence: Synthetic peptide
PSKGTYP

SEQ ID NO: 30235 - protein, 7 aa, Artificial Sequence
  Description of Artificial Sequence: Synthetic peptide
HLSHSPT

SEQ ID NO: 30236 - protein, 7 aa, Artificial Sequence
  Description of Artificial Sequence: Synthetic peptide
PPSKPNT

SEQ ID NO: 30237 - protein, 7 aa, Artificial Sequence
  Description of Artificial Sequence: Synthetic peptide
SVVPKTN

SEQ ID NO: 30238 - protein, 7 aa, Artificial Sequence
  Description of Artificial Sequence: Synthetic peptide
IASQPLR

SEQ ID NO: 30239 - protein, 7 aa, Artificial Sequence
  Description of Artificial Sequence: Synthetic peptide
DRARNVH

SEQ ID NO: 30240 - protein, 7 aa, Artificial Sequence
  Description of Artificial Sequence: Synthetic peptide
YSNSRVG

SEQ ID NO: 30241 - protein, 7 aa, Artificial Sequence
  Description of Artificial Sequence: Synthetic peptide
DPLRQSV

SEQ ID NO: 30242 - protein, 7 aa, Artificial Sequence
  Description of Artificial Sequence: Synthetic peptide
GSHHPSG

SEQ ID NO: 30243 - protein, 7 aa, Artificial Sequence
  Description of Artificial Sequence: Synthetic peptide
TGIGSHL

SEQ ID NO: 30244 - protein, 7 aa, Artificial Sequence
  Description of Artificial Sequence: Synthetic peptide
NTNGSQR

SEQ ID NO: 30245 - protein, 7 aa, Artificial Sequence
  Description of Artificial Sequence: Synthetic peptide
SSNTRIV

SEQ ID NO: 30246 - protein, 7 aa, Artificial Sequence
  Description of Artificial Sequence: Synthetic peptide
GPQVSRT

SEQ ID NO: 30247 - protein, 7 aa, Artificial Sequence
  Description of Artificial Sequence: Synthetic peptide
NNTSTHL

SEQ ID NO: 30248 - protein, 7 aa, Artificial Sequence
  Description of Artificial Sequence: Synthetic peptide
GTGTPRT

SEQ ID NO: 30249 - protein, 7 aa, Artificial Sequence
  Description of Artificial Sequence: Synthetic peptide
QVPVRPV

SEQ ID NO: 30250 - protein, 7 aa, Artificial Sequence
  Description of Artificial Sequence: Synthetic peptide
INGTQTL

SEQ ID NO: 30251 - protein, 7 aa, Artificial Sequence
  Description of Artificial Sequence: Synthetic peptide
ESPNLHS

SEQ ID NO: 30252 - protein, 7 aa, Artificial Sequence
  Description of Artificial Sequence: Synthetic peptide
VPHNHSL

SEQ ID NO: 30253 - protein, 7 aa, Artificial Sequence
  Description of Artificial Sequence: Synthetic peptide
PKLAADL

SEQ ID NO: 30254 - protein, 7 aa, Artificial Sequence
  Description of Artificial Sequence: Synthetic peptide
KGKSGEQ

SEQ ID NO: 30255 - protein, 7 aa, Artificial Sequence
  Description of Artificial Sequence: Synthetic peptide
SKVTAQS

SEQ ID NO: 30256 - protein, 7 aa, Artificial Sequence
  Description of Artificial Sequence: Synthetic peptide
ETNSRLG

SEQ ID NO: 30257 - protein, 7 aa, Artificial Sequence
  Description of Artificial Sequence: Synthetic peptide
GRTNSYS

SEQ ID NO: 30258 - protein, 7 aa, Artificial Sequence
  Description of Artificial Sequence: Synthetic peptide
RTPTASG

SEQ ID NO: 30259 - protein, 7 aa, Artificial Sequence
  Description of Artificial Sequence: Synthetic peptide
FPLTKPA

SEQ ID NO: 30260 - protein, 7 aa, Artificial Sequence
  Description of Artificial Sequence: Synthetic peptide
CGSTKTS

SEQ ID NO: 30261 - protein, 7 aa, Artificial Sequence
  Description of Artificial Sequence: Synthetic peptide
PATVTGV

SEQ ID NO: 30262 - protein, 7 aa, Artificial Sequence
  Description of Artificial Sequence: Synthetic peptide
GFPVSSM

SEQ ID NO: 30263 - protein, 7 aa, Artificial Sequence
  Description of Artificial Sequence: Synthetic peptide
LGIANIG

SEQ ID NO: 30264 - protein, 7 aa, Artificial Sequence
  Description of Artificial Sequence: Synthetic peptide
HVRLSGS

SEQ ID NO: 30265 - protein, 7 aa, Artificial Sequence
  Description of Artificial Sequence: Synthetic peptide
DIMSPLK

SEQ ID NO: 30266 - protein, 7 aa, Artificial Sequence
  Description of Artificial Sequence: Synthetic peptide
AVRVERP

SEQ ID NO: 30267 - protein, 7 aa, Artificial Sequence
  Description of Artificial Sequence: Synthetic peptide
SKGRPTI

SEQ ID NO: 30268 - protein, 7 aa, Artificial Sequence
  Description of Artificial Sequence: Synthetic peptide
LNAGRST

SEQ ID NO: 30269 - protein, 7 aa, Artificial Sequence
  Description of Artificial Sequence: Synthetic peptide
TTHNMQG

SEQ ID NO: 30270 - protein, 7 aa, Artificial Sequence
  Description of Artificial Sequence: Synthetic peptide
SIPSTSQ

SEQ ID NO: 30271 - protein, 7 aa, Artificial Sequence
  Description of Artificial Sequence: Synthetic peptide
TSNMVGK

SEQ ID NO: 30272 - protein, 7 aa, Artificial Sequence
  Description of Artificial Sequence: Synthetic peptide
TGNKGGV

SEQ ID NO: 30273 - protein, 7 aa, Artificial Sequence
  Description of Artificial Sequence: Synthetic peptide
VSGSNSL

SEQ ID NO: 30274 - protein, 7 aa, Artificial Sequence
  Description of Artificial Sequence: Synthetic peptide
RMLDGHS

SEQ ID NO: 30275 - protein, 7 aa, Artificial Sequence
  Description of Artificial Sequence: Synthetic peptide
NDRGQNG

SEQ ID NO: 30276 - protein, 7 aa, Artificial Sequence
  Description of Artificial Sequence: Synthetic peptide
SQSNSFL

SEQ ID NO: 30277 - protein, 7 aa, Artificial Sequence
  Description of Artificial Sequence: Synthetic peptide
SDGGGRM

SEQ ID NO: 30278 - protein, 7 aa, Artificial Sequence
  Description of Artificial Sequence: Synthetic peptide
RVATSVS

SEQ ID NO: 30279 - protein, 7 aa, Artificial Sequence
  Description of Artificial Sequence: Synthetic peptide
RLAQSGL

SEQ ID NO: 30280 - protein, 7 aa, Artificial Sequence
  Description of Artificial Sequence: Synthetic peptide
SVADTRL

SEQ ID NO: 30281 - protein, 7 aa, Artificial Sequence
  Description of Artificial Sequence: Synthetic peptide
NANVQTR

SEQ ID NO: 30282 - protein, 7 aa, Artificial Sequence
  Description of Artificial Sequence: Synthetic peptide
YSGASGR

SEQ ID NO: 30283 - protein, 7 aa, Artificial Sequence
  Description of Artificial Sequence: Synthetic peptide
SRQPLMT

SEQ ID NO: 30284 - protein, 7 aa, Artificial Sequence
  Description of Artificial Sequence: Synthetic peptide
HHSTLQT

SEQ ID NO: 30285 - protein, 7 aa, Artificial Sequence
  Description of Artificial Sequence: Synthetic peptide
TVTNAAR

SEQ ID NO: 30286 - protein, 7 aa, Artificial Sequence
  Description of Artificial Sequence: Synthetic peptide
SVNSHHG

SEQ ID NO: 30287 - protein, 7 aa, Artificial Sequence
  Description of Artificial Sequence: Synthetic peptide
GDLNPPS

SEQ ID NO: 30288 - protein, 7 aa, Artificial Sequence
  Description of Artificial Sequence: Synthetic peptide
NSHSGHR

SEQ ID NO: 30289 - protein, 7 aa, Artificial Sequence
  Description of Artificial Sequence: Synthetic peptide
PGADPNL

SEQ ID NO: 30290 - protein, 7 aa, Artificial Sequence
  Description of Artificial Sequence: Synthetic peptide
HANNKLM

SEQ ID NO: 30291 - protein, 7 aa, Artificial Sequence
  Description of Artificial Sequence: Synthetic peptide
YGSPVHQ

SEQ ID NO: 30292 - protein, 7 aa, Artificial Sequence
  Description of Artificial Sequence: Synthetic peptide
VSSNASM

SEQ ID NO: 30293 - protein, 7 aa, Artificial Sequence
  Description of Artificial Sequence: Synthetic peptide
GFHGQGS

SEQ ID NO: 30294 - protein, 7 aa, Artificial Sequence
  Description of Artificial Sequence: Synthetic peptide
SLTRTLG

SEQ ID NO: 30295 - protein, 7 aa, Artificial Sequence
  Description of Artificial Sequence: Synthetic peptide
LRSDRWD

SEQ ID NO: 30296 - protein, 7 aa, Artificial Sequence
  Description of Artificial Sequence: Synthetic peptide
TQRPAQM

SEQ ID NO: 30297 - protein, 7 aa, Artificial Sequence
  Description of Artificial Sequence: Synthetic peptide
LASTYSG

SEQ ID NO: 30298 - protein, 7 aa, Artificial Sequence
  Description of Artificial Sequence: Synthetic peptide
FALSNST

SEQ ID NO: 30299 - protein, 7 aa, Artificial Sequence
  Description of Artificial Sequence: Synthetic peptide
DYSSDSS

SEQ ID NO: 30300 - protein, 7 aa, Artificial Sequence
  Description of Artificial Sequence: Synthetic peptide
AYPTTGS

SEQ ID NO: 30301 - protein, 7 aa, Artificial Sequence
  Description of Artificial Sequence: Synthetic peptide
RNVSHLE

SEQ ID NO: 30302 - protein, 7 aa, Artificial Sequence
  Description of Artificial Sequence: Synthetic peptide
STVGHMN

SEQ ID NO: 30303 - protein, 7 aa, Artificial Sequence
  Description of Artificial Sequence: Synthetic peptide
VEARPTC

SEQ ID NO: 30304 - protein, 7 aa, Artificial Sequence
  Description of Artificial Sequence: Synthetic peptide
EVQSSRR

SEQ ID NO: 30305 - protein, 7 aa, Artificial Sequence
  Description of Artificial Sequence: Synthetic peptide
HSRDSPH

SEQ ID NO: 30306 - protein, 7 aa, Artificial Sequence
  Description of Artificial Sequence: Synthetic peptide
PVVGKMS

SEQ ID NO: 30307 - protein, 7 aa, Artificial Sequence
  Description of Artificial Sequence: Synthetic peptide
SAASNGR

SEQ ID NO: 30308 - protein, 7 aa, Artificial Sequence
  Description of Artificial Sequence: Synthetic peptide
RTNASLS

SEQ ID NO: 30309 - protein, 7 aa, Artificial Sequence
  Description of Artificial Sequence: Synthetic peptide
GEPTRYG

SEQ ID NO: 30310 - protein, 7 aa, Artificial Sequence
  Description of Artificial Sequence: Synthetic peptide
DISVRPG

SEQ ID NO: 30311 - protein, 7 aa, Artificial Sequence
  Description of Artificial Sequence: Synthetic peptide
QAHTPPT

SEQ ID NO: 30312 - protein, 7 aa, Artificial Sequence
  Description of Artificial Sequence: Synthetic peptide
PTLGTTK

SEQ ID NO: 30313 - protein, 7 aa, Artificial Sequence
  Description of Artificial Sequence: Synthetic peptide
NLSGSRY

SEQ ID NO: 30314 - protein, 7 aa, Artificial Sequence
  Description of Artificial Sequence: Synthetic peptide
QAYTNAD

SEQ ID NO: 30315 - protein, 7 aa, Artificial Sequence
  Description of Artificial Sequence: Synthetic peptide
HTPDVGK

SEQ ID NO: 30316 - protein, 7 aa, Artificial Sequence
  Description of Artificial Sequence: Synthetic peptide
VTRVAGN

SEQ ID NO: 30317 - protein, 7 aa, Artificial Sequence
  Description of Artificial Sequence: Synthetic peptide
TTSHMLK

SEQ ID NO: 30318 - protein, 7 aa, Artificial Sequence
  Description of Artificial Sequence: Synthetic peptide
GAPDWSN

SEQ ID NO: 30319 - protein, 7 aa, Artificial Sequence
  Description of Artificial Sequence: Synthetic peptide
NSRTHYT

SEQ ID NO: 30320 - protein, 7 aa, Artificial Sequence
  Description of Artificial Sequence: Synthetic peptide
ESARIGS

SEQ ID NO: 30321 - protein, 7 aa, Artificial Sequence
  Description of Artificial Sequence: Synthetic peptide
FPSVSTT

SEQ ID NO: 30322 - protein, 7 aa, Artificial Sequence
  Description of Artificial Sequence: Synthetic peptide
SYKGALS

SEQ ID NO: 30323 - protein, 7 aa, Artificial Sequence
  Description of Artificial Sequence: Synthetic peptide
GSGGDRN

SEQ ID NO: 30324 - protein, 7 aa, Artificial Sequence
  Description of Artificial Sequence: Synthetic peptide
NSRISPS

SEQ ID NO: 30325 - protein, 7 aa, Artificial Sequence
  Description of Artificial Sequence: Synthetic peptide
AFGTTLR

SEQ ID NO: 30326 - protein, 7 aa, Artificial Sequence
  Description of Artificial Sequence: Synthetic peptide
PRNTGNT

SEQ ID NO: 30327 - protein, 7 aa, Artificial Sequence
  Description of Artificial Sequence: Synthetic peptide
FNRDRIG

SEQ ID NO: 30328 - protein, 7 aa, Artificial Sequence
  Description of Artificial Sequence: Synthetic peptide
SRSHAMT

SEQ ID NO: 30329 - protein, 7 aa, Artificial Sequence
  Description of Artificial Sequence: Synthetic peptide
CSLGKVQ

SEQ ID NO: 30330 - protein, 7 aa, Artificial Sequence
  Description of Artificial Sequence: Synthetic peptide
RNLHMHE

SEQ ID NO: 30331 - protein, 7 aa, Artificial Sequence
  Description of Artificial Sequence: Synthetic peptide
HQSAVQG

SEQ ID NO: 30332 - protein, 7 aa, Artificial Sequence
  Description of Artificial Sequence: Synthetic peptide
PISESTR

SEQ ID NO: 30333 - protein, 7 aa, Artificial Sequence
  Description of Artificial Sequence: Synthetic peptide
VSGHGVR

SEQ ID NO: 30334 - protein, 7 aa, Artificial Sequence
  Description of Artificial Sequence: Synthetic peptide
RLDNHPS

SEQ ID NO: 30335 - protein, 7 aa, Artificial Sequence
  Description of Artificial Sequence: Synthetic peptide
FPTSPTR

SEQ ID NO: 30336 - protein, 7 aa, Artificial Sequence
  Description of Artificial Sequence: Synthetic peptide
YTNSSTC

SEQ ID NO: 30337 - protein, 7 aa, Artificial Sequence
  Description of Artificial Sequence: Synthetic peptide
GEGTKRH

SEQ ID NO: 30338 - protein, 7 aa, Artificial Sequence
  Description of Artificial Sequence: Synthetic peptide
VRTNLDK

SEQ ID NO: 30339 - protein, 7 aa, Artificial Sequence
  Description of Artificial Sequence: Synthetic peptide
VRDGVRS

SEQ ID NO: 30340 - protein, 7 aa, Artificial Sequence
  Description of Artificial Sequence: Synthetic peptide
NSGTHFK

SEQ ID NO: 30341 - protein, 7 aa, Artificial Sequence
  Description of Artificial Sequence: Synthetic peptide
GNSTANR

SEQ ID NO: 30342 - protein, 7 aa, Artificial Sequence
  Description of Artificial Sequence: Synthetic peptide
YTAASHR

SEQ ID NO: 30343 - protein, 7 aa, Artificial Sequence
  Description of Artificial Sequence: Synthetic peptide
SMNSKPT

SEQ ID NO: 30344 - protein, 7 aa, Artificial Sequence
  Description of Artificial Sequence: Synthetic peptide
PRSPSKL

SEQ ID NO: 30345 - protein, 7 aa, Artificial Sequence
  Description of Artificial Sequence: Synthetic peptide
GRVVSMQ

SEQ ID NO: 30346 - protein, 7 aa, Artificial Sequence
  Description of Artificial Sequence: Synthetic peptide
YPSPTVT

SEQ ID NO: 30347 - protein, 7 aa, Artificial Sequence
  Description of Artificial Sequence: Synthetic peptide
SGVGHRG

SEQ ID NO: 30348 - protein, 7 aa, Artificial Sequence
  Description of Artificial Sequence: Synthetic peptide
STSNHRV

SEQ ID NO: 30349 - protein, 7 aa, Artificial Sequence
  Description of Artificial Sequence: Synthetic peptide
GRTAEGR

SEQ ID NO: 30350 - protein, 7 aa, Artificial Sequence
  Description of Artificial Sequence: Synthetic peptide
DNVPHLA

SEQ ID NO: 30351 - protein, 7 aa, Artificial Sequence
  Description of Artificial Sequence: Synthetic peptide
NNSTGVA

SEQ ID NO: 30352 - protein, 7 aa, Artificial Sequence
  Description of Artificial Sequence: Synthetic peptide
CGFKNPS

SEQ ID NO: 30353 - protein, 7 aa, Artificial Sequence
  Description of Artificial Sequence: Synthetic peptide
LTSRSMA

SEQ ID NO: 30354 - protein, 7 aa, Artificial Sequence
  Description of Artificial Sequence: Synthetic peptide
SREKNNA

SEQ ID NO: 30355 - protein, 7 aa, Artificial Sequence
  Description of Artificial Sequence: Synthetic peptide
SNNKANV

SEQ ID NO: 30356 - protein, 7 aa, Artificial Sequence
  Description of Artificial Sequence: Synthetic peptide
PMTNLGT

SEQ ID NO: 30357 - protein, 7 aa, Artificial Sequence
  Description of Artificial Sequence: Synthetic peptide
IIAPQTQ

SEQ ID NO: 30358 - protein, 7 aa, Artificial Sequence
  Description of Artificial Sequence: Synthetic peptide
VSQNGSM

SEQ ID NO: 30359 - protein, 7 aa, Artificial Sequence
  Description of Artificial Sequence: Synthetic peptide
SNQRGEG

SEQ ID NO: 30360 - protein, 7 aa, Artificial Sequence
  Description of Artificial Sequence: Synthetic peptide
PHNTSKG

SEQ ID NO: 30361 - protein, 7 aa, Artificial Sequence
  Description of Artificial Sequence: Synthetic peptide
AFGEIRQ

SEQ ID NO: 30362 - protein, 7 aa, Artificial Sequence
  Description of Artificial Sequence: Synthetic peptide
YHVSKPQ

SEQ ID NO: 30363 - protein, 7 aa, Artificial Sequence
  Description of Artificial Sequence: Synthetic peptide
KNMGSSR

SEQ ID NO: 30364 - protein, 7 aa, Artificial Sequence
  Description of Artificial Sequence: Synthetic peptide
EGMGVHG

SEQ ID NO: 30365 - protein, 7 aa, Artificial Sequence
  Description of Artificial Sequence: Synthetic peptide
SKFSETK

SEQ ID NO: 30366 - protein, 7 aa, Artificial Sequence
  Description of Artificial Sequence: Synthetic peptide
YVPRSSL

SEQ ID NO: 30367 - protein, 7 aa, Artificial Sequence
  Description of Artificial Sequence: Synthetic peptide
NSKSVLS

SEQ ID NO: 30368 - protein, 7 aa, Artificial Sequence
  Description of Artificial Sequence: Synthetic peptide
CLGSNNL

SEQ ID NO: 30369 - protein, 7 aa, Artificial Sequence
  Description of Artificial Sequence: Synthetic peptide
SNYKSSN

SEQ ID NO: 30370 - protein, 7 aa, Artificial Sequence
  Description of Artificial Sequence: Synthetic peptide
GLVPNLI

SEQ ID NO: 30371 - protein, 7 aa, Artificial Sequence
  Description of Artificial Sequence: Synthetic peptide
CSFGNQL

SEQ ID NO: 30372 - protein, 7 aa, Artificial Sequence
  Description of Artificial Sequence: Synthetic peptide
GRAQLAS

SEQ ID NO: 30373 - protein, 7 aa, Artificial Sequence
  Description of Artificial Sequence: Synthetic peptide
SSRTGSI

SEQ ID NO: 30374 - protein, 7 aa, Artificial Sequence
  Description of Artificial Sequence: Synthetic peptide
QPTTSAL

SEQ ID NO: 30375 - protein, 7 aa, Artificial Sequence
  Description of Artificial Sequence: Synthetic peptide
LGGGTLR

SEQ ID NO: 30376 - protein, 7 aa, Artificial Sequence
  Description of Artificial Sequence: Synthetic peptide
SGTSSYK

SEQ ID NO: 30377 - protein, 7 aa, Artificial Sequence
  Description of Artificial Sequence: Synthetic peptide
TLGGRNL

SEQ ID NO: 30378 - protein, 7 aa, Artificial Sequence
  Description of Artificial Sequence: Synthetic peptide
TGVTGPL

SEQ ID NO: 30379 - protein, 7 aa, Artificial Sequence
  Description of Artificial Sequence: Synthetic peptide
LTAVSPK

SEQ ID NO: 30380 - protein, 7 aa, Artificial Sequence
  Description of Artificial Sequence: Synthetic peptide
YDASARA

SEQ ID NO: 30381 - protein, 7 aa, Artificial Sequence
  Description of Artificial Sequence: Synthetic peptide
GVSASLA

SEQ ID NO: 30382 - protein, 7 aa, Artificial Sequence
  Description of Artificial Sequence: Synthetic peptide
SASNTSV

SEQ ID NO: 30383 - protein, 7 aa, Artificial Sequence
  Description of Artificial Sequence: Synthetic peptide
PVTLRGI

SEQ ID NO: 30384 - protein, 7 aa, Artificial Sequence
  Description of Artificial Sequence: Synthetic peptide
HQLKNSV

SEQ ID NO: 30385 - protein, 7 aa, Artificial Sequence
  Description of Artificial Sequence: Synthetic peptide
TSNSIQG

SEQ ID NO: 30386 - protein, 7 aa, Artificial Sequence
  Description of Artificial Sequence: Synthetic peptide
PIPKYHD

SEQ ID NO: 30387 - protein, 7 aa, Artificial Sequence
  Description of Artificial Sequence: Synthetic peptide
KGQNTIS

SEQ ID NO: 30388 - protein, 7 aa, Artificial Sequence
  Description of Artificial Sequence: Synthetic peptide
HPTLVSK

SEQ ID NO: 30389 - protein, 7 aa, Artificial Sequence
  Description of Artificial Sequence: Synthetic peptide
SRQATSS

SEQ ID NO: 30390 - protein, 7 aa, Artificial Sequence
  Description of Artificial Sequence: Synthetic peptide
GASTVGR

SEQ ID NO: 30391 - protein, 7 aa, Artificial Sequence
  Description of Artificial Sequence: Synthetic peptide
VPSSRSN

SEQ ID NO: 30392 - protein, 7 aa, Artificial Sequence
  Description of Artificial Sequence: Synthetic peptide
SKSTHQA

SEQ ID NO: 30393 - protein, 7 aa, Artificial Sequence
  Description of Artificial Sequence: Synthetic peptide
NGSGQNR

SEQ ID NO: 30394 - protein, 7 aa, Artificial Sequence
  Description of Artificial Sequence: Synthetic peptide
SIARPFT

SEQ ID NO: 30395 - protein, 7 aa, Artificial Sequence
  Description of Artificial Sequence: Synthetic peptide
TRTAGVD

SEQ ID NO: 30396 - protein, 7 aa, Artificial Sequence
  Description of Artificial Sequence: Synthetic peptide
PSDFKHG

SEQ ID NO: 30397 - protein, 7 aa, Artificial Sequence
  Description of Artificial Sequence: Synthetic peptide
PISTRSA

SEQ ID NO: 30398 - protein, 7 aa, Artificial Sequence
  Description of Artificial Sequence: Synthetic peptide
TGMQSLS

SEQ ID NO: 30399 - protein, 7 aa, Artificial Sequence
  Description of Artificial Sequence: Synthetic peptide
SSPANMA

SEQ ID NO: 30400 - protein, 7 aa, Artificial Sequence
  Description of Artificial Sequence: Synthetic peptide
LNHHSSL

SEQ ID NO: 30401 - protein, 7 aa, Artificial Sequence
  Description of Artificial Sequence: Synthetic peptide
DRVTGKM

SEQ ID NO: 30402 - protein, 7 aa, Artificial Sequence
  Description of Artificial Sequence: Synthetic peptide
STPMSNR

SEQ ID NO: 30403 - protein, 7 aa, Artificial Sequence
  Description of Artificial Sequence: Synthetic peptide
YTASALR

SEQ ID NO: 30404 - protein, 7 aa, Artificial Sequence
  Description of Artificial Sequence: Synthetic peptide
INLSHST

SEQ ID NO: 30405 - protein, 7 aa, Artificial Sequence
  Description of Artificial Sequence: Synthetic peptide
VNLRSNT

SEQ ID NO: 30406 - protein, 7 aa, Artificial Sequence
  Description of Artificial Sequence: Synthetic peptide
LHRAGDA

SEQ ID NO: 30407 - protein, 7 aa, Artificial Sequence
  Description of Artificial Sequence: Synthetic peptide
QHSSARV

SEQ ID NO: 30408 - protein, 7 aa, Artificial Sequence
  Description of Artificial Sequence: Synthetic peptide
RVSDQLS

SEQ ID NO: 30409 - protein, 7 aa, Artificial Sequence
  Description of Artificial Sequence: Synthetic peptide
RDLGHDN

SEQ ID NO: 30410 - protein, 7 aa, Artificial Sequence
  Description of Artificial Sequence: Synthetic peptide
PPVTTRP

SEQ ID NO: 30411 - protein, 7 aa, Artificial Sequence
  Description of Artificial Sequence: Synthetic peptide
GTKSAFS

SEQ ID NO: 30412 - protein, 7 aa, Artificial Sequence
  Description of Artificial Sequence: Synthetic peptide
DRNHAAE

SEQ ID NO: 30413 - protein, 7 aa, Artificial Sequence
  Description of Artificial Sequence: Synthetic peptide
HRTSTVS

SEQ ID NO: 30414 - protein, 7 aa, Artificial Sequence
  Description of Artificial Sequence: Synthetic peptide
NRMTPVM

SEQ ID NO: 30415 - protein, 7 aa, Artificial Sequence
  Description of Artificial Sequence: Synthetic peptide
SGPQPVA

SEQ ID NO: 30416 - protein, 7 aa, Artificial Sequence
  Description of Artificial Sequence: Synthetic peptide
CRPTPSL

SEQ ID NO: 30417 - protein, 7 aa, Artificial Sequence
  Description of Artificial Sequence: Synthetic peptide
SRESTSA

SEQ ID NO: 30418 - protein, 7 aa, Artificial Sequence
  Description of Artificial Sequence: Synthetic peptide
HIRPSMS

SEQ ID NO: 30419 - protein, 7 aa, Artificial Sequence
  Description of Artificial Sequence: Synthetic peptide
AGSHKGV

SEQ ID NO: 30420 - protein, 7 aa, Artificial Sequence
  Description of Artificial Sequence: Synthetic peptide
DSHPRSI

SEQ ID NO: 30421 - protein, 7 aa, Artificial Sequence
  Description of Artificial Sequence: Synthetic peptide
SGSNTIG

SEQ ID NO: 30422 - protein, 7 aa, Artificial Sequence
  Description of Artificial Sequence: Synthetic peptide
GVEAMRN

SEQ ID NO: 30423 - protein, 7 aa, Artificial Sequence
  Description of Artificial Sequence: Synthetic peptide
TNRVGYG

SEQ ID NO: 30424 - protein, 7 aa, Artificial Sequence
  Description of Artificial Sequence: Synthetic peptide
HKNGGRD

SEQ ID NO: 30425 - protein, 7 aa, Artificial Sequence
  Description of Artificial Sequence: Synthetic peptide
YLKTGDN

SEQ ID NO: 30426 - protein, 7 aa, Artificial Sequence
  Description of Artificial Sequence: Synthetic peptide
TGTDSRS

SEQ ID NO: 30427 - protein, 7 aa, Artificial Sequence
  Description of Artificial Sequence: Synthetic peptide
PPSAVMG

SEQ ID NO: 30428 - protein, 7 aa, Artificial Sequence
  Description of Artificial Sequence: Synthetic peptide
CMTRDTS

SEQ ID NO: 30429 - protein, 7 aa, Artificial Sequence
  Description of Artificial Sequence: Synthetic peptide
PTASPST

SEQ ID NO: 30430 - protein, 7 aa, Artificial Sequence
  Description of Artificial Sequence: Synthetic peptide
QDSSIRN

SEQ ID NO: 30431 - protein, 7 aa, Artificial Sequence
  Description of Artificial Sequence: Synthetic peptide
VPVTGLS

SEQ ID NO: 30432 - protein, 7 aa, Artificial Sequence
  Description of Artificial Sequence: Synthetic peptide
YPGALQK

SEQ ID NO: 30433 - protein, 7 aa, Artificial Sequence
  Description of Artificial Sequence: Synthetic peptide
HASREPL

SEQ ID NO: 30434 - protein, 7 aa, Artificial Sequence
  Description of Artificial Sequence: Synthetic peptide
GRHTPTA

SEQ ID NO: 30435 - protein, 7 aa, Artificial Sequence
  Description of Artificial Sequence: Synthetic peptide
PRSQPVP

SEQ ID NO: 30436 - protein, 7 aa, Artificial Sequence
  Description of Artificial Sequence: Synthetic peptide
YQPSLSK

SEQ ID NO: 30437 - protein, 7 aa, Artificial Sequence
  Description of Artificial Sequence: Synthetic peptide
RQTHQPS

SEQ ID NO: 30438 - protein, 7 aa, Artificial Sequence
  Description of Artificial Sequence: Synthetic peptide
QHNTLGQ

SEQ ID NO: 30439 - protein, 7 aa, Artificial Sequence
  Description of Artificial Sequence: Synthetic peptide
WGNELRR

SEQ ID NO: 30440 - protein, 7 aa, Artificial Sequence
  Description of Artificial Sequence: Synthetic peptide
VHSTVHS

SEQ ID NO: 30441 - protein, 7 aa, Artificial Sequence
  Description of Artificial Sequence: Synthetic peptide
KLTGQRS

SEQ ID NO: 30442 - protein, 7 aa, Artificial Sequence
  Description of Artificial Sequence: Synthetic peptide
ESVRSSS

SEQ ID NO: 30443 - protein, 7 aa, Artificial Sequence
  Description of Artificial Sequence: Synthetic peptide
SPHGAGY

SEQ ID NO: 30444 - protein, 7 aa, Artificial Sequence
  Description of Artificial Sequence: Synthetic peptide
SAAKPGP

SEQ ID NO: 30445 - protein, 7 aa, Artificial Sequence
  Description of Artificial Sequence: Synthetic peptide
DNMHRSN

SEQ ID NO: 30446 - protein, 7 aa, Artificial Sequence
  Description of Artificial Sequence: Synthetic peptide
SGGRGTS

SEQ ID NO: 30447 - protein, 7 aa, Artificial Sequence
  Description of Artificial Sequence: Synthetic peptide
KTSTPYS

SEQ ID NO: 30448 - protein, 7 aa, Artificial Sequence
  Description of Artificial Sequence: Synthetic peptide
NTHNIQG

SEQ ID NO: 30449 - protein, 7 aa, Artificial Sequence
  Description of Artificial Sequence: Synthetic peptide
TGSEQNQ

SEQ ID NO: 30450 - protein, 7 aa, Artificial Sequence
  Description of Artificial Sequence: Synthetic peptide
AATMRNS

SEQ ID NO: 30451 - protein, 7 aa, Artificial Sequence
  Description of Artificial Sequence: Synthetic peptide
GINLSPG

SEQ ID NO: 30452 - protein, 7 aa, Artificial Sequence
  Description of Artificial Sequence: Synthetic peptide
HTHDVGK

SEQ ID NO: 30453 - protein, 7 aa, Artificial Sequence
  Description of Artificial Sequence: Synthetic peptide
SGSHRTQ

SEQ ID NO: 30454 - protein, 7 aa, Artificial Sequence
  Description of Artificial Sequence: Synthetic peptide
VSSHRNM

SEQ ID NO: 30455 - protein, 7 aa, Artificial Sequence
  Description of Artificial Sequence: Synthetic peptide
GRTTKAF

SEQ ID NO: 30456 - protein, 7 aa, Artificial Sequence
  Description of Artificial Sequence: Synthetic peptide
QMLGRGG

SEQ ID NO: 30457 - protein, 7 aa, Artificial Sequence
  Description of Artificial Sequence: Synthetic peptide
ATLSSGE

SEQ ID NO: 30458 - protein, 7 aa, Artificial Sequence
  Description of Artificial Sequence: Synthetic peptide
NGRQGHT

SEQ ID NO: 30459 - protein, 7 aa, Artificial Sequence
  Description of Artificial Sequence: Synthetic peptide
SSLQPFT

SEQ ID NO: 30460 - protein, 7 aa, Artificial Sequence
  Description of Artificial Sequence: Synthetic peptide
ASRSTNP

SEQ ID NO: 30461 - protein, 7 aa, Artificial Sequence
  Description of Artificial Sequence: Synthetic peptide
MPNSSSL

SEQ ID NO: 30462 - protein, 7 aa, Artificial Sequence
  Description of Artificial Sequence: Synthetic peptide
RNNNRLE

SEQ ID NO: 30463 - protein, 7 aa, Artificial Sequence
  Description of Artificial Sequence: Synthetic peptide
NSAALNS

SEQ ID NO: 30464 - protein, 7 aa, Artificial Sequence
  Description of Artificial Sequence: Synthetic peptide
SSLPRYN

SEQ ID NO: 30465 - protein, 7 aa, Artificial Sequence
  Description of Artificial Sequence: Synthetic peptide
PLQDSLR

SEQ ID NO: 30466 - protein, 7 aa, Artificial Sequence
  Description of Artificial Sequence: Synthetic peptide
DRLDHSR

SEQ ID NO: 30467 - protein, 7 aa, Artificial Sequence
  Description of Artificial Sequence: Synthetic peptide
SIQRAAA

SEQ ID NO: 30468 - protein, 7 aa, Artificial Sequence
  Description of Artificial Sequence: Synthetic peptide
RGNGTHG

SEQ ID NO: 30469 - protein, 7 aa, Artificial Sequence
  Description of Artificial Sequence: Synthetic peptide
RVNLNEL

SEQ ID NO: 30470 - protein, 7 aa, Artificial Sequence
  Description of Artificial Sequence: Synthetic peptide
SQPGSNH

SEQ ID NO: 30471 - protein, 7 aa, Artificial Sequence
  Description of Artificial Sequence: Synthetic peptide
DSRQTSL

SEQ ID NO: 30472 - protein, 7 aa, Artificial Sequence
  Description of Artificial Sequence: Synthetic peptide
RMTRGAD

SEQ ID NO: 30473 - protein, 7 aa, Artificial Sequence
  Description of Artificial Sequence: Synthetic peptide
SSISRTS

SEQ ID NO: 30474 - protein, 7 aa, Artificial Sequence
  Description of Artificial Sequence: Synthetic peptide
ASLRESR

SEQ ID NO: 30475 - protein, 7 aa, Artificial Sequence
  Description of Artificial Sequence: Synthetic peptide
PRDLRAS

SEQ ID NO: 30476 - protein, 7 aa, Artificial Sequence
  Description of Artificial Sequence: Synthetic peptide
QGSSLRT

SEQ ID NO: 30477 - protein, 7 aa, Artificial Sequence
  Description of Artificial Sequence: Synthetic peptide
SLYTNAV

SEQ ID NO: 30478 - protein, 7 aa, Artificial Sequence
  Description of Artificial Sequence: Synthetic peptide
GSNLGQM

SEQ ID NO: 30479 - protein, 7 aa, Artificial Sequence
  Description of Artificial Sequence: Synthetic peptide
LTTSNIG

SEQ ID NO: 30480 - protein, 7 aa, Artificial Sequence
  Description of Artificial Sequence: Synthetic peptide
SAGTSVG

SEQ ID NO: 30481 - protein, 7 aa, Artificial Sequence
  Description of Artificial Sequence: Synthetic peptide
LSSGRGG

SEQ ID NO: 30482 - protein, 7 aa, Artificial Sequence
  Description of Artificial Sequence: Synthetic peptide
LSPTSTN

SEQ ID NO: 30483 - protein, 7 aa, Artificial Sequence
  Description of Artificial Sequence: Synthetic peptide
IGTSPMK

SEQ ID NO: 30484 - protein, 7 aa, Artificial Sequence
  Description of Artificial Sequence: Synthetic peptide
GDSKSTW

SEQ ID NO: 30485 - protein, 7 aa, Artificial Sequence
  Description of Artificial Sequence: Synthetic peptide
QVTGASH

SEQ ID NO: 30486 - protein, 7 aa, Artificial Sequence
  Description of Artificial Sequence: Synthetic peptide
SLERLKT

SEQ ID NO: 30487 - protein, 7 aa, Artificial Sequence
  Description of Artificial Sequence: Synthetic peptide
TLPRVPA

SEQ ID NO: 30488 - protein, 7 aa, Artificial Sequence
  Description of Artificial Sequence: Synthetic peptide
PSVANVM

SEQ ID NO: 30489 - protein, 7 aa, Artificial Sequence
  Description of Artificial Sequence: Synthetic peptide
GTARTLH

SEQ ID NO: 30490 - protein, 7 aa, Artificial Sequence
  Description of Artificial Sequence: Synthetic peptide
TSVSNRT

SEQ ID NO: 30491 - protein, 7 aa, Artificial Sequence
  Description of Artificial Sequence: Synthetic peptide
HIGSPHT

SEQ ID NO: 30492 - protein, 7 aa, Artificial Sequence
  Description of Artificial Sequence: Synthetic peptide
LMHSAVS

SEQ ID NO: 30493 - protein, 7 aa, Artificial Sequence
  Description of Artificial Sequence: Synthetic peptide
SRSGGQV

SEQ ID NO: 30494 - protein, 7 aa, Artificial Sequence
  Description of Artificial Sequence: Synthetic peptide
FNIQGIG

SEQ ID NO: 30495 - protein, 7 aa, Artificial Sequence
  Description of Artificial Sequence: Synthetic peptide
PLAAGGT

SEQ ID NO: 30496 - protein, 7 aa, Artificial Sequence
  Description of Artificial Sequence: Synthetic peptide
TSLSPSV

SEQ ID NO: 30497 - protein, 7 aa, Artificial Sequence
  Description of Artificial Sequence: Synthetic peptide
VSTQAIS

SEQ ID NO: 30498 - protein, 7 aa, Artificial Sequence
  Description of Artificial Sequence: Synthetic peptide
TRPNGGG

SEQ ID NO: 30499 - protein, 7 aa, Artificial Sequence
  Description of Artificial Sequence: Synthetic peptide
VGSSKGC

SEQ ID NO: 30500 - protein, 7 aa, Artificial Sequence
  Description of Artificial Sequence: Synthetic peptide
VTYPPAG

SEQ ID NO: 30501 - protein, 7 aa, Artificial Sequence
  Description of Artificial Sequence: Synthetic peptide
YSSRSGP

SEQ ID NO: 30502 - protein, 7 aa, Artificial Sequence
  Description of Artificial Sequence: Synthetic peptide
RIQAPGR

SEQ ID NO: 30503 - protein, 7 aa, Artificial Sequence
  Description of Artificial Sequence: Synthetic peptide
MSYKAHD

SEQ ID NO: 30504 - protein, 7 aa, Artificial Sequence
  Description of Artificial Sequence: Synthetic peptide
WSLGHND

SEQ ID NO: 30505 - protein, 7 aa, Artificial Sequence
  Description of Artificial Sequence: Synthetic peptide
VPTSRLN

SEQ ID NO: 30506 - protein, 7 aa, Artificial Sequence
  Description of Artificial Sequence: Synthetic peptide
RCEATTA

SEQ ID NO: 30507 - protein, 7 aa, Artificial Sequence
  Description of Artificial Sequence: Synthetic peptide
TQSSTRS

SEQ ID NO: 30508 - protein, 7 aa, Artificial Sequence
  Description of Artificial Sequence: Synthetic peptide
LTGTAHQ

SEQ ID NO: 30509 - protein, 7 aa, Artificial Sequence
  Description of Artificial Sequence: Synthetic peptide
TSSANTV

SEQ ID NO: 30510 - protein, 7 aa, Artificial Sequence
  Description of Artificial Sequence: Synthetic peptide
SASGKPC

SEQ ID NO: 30511 - protein, 7 aa, Artificial Sequence
  Description of Artificial Sequence: Synthetic peptide
RSDPTRG

SEQ ID NO: 30512 - protein, 7 aa, Artificial Sequence
  Description of Artificial Sequence: Synthetic peptide
KTPQLSQ

SEQ ID NO: 30513 - protein, 7 aa, Artificial Sequence
  Description of Artificial Sequence: Synthetic peptide
SATSVPI

SEQ ID NO: 30514 - protein, 7 aa, Artificial Sequence
  Description of Artificial Sequence: Synthetic peptide
MKSKERP

SEQ ID NO: 30515 - protein, 7 aa, Artificial Sequence
  Description of Artificial Sequence: Synthetic peptide
FSASGAR

SEQ ID NO: 30516 - protein, 7 aa, Artificial Sequence
  Description of Artificial Sequence: Synthetic peptide
YNTLPAR

SEQ ID NO: 30517 - protein, 7 aa, Artificial Sequence
  Description of Artificial Sequence: Synthetic peptide
YSGSAGQ

SEQ ID NO: 30518 - protein, 7 aa, Artificial Sequence
  Description of Artificial Sequence: Synthetic peptide
SFTADRS

SEQ ID NO: 30519 - protein, 7 aa, Artificial Sequence
  Description of Artificial Sequence: Synthetic peptide
APSHASL

SEQ ID NO: 30520 - protein, 7 aa, Artificial Sequence
  Description of Artificial Sequence: Synthetic peptide
AKTNLSS

SEQ ID NO: 30521 - protein, 7 aa, Artificial Sequence
  Description of Artificial Sequence: Synthetic peptide
SSHSDTR

SEQ ID NO: 30522 - protein, 7 aa, Artificial Sequence
  Description of Artificial Sequence: Synthetic peptide
TRAQHSG

SEQ ID NO: 30523 - protein, 7 aa, Artificial Sequence
  Description of Artificial Sequence: Synthetic peptide
GVPAGHT

SEQ ID NO: 30524 - protein, 7 aa, Artificial Sequence
  Description of Artificial Sequence: Synthetic peptide
DTSRAPG

SEQ ID NO: 30525 - protein, 7 aa, Artificial Sequence
  Description of Artificial Sequence: Synthetic peptide
HVKANGS

SEQ ID NO: 30526 - protein, 7 aa, Artificial Sequence
  Description of Artificial Sequence: Synthetic peptide
SRDSGGA

SEQ ID NO: 30527 - protein, 7 aa, Artificial Sequence
  Description of Artificial Sequence: Synthetic peptide
GVTSSGP

SEQ ID NO: 30528 - protein, 7 aa, Artificial Sequence
  Description of Artificial Sequence: Synthetic peptide
SSINTAA

SEQ ID NO: 30529 - protein, 7 aa, Artificial Sequence
  Description of Artificial Sequence: Synthetic peptide
SGMASVT

SEQ ID NO: 30530 - protein, 7 aa, Artificial Sequence
  Description of Artificial Sequence: Synthetic peptide
GGTPTHR

SEQ ID NO: 30531 - protein, 7 aa, Artificial Sequence
  Description of Artificial Sequence: Synthetic peptide
HREARLL

SEQ ID NO: 30532 - protein, 7 aa, Artificial Sequence
  Description of Artificial Sequence: Synthetic peptide
NSRSHHE

SEQ ID NO: 30533 - protein, 7 aa, Artificial Sequence
  Description of Artificial Sequence: Synthetic peptide
GPRNSLN

SEQ ID NO: 30534 - protein, 7 aa, Artificial Sequence
  Description of Artificial Sequence: Synthetic peptide
TRSQDYQ

SEQ ID NO: 30535 - protein, 7 aa, Artificial Sequence
  Description of Artificial Sequence: Synthetic peptide
RGLDSIN

SEQ ID NO: 30536 - protein, 7 aa, Artificial Sequence
  Description of Artificial Sequence: Synthetic peptide
SDHQSVR

SEQ ID NO: 30537 - protein, 7 aa, Artificial Sequence
  Description of Artificial Sequence: Synthetic peptide
PYAQGSF

SEQ ID NO: 30538 - protein, 7 aa, Artificial Sequence
  Description of Artificial Sequence: Synthetic peptide
PTSIGRD

SEQ ID NO: 30539 - protein, 7 aa, Artificial Sequence
  Description of Artificial Sequence: Synthetic peptide
SLSLVKG

SEQ ID NO: 30540 - protein, 7 aa, Artificial Sequence
  Description of Artificial Sequence: Synthetic peptide
LERNGLK

SEQ ID NO: 30541 - protein, 7 aa, Artificial Sequence
  Description of Artificial Sequence: Synthetic peptide
TAFSTNR

SEQ ID NO: 30542 - protein, 7 aa, Artificial Sequence
  Description of Artificial Sequence: Synthetic peptide
DHRNISS

SEQ ID NO: 30543 - protein, 7 aa, Artificial Sequence
  Description of Artificial Sequence: Synthetic peptide
VRQSQVM

SEQ ID NO: 30544 - protein, 7 aa, Artificial Sequence
  Description of Artificial Sequence: Synthetic peptide
RDRGAEH

SEQ ID NO: 30545 - protein, 7 aa, Artificial Sequence
  Description of Artificial Sequence: Synthetic peptide
SRGDGVT

SEQ ID NO: 30546 - protein, 7 aa, Artificial Sequence
  Description of Artificial Sequence: Synthetic peptide
DTITSRG

SEQ ID NO: 30547 - protein, 7 aa, Artificial Sequence
  Description of Artificial Sequence: Synthetic peptide
PNGHEVL

SEQ ID NO: 30548 - protein, 7 aa, Artificial Sequence
  Description of Artificial Sequence: Synthetic peptide
SGNSHNG

SEQ ID NO: 30549 - protein, 7 aa, Artificial Sequence
  Description of Artificial Sequence: Synthetic peptide
NTDTSAV

SEQ ID NO: 30550 - protein, 7 aa, Artificial Sequence
  Description of Artificial Sequence: Synthetic peptide
PRDRDYH

SEQ ID NO: 30551 - protein, 7 aa, Artificial Sequence
  Description of Artificial Sequence: Synthetic peptide
PANQLRS

SEQ ID NO: 30552 - protein, 7 aa, Artificial Sequence
  Description of Artificial Sequence: Synthetic peptide
NIHLAGT

SEQ ID NO: 30553 - protein, 7 aa, Artificial Sequence
  Description of Artificial Sequence: Synthetic peptide
MSGSGTE

SEQ ID NO: 30554 - protein, 7 aa, Artificial Sequence
  Description of Artificial Sequence: Synthetic peptide
LRGTVPK

SEQ ID NO: 30555 - protein, 7 aa, Artificial Sequence
  Description of Artificial Sequence: Synthetic peptide
TGSSSSQ

SEQ ID NO: 30556 - protein, 7 aa, Artificial Sequence
  Description of Artificial Sequence: Synthetic peptide
SARDRAS

SEQ ID NO: 30557 - protein, 7 aa, Artificial Sequence
  Description of Artificial Sequence: Synthetic peptide
SNSRMGT

SEQ ID NO: 30558 - protein, 7 aa, Artificial Sequence
  Description of Artificial Sequence: Synthetic peptide
YGSDKSI

SEQ ID NO: 30559 - protein, 7 aa, Artificial Sequence
  Description of Artificial Sequence: Synthetic peptide
GLSKTYH

SEQ ID NO: 30560 - protein, 7 aa, Artificial Sequence
  Description of Artificial Sequence: Synthetic peptide
VARRDAL

SEQ ID NO: 30561 - protein, 7 aa, Artificial Sequence
  Description of Artificial Sequence: Synthetic peptide
TGPHTSR

SEQ ID NO: 30562 - protein, 7 aa, Artificial Sequence
  Description of Artificial Sequence: Synthetic peptide
LMPSSSS

SEQ ID NO: 30563 - protein, 7 aa, Artificial Sequence
  Description of Artificial Sequence: Synthetic peptide
LPPASPR

SEQ ID NO: 30564 - protein, 7 aa, Artificial Sequence
  Description of Artificial Sequence: Synthetic peptide
MVSHTHG

SEQ ID NO: 30565 - protein, 7 aa, Artificial Sequence
  Description of Artificial Sequence: Synthetic peptide
SYGPTPQ

SEQ ID NO: 30566 - protein, 7 aa, Artificial Sequence
  Description of Artificial Sequence: Synthetic peptide
TGPGAHA

SEQ ID NO: 30567 - protein, 7 aa, Artificial Sequence
  Description of Artificial Sequence: Synthetic peptide
DSRQAMS

SEQ ID NO: 30568 - protein, 7 aa, Artificial Sequence
  Description of Artificial Sequence: Synthetic peptide
SSMSHQK

SEQ ID NO: 30569 - protein, 7 aa, Artificial Sequence
  Description of Artificial Sequence: Synthetic peptide
PSLRSMT

SEQ ID NO: 30570 - protein, 7 aa, Artificial Sequence
  Description of Artificial Sequence: Synthetic peptide
TKFKTTL

SEQ ID NO: 30571 - protein, 7 aa, Artificial Sequence
  Description of Artificial Sequence: Synthetic peptide
VSASNSL

SEQ ID NO: 30572 - protein, 7 aa, Artificial Sequence
  Description of Artificial Sequence: Synthetic peptide
ASTGPNA

SEQ ID NO: 30573 - protein, 7 aa, Artificial Sequence
  Description of Artificial Sequence: Synthetic peptide
GSRSSTT

SEQ ID NO: 30574 - protein, 7 aa, Artificial Sequence
  Description of Artificial Sequence: Synthetic peptide
SGGTPGR

SEQ ID NO: 30575 - protein, 7 aa, Artificial Sequence
  Description of Artificial Sequence: Synthetic peptide
VHQAGAN

SEQ ID NO: 30576 - protein, 7 aa, Artificial Sequence
  Description of Artificial Sequence: Synthetic peptide
PEISASR

SEQ ID NO: 30577 - protein, 7 aa, Artificial Sequence
  Description of Artificial Sequence: Synthetic peptide
HRHVKSE

SEQ ID NO: 30578 - protein, 7 aa, Artificial Sequence
  Description of Artificial Sequence: Synthetic peptide
LGAGQRE

SEQ ID NO: 30579 - protein, 7 aa, Artificial Sequence
  Description of Artificial Sequence: Synthetic peptide
HMAASTG

SEQ ID NO: 30580 - protein, 7 aa, Artificial Sequence
  Description of Artificial Sequence: Synthetic peptide
GKAGAGG

SEQ ID NO: 30581 - protein, 7 aa, Artificial Sequence
  Description of Artificial Sequence: Synthetic peptide
SSRVSHS

SEQ ID NO: 30582 - protein, 7 aa, Artificial Sequence
  Description of Artificial Sequence: Synthetic peptide
TGAGGYC

SEQ ID NO: 30583 - protein, 7 aa, Artificial Sequence
  Description of Artificial Sequence: Synthetic peptide
AVLNPRV

SEQ ID NO: 30584 - protein, 7 aa, Artificial Sequence
  Description of Artificial Sequence: Synthetic peptide
VASSAHV

SEQ ID NO: 30585 - protein, 7 aa, Artificial Sequence
  Description of Artificial Sequence: Synthetic peptide
SYKNTGV

SEQ ID NO: 30586 - protein, 7 aa, Artificial Sequence
  Description of Artificial Sequence: Synthetic peptide
GNSNTLA

SEQ ID NO: 30587 - protein, 7 aa, Artificial Sequence
  Description of Artificial Sequence: Synthetic peptide
TQGHKAL

SEQ ID NO: 30588 - protein, 7 aa, Artificial Sequence
  Description of Artificial Sequence: Synthetic peptide
TIGPPST

SEQ ID NO: 30589 - protein, 7 aa, Artificial Sequence
  Description of Artificial Sequence: Synthetic peptide
CYGDRHN

SEQ ID NO: 30590 - protein, 7 aa, Artificial Sequence
  Description of Artificial Sequence: Synthetic peptide
PASRIPS

SEQ ID NO: 30591 - protein, 7 aa, Artificial Sequence
  Description of Artificial Sequence: Synthetic peptide
SAHRSGV

SEQ ID NO: 30592 - protein, 7 aa, Artificial Sequence
  Description of Artificial Sequence: Synthetic peptide
QPNRADN

SEQ ID NO: 30593 - protein, 7 aa, Artificial Sequence
  Description of Artificial Sequence: Synthetic peptide
RPASTHT

SEQ ID NO: 30594 - protein, 7 aa, Artificial Sequence
  Description of Artificial Sequence: Synthetic peptide
RGTGIGS

SEQ ID NO: 30595 - protein, 7 aa, Artificial Sequence
  Description of Artificial Sequence: Synthetic peptide
QTSSREM

SEQ ID NO: 30596 - protein, 7 aa, Artificial Sequence
  Description of Artificial Sequence: Synthetic peptide
GKAGEGG

SEQ ID NO: 30597 - protein, 7 aa, Artificial Sequence
  Description of Artificial Sequence: Synthetic peptide
SSPVSAV

SEQ ID NO: 30598 - protein, 7 aa, Artificial Sequence
  Description of Artificial Sequence: Synthetic peptide
PTTTAKP

SEQ ID NO: 30599 - protein, 7 aa, Artificial Sequence
  Description of Artificial Sequence: Synthetic peptide
SSTNRPT

SEQ ID NO: 30600 - protein, 7 aa, Artificial Sequence
  Description of Artificial Sequence: Synthetic peptide
QIGSLSG

SEQ ID NO: 30601 - protein, 7 aa, Artificial Sequence
  Description of Artificial Sequence: Synthetic peptide
GMHVSNP

SEQ ID NO: 30602 - protein, 7 aa, Artificial Sequence
  Description of Artificial Sequence: Synthetic peptide
NFGPQAD

SEQ ID NO: 30603 - protein, 7 aa, Artificial Sequence
  Description of Artificial Sequence: Synthetic peptide
NRTSPVS

SEQ ID NO: 30604 - protein, 7 aa, Artificial Sequence
  Description of Artificial Sequence: Synthetic peptide
HTHVSNR

SEQ ID NO: 30605 - protein, 7 aa, Artificial Sequence
  Description of Artificial Sequence: Synthetic peptide
SPAYDTR

SEQ ID NO: 30606 - protein, 7 aa, Artificial Sequence
  Description of Artificial Sequence: Synthetic peptide
KLSNDNL

SEQ ID NO: 30607 - protein, 7 aa, Artificial Sequence
  Description of Artificial Sequence: Synthetic peptide
GELPDRR

SEQ ID NO: 30608 - protein, 7 aa, Artificial Sequence
  Description of Artificial Sequence: Synthetic peptide
YSRPTTT

SEQ ID NO: 30609 - protein, 7 aa, Artificial Sequence
  Description of Artificial Sequence: Synthetic peptide
SVVAHGP

SEQ ID NO: 30610 - protein, 7 aa, Artificial Sequence
  Description of Artificial Sequence: Synthetic peptide
ASSLLNV

SEQ ID NO: 30611 - protein, 7 aa, Artificial Sequence
  Description of Artificial Sequence: Synthetic peptide
TQGARNL

SEQ ID NO: 30612 - protein, 7 aa, Artificial Sequence
  Description of Artificial Sequence: Synthetic peptide
VYSSPSA

SEQ ID NO: 30613 - protein, 7 aa, Artificial Sequence
  Description of Artificial Sequence: Synthetic peptide
GVSNLAS

SEQ ID NO: 30614 - protein, 7 aa, Artificial Sequence
  Description of Artificial Sequence: Synthetic peptide
MRPNSGM

SEQ ID NO: 30615 - protein, 7 aa, Artificial Sequence
  Description of Artificial Sequence: Synthetic peptide
CAGTSRV

SEQ ID NO: 30616 - protein, 7 aa, Artificial Sequence
  Description of Artificial Sequence: Synthetic peptide
CRAGTIM

SEQ ID NO: 30617 - protein, 7 aa, Artificial Sequence
  Description of Artificial Sequence: Synthetic peptide
SRAQSIP

SEQ ID NO: 30618 - protein, 7 aa, Artificial Sequence
  Description of Artificial Sequence: Synthetic peptide
CHLHATT

SEQ ID NO: 30619 - protein, 7 aa, Artificial Sequence
  Description of Artificial Sequence: Synthetic peptide
ISPVPLT

SEQ ID NO: 30620 - protein, 7 aa, Artificial Sequence
  Description of Artificial Sequence: Synthetic peptide
KSNSSLG

SEQ ID NO: 30621 - protein, 7 aa, Artificial Sequence
  Description of Artificial Sequence: Synthetic peptide
SPKANRV

SEQ ID NO: 30622 - protein, 7 aa, Artificial Sequence
  Description of Artificial Sequence: Synthetic peptide
TQSSRAG

SEQ ID NO: 30623 - protein, 7 aa, Artificial Sequence
  Description of Artificial Sequence: Synthetic peptide
KHQEFVG

SEQ ID NO: 30624 - protein, 7 aa, Artificial Sequence
  Description of Artificial Sequence: Synthetic peptide
SSISSAV

SEQ ID NO: 30625 - protein, 7 aa, Artificial Sequence
  Description of Artificial Sequence: Synthetic peptide
AVASRTN

SEQ ID NO: 30626 - protein, 7 aa, Artificial Sequence
  Description of Artificial Sequence: Synthetic peptide
AHSVTPG

SEQ ID NO: 30627 - protein, 7 aa, Artificial Sequence
  Description of Artificial Sequence: Synthetic peptide
PISTHLK

SEQ ID NO: 30628 - protein, 7 aa, Artificial Sequence
  Description of Artificial Sequence: Synthetic peptide
QGLSKSG

SEQ ID NO: 30629 - protein, 7 aa, Artificial Sequence
  Description of Artificial Sequence: Synthetic peptide
PNQAHRS

SEQ ID NO: 30630 - protein, 7 aa, Artificial Sequence
  Description of Artificial Sequence: Synthetic peptide
ARGKPAL

SEQ ID NO: 30631 - protein, 7 aa, Artificial Sequence
  Description of Artificial Sequence: Synthetic peptide
PRANAPR

SEQ ID NO: 30632 - protein, 7 aa, Artificial Sequence
  Description of Artificial Sequence: Synthetic peptide
CPPITKG

SEQ ID NO: 30633 - protein, 7 aa, Artificial Sequence
  Description of Artificial Sequence: Synthetic peptide
ATTKEGI

SEQ ID NO: 30634 - protein, 7 aa, Artificial Sequence
  Description of Artificial Sequence: Synthetic peptide
SSDNRGL

SEQ ID NO: 30635 - protein, 7 aa, Artificial Sequence
  Description of Artificial Sequence: Synthetic peptide
AGDGVVR

SEQ ID NO: 30636 - protein, 7 aa, Artificial Sequence
  Description of Artificial Sequence: Synthetic peptide
NAHTRPA

SEQ ID NO: 30637 - protein, 7 aa, Artificial Sequence
  Description of Artificial Sequence: Synthetic peptide
AHTSAGG

SEQ ID NO: 30638 - protein, 7 aa, Artificial Sequence
  Description of Artificial Sequence: Synthetic peptide
HTSTNTI

SEQ ID NO: 30639 - protein, 7 aa, Artificial Sequence
  Description of Artificial Sequence: Synthetic peptide
LNRPSLG

SEQ ID NO: 30640 - protein, 7 aa, Artificial Sequence
  Description of Artificial Sequence: Synthetic peptide
TSGRTTY

SEQ ID NO: 30641 - protein, 7 aa, Artificial Sequence
  Description of Artificial Sequence: Synthetic peptide
RKTSLND

SEQ ID NO: 30642 - protein, 7 aa, Artificial Sequence
  Description of Artificial Sequence: Synthetic peptide
TNSHVPR

SEQ ID NO: 30643 - protein, 7 aa, Artificial Sequence
  Description of Artificial Sequence: Synthetic peptide
ASSLPKR

SEQ ID NO: 30644 - protein, 7 aa, Artificial Sequence
  Description of Artificial Sequence: Synthetic peptide
TETRSAN

SEQ ID NO: 30645 - protein, 7 aa, Artificial Sequence
  Description of Artificial Sequence: Synthetic peptide
SRAQSQI

SEQ ID NO: 30646 - protein, 7 aa, Artificial Sequence
  Description of Artificial Sequence: Synthetic peptide
VRHTTDS

SEQ ID NO: 30647 - protein, 7 aa, Artificial Sequence
  Description of Artificial Sequence: Synthetic peptide
PRMNGIK

SEQ ID NO: 30648 - protein, 7 aa, Artificial Sequence
  Description of Artificial Sequence: Synthetic peptide
AIPAVSM

SEQ ID NO: 30649 - protein, 7 aa, Artificial Sequence
  Description of Artificial Sequence: Synthetic peptide
GSTGSSI

SEQ ID NO: 30650 - protein, 7 aa, Artificial Sequence
  Description of Artificial Sequence: Synthetic peptide
ENNALSR

SEQ ID NO: 30651 - protein, 7 aa, Artificial Sequence
  Description of Artificial Sequence: Synthetic peptide
YPNSVPS

SEQ ID NO: 30652 - protein, 7 aa, Artificial Sequence
  Description of Artificial Sequence: Synthetic peptide
VNGKICS

SEQ ID NO: 30653 - protein, 7 aa, Artificial Sequence
  Description of Artificial Sequence: Synthetic peptide
HPSSRNS

SEQ ID NO: 30654 - protein, 7 aa, Artificial Sequence
  Description of Artificial Sequence: Synthetic peptide
SRVTVSQ

SEQ ID NO: 30655 - protein, 7 aa, Artificial Sequence
  Description of Artificial Sequence: Synthetic peptide
MGAGELT

SEQ ID NO: 30656 - protein, 7 aa, Artificial Sequence
  Description of Artificial Sequence: Synthetic peptide
GLADPRT

SEQ ID NO: 30657 - protein, 7 aa, Artificial Sequence
  Description of Artificial Sequence: Synthetic peptide
TLDNHRS

SEQ ID NO: 30658 - protein, 7 aa, Artificial Sequence
  Description of Artificial Sequence: Synthetic peptide
LDGRGFS

SEQ ID NO: 30659 - protein, 7 aa, Artificial Sequence
  Description of Artificial Sequence: Synthetic peptide
AGTLGQI

SEQ ID NO: 30660 - protein, 7 aa, Artificial Sequence
  Description of Artificial Sequence: Synthetic peptide
GVCKPYA

SEQ ID NO: 30661 - protein, 7 aa, Artificial Sequence
  Description of Artificial Sequence: Synthetic peptide
MRANHTS

SEQ ID NO: 30662 - protein, 7 aa, Artificial Sequence
  Description of Artificial Sequence: Synthetic peptide
GLKGSFP

SEQ ID NO: 30663 - protein, 7 aa, Artificial Sequence
  Description of Artificial Sequence: Synthetic peptide
VRHTDVS

SEQ ID NO: 30664 - protein, 7 aa, Artificial Sequence
  Description of Artificial Sequence: Synthetic peptide
RVQDTPR

SEQ ID NO: 30665 - protein, 7 aa, Artificial Sequence
  Description of Artificial Sequence: Synthetic peptide
GMQKMSS

SEQ ID NO: 30666 - protein, 7 aa, Artificial Sequence
  Description of Artificial Sequence: Synthetic peptide
HSRAQAG

SEQ ID NO: 30667 - protein, 7 aa, Artificial Sequence
  Description of Artificial Sequence: Synthetic peptide
GNGISAR

SEQ ID NO: 30668 - protein, 7 aa, Artificial Sequence
  Description of Artificial Sequence: Synthetic peptide
IPASHNP

SEQ ID NO: 30669 - protein, 7 aa, Artificial Sequence
  Description of Artificial Sequence: Synthetic peptide
GPTDHKL

SEQ ID NO: 30670 - protein, 7 aa, Artificial Sequence
  Description of Artificial Sequence: Synthetic peptide
SMTSRNS

SEQ ID NO: 30671 - protein, 7 aa, Artificial Sequence
  Description of Artificial Sequence: Synthetic peptide
DVNTRSR

SEQ ID NO: 30672 - protein, 7 aa, Artificial Sequence
  Description of Artificial Sequence: Synthetic peptide
HHDASPN

SEQ ID NO: 30673 - protein, 7 aa, Artificial Sequence
  Description of Artificial Sequence: Synthetic peptide
YAQVGSS

SEQ ID NO: 30674 - protein, 7 aa, Artificial Sequence
  Description of Artificial Sequence: Synthetic peptide
VGSDSST

SEQ ID NO: 30675 - protein, 7 aa, Artificial Sequence
  Description of Artificial Sequence: Synthetic peptide
RATSREA

SEQ ID NO: 30676 - protein, 7 aa, Artificial Sequence
  Description of Artificial Sequence: Synthetic peptide
LAPTNVK

SEQ ID NO: 30677 - protein, 7 aa, Artificial Sequence
  Description of Artificial Sequence: Synthetic peptide
YNHGSVD

SEQ ID NO: 30678 - protein, 7 aa, Artificial Sequence
  Description of Artificial Sequence: Synthetic peptide
CSTTAIR

SEQ ID NO: 30679 - protein, 7 aa, Artificial Sequence
  Description of Artificial Sequence: Synthetic peptide
ALPGSTS

SEQ ID NO: 30680 - protein, 7 aa, Artificial Sequence
  Description of Artificial Sequence: Synthetic peptide
TQPSHDS

SEQ ID NO: 30681 - protein, 7 aa, Artificial Sequence
  Description of Artificial Sequence: Synthetic peptide
SSPDRPV

SEQ ID NO: 30682 - protein, 7 aa, Artificial Sequence
  Description of Artificial Sequence: Synthetic peptide
AHGTTGT

SEQ ID NO: 30683 - protein, 7 aa, Artificial Sequence
  Description of Artificial Sequence: Synthetic peptide
SSVQHTG

SEQ ID NO: 30684 - protein, 7 aa, Artificial Sequence
  Description of Artificial Sequence: Synthetic peptide
STSSRPS

SEQ ID NO: 30685 - protein, 7 aa, Artificial Sequence
  Description of Artificial Sequence: Synthetic peptide
GHVNAHV

SEQ ID NO: 30686 - protein, 7 aa, Artificial Sequence
  Description of Artificial Sequence: Synthetic peptide
PNQRVIG

SEQ ID NO: 30687 - protein, 7 aa, Artificial Sequence
  Description of Artificial Sequence: Synthetic peptide
SLGRSQL

SEQ ID NO: 30688 - protein, 7 aa, Artificial Sequence
  Description of Artificial Sequence: Synthetic peptide
SNANNVC

SEQ ID NO: 30689 - protein, 7 aa, Artificial Sequence
  Description of Artificial Sequence: Synthetic peptide
CTSKSSS

SEQ ID NO: 30690 - protein, 7 aa, Artificial Sequence
  Description of Artificial Sequence: Synthetic peptide
RTLSASS

SEQ ID NO: 30691 - protein, 7 aa, Artificial Sequence
  Description of Artificial Sequence: Synthetic peptide
LRAEHVR

SEQ ID NO: 30692 - protein, 7 aa, Artificial Sequence
  Description of Artificial Sequence: Synthetic peptide
SNRQHGL

SEQ ID NO: 30693 - protein, 7 aa, Artificial Sequence
  Description of Artificial Sequence: Synthetic peptide
SIQSAAA

SEQ ID NO: 30694 - protein, 7 aa, Artificial Sequence
  Description of Artificial Sequence: Synthetic peptide
HTSNTRV

SEQ ID NO: 30695 - protein, 7 aa, Artificial Sequence
  Description of Artificial Sequence: Synthetic peptide
SRVEINR

SEQ ID NO: 30696 - protein, 7 aa, Artificial Sequence
  Description of Artificial Sequence: Synthetic peptide
ATSTNGI

SEQ ID NO: 30697 - protein, 7 aa, Artificial Sequence
  Description of Artificial Sequence: Synthetic peptide
PLLSSRV

SEQ ID NO: 30698 - protein, 7 aa, Artificial Sequence
  Description of Artificial Sequence: Synthetic peptide
GSLTSQK

SEQ ID NO: 30699 - protein, 7 aa, Artificial Sequence
  Description of Artificial Sequence: Synthetic peptide
LVNSAVQ

SEQ ID NO: 30700 - protein, 7 aa, Artificial Sequence
  Description of Artificial Sequence: Synthetic peptide
SATNGSL

SEQ ID NO: 30701 - protein, 7 aa, Artificial Sequence
  Description of Artificial Sequence: Synthetic peptide
HANNGTS

SEQ ID NO: 30702 - protein, 7 aa, Artificial Sequence
  Description of Artificial Sequence: Synthetic peptide
QNLNSFS

SEQ ID NO: 30703 - protein, 7 aa, Artificial Sequence
  Description of Artificial Sequence: Synthetic peptide
TNLPRSH

SEQ ID NO: 30704 - protein, 7 aa, Artificial Sequence
  Description of Artificial Sequence: Synthetic peptide
GVGHDDR

SEQ ID NO: 30705 - protein, 7 aa, Artificial Sequence
  Description of Artificial Sequence: Synthetic peptide
SVHQKRA

SEQ ID NO: 30706 - protein, 7 aa, Artificial Sequence
  Description of Artificial Sequence: Synthetic peptide
TRLANMH

SEQ ID NO: 30707 - protein, 7 aa, Artificial Sequence
  Description of Artificial Sequence: Synthetic peptide
LAFGSST

SEQ ID NO: 30708 - protein, 7 aa, Artificial Sequence
  Description of Artificial Sequence: Synthetic peptide
PSLERGS

SEQ ID NO: 30709 - protein, 7 aa, Artificial Sequence
  Description of Artificial Sequence: Synthetic peptide
LNSGSFS

SEQ ID NO: 30710 - protein, 7 aa, Artificial Sequence
  Description of Artificial Sequence: Synthetic peptide
LIRSGER

SEQ ID NO: 30711 - protein, 7 aa, Artificial Sequence
  Description of Artificial Sequence: Synthetic peptide
SLTSTGK

SEQ ID NO: 30712 - protein, 7 aa, Artificial Sequence
  Description of Artificial Sequence: Synthetic peptide
GRLNTNG

SEQ ID NO: 30713 - protein, 7 aa, Artificial Sequence
  Description of Artificial Sequence: Synthetic peptide
RSMSSAV

SEQ ID NO: 30714 - protein, 7 aa, Artificial Sequence
  Description of Artificial Sequence: Synthetic peptide
SRPGISQ

SEQ ID NO: 30715 - protein, 7 aa, Artificial Sequence
  Description of Artificial Sequence: Synthetic peptide
PTTLKHD

SEQ ID NO: 30716 - protein, 7 aa, Artificial Sequence
  Description of Artificial Sequence: Synthetic peptide
RSNMATA

SEQ ID NO: 30717 - protein, 7 aa, Artificial Sequence
  Description of Artificial Sequence: Synthetic peptide
GRAQLSQ

SEQ ID NO: 30718 - protein, 7 aa, Artificial Sequence
  Description of Artificial Sequence: Synthetic peptide
ALHASYN

SEQ ID NO: 30719 - protein, 7 aa, Artificial Sequence
  Description of Artificial Sequence: Synthetic peptide
NSNGLNN

SEQ ID NO: 30720 - protein, 7 aa, Artificial Sequence
  Description of Artificial Sequence: Synthetic peptide
LGTRPMK

SEQ ID NO: 30721 - protein, 7 aa, Artificial Sequence
  Description of Artificial Sequence: Synthetic peptide
ERTPPRI

SEQ ID NO: 30722 - protein, 7 aa, Artificial Sequence
  Description of Artificial Sequence: Synthetic peptide
NSHQKPS

SEQ ID NO: 30723 - protein, 7 aa, Artificial Sequence
  Description of Artificial Sequence: Synthetic peptide
QSGSKPG

SEQ ID NO: 30724 - protein, 7 aa, Artificial Sequence
  Description of Artificial Sequence: Synthetic peptide
GTARTTG

SEQ ID NO: 30725 - protein, 7 aa, Artificial Sequence
  Description of Artificial Sequence: Synthetic peptide
FLSSRAS

SEQ ID NO: 30726 - protein, 7 aa, Artificial Sequence
  Description of Artificial Sequence: Synthetic peptide
NNTQKNS

SEQ ID NO: 30727 - protein, 7 aa, Artificial Sequence
  Description of Artificial Sequence: Synthetic peptide
NDSGQNQ

SEQ ID NO: 30728 - protein, 7 aa, Artificial Sequence
  Description of Artificial Sequence: Synthetic peptide
DRSSRGV

SEQ ID NO: 30729 - protein, 7 aa, Artificial Sequence
  Description of Artificial Sequence: Synthetic peptide
NIPSPRL

SEQ ID NO: 30730 - protein, 7 aa, Artificial Sequence
  Description of Artificial Sequence: Synthetic peptide
PGLSNSR

SEQ ID NO: 30731 - protein, 7 aa, Artificial Sequence
  Description of Artificial Sequence: Synthetic peptide
MVSGKSY

SEQ ID NO: 30732 - protein, 7 aa, Artificial Sequence
  Description of Artificial Sequence: Synthetic peptide
NSGRNSV

SEQ ID NO: 30733 - protein, 7 aa, Artificial Sequence
  Description of Artificial Sequence: Synthetic peptide
WMSGKNS

SEQ ID NO: 30734 - protein, 7 aa, Artificial Sequence
  Description of Artificial Sequence: Synthetic peptide
IRSTKAQ

SEQ ID NO: 30735 - protein, 7 aa, Artificial Sequence
  Description of Artificial Sequence: Synthetic peptide
EVFSSQK

SEQ ID NO: 30736 - protein, 7 aa, Artificial Sequence
  Description of Artificial Sequence: Synthetic peptide
SFTKGAG

SEQ ID NO: 30737 - protein, 7 aa, Artificial Sequence
  Description of Artificial Sequence: Synthetic peptide
TGMRPPG

SEQ ID NO: 30738 - protein, 7 aa, Artificial Sequence
  Description of Artificial Sequence: Synthetic peptide
NNSKSQI

SEQ ID NO: 30739 - protein, 7 aa, Artificial Sequence
  Description of Artificial Sequence: Synthetic peptide
PKLSHTG

SEQ ID NO: 30740 - protein, 7 aa, Artificial Sequence
  Description of Artificial Sequence: Synthetic peptide
QGHTRFT

SEQ ID NO: 30741 - protein, 7 aa, Artificial Sequence
  Description of Artificial Sequence: Synthetic peptide
QPSQGHS

SEQ ID NO: 30742 - protein, 7 aa, Artificial Sequence
  Description of Artificial Sequence: Synthetic peptide
DRIRTGH

SEQ ID NO: 30743 - protein, 7 aa, Artificial Sequence
  Description of Artificial Sequence: Synthetic peptide
AYSNIQN

SEQ ID NO: 30744 - protein, 7 aa, Artificial Sequence
  Description of Artificial Sequence: Synthetic peptide
IGLNRTG

SEQ ID NO: 30745 - protein, 7 aa, Artificial Sequence
  Description of Artificial Sequence: Synthetic peptide
VSGRPTG

SEQ ID NO: 30746 - protein, 7 aa, Artificial Sequence
  Description of Artificial Sequence: Synthetic peptide
YTITPQK

SEQ ID NO: 30747 - protein, 7 aa, Artificial Sequence
  Description of Artificial Sequence: Synthetic peptide
ETTTPRK

SEQ ID NO: 30748 - protein, 7 aa, Artificial Sequence
  Description of Artificial Sequence: Synthetic peptide
SQSSRSG

SEQ ID NO: 30749 - protein, 7 aa, Artificial Sequence
  Description of Artificial Sequence: Synthetic peptide
YGLHNAR

SEQ ID NO: 30750 - protein, 7 aa, Artificial Sequence
  Description of Artificial Sequence: Synthetic peptide
KNAPQQA

SEQ ID NO: 30751 - protein, 7 aa, Artificial Sequence
  Description of Artificial Sequence: Synthetic peptide
NGSGQNK

SEQ ID NO: 30752 - protein, 7 aa, Artificial Sequence
  Description of Artificial Sequence: Synthetic peptide
STDRSFN

SEQ ID NO: 30753 - protein, 7 aa, Artificial Sequence
  Description of Artificial Sequence: Synthetic peptide
FSASGAR

SEQ ID NO: 30754 - protein, 7 aa, Artificial Sequence
  Description of Artificial Sequence: Synthetic peptide
LYSGSQE

SEQ ID NO: 30755 - protein, 7 aa, Artificial Sequence
  Description of Artificial Sequence: Synthetic peptide
NSHTPVR

SEQ ID NO: 30756 - protein, 7 aa, Artificial Sequence
  Description of Artificial Sequence: Synthetic peptide
KRDAHTA

SEQ ID NO: 30757 - protein, 7 aa, Artificial Sequence
  Description of Artificial Sequence: Synthetic peptide
HGSKPYI

SEQ ID NO: 30758 - protein, 7 aa, Artificial Sequence
  Description of Artificial Sequence: Synthetic peptide
NPGKGSS

SEQ ID NO: 30759 - protein, 7 aa, Artificial Sequence
  Description of Artificial Sequence: Synthetic peptide
SFSKGSS

SEQ ID NO: 30760 - protein, 7 aa, Artificial Sequence
  Description of Artificial Sequence: Synthetic peptide
NSGTHFK

SEQ ID NO: 30761 - protein, 7 aa, Artificial Sequence
  Description of Artificial Sequence: Synthetic peptide
SSMSHQK

SEQ ID NO: 30762 - protein, 7 aa, Artificial Sequence
  Description of Artificial Sequence: Synthetic peptide
SIGKGYN

SEQ ID NO: 30763 - protein, 7 aa, Artificial Sequence
  Description of Artificial Sequence: Synthetic peptide
QSSIHTK

SEQ ID NO: 30764 - protein, 7 aa, Artificial Sequence
  Description of Artificial Sequence: Synthetic peptide
SFSGANK

SEQ ID NO: 30765 - protein, 7 aa, Artificial Sequence
  Description of Artificial Sequence: Synthetic peptide
GQTLPIC

SEQ ID NO: 30766 - protein, 7 aa, Artificial Sequence
  Description of Artificial Sequence: Synthetic peptide
ALLNINT

SEQ ID NO: 30767 - protein, 7 aa, Artificial Sequence
  Description of Artificial Sequence: Synthetic peptide
MLQRAPG

SEQ ID NO: 30768 - protein, 7 aa, Artificial Sequence
  Description of Artificial Sequence: Synthetic peptide
GTGHQRS

SEQ ID NO: 30769 - protein, 7 aa, Artificial Sequence
  Description of Artificial Sequence: Synthetic peptide
SLTPMGR

SEQ ID NO: 30770 - protein, 7 aa, Artificial Sequence
  Description of Artificial Sequence: Synthetic peptide
LVASGQK

SEQ ID NO: 30771 - protein, 7 aa, Artificial Sequence
  Description of Artificial Sequence: Synthetic peptide
PRTRENQ

SEQ ID NO: 30772 - protein, 7 aa, Artificial Sequence
  Description of Artificial Sequence: Synthetic peptide
NISSKVA

SEQ ID NO: 30773 - protein, 7 aa, Artificial Sequence
  Description of Artificial Sequence: Synthetic peptide
LQRAPQT

SEQ ID NO: 30774 - protein, 7 aa, Artificial Sequence
  Description of Artificial Sequence: Synthetic peptide
SISKTQA

SEQ ID NO: 30775 - protein, 7 aa, Artificial Sequence
  Description of Artificial Sequence: Synthetic peptide
VTGQNQT

SEQ ID NO: 30776 - protein, 7 aa, Artificial Sequence
  Description of Artificial Sequence: Synthetic peptide
FLTGRQS

SEQ ID NO: 30777 - protein, 7 aa, Artificial Sequence
  Description of Artificial Sequence: Synthetic peptide
TMRATPP

SEQ ID NO: 30778 - protein, 7 aa, Artificial Sequence
  Description of Artificial Sequence: Synthetic peptide
NNLPRNL

SEQ ID NO: 30779 - protein, 7 aa, Artificial Sequence
  Description of Artificial Sequence: Synthetic peptide
TSERPTC

SEQ ID NO: 30780 - protein, 7 aa, Artificial Sequence
  Description of Artificial Sequence: Synthetic peptide
LPTGKML

SEQ ID NO: 30781 - protein, 7 aa, Artificial Sequence
  Description of Artificial Sequence: Synthetic peptide
YKPGLQS

SEQ ID NO: 30782 - protein, 7 aa, Artificial Sequence
  Description of Artificial Sequence: Synthetic peptide
GRLEAQK

SEQ ID NO: 30783 - protein, 7 aa, Artificial Sequence
  Description of Artificial Sequence: Synthetic peptide
VHVTSQT

SEQ ID NO: 30784 - protein, 7 aa, Artificial Sequence
  Description of Artificial Sequence: Synthetic peptide
RSPSTNP

SEQ ID NO: 30785 - protein, 7 aa, Artificial Sequence
  Description of Artificial Sequence: Synthetic peptide
FMGRPNV

SEQ ID NO: 30786 - protein, 7 aa, Artificial Sequence
  Description of Artificial Sequence: Synthetic peptide
QGPKNAD

SEQ ID NO: 30787 - protein, 7 aa, Artificial Sequence
  Description of Artificial Sequence: Synthetic peptide
SPVKGSV

SEQ ID NO: 30788 - protein, 7 aa, Artificial Sequence
  Description of Artificial Sequence: Synthetic peptide
HPSNKPL

SEQ ID NO: 30789 - protein, 7 aa, Artificial Sequence
  Description of Artificial Sequence: Synthetic peptide
EPVPKTR

SEQ ID NO: 30790 - protein, 7 aa, Artificial Sequence
  Description of Artificial Sequence: Synthetic peptide
HNSKSQI

SEQ ID NO: 30791 - protein, 7 aa, Artificial Sequence
  Description of Artificial Sequence: Synthetic peptide
FSSKTSP

SEQ ID NO: 30792 - protein, 7 aa, Artificial Sequence
  Description of Artificial Sequence: Synthetic peptide
PNRVPNH

SEQ ID NO: 30793 - protein, 7 aa, Artificial Sequence
  Description of Artificial Sequence: Synthetic peptide
YSDNKTT

SEQ ID NO: 30794 - protein, 7 aa, Artificial Sequence
  Description of Artificial Sequence: Synthetic peptide
SPTRPMN

SEQ ID NO: 30795 - protein, 7 aa, Artificial Sequence
  Description of Artificial Sequence: Synthetic peptide
FSGKPSR

SEQ ID NO: 30796 - protein, 7 aa, Artificial Sequence
  Description of Artificial Sequence: Synthetic peptide
PSAGREK

SEQ ID NO: 30797 - protein, 7 aa, Artificial Sequence
  Description of Artificial Sequence: Synthetic peptide
PGREKTV

SEQ ID NO: 30798 - protein, 7 aa, Artificial Sequence
  Description of Artificial Sequence: Synthetic peptide
LQQHNTK

SEQ ID NO: 30799 - protein, 7 aa, Artificial Sequence
  Description of Artificial Sequence: Synthetic peptide
MTQHKQA

SEQ ID NO: 30800 - protein, 7 aa, Artificial Sequence
  Description of Artificial Sequence: Synthetic peptide
YSMRPTE

SEQ ID NO: 30801 - protein, 7 aa, Artificial Sequence
  Description of Artificial Sequence: Synthetic peptide
KGFKTES

SEQ ID NO: 30802 - protein, 7 aa, Artificial Sequence
  Description of Artificial Sequence: Synthetic peptide
NRESPQR

SEQ ID NO: 30803 - protein, 7 aa, Artificial Sequence
  Description of Artificial Sequence: Synthetic peptide
NLGNSLK

SEQ ID NO: 30804 - protein, 7 aa, Artificial Sequence
  Description of Artificial Sequence: Synthetic peptide
QNLPKAS

SEQ ID NO: 30805 - protein, 7 aa, Artificial Sequence
  Description of Artificial Sequence: Synthetic peptide
TQNTKSI

SEQ ID NO: 30806 - protein, 7 aa, Artificial Sequence
  Description of Artificial Sequence: Synthetic peptide
LGPGKNT

SEQ ID NO: 30807 - protein, 7 aa, Artificial Sequence
  Description of Artificial Sequence: Synthetic peptide
QVSAKSA

SEQ ID NO: 30808 - protein, 7 aa, Artificial Sequence
  Description of Artificial Sequence: Synthetic peptide
LNGTPQS

SEQ ID NO: 30809 - protein, 7 aa, Artificial Sequence
  Description of Artificial Sequence: Synthetic peptide
LGTSPMK

SEQ ID NO: 30810 - protein, 7 aa, Artificial Sequence
  Description of Artificial Sequence: Synthetic peptide
TRGSPLM

SEQ ID NO: 30811 - protein, 7 aa, Artificial Sequence
  Description of Artificial Sequence: Synthetic peptide
SSGGNMS

SEQ ID NO: 30812 - protein, 7 aa, Artificial Sequence
  Description of Artificial Sequence: Synthetic peptide
PGTGSNH

SEQ ID NO: 30813 - protein, 7 aa, Artificial Sequence
  Description of Artificial Sequence: Synthetic peptide
QNTPKST

SEQ ID NO: 30814 - protein, 7 aa, Artificial Sequence
  Description of Artificial Sequence: Synthetic peptide
FNMQRSQ

SEQ ID NO: 30815 - protein, 7 aa, Artificial Sequence
  Description of Artificial Sequence: Synthetic peptide
SNLPRNL

SEQ ID NO: 30816 - protein, 7 aa, Artificial Sequence
  Description of Artificial Sequence: Synthetic peptide
SSGKSFS

SEQ ID NO: 30817 - protein, 7 aa, Artificial Sequence
  Description of Artificial Sequence: Synthetic peptide
NGSRQNQ

SEQ ID NO: 30818 - protein, 7 aa, Artificial Sequence
  Description of Artificial Sequence: Synthetic peptide
PTSSPQR

SEQ ID NO: 30819 - protein, 7 aa, Artificial Sequence
  Description of Artificial Sequence: Synthetic peptide
SFDSKPP

SEQ ID NO: 30820 - protein, 7 aa, Artificial Sequence
  Description of Artificial Sequence: Synthetic peptide
QTSATQR

SEQ ID NO: 30821 - protein, 7 aa, Artificial Sequence
  Description of Artificial Sequence: Synthetic peptide
PSNKTNS

SEQ ID NO: 30822 - protein, 7 aa, Artificial Sequence
  Description of Artificial Sequence: Synthetic peptide
TPQNSVK

SEQ ID NO: 30823 - protein, 7 aa, Artificial Sequence
  Description of Artificial Sequence: Synthetic peptide
SHTGNMV

SEQ ID NO: 30824 - protein, 7 aa, Artificial Sequence
  Description of Artificial Sequence: Synthetic peptide
NPSEKML

SEQ ID NO: 30825 - protein, 7 aa, Artificial Sequence
  Description of Artificial Sequence: Synthetic peptide
LGTSQMK

SEQ ID NO: 30826 - protein, 7 aa, Artificial Sequence
  Description of Artificial Sequence: Synthetic peptide
GLQTPPR

SEQ ID NO: 30827 - protein, 7 aa, Artificial Sequence
  Description of Artificial Sequence: Synthetic peptide
QTGSNNK

SEQ ID NO: 30828 - protein, 7 aa, Artificial Sequence
  Description of Artificial Sequence: Synthetic peptide
TPITPMT

SEQ ID NO: 30829 - protein, 7 aa, Artificial Sequence
  Description of Artificial Sequence: Synthetic peptide
TFSKGTN

SEQ ID NO: 30830 - protein, 7 aa, Artificial Sequence
  Description of Artificial Sequence: Synthetic peptide
SHSSPYK

SEQ ID NO: 30831 - protein, 7 aa, Artificial Sequence
  Description of Artificial Sequence: Synthetic peptide
RSASGQL

SEQ ID NO: 30832 - protein, 7 aa, Artificial Sequence
  Description of Artificial Sequence: Synthetic peptide
YPRQRTE

SEQ ID NO: 30833 - protein, 7 aa, Artificial Sequence
  Description of Artificial Sequence: Synthetic peptide
YGQTKTQ

SEQ ID NO: 30834 - protein, 7 aa, Artificial Sequence
  Description of Artificial Sequence: Synthetic peptide
QISASTR

SEQ ID NO: 30835 - protein, 7 aa, Artificial Sequence
  Description of Artificial Sequence: Synthetic peptide
SYASTQQ

SEQ ID NO: 30836 - protein, 7 aa, Artificial Sequence
  Description of Artificial Sequence: Synthetic peptide
KGQNTIS

SEQ ID NO: 30837 - protein, 7 aa, Artificial Sequence
  Description of Artificial Sequence: Synthetic peptide
PTTGPQR

SEQ ID NO: 30838 - protein, 7 aa, Artificial Sequence
  Description of Artificial Sequence: Synthetic peptide
SNNGTQK

SEQ ID NO: 30839 - protein, 7 aa, Artificial Sequence
  Description of Artificial Sequence: Synthetic peptide
SRSGGQV

SEQ ID NO: 30840 - protein, 7 aa, Artificial Sequence
  Description of Artificial Sequence: Synthetic peptide
GNNRPAS

SEQ ID NO: 30841 - protein, 7 aa, Artificial Sequence
  Description of Artificial Sequence: Synthetic peptide
KNQAPLL

SEQ ID NO: 30842 - protein, 7 aa, Artificial Sequence
  Description of Artificial Sequence: Synthetic peptide
NGATKNS

SEQ ID NO: 30843 - protein, 7 aa, Artificial Sequence
  Description of Artificial Sequence: Synthetic peptide
GTQKQTS

SEQ ID NO: 30844 - protein, 7 aa, Artificial Sequence
  Description of Artificial Sequence: Synthetic peptide
KVDKRTD

SEQ ID NO: 30845 - protein, 7 aa, Artificial Sequence
  Description of Artificial Sequence: Synthetic peptide
SGVKAFS

SEQ ID NO: 30846 - protein, 7 aa, Artificial Sequence
  Description of Artificial Sequence: Synthetic peptide
YNKNAQL

SEQ ID NO: 30847 - protein, 7 aa, Artificial Sequence
  Description of Artificial Sequence: Synthetic peptide
TQRPAQM

SEQ ID NO: 30848 - protein, 7 aa, Artificial Sequence
  Description of Artificial Sequence: Synthetic peptide
QTQGQLK

SEQ ID NO: 30849 - protein, 7 aa, Artificial Sequence
  Description of Artificial Sequence: Synthetic peptide
SNSHKIY

SEQ ID NO: 30850 - protein, 7 aa, Artificial Sequence
  Description of Artificial Sequence: Synthetic peptide
ANGHPQS

SEQ ID NO: 30851 - protein, 7 aa, Artificial Sequence
  Description of Artificial Sequence: Synthetic peptide
RPVGGLA

SEQ ID NO: 30852 - protein, 7 aa, Artificial Sequence
  Description of Artificial Sequence: Synthetic peptide
PQSSHQT

SEQ ID NO: 30853 - protein, 7 aa, Artificial Sequence
  Description of Artificial Sequence: Synthetic peptide
TYNSSQA

SEQ ID NO: 30854 - protein, 7 aa, Artificial Sequence
  Description of Artificial Sequence: Synthetic peptide
SNQVRQI

SEQ ID NO: 30855 - protein, 7 aa, Artificial Sequence
  Description of Artificial Sequence: Synthetic peptide
SLTTKAN

SEQ ID NO: 30856 - protein, 7 aa, Artificial Sequence
  Description of Artificial Sequence: Synthetic peptide
SPGNKST

SEQ ID NO: 30857 - protein, 7 aa, Artificial Sequence
  Description of Artificial Sequence: Synthetic peptide
YGNPRQA

SEQ ID NO: 30858 - protein, 7 aa, Artificial Sequence
  Description of Artificial Sequence: Synthetic peptide
RRQDTQE

SEQ ID NO: 30859 - protein, 7 aa, Artificial Sequence
  Description of Artificial Sequence: Synthetic peptide
NNRSGMG

SEQ ID NO: 30860 - protein, 7 aa, Artificial Sequence
  Description of Artificial Sequence: Synthetic peptide
SFAKSAS

SEQ ID NO: 30861 - protein, 7 aa, Artificial Sequence
  Description of Artificial Sequence: Synthetic peptide
GQNRNNT

SEQ ID NO: 30862 - protein, 7 aa, Artificial Sequence
  Description of Artificial Sequence: Synthetic peptide
TPAGPNK

SEQ ID NO: 30863 - protein, 7 aa, Artificial Sequence
  Description of Artificial Sequence: Synthetic peptide
NISTRQS

SEQ ID NO: 30864 - protein, 7 aa, Artificial Sequence
  Description of Artificial Sequence: Synthetic peptide
YHLNSQS

SEQ ID NO: 30865 - protein, 7 aa, Artificial Sequence
  Description of Artificial Sequence: Synthetic peptide
SLSSKQM

SEQ ID NO: 30866 - protein, 7 aa, Artificial Sequence
  Description of Artificial Sequence: Synthetic peptide
NNGRPIA

SEQ ID NO: 30867 - protein, 7 aa, Artificial Sequence
  Description of Artificial Sequence: Synthetic peptide
NQKTRTD

SEQ ID NO: 30868 - protein, 7 aa, Artificial Sequence
  Description of Artificial Sequence: Synthetic peptide
TSQTKIV

SEQ ID NO: 30869 - protein, 7 aa, Artificial Sequence
  Description of Artificial Sequence: Synthetic peptide
VTPTKHP

SEQ ID NO: 30870 - protein, 7 aa, Artificial Sequence
  Description of Artificial Sequence: Synthetic peptide
PGQSTSK

SEQ ID NO: 30871 - protein, 7 aa, Artificial Sequence
  Description of Artificial Sequence: Synthetic peptide
KTSTPYS

SEQ ID NO: 30872 - protein, 7 aa, Artificial Sequence
  Description of Artificial Sequence: Synthetic peptide
SGGKSAL

SEQ ID NO: 30873 - protein, 7 aa, Artificial Sequence
  Description of Artificial Sequence: Synthetic peptide
NGTRQNQ

SEQ ID NO: 30874 - protein, 7 aa, Artificial Sequence
  Description of Artificial Sequence: Synthetic peptide
NGPGQNQ

SEQ ID NO: 30875 - protein, 7 aa, Artificial Sequence
  Description of Artificial Sequence: Synthetic peptide
ATNKTTN

SEQ ID NO: 30876 - protein, 7 aa, Artificial Sequence
  Description of Artificial Sequence: Synthetic peptide
TGMRNIG

SEQ ID NO: 30877 - protein, 7 aa, Artificial Sequence
  Description of Artificial Sequence: Synthetic peptide
PTTTAKP

SEQ ID NO: 30878 - protein, 7 aa, Artificial Sequence
  Description of Artificial Sequence: Synthetic peptide
FPTSPTR

SEQ ID NO: 30879 - protein, 7 aa, Artificial Sequence
  Description of Artificial Sequence: Synthetic peptide
PYNSKAS

SEQ ID NO: 30880 - protein, 7 aa, Artificial Sequence
  Description of Artificial Sequence: Synthetic peptide
GLQSKQL

SEQ ID NO: 30881 - protein, 7 aa, Artificial Sequence
  Description of Artificial Sequence: Synthetic peptide
ASLKTQM

SEQ ID NO: 30882 - protein, 7 aa, Artificial Sequence
  Description of Artificial Sequence: Synthetic peptide
SPGRTQS

SEQ ID NO: 30883 - protein, 7 aa, Artificial Sequence
  Description of Artificial Sequence: Synthetic peptide
ELMNKSK

SEQ ID NO: 30884 - protein, 7 aa, Artificial Sequence
  Description of Artificial Sequence: Synthetic peptide
IGNKQSQ

SEQ ID NO: 30885 - protein, 7 aa, Artificial Sequence
  Description of Artificial Sequence: Synthetic peptide
PGQKQGI

SEQ ID NO: 30886 - protein, 7 aa, Artificial Sequence
  Description of Artificial Sequence: Synthetic peptide
EPTHPRG

SEQ ID NO: 30887 - protein, 7 aa, Artificial Sequence
  Description of Artificial Sequence: Synthetic peptide
FRAQANV

SEQ ID NO: 30888 - protein, 7 aa, Artificial Sequence
  Description of Artificial Sequence: Synthetic peptide
PTHERAK

SEQ ID NO: 30889 - protein, 7 aa, Artificial Sequence
  Description of Artificial Sequence: Synthetic peptide
PGSSNRN

SEQ ID NO: 30890 - protein, 7 aa, Artificial Sequence
  Description of Artificial Sequence: Synthetic peptide
VPLQKPS

SEQ ID NO: 30891 - protein, 7 aa, Artificial Sequence
  Description of Artificial Sequence: Synthetic peptide
FTSNKAS

SEQ ID NO: 30892 - protein, 7 aa, Artificial Sequence
  Description of Artificial Sequence: Synthetic peptide
ENSSKAK

SEQ ID NO: 30893 - protein, 7 aa, Artificial Sequence
  Description of Artificial Sequence: Synthetic peptide
SGAGSAG

SEQ ID NO: 30894 - protein, 7 aa, Artificial Sequence
  Description of Artificial Sequence: Synthetic peptide
GLAKDQR

SEQ ID NO: 30895 - protein, 7 aa, Artificial Sequence
  Description of Artificial Sequence: Synthetic peptide
TPHDGQR

SEQ ID NO: 30896 - protein, 7 aa, Artificial Sequence
  Description of Artificial Sequence: Synthetic peptide
CIGNKTN

SEQ ID NO: 30897 - protein, 7 aa, Artificial Sequence
  Description of Artificial Sequence: Synthetic peptide
YIKSVTN

SEQ ID NO: 30898 - protein, 7 aa, Artificial Sequence
  Description of Artificial Sequence: Synthetic peptide
TSSGHSV

SEQ ID NO: 30899 - protein, 7 aa, Artificial Sequence
  Description of Artificial Sequence: Synthetic peptide
NSFSRNS

SEQ ID NO: 30900 - protein, 7 aa, Artificial Sequence
  Description of Artificial Sequence: Synthetic peptide
SDSRNTN

SEQ ID NO: 30901 - protein, 7 aa, Artificial Sequence
  Description of Artificial Sequence: Synthetic peptide
NTQSYTR

SEQ ID NO: 30902 - protein, 7 aa, Artificial Sequence
  Description of Artificial Sequence: Synthetic peptide
SRNSPPQ

SEQ ID NO: 30903 - protein, 7 aa, Artificial Sequence
  Description of Artificial Sequence: Synthetic peptide
TISTSQS

SEQ ID NO: 30904 - protein, 7 aa, Artificial Sequence
  Description of Artificial Sequence: Synthetic peptide
NGFNSNN

SEQ ID NO: 30905 - protein, 7 aa, Artificial Sequence
  Description of Artificial Sequence: Synthetic peptide
FTKLASP

SEQ ID NO: 30906 - protein, 7 aa, Artificial Sequence
  Description of Artificial Sequence: Synthetic peptide
WRLSRQQ

SEQ ID NO: 30907 - protein, 7 aa, Artificial Sequence
  Description of Artificial Sequence: Synthetic peptide
QTSHSAK

SEQ ID NO: 30908 - protein, 7 aa, Artificial Sequence
  Description of Artificial Sequence: Synthetic peptide
PYAGNQR

SEQ ID NO: 30909 - protein, 7 aa, Artificial Sequence
  Description of Artificial Sequence: Synthetic peptide
GSGNKVN

SEQ ID NO: 30910 - protein, 7 aa, Artificial Sequence
  Description of Artificial Sequence: Synthetic peptide
NSGKPNA

SEQ ID NO: 30911 - protein, 7 aa, Artificial Sequence
  Description of Artificial Sequence: Synthetic peptide
PGSVTGS

SEQ ID NO: 30912 - protein, 7 aa, Artificial Sequence
  Description of Artificial Sequence: Synthetic peptide
NGITKSS

SEQ ID NO: 30913 - protein, 7 aa, Artificial Sequence
  Description of Artificial Sequence: Synthetic peptide
QGSGSNH

SEQ ID NO: 30914 - protein, 7 aa, Artificial Sequence
  Description of Artificial Sequence: Synthetic peptide
GPIRPIQ

SEQ ID NO: 30915 - protein, 7 aa, Artificial Sequence
  Description of Artificial Sequence: Synthetic peptide
FASRPVQ

SEQ ID NO: 30916 - protein, 7 aa, Artificial Sequence
  Description of Artificial Sequence: Synthetic peptide
SNETKSS

SEQ ID NO: 30917 - protein, 7 aa, Artificial Sequence
  Description of Artificial Sequence: Synthetic peptide
IPANSFK

SEQ ID NO: 30918 - protein, 7 aa, Artificial Sequence
  Description of Artificial Sequence: Synthetic peptide
AQTKGTQ

SEQ ID NO: 30919 - protein, 7 aa, Artificial Sequence
  Description of Artificial Sequence: Synthetic peptide
TSMNGNK

SEQ ID NO: 30920 - protein, 7 aa, Artificial Sequence
  Description of Artificial Sequence: Synthetic peptide
SQVSKPQ

SEQ ID NO: 30921 - protein, 7 aa, Artificial Sequence
  Description of Artificial Sequence: Synthetic peptide
PNTKPVL

SEQ ID NO: 30922 - protein, 7 aa, Artificial Sequence
  Description of Artificial Sequence: Synthetic peptide
TPHQRSS

SEQ ID NO: 30923 - protein, 7 aa, Artificial Sequence
  Description of Artificial Sequence: Synthetic peptide
NQSRPGV

SEQ ID NO: 30924 - protein, 7 aa, Artificial Sequence
  Description of Artificial Sequence: Synthetic peptide
NNSKSQI

SEQ ID NO: 30925 - protein, 7 aa, Artificial Sequence
  Description of Artificial Sequence: Synthetic peptide
AMSEHLK

SEQ ID NO: 30926 - protein, 7 aa, Artificial Sequence
  Description of Artificial Sequence: Synthetic peptide
LILPGNN

SEQ ID NO: 30927 - protein, 7 aa, Artificial Sequence
  Description of Artificial Sequence: Synthetic peptide
GVSEHRK

SEQ ID NO: 30928 - protein, 7 aa, Artificial Sequence
  Description of Artificial Sequence: Synthetic peptide
HSENGNR

SEQ ID NO: 30929 - protein, 7 aa, Artificial Sequence
  Description of Artificial Sequence: Synthetic peptide
DLQTSAK

SEQ ID NO: 30930 - protein, 7 aa, Artificial Sequence
  Description of Artificial Sequence: Synthetic peptide
RSLPNVA

SEQ ID NO: 30931 - protein, 7 aa, Artificial Sequence
  Description of Artificial Sequence: Synthetic peptide
YSDNKTT

SEQ ID NO: 30932 - protein, 7 aa, Artificial Sequence
  Description of Artificial Sequence: Synthetic peptide
SHNRTND

SEQ ID NO: 30933 - protein, 7 aa, Artificial Sequence
  Description of Artificial Sequence: Synthetic peptide
VSNKSVL

SEQ ID NO: 30934 - protein, 7 aa, Artificial Sequence
  Description of Artificial Sequence: Synthetic peptide
RDHSGSR

SEQ ID NO: 30935 - protein, 7 aa, Artificial Sequence
  Description of Artificial Sequence: Synthetic peptide
NANQNQM

SEQ ID NO: 30936 - protein, 7 aa, Artificial Sequence
  Description of Artificial Sequence: Synthetic peptide
THQSSTS

SEQ ID NO: 30937 - protein, 7 aa, Artificial Sequence
  Description of Artificial Sequence: Synthetic peptide
TLPRVPA

SEQ ID NO: 30938 - protein, 7 aa, Artificial Sequence
  Description of Artificial Sequence: Synthetic peptide
SYSSSQL

SEQ ID NO: 30939 - protein, 7 aa, Artificial Sequence
  Description of Artificial Sequence: Synthetic peptide
PKVRDGY

SEQ ID NO: 30940 - protein, 7 aa, Artificial Sequence
  Description of Artificial Sequence: Synthetic peptide
YGQTKTQ

SEQ ID NO: 30941 - protein, 7 aa, Artificial Sequence
  Description of Artificial Sequence: Synthetic peptide
SASPSIK

SEQ ID NO: 30942 - protein, 7 aa, Artificial Sequence
  Description of Artificial Sequence: Synthetic peptide
RSTVSPN

SEQ ID NO: 30943 - protein, 7 aa, Artificial Sequence
  Description of Artificial Sequence: Synthetic peptide
VQRSSNQ

SEQ ID NO: 30944 - protein, 7 aa, Artificial Sequence
  Description of Artificial Sequence: Synthetic peptide
NGCGQNQ

SEQ ID NO: 30945 - protein, 7 aa, Artificial Sequence
  Description of Artificial Sequence: Synthetic peptide
SNMTSTR

SEQ ID NO: 30946 - protein, 7 aa, Artificial Sequence
  Description of Artificial Sequence: Synthetic peptide
PPNLKLS

SEQ ID NO: 30947 - protein, 7 aa, Artificial Sequence
  Description of Artificial Sequence: Synthetic peptide
DSIGSSK

SEQ ID NO: 30948 - protein, 7 aa, Artificial Sequence
  Description of Artificial Sequence: Synthetic peptide
MLGSSNK

SEQ ID NO: 30949 - protein, 7 aa, Artificial Sequence
  Description of Artificial Sequence: Synthetic peptide
DNMSTPK

SEQ ID NO: 30950 - protein, 7 aa, Artificial Sequence
  Description of Artificial Sequence: Synthetic peptide
LGSSTIL

SEQ ID NO: 30951 - protein, 7 aa, Artificial Sequence
  Description of Artificial Sequence: Synthetic peptide
SSMSHQK

SEQ ID NO: 30952 - protein, 7 aa, Artificial Sequence
  Description of Artificial Sequence: Synthetic peptide
KQPASTH

SEQ ID NO: 30953 - protein, 7 aa, Artificial Sequence
  Description of Artificial Sequence: Synthetic peptide
ALTGKLS

SEQ ID NO: 30954 - protein, 7 aa, Artificial Sequence
  Description of Artificial Sequence: Synthetic peptide
GSGHGTN

SEQ ID NO: 30955 - protein, 7 aa, Artificial Sequence
  Description of Artificial Sequence: Synthetic peptide
PTGVNKM

SEQ ID NO: 30956 - protein, 7 aa, Artificial Sequence
  Description of Artificial Sequence: Synthetic peptide
TSSGGLT

SEQ ID NO: 30957 - protein, 7 aa, Artificial Sequence
  Description of Artificial Sequence: Synthetic peptide
NSRSHHE

SEQ ID NO: 30958 - protein, 7 aa, Artificial Sequence
  Description of Artificial Sequence: Synthetic peptide
MGGVTSS

SEQ ID NO: 30959 - protein, 7 aa, Artificial Sequence
  Description of Artificial Sequence: Synthetic peptide
GYRGNGN

SEQ ID NO: 30960 - protein, 7 aa, Artificial Sequence
  Description of Artificial Sequence: Synthetic peptide
TGTGSFH

SEQ ID NO: 30961 - protein, 7 aa, Artificial Sequence
  Description of Artificial Sequence: Synthetic peptide
TGLSHMG

SEQ ID NO: 30962 - protein, 7 aa, Artificial Sequence
  Description of Artificial Sequence: Synthetic peptide
LRSKESA

SEQ ID NO: 30963 - protein, 7 aa, Artificial Sequence
  Description of Artificial Sequence: Synthetic peptide
PTHASSL

SEQ ID NO: 30964 - protein, 7 aa, Artificial Sequence
  Description of Artificial Sequence: Synthetic peptide
KIASKSE

SEQ ID NO: 30965 - protein, 7 aa, Artificial Sequence
  Description of Artificial Sequence: Synthetic peptide
NVSTGAT

SEQ ID NO: 30966 - protein, 7 aa, Artificial Sequence
  Description of Artificial Sequence: Synthetic peptide
NRSGQNQ

SEQ ID NO: 30967 - protein, 7 aa, Artificial Sequence
  Description of Artificial Sequence: Synthetic peptide
SPTSPMN

SEQ ID NO: 30968 - protein, 7 aa, Artificial Sequence
  Description of Artificial Sequence: Synthetic peptide
YNQPVGK

SEQ ID NO: 30969 - protein, 7 aa, Artificial Sequence
  Description of Artificial Sequence: Synthetic peptide
ATMRSNE

SEQ ID NO: 30970 - protein, 7 aa, Artificial Sequence
  Description of Artificial Sequence: Synthetic peptide
KNPSSAP

SEQ ID NO: 30971 - protein, 7 aa, Artificial Sequence
  Description of Artificial Sequence: Synthetic peptide
NNLAGSK

SEQ ID NO: 30972 - protein, 7 aa, Artificial Sequence
  Description of Artificial Sequence: Synthetic peptide
SDSRSGM

SEQ ID NO: 30973 - protein, 7 aa, Artificial Sequence
  Description of Artificial Sequence: Synthetic peptide
PSNKTNS

SEQ ID NO: 30974 - protein, 7 aa, Artificial Sequence
  Description of Artificial Sequence: Synthetic peptide
AQARMMN

SEQ ID NO: 30975 - protein, 7 aa, Artificial Sequence
  Description of Artificial Sequence: Synthetic peptide
QKTNKLY

SEQ ID NO: 30976 - protein, 7 aa, Artificial Sequence
  Description of Artificial Sequence: Synthetic peptide
VTRGLNV

SEQ ID NO: 30977 - protein, 7 aa, Artificial Sequence
  Description of Artificial Sequence: Synthetic peptide
GRLTSSI

SEQ ID NO: 30978 - protein, 7 aa, Artificial Sequence
  Description of Artificial Sequence: Synthetic peptide
YNVNRNT

SEQ ID NO: 30979 - protein, 7 aa, Artificial Sequence
  Description of Artificial Sequence: Synthetic peptide
PAAHNAV

SEQ ID NO: 30980 - protein, 7 aa, Artificial Sequence
  Description of Artificial Sequence: Synthetic peptide
VSTKSAP

SEQ ID NO: 30981 - protein, 7 aa, Artificial Sequence
  Description of Artificial Sequence: Synthetic peptide
TAGQASV

SEQ ID NO: 30982 - protein, 7 aa, Artificial Sequence
  Description of Artificial Sequence: Synthetic peptide
NISTRQS

SEQ ID NO: 30983 - protein, 7 aa, Artificial Sequence
  Description of Artificial Sequence: Synthetic peptide
SSSGGVK

SEQ ID NO: 30984 - protein, 7 aa, Artificial Sequence
  Description of Artificial Sequence: Synthetic peptide
NSYDPKR

SEQ ID NO: 30985 - protein, 7 aa, Artificial Sequence
  Description of Artificial Sequence: Synthetic peptide
LVRQSSA

SEQ ID NO: 30986 - protein, 7 aa, Artificial Sequence
  Description of Artificial Sequence: Synthetic peptide
NVNSQML

SEQ ID NO: 30987 - protein, 7 aa, Artificial Sequence
  Description of Artificial Sequence: Synthetic peptide
PGDRGKV

SEQ ID NO: 30988 - protein, 7 aa, Artificial Sequence
  Description of Artificial Sequence: Synthetic peptide
PSTSGAM

SEQ ID NO: 30989 - protein, 7 aa, Artificial Sequence
  Description of Artificial Sequence: Synthetic peptide
SRLEKSN

SEQ ID NO: 30990 - protein, 7 aa, Artificial Sequence
  Description of Artificial Sequence: Synthetic peptide
DTNNRAN

SEQ ID NO: 30991 - protein, 7 aa, Artificial Sequence
  Description of Artificial Sequence: Synthetic peptide
ASTPNNT

SEQ ID NO: 30992 - protein, 7 aa, Artificial Sequence
  Description of Artificial Sequence: Synthetic peptide
IGTSINS

SEQ ID NO: 30993 - protein, 7 aa, Artificial Sequence
  Description of Artificial Sequence: Synthetic peptide
VSTRSIS

SEQ ID NO: 30994 - protein, 7 aa, Artificial Sequence
  Description of Artificial Sequence: Synthetic peptide
PLPKNSS

SEQ ID NO: 30995 - protein, 7 aa, Artificial Sequence
  Description of Artificial Sequence: Synthetic peptide
VSGQGNS

SEQ ID NO: 30996 - protein, 7 aa, Artificial Sequence
  Description of Artificial Sequence: Synthetic peptide
QVSAKSA

SEQ ID NO: 30997 - protein, 7 aa, Artificial Sequence
  Description of Artificial Sequence: Synthetic peptide
PTLGTTK

SEQ ID NO: 30998 - protein, 7 aa, Artificial Sequence
  Description of Artificial Sequence: Synthetic peptide
LHDGQTR

SEQ ID NO: 30999 - protein, 7 aa, Artificial Sequence
  Description of Artificial Sequence: Synthetic peptide
GIAGVTR

SEQ ID NO: 31000 - protein, 7 aa, Artificial Sequence
  Description of Artificial Sequence: Synthetic peptide
QRTSDQT

SEQ ID NO: 31001 - protein, 7 aa, Artificial Sequence
  Description of Artificial Sequence: Synthetic peptide
SQVSKPQ

SEQ ID NO: 31002 - protein, 7 aa, Artificial Sequence
  Description of Artificial Sequence: Synthetic peptide
PILDRKS

SEQ ID NO: 31003 - protein, 7 aa, Artificial Sequence
  Description of Artificial Sequence: Synthetic peptide
HPSNKPL

SEQ ID NO: 31004 - protein, 7 aa, Artificial Sequence
  Description of Artificial Sequence: Synthetic peptide
SSSAKSI

SEQ ID NO: 31005 - protein, 7 aa, Artificial Sequence
  Description of Artificial Sequence: Synthetic peptide
TGIGSHL

SEQ ID NO: 31006 - protein, 7 aa, Artificial Sequence
  Description of Artificial Sequence: Synthetic peptide
DPVRKTS

SEQ ID NO: 31007 - protein, 7 aa, Artificial Sequence
  Description of Artificial Sequence: Synthetic peptide
DPQVRAL

SEQ ID NO: 31008 - protein, 7 aa, Artificial Sequence
  Description of Artificial Sequence: Synthetic peptide
SGSLSSA

SEQ ID NO: 31009 - protein, 7 aa, Artificial Sequence
  Description of Artificial Sequence: Synthetic peptide
GHLSPSS

SEQ ID NO: 31010 - protein, 7 aa, Artificial Sequence
  Description of Artificial Sequence: Synthetic peptide
RNDTKLF

SEQ ID NO: 31011 - protein, 7 aa, Artificial Sequence
  Description of Artificial Sequence: Synthetic peptide
YQNKSLT

SEQ ID NO: 31012 - protein, 7 aa, Artificial Sequence
  Description of Artificial Sequence: Synthetic peptide
GYTDKHV

SEQ ID NO: 31013 - protein, 7 aa, Artificial Sequence
  Description of Artificial Sequence: Synthetic peptide
PGGKSQL

SEQ ID NO: 31014 - protein, 7 aa, Artificial Sequence
  Description of Artificial Sequence: Synthetic peptide
RSASGQL

SEQ ID NO: 31015 - protein, 7 aa, Artificial Sequence
  Description of Artificial Sequence: Synthetic peptide
GSHNDSR

SEQ ID NO: 31016 - protein, 7 aa, Artificial Sequence
  Description of Artificial Sequence: Synthetic peptide
NGSGQKQ

SEQ ID NO: 31017 - protein, 7 aa, Artificial Sequence
  Description of Artificial Sequence: Synthetic peptide
YAMERVG

SEQ ID NO: 31018 - protein, 7 aa, Artificial Sequence
  Description of Artificial Sequence: Synthetic peptide
GLHSVAK

SEQ ID NO: 31019 - protein, 7 aa, Artificial Sequence
  Description of Artificial Sequence: Synthetic peptide
SVHQNRA

SEQ ID NO: 31020 - protein, 7 aa, Artificial Sequence
  Description of Artificial Sequence: Synthetic peptide
LGPGKNT

SEQ ID NO: 31021 - protein, 7 aa, Artificial Sequence
  Description of Artificial Sequence: Synthetic peptide
ERKVQNC

SEQ ID NO: 31022 - protein, 7 aa, Artificial Sequence
  Description of Artificial Sequence: Synthetic peptide
PTKGANA

SEQ ID NO: 31023 - protein, 7 aa, Artificial Sequence
  Description of Artificial Sequence: Synthetic peptide
GNRSSGL

SEQ ID NO: 31024 - protein, 7 aa, Artificial Sequence
  Description of Artificial Sequence: Synthetic peptide
VQQSKAY

SEQ ID NO: 31025 - protein, 7 aa, Artificial Sequence
  Description of Artificial Sequence: Synthetic peptide
GQERTNM

SEQ ID NO: 31026 - protein, 7 aa, Artificial Sequence
  Description of Artificial Sequence: Synthetic peptide
ATANTHM

SEQ ID NO: 31027 - protein, 7 aa, Artificial Sequence
  Description of Artificial Sequence: Synthetic peptide
VNTTRAE

SEQ ID NO: 31028 - protein, 7 aa, Artificial Sequence
  Description of Artificial Sequence: Synthetic peptide
TQQHGSN

SEQ ID NO: 31029 - protein, 7 aa, Artificial Sequence
  Description of Artificial Sequence: Synthetic peptide
LNLKPIN

SEQ ID NO: 31030 - protein, 7 aa, Artificial Sequence
  Description of Artificial Sequence: Synthetic peptide
GVSATVK

SEQ ID NO: 31031 - protein, 7 aa, Artificial Sequence
  Description of Artificial Sequence: Synthetic peptide
TPTPVNQ

SEQ ID NO: 31032 - protein, 7 aa, Artificial Sequence
  Description of Artificial Sequence: Synthetic peptide
TTHNMQG

SEQ ID NO: 31033 - protein, 7 aa, Artificial Sequence
  Description of Artificial Sequence: Synthetic peptide
NAQQAQR

SEQ ID NO: 31034 - protein, 7 aa, Artificial Sequence
  Description of Artificial Sequence: Synthetic peptide
VSKSPST

SEQ ID NO: 31035 - protein, 7 aa, Artificial Sequence
  Description of Artificial Sequence: Synthetic peptide
VGDRSWS

SEQ ID NO: 31036 - protein, 7 aa, Artificial Sequence
  Description of Artificial Sequence: Synthetic peptide
HRDQVSL

SEQ ID NO: 31037 - protein, 7 aa, Artificial Sequence
  Description of Artificial Sequence: Synthetic peptide
PNGAHVT

SEQ ID NO: 31038 - protein, 7 aa, Artificial Sequence
  Description of Artificial Sequence: Synthetic peptide
TVPGRST

SEQ ID NO: 31039 - protein, 7 aa, Artificial Sequence
  Description of Artificial Sequence: Synthetic peptide
YVSNSNA

SEQ ID NO: 31040 - protein, 7 aa, Artificial Sequence
  Description of Artificial Sequence: Synthetic peptide
ALSSQKG

SEQ ID NO: 31041 - protein, 7 aa, Artificial Sequence
  Description of Artificial Sequence: Synthetic peptide
NGSGQNK

SEQ ID NO: 31042 - protein, 7 aa, Artificial Sequence
  Description of Artificial Sequence: Synthetic peptide
GTVNAKG

SEQ ID NO: 31043 - protein, 7 aa, Artificial Sequence
  Description of Artificial Sequence: Synthetic peptide
RDGGQDR

SEQ ID NO: 31044 - protein, 7 aa, Artificial Sequence
  Description of Artificial Sequence: Synthetic peptide
HSSRPLE

SEQ ID NO: 31045 - protein, 7 aa, Artificial Sequence
  Description of Artificial Sequence: Synthetic peptide
SSSDKLR

SEQ ID NO: 31046 - protein, 7 aa, Artificial Sequence
  Description of Artificial Sequence: Synthetic peptide
DPLRQSV

SEQ ID NO: 31047 - protein, 7 aa, Artificial Sequence
  Description of Artificial Sequence: Synthetic peptide
PLQATGK

SEQ ID NO: 31048 - protein, 7 aa, Artificial Sequence
  Description of Artificial Sequence: Synthetic peptide
QANTIGK

SEQ ID NO: 31049 - protein, 7 aa, Artificial Sequence
  Description of Artificial Sequence: Synthetic peptide
RTTSSLV

SEQ ID NO: 31050 - protein, 7 aa, Artificial Sequence
  Description of Artificial Sequence: Synthetic peptide
RPSMPHS

SEQ ID NO: 31051 - protein, 7 aa, Artificial Sequence
  Description of Artificial Sequence: Synthetic peptide
LNRGNGS

SEQ ID NO: 31052 - protein, 7 aa, Artificial Sequence
  Description of Artificial Sequence: Synthetic peptide
NSHNGAS

SEQ ID NO: 31053 - protein, 7 aa, Artificial Sequence
  Description of Artificial Sequence: Synthetic peptide
PYAGNQR

SEQ ID NO: 31054 - protein, 7 aa, Artificial Sequence
  Description of Artificial Sequence: Synthetic peptide
SESGQQR

SEQ ID NO: 31055 - protein, 7 aa, Artificial Sequence
  Description of Artificial Sequence: Synthetic peptide
QSSEKRQ

SEQ ID NO: 31056 - protein, 7 aa, Artificial Sequence
  Description of Artificial Sequence: Synthetic peptide
RSTNTDN

SEQ ID NO: 31057 - protein, 7 aa, Artificial Sequence
  Description of Artificial Sequence: Synthetic peptide
NNKSASQ

SEQ ID NO: 31058 - protein, 7 aa, Artificial Sequence
  Description of Artificial Sequence: Synthetic peptide
SISHTPV

SEQ ID NO: 31059 - protein, 7 aa, Artificial Sequence
  Description of Artificial Sequence: Synthetic peptide
SVSNTNT

SEQ ID NO: 31060 - protein, 7 aa, Artificial Sequence
  Description of Artificial Sequence: Synthetic peptide
SGQQGPC

SEQ ID NO: 31061 - protein, 7 aa, Artificial Sequence
  Description of Artificial Sequence: Synthetic peptide
GIATTNR

SEQ ID NO: 31062 - protein, 7 aa, Artificial Sequence
  Description of Artificial Sequence: Synthetic peptide
PAGRSSN

SEQ ID NO: 31063 - protein, 7 aa, Artificial Sequence
  Description of Artificial Sequence: Synthetic peptide
PNLNSRG

SEQ ID NO: 31064 - protein, 7 aa, Artificial Sequence
  Description of Artificial Sequence: Synthetic peptide
PMAQQRA

SEQ ID NO: 31065 - protein, 7 aa, Artificial Sequence
  Description of Artificial Sequence: Synthetic peptide
KSDAHTA

SEQ ID NO: 31066 - protein, 7 aa, Artificial Sequence
  Description of Artificial Sequence: Synthetic peptide
SSISRTS

SEQ ID NO: 31067 - protein, 7 aa, Artificial Sequence
  Description of Artificial Sequence: Synthetic peptide
STLPPRT

SEQ ID NO: 31068 - protein, 7 aa, Artificial Sequence
  Description of Artificial Sequence: Synthetic peptide
NNRSGMG

SEQ ID NO: 31069 - protein, 7 aa, Artificial Sequence
  Description of Artificial Sequence: Synthetic peptide
VSTGKSV

SEQ ID NO: 31070 - protein, 7 aa, Artificial Sequence
  Description of Artificial Sequence: Synthetic peptide
RLPSVSS

SEQ ID NO: 31071 - protein, 7 aa, Artificial Sequence
  Description of Artificial Sequence: Synthetic peptide
GSTTSGR

SEQ ID NO: 31072 - protein, 7 aa, Artificial Sequence
  Description of Artificial Sequence: Synthetic peptide
TSGTKAH

SEQ ID NO: 31073 - protein, 7 aa, Artificial Sequence
  Description of Artificial Sequence: Synthetic peptide
DPHNTSR

SEQ ID NO: 31074 - protein, 7 aa, Artificial Sequence
  Description of Artificial Sequence: Synthetic peptide
FVNTSAQ

SEQ ID NO: 31075 - protein, 7 aa, Artificial Sequence
  Description of Artificial Sequence: Synthetic peptide
SFSGANK

SEQ ID NO: 31076 - protein, 7 aa, Artificial Sequence
  Description of Artificial Sequence: Synthetic peptide
QGSSPME

SEQ ID NO: 31077 - protein, 7 aa, Artificial Sequence
  Description of Artificial Sequence: Synthetic peptide
TPMTKNP

SEQ ID NO: 31078 - protein, 7 aa, Artificial Sequence
  Description of Artificial Sequence: Synthetic peptide
SSDLGKR

SEQ ID NO: 31079 - protein, 7 aa, Artificial Sequence
  Description of Artificial Sequence: Synthetic peptide
MATSTRN

SEQ ID NO: 31080 - protein, 7 aa, Artificial Sequence
  Description of Artificial Sequence: Synthetic peptide
LGTSTMK

SEQ ID NO: 31081 - protein, 7 aa, Artificial Sequence
  Description of Artificial Sequence: Synthetic peptide
YTITPQK

SEQ ID NO: 31082 - protein, 7 aa, Artificial Sequence
  Description of Artificial Sequence: Synthetic peptide
IGGNKPL

SEQ ID NO: 31083 - protein, 7 aa, Artificial Sequence
  Description of Artificial Sequence: Synthetic peptide
HSSSKIH

SEQ ID NO: 31084 - protein, 7 aa, Artificial Sequence
  Description of Artificial Sequence: Synthetic peptide
SNTNSAN

SEQ ID NO: 31085 - protein, 7 aa, Artificial Sequence
  Description of Artificial Sequence: Synthetic peptide
QSSNARN

SEQ ID NO: 31086 - protein, 7 aa, Artificial Sequence
  Description of Artificial Sequence: Synthetic peptide
ELMNKSK

SEQ ID NO: 31087 - protein, 7 aa, Artificial Sequence
  Description of Artificial Sequence: Synthetic peptide
RSTKTEN

SEQ ID NO: 31088 - protein, 7 aa, Artificial Sequence
  Description of Artificial Sequence: Synthetic peptide
PMSHVSG

SEQ ID NO: 31089 - protein, 7 aa, Artificial Sequence
  Description of Artificial Sequence: Synthetic peptide
PSSPNSI

SEQ ID NO: 31090 - protein, 7 aa, Artificial Sequence
  Description of Artificial Sequence: Synthetic peptide
ETPNRSQ

SEQ ID NO: 31091 - protein, 7 aa, Artificial Sequence
  Description of Artificial Sequence: Synthetic peptide
GAERTVL

SEQ ID NO: 31092 - protein, 7 aa, Artificial Sequence
  Description of Artificial Sequence: Synthetic peptide
LVSSKSS

SEQ ID NO: 31093 - protein, 7 aa, Artificial Sequence
  Description of Artificial Sequence: Synthetic peptide
INGTQTL

SEQ ID NO: 31094 - protein, 7 aa, Artificial Sequence
  Description of Artificial Sequence: Synthetic peptide
PGQSTSS

SEQ ID NO: 31095 - protein, 7 aa, Artificial Sequence
  Description of Artificial Sequence: Synthetic peptide
AVSSKVG

SEQ ID NO: 31096 - protein, 7 aa, Artificial Sequence
  Description of Artificial Sequence: Synthetic peptide
LISSKSS

SEQ ID NO: 31097 - protein, 7 aa, Artificial Sequence
  Description of Artificial Sequence: Synthetic peptide
FHANSTV

SEQ ID NO: 31098 - protein, 7 aa, Artificial Sequence
  Description of Artificial Sequence: Synthetic peptide
GQNTHLT

SEQ ID NO: 31099 - protein, 7 aa, Artificial Sequence
  Description of Artificial Sequence: Synthetic peptide
RNVSGMN

SEQ ID NO: 31100 - protein, 7 aa, Artificial Sequence
  Description of Artificial Sequence: Synthetic peptide
SRPHTDG

SEQ ID NO: 31101 - protein, 7 aa, Artificial Sequence
  Description of Artificial Sequence: Synthetic peptide
LNKSTLP

SEQ ID NO: 31102 - protein, 7 aa, Artificial Sequence
  Description of Artificial Sequence: Synthetic peptide
GYEANRG

SEQ ID NO: 31103 - protein, 7 aa, Artificial Sequence
  Description of Artificial Sequence: Synthetic peptide
RPTQVGA

SEQ ID NO: 31104 - protein, 7 aa, Artificial Sequence
  Description of Artificial Sequence: Synthetic peptide
HTSPGKN

SEQ ID NO: 31105 - protein, 7 aa, Artificial Sequence
  Description of Artificial Sequence: Synthetic peptide
VPSQSLH

SEQ ID NO: 31106 - protein, 7 aa, Artificial Sequence
  Description of Artificial Sequence: Synthetic peptide
SLSKQAA

SEQ ID NO: 31107 - protein, 7 aa, Artificial Sequence
  Description of Artificial Sequence: Synthetic peptide
NTGIPTL

SEQ ID NO: 31108 - protein, 7 aa, Artificial Sequence
  Description of Artificial Sequence: Synthetic peptide
SIPTSAR

SEQ ID NO: 31109 - protein, 7 aa, Artificial Sequence
  Description of Artificial Sequence: Synthetic peptide
ERFTSSS

SEQ ID NO: 31110 - protein, 7 aa, Artificial Sequence
  Description of Artificial Sequence: Synthetic peptide
QQVNTTR

SEQ ID NO: 31111 - protein, 7 aa, Artificial Sequence
  Description of Artificial Sequence: Synthetic peptide
YTSKSTA

SEQ ID NO: 31112 - protein, 7 aa, Artificial Sequence
  Description of Artificial Sequence: Synthetic peptide
GHGNNGA

SEQ ID NO: 31113 - protein, 7 aa, Artificial Sequence
  Description of Artificial Sequence: Synthetic peptide
GRSPTAS

SEQ ID NO: 31114 - protein, 7 aa, Artificial Sequence
  Description of Artificial Sequence: Synthetic peptide
STTNSKN

SEQ ID NO: 31115 - protein, 7 aa, Artificial Sequence
  Description of Artificial Sequence: Synthetic peptide
PGQSTSK

SEQ ID NO: 31116 - protein, 7 aa, Artificial Sequence
  Description of Artificial Sequence: Synthetic peptide
IPGHPTA

SEQ ID NO: 31117 - protein, 7 aa, Artificial Sequence
  Description of Artificial Sequence: Synthetic peptide
NTSNNIQ

SEQ ID NO: 31118 - protein, 7 aa, Artificial Sequence
  Description of Artificial Sequence: Synthetic peptide
STDRSFN

SEQ ID NO: 31119 - protein, 7 aa, Artificial Sequence
  Description of Artificial Sequence: Synthetic peptide
SFSKGSS

SEQ ID NO: 31120 - protein, 7 aa, Artificial Sequence
  Description of Artificial Sequence: Synthetic peptide
NSAALNS

SEQ ID NO: 31121 - protein, 7 aa, Artificial Sequence
  Description of Artificial Sequence: Synthetic peptide
PLPNRNQ

SEQ ID NO: 31122 - protein, 7 aa, Artificial Sequence
  Description of Artificial Sequence: Synthetic peptide
EHMTPRS

SEQ ID NO: 31123 - protein, 7 aa, Artificial Sequence
  Description of Artificial Sequence: Synthetic peptide
TTHNIKG

SEQ ID NO: 31124 - protein, 7 aa, Artificial Sequence
  Description of Artificial Sequence: Synthetic peptide
AVSKGGP

SEQ ID NO: 31125 - protein, 7 aa, Artificial Sequence
  Description of Artificial Sequence: Synthetic peptide
SPASLPK

SEQ ID NO: 31126 - protein, 7 aa, Artificial Sequence
  Description of Artificial Sequence: Synthetic peptide
LIRGGNN

SEQ ID NO: 31127 - protein, 7 aa, Artificial Sequence
  Description of Artificial Sequence: Synthetic peptide
SSQQKAS

SEQ ID NO: 31128 - protein, 7 aa, Artificial Sequence
  Description of Artificial Sequence: Synthetic peptide
PYNSKAS

SEQ ID NO: 31129 - protein, 7 aa, Artificial Sequence
  Description of Artificial Sequence: Synthetic peptide
MNRNGSL

SEQ ID NO: 31130 - protein, 7 aa, Artificial Sequence
  Description of Artificial Sequence: Synthetic peptide
TRNQSVT

SEQ ID NO: 31131 - protein, 7 aa, Artificial Sequence
  Description of Artificial Sequence: Synthetic peptide
LGGGTLR

SEQ ID NO: 31132 - protein, 7 aa, Artificial Sequence
  Description of Artificial Sequence: Synthetic peptide
RTGESYM

SEQ ID NO: 31133 - protein, 7 aa, Artificial Sequence
  Description of Artificial Sequence: Synthetic peptide
ADSNRPG

SEQ ID NO: 31134 - protein, 7 aa, Artificial Sequence
  Description of Artificial Sequence: Synthetic peptide
VMGAGAS

SEQ ID NO: 31135 - protein, 7 aa, Artificial Sequence
  Description of Artificial Sequence: Synthetic peptide
NGSGQTQ

SEQ ID NO: 31136 - protein, 7 aa, Artificial Sequence
  Description of Artificial Sequence: Synthetic peptide
STLPGNS

SEQ ID NO: 31137 - protein, 7 aa, Artificial Sequence
  Description of Artificial Sequence: Synthetic peptide
YGNPRQA

SEQ ID NO: 31138 - protein, 7 aa, Artificial Sequence
  Description of Artificial Sequence: Synthetic peptide
RSQGSYA

SEQ ID NO: 31139 - protein, 7 aa, Artificial Sequence
  Description of Artificial Sequence: Synthetic peptide
SLPNTNG

SEQ ID NO: 31140 - protein, 7 aa, Artificial Sequence
  Description of Artificial Sequence: Synthetic peptide
RSGGSLS

SEQ ID NO: 31141 - protein, 7 aa, Artificial Sequence
  Description of Artificial Sequence: Synthetic peptide
SPVKGSV

SEQ ID NO: 31142 - protein, 7 aa, Artificial Sequence
  Description of Artificial Sequence: Synthetic peptide
SVSTKSA

SEQ ID NO: 31143 - protein, 7 aa, Artificial Sequence
  Description of Artificial Sequence: Synthetic peptide
DPRNSTS

SEQ ID NO: 31144 - protein, 7 aa, Artificial Sequence
  Description of Artificial Sequence: Synthetic peptide
WSASRSA

SEQ ID NO: 31145 - protein, 7 aa, Artificial Sequence
  Description of Artificial Sequence: Synthetic peptide
YSGGTQQ

SEQ ID NO: 31146 - protein, 7 aa, Artificial Sequence
  Description of Artificial Sequence: Synthetic peptide
PSHNPTN

SEQ ID NO: 31147 - protein, 7 aa, Artificial Sequence
  Description of Artificial Sequence: Synthetic peptide
GSGIKRE

SEQ ID NO: 31148 - protein, 7 aa, Artificial Sequence
  Description of Artificial Sequence: Synthetic peptide
NGISKSN

SEQ ID NO: 31149 - protein, 7 aa, Artificial Sequence
  Description of Artificial Sequence: Synthetic peptide
MTQHKQA

SEQ ID NO: 31150 - protein, 7 aa, Artificial Sequence
  Description of Artificial Sequence: Synthetic peptide
QSHGITN

SEQ ID NO: 31151 - protein, 7 aa, Artificial Sequence
  Description of Artificial Sequence: Synthetic peptide
SSAGTYT

SEQ ID NO: 31152 - protein, 7 aa, Artificial Sequence
  Description of Artificial Sequence: Synthetic peptide
GSSPSLR

SEQ ID NO: 31153 - protein, 7 aa, Artificial Sequence
  Description of Artificial Sequence: Synthetic peptide
GITKNLA

SEQ ID NO: 31154 - protein, 7 aa, Artificial Sequence
  Description of Artificial Sequence: Synthetic peptide
SGAGSAG

SEQ ID NO: 31155 - protein, 7 aa, Artificial Sequence
  Description of Artificial Sequence: Synthetic peptide
AQSTYQS

SEQ ID NO: 31156 - protein, 7 aa, Artificial Sequence
  Description of Artificial Sequence: Synthetic peptide
GSNRNPL

SEQ ID NO: 31157 - protein, 7 aa, Artificial Sequence
  Description of Artificial Sequence: Synthetic peptide
SSRSTAS

SEQ ID NO: 31158 - protein, 7 aa, Artificial Sequence
  Description of Artificial Sequence: Synthetic peptide
SHDTSYR

SEQ ID NO: 31159 - protein, 7 aa, Artificial Sequence
  Description of Artificial Sequence: Synthetic peptide
SSASTYK

SEQ ID NO: 31160 - protein, 7 aa, Artificial Sequence
  Description of Artificial Sequence: Synthetic peptide
NPNQSLG

SEQ ID NO: 31161 - protein, 7 aa, Artificial Sequence
  Description of Artificial Sequence: Synthetic peptide
VGSRNVG

SEQ ID NO: 31162 - protein, 7 aa, Artificial Sequence
  Description of Artificial Sequence: Synthetic peptide
HASTPAR

SEQ ID NO: 31163 - protein, 7 aa, Artificial Sequence
  Description of Artificial Sequence: Synthetic peptide
ASSSKSV

SEQ ID NO: 31164 - protein, 7 aa, Artificial Sequence
  Description of Artificial Sequence: Synthetic peptide
NLSHSAG

SEQ ID NO: 31165 - protein, 7 aa, Artificial Sequence
  Description of Artificial Sequence: Synthetic peptide
SITGNRT

SEQ ID NO: 31166 - protein, 7 aa, Artificial Sequence
  Description of Artificial Sequence: Synthetic peptide
STNPANR

SEQ ID NO: 31167 - protein, 7 aa, Artificial Sequence
  Description of Artificial Sequence: Synthetic peptide
IRTKESA

SEQ ID NO: 31168 - protein, 7 aa, Artificial Sequence
  Description of Artificial Sequence: Synthetic peptide
GINPTSV

SEQ ID NO: 31169 - protein, 7 aa, Artificial Sequence
  Description of Artificial Sequence: Synthetic peptide
DQRNRSI

SEQ ID NO: 31170 - protein, 7 aa, Artificial Sequence
  Description of Artificial Sequence: Synthetic peptide
TGRAPSS

SEQ ID NO: 31171 - protein, 7 aa, Artificial Sequence
  Description of Artificial Sequence: Synthetic peptide
NTHNIQG

SEQ ID NO: 31172 - protein, 7 aa, Artificial Sequence
  Description of Artificial Sequence: Synthetic peptide
NQSSSAR

SEQ ID NO: 31173 - protein, 7 aa, Artificial Sequence
  Description of Artificial Sequence: Synthetic peptide
FNSNRDS

SEQ ID NO: 31174 - protein, 7 aa, Artificial Sequence
  Description of Artificial Sequence: Synthetic peptide
NDSGQNQ

SEQ ID NO: 31175 - protein, 7 aa, Artificial Sequence
  Description of Artificial Sequence: Synthetic peptide
HGTSPLR

SEQ ID NO: 31176 - protein, 7 aa, Artificial Sequence
  Description of Artificial Sequence: Synthetic peptide
ITSGSTR

SEQ ID NO: 31177 - protein, 7 aa, Artificial Sequence
  Description of Artificial Sequence: Synthetic peptide
RMNGGGP

SEQ ID NO: 31178 - protein, 7 aa, Artificial Sequence
  Description of Artificial Sequence: Synthetic peptide
VGTNHTS

SEQ ID NO: 31179 - protein, 7 aa, Artificial Sequence
  Description of Artificial Sequence: Synthetic peptide
SYADKQG

SEQ ID NO: 31180 - protein, 7 aa, Artificial Sequence
  Description of Artificial Sequence: Synthetic peptide
LRAEHVR

SEQ ID NO: 31181 - protein, 7 aa, Artificial Sequence
  Description of Artificial Sequence: Synthetic peptide
VTTSRGV

SEQ ID NO: 31182 - protein, 7 aa, Artificial Sequence
  Description of Artificial Sequence: Synthetic peptide
NANPSLR

SEQ ID NO: 31183 - protein, 7 aa, Artificial Sequence
  Description of Artificial Sequence: Synthetic peptide
SSAPSLS

SEQ ID NO: 31184 - protein, 7 aa, Artificial Sequence
  Description of Artificial Sequence: Synthetic peptide
NSGRNSV

SEQ ID NO: 31185 - protein, 7 aa, Artificial Sequence
  Description of Artificial Sequence: Synthetic peptide
SFTKGAG

SEQ ID NO: 31186 - protein, 7 aa, Artificial Sequence
  Description of Artificial Sequence: Synthetic peptide
TTQSRSL

SEQ ID NO: 31187 - protein, 7 aa, Artificial Sequence
  Description of Artificial Sequence: Synthetic peptide
YRATSGQ

SEQ ID NO: 31188 - protein, 7 aa, Artificial Sequence
  Description of Artificial Sequence: Synthetic peptide
GKHGTNS

SEQ ID NO: 31189 - protein, 7 aa, Artificial Sequence
  Description of Artificial Sequence: Synthetic peptide
TGGNRVL

SEQ ID NO: 31190 - protein, 7 aa, Artificial Sequence
  Description of Artificial Sequence: Synthetic peptide
QRTVGTA

SEQ ID NO: 31191 - protein, 7 aa, Artificial Sequence
  Description of Artificial Sequence: Synthetic peptide
TSGSQVR

SEQ ID NO: 31192 - protein, 7 aa, Artificial Sequence
  Description of Artificial Sequence: Synthetic peptide
GAGNLTG

SEQ ID NO: 31193 - protein, 7 aa, Artificial Sequence
  Description of Artificial Sequence: Synthetic peptide
GGSNLRT

SEQ ID NO: 31194 - protein, 7 aa, Artificial Sequence
  Description of Artificial Sequence: Synthetic peptide
ARSPPSG

SEQ ID NO: 31195 - protein, 7 aa, Artificial Sequence
  Description of Artificial Sequence: Synthetic peptide
SSVQHTG

SEQ ID NO: 31196 - protein, 7 aa, Artificial Sequence
  Description of Artificial Sequence: Synthetic peptide
ATVSKTA

SEQ ID NO: 31197 - protein, 7 aa, Artificial Sequence
  Description of Artificial Sequence: Synthetic peptide
NGSGQHQ

SEQ ID NO: 31198 - protein, 7 aa, Artificial Sequence
  Description of Artificial Sequence: Synthetic peptide
AGHSGRD

SEQ ID NO: 31199 - protein, 7 aa, Artificial Sequence
  Description of Artificial Sequence: Synthetic peptide
EGTRGVG

SEQ ID NO: 31200 - protein, 7 aa, Artificial Sequence
  Description of Artificial Sequence: Synthetic peptide
GNTQTSR

SEQ ID NO: 31201 - protein, 7 aa, Artificial Sequence
  Description of Artificial Sequence: Synthetic peptide
MNTSRSS

SEQ ID NO: 31202 - protein, 7 aa, Artificial Sequence
  Description of Artificial Sequence: Synthetic peptide
GTNSTRG

SEQ ID NO: 31203 - protein, 7 aa, Artificial Sequence
  Description of Artificial Sequence: Synthetic peptide
PRVHPLV

SEQ ID NO: 31204 - protein, 7 aa, Artificial Sequence
  Description of Artificial Sequence: Synthetic peptide
MSGGNMR

SEQ ID NO: 31205 - protein, 7 aa, Artificial Sequence
  Description of Artificial Sequence: Synthetic peptide
ATNNGSK

SEQ ID NO: 31206 - protein, 7 aa, Artificial Sequence
  Description of Artificial Sequence: Synthetic peptide
ANSRDAK

SEQ ID NO: 31207 - protein, 7 aa, Artificial Sequence
  Description of Artificial Sequence: Synthetic peptide
PVARAAQ

SEQ ID NO: 31208 - protein, 7 aa, Artificial Sequence
  Description of Artificial Sequence: Synthetic peptide
QSGNTIQ

SEQ ID NO: 31209 - protein, 7 aa, Artificial Sequence
  Description of Artificial Sequence: Synthetic peptide
RASQSVG

SEQ ID NO: 31210 - protein, 7 aa, Artificial Sequence
  Description of Artificial Sequence: Synthetic peptide
PTLSGSR

SEQ ID NO: 31211 - protein, 7 aa, Artificial Sequence
  Description of Artificial Sequence: Synthetic peptide
MRQTASL

SEQ ID NO: 31212 - protein, 7 aa, Artificial Sequence
  Description of Artificial Sequence: Synthetic peptide
RSTDTHG

SEQ ID NO: 31213 - protein, 7 aa, Artificial Sequence
  Description of Artificial Sequence: Synthetic peptide
EFTKVGA

SEQ ID NO: 31214 - protein, 7 aa, Artificial Sequence
  Description of Artificial Sequence: Synthetic peptide
PMGHSLL

SEQ ID NO: 31215 - protein, 7 aa, Artificial Sequence
  Description of Artificial Sequence: Synthetic peptide
ARNPQVS

SEQ ID NO: 31216 - protein, 7 aa, Artificial Sequence
  Description of Artificial Sequence: Synthetic peptide
GTGTPRT

SEQ ID NO: 31217 - protein, 7 aa, Artificial Sequence
  Description of Artificial Sequence: Synthetic peptide
TAPSHTN

SEQ ID NO: 31218 - protein, 7 aa, Artificial Sequence
  Description of Artificial Sequence: Synthetic peptide
SATNGSL

SEQ ID NO: 31219 - protein, 7 aa, Artificial Sequence
  Description of Artificial Sequence: Synthetic peptide
ATHNSSQ

SEQ ID NO: 31220 - protein, 7 aa, Artificial Sequence
  Description of Artificial Sequence: Synthetic peptide
LLTSPNS

SEQ ID NO: 31221 - protein, 7 aa, Artificial Sequence
  Description of Artificial Sequence: Synthetic peptide
QSGSKPG

SEQ ID NO: 31222 - protein, 7 aa, Artificial Sequence
  Description of Artificial Sequence: Synthetic peptide
WRSQHNS

SEQ ID NO: 31223 - protein, 7 aa, Artificial Sequence
  Description of Artificial Sequence: Synthetic peptide
QPTQRMG

SEQ ID NO: 31224 - protein, 7 aa, Artificial Sequence
  Description of Artificial Sequence: Synthetic peptide
GMTQGGK

SEQ ID NO: 31225 - protein, 7 aa, Artificial Sequence
  Description of Artificial Sequence: Synthetic peptide
VSMNTTR

SEQ ID NO: 31226 - protein, 7 aa, Artificial Sequence
  Description of Artificial Sequence: Synthetic peptide
SPGNKLL

SEQ ID NO: 31227 - protein, 7 aa, Artificial Sequence
  Description of Artificial Sequence: Synthetic peptide
ATHSKAS

SEQ ID NO: 31228 - protein, 7 aa, Artificial Sequence
  Description of Artificial Sequence: Synthetic peptide
NSSHNVS

SEQ ID NO: 31229 - protein, 7 aa, Artificial Sequence
  Description of Artificial Sequence: Synthetic peptide
VNTNRAA

SEQ ID NO: 31230 - protein, 7 aa, Artificial Sequence
  Description of Artificial Sequence: Synthetic peptide
RSNPTLV

SEQ ID NO: 31231 - protein, 7 aa, Artificial Sequence
  Description of Artificial Sequence: Synthetic peptide
LPTSSVA

SEQ ID NO: 31232 - protein, 7 aa, Artificial Sequence
  Description of Artificial Sequence: Synthetic peptide
SGTSRFS

SEQ ID NO: 31233 - protein, 7 aa, Artificial Sequence
  Description of Artificial Sequence: Synthetic peptide
ASPNRGS

SEQ ID NO: 31234 - protein, 7 aa, Artificial Sequence
  Description of Artificial Sequence: Synthetic peptide
FVSGKVQ

SEQ ID NO: 31235 - protein, 7 aa, Artificial Sequence
  Description of Artificial Sequence: Synthetic peptide
SSSTSPR

SEQ ID NO: 31236 - protein, 7 aa, Artificial Sequence
  Description of Artificial Sequence: Synthetic peptide
QGLSKSG

SEQ ID NO: 31237 - protein, 7 aa, Artificial Sequence
  Description of Artificial Sequence: Synthetic peptide
SSEQTTR

SEQ ID NO: 31238 - protein, 7 aa, Artificial Sequence
  Description of Artificial Sequence: Synthetic peptide
IGTTPPK

SEQ ID NO: 31239 - protein, 7 aa, Artificial Sequence
  Description of Artificial Sequence: Synthetic peptide
PLSKDRL

SEQ ID NO: 31240 - protein, 7 aa, Artificial Sequence
  Description of Artificial Sequence: Synthetic peptide
TPQNVRN

SEQ ID NO: 31241 - protein, 7 aa, Artificial Sequence
  Description of Artificial Sequence: Synthetic peptide
PYAPRKD

SEQ ID NO: 31242 - protein, 7 aa, Artificial Sequence
  Description of Artificial Sequence: Synthetic peptide
SSTSPGR

SEQ ID NO: 31243 - protein, 7 aa, Artificial Sequence
  Description of Artificial Sequence: Synthetic peptide
GSLTPKA

SEQ ID NO: 31244 - protein, 7 aa, Artificial Sequence
  Description of Artificial Sequence: Synthetic peptide
MATSTVK

SEQ ID NO: 31245 - protein, 7 aa, Artificial Sequence
  Description of Artificial Sequence: Synthetic peptide
SAVGKAS

SEQ ID NO: 31246 - protein, 7 aa, Artificial Sequence
  Description of Artificial Sequence: Synthetic peptide
RPVGGLA

SEQ ID NO: 31247 - protein, 7 aa, Artificial Sequence
  Description of Artificial Sequence: Synthetic peptide
SNTHSPS

SEQ ID NO: 31248 - protein, 7 aa, Artificial Sequence
  Description of Artificial Sequence: Synthetic peptide
GDHNRMN

SEQ ID NO: 31249 - protein, 7 aa, Artificial Sequence
  Description of Artificial Sequence: Synthetic peptide
SSPVSAV

SEQ ID NO: 31250 - protein, 7 aa, Artificial Sequence
  Description of Artificial Sequence: Synthetic peptide
QNLPKAS

SEQ ID NO: 31251 - protein, 7 aa, Artificial Sequence
  Description of Artificial Sequence: Synthetic peptide
TNAARDS

SEQ ID NO: 31252 - protein, 7 aa, Artificial Sequence
  Description of Artificial Sequence: Synthetic peptide
ETNSRLG

SEQ ID NO: 31253 - protein, 7 aa, Artificial Sequence
  Description of Artificial Sequence: Synthetic peptide
TRDSSLH

SEQ ID NO: 31254 - protein, 7 aa, Artificial Sequence
  Description of Artificial Sequence: Synthetic peptide
VTQSSSK

SEQ ID NO: 31255 - protein, 7 aa, Artificial Sequence
  Description of Artificial Sequence: Synthetic peptide
AQTKGTQ

SEQ ID NO: 31256 - protein, 7 aa, Artificial Sequence
  Description of Artificial Sequence: Synthetic peptide
LLSSKTA

SEQ ID NO: 31257 - protein, 7 aa, Artificial Sequence
  Description of Artificial Sequence: Synthetic peptide
SPHTHQK

SEQ ID NO: 31258 - protein, 7 aa, Artificial Sequence
  Description of Artificial Sequence: Synthetic peptide
PSNTGTI

SEQ ID NO: 31259 - protein, 7 aa, Artificial Sequence
  Description of Artificial Sequence: Synthetic peptide
QNQNSGR

SEQ ID NO: 31260 - protein, 7 aa, Artificial Sequence
  Description of Artificial Sequence: Synthetic peptide
PTSQQRP

SEQ ID NO: 31261 - protein, 7 aa, Artificial Sequence
  Description of Artificial Sequence: Synthetic peptide
RGATSTS

SEQ ID NO: 31262 - protein, 7 aa, Artificial Sequence
  Description of Artificial Sequence: Synthetic peptide
SSVGRLN

SEQ ID NO: 31263 - protein, 7 aa, Artificial Sequence
  Description of Artificial Sequence: Synthetic peptide
QPNSGTT

SEQ ID NO: 31264 - protein, 7 aa, Artificial Sequence
  Description of Artificial Sequence: Synthetic peptide
AYPKNSN

SEQ ID NO: 31265 - protein, 7 aa, Artificial Sequence
  Description of Artificial Sequence: Synthetic peptide
SLTSTGK

SEQ ID NO: 31266 - protein, 7 aa, Artificial Sequence
  Description of Artificial Sequence: Synthetic peptide
TSGSARG

SEQ ID NO: 31267 - protein, 7 aa, Artificial Sequence
  Description of Artificial Sequence: Synthetic peptide
LNRPSLG

SEQ ID NO: 31268 - protein, 7 aa, Artificial Sequence
  Description of Artificial Sequence: Synthetic peptide
NCSGQNQ

SEQ ID NO: 31269 - protein, 7 aa, Artificial Sequence
  Description of Artificial Sequence: Synthetic peptide
MLPQNGR

SEQ ID NO: 31270 - protein, 7 aa, Artificial Sequence
  Description of Artificial Sequence: Synthetic peptide
GYGSKVS

SEQ ID NO: 31271 - protein, 7 aa, Artificial Sequence
  Description of Artificial Sequence: Synthetic peptide
SLSSKQM

SEQ ID NO: 31272 - protein, 7 aa, Artificial Sequence
  Description of Artificial Sequence: Synthetic peptide
NGATKNS

SEQ ID NO: 31273 - protein, 7 aa, Artificial Sequence
  Description of Artificial Sequence: Synthetic peptide
GPRSMSN

SEQ ID NO: 31274 - protein, 7 aa, Artificial Sequence
  Description of Artificial Sequence: Synthetic peptide
TSAAPHA

SEQ ID NO: 31275 - protein, 7 aa, Artificial Sequence
  Description of Artificial Sequence: Synthetic peptide
RSSPASL

SEQ ID NO: 31276 - protein, 7 aa, Artificial Sequence
  Description of Artificial Sequence: Synthetic peptide
GQVKALG

SEQ ID NO: 31277 - protein, 7 aa, Artificial Sequence
  Description of Artificial Sequence: Synthetic peptide
SDNTARS

SEQ ID NO: 31278 - protein, 7 aa, Artificial Sequence
  Description of Artificial Sequence: Synthetic peptide
RSNGSAA

SEQ ID NO: 31279 - protein, 7 aa, Artificial Sequence
  Description of Artificial Sequence: Synthetic peptide
YLTSTSN

SEQ ID NO: 31280 - protein, 7 aa, Artificial Sequence
  Description of Artificial Sequence: Synthetic peptide
SYKNTGV

SEQ ID NO: 31281 - protein, 7 aa, Artificial Sequence
  Description of Artificial Sequence: Synthetic peptide
TRSQGIL

SEQ ID NO: 31282 - protein, 7 aa, Artificial Sequence
  Description of Artificial Sequence: Synthetic peptide
SQSPNRG

SEQ ID NO: 31283 - protein, 7 aa, Artificial Sequence
  Description of Artificial Sequence: Synthetic peptide
FSRSPAV

SEQ ID NO: 31284 - protein, 7 aa, Artificial Sequence
  Description of Artificial Sequence: Synthetic peptide
YGKSVTP

SEQ ID NO: 31285 - protein, 7 aa, Artificial Sequence
  Description of Artificial Sequence: Synthetic peptide
TQMGKSN

SEQ ID NO: 31286 - protein, 7 aa, Artificial Sequence
  Description of Artificial Sequence: Synthetic peptide
LATANSR

SEQ ID NO: 31287 - protein, 7 aa, Artificial Sequence
  Description of Artificial Sequence: Synthetic peptide
VPSRAAT

SEQ ID NO: 31288 - protein, 7 aa, Artificial Sequence
  Description of Artificial Sequence: Synthetic peptide
DSHPRSI

SEQ ID NO: 31289 - protein, 7 aa, Artificial Sequence
  Description of Artificial Sequence: Synthetic peptide
SGSGQNQ

SEQ ID NO: 31290 - protein, 7 aa, Artificial Sequence
  Description of Artificial Sequence: Synthetic peptide
MSHTKSN

SEQ ID NO: 31291 - protein, 7 aa, Artificial Sequence
  Description of Artificial Sequence: Synthetic peptide
GRETVSR

SEQ ID NO: 31292 - protein, 7 aa, Artificial Sequence
  Description of Artificial Sequence: Synthetic peptide
GVLGSPK

SEQ ID NO: 31293 - protein, 7 aa, Artificial Sequence
  Description of Artificial Sequence: Synthetic peptide
PGMKVSP

SEQ ID NO: 31294 - protein, 7 aa, Artificial Sequence
  Description of Artificial Sequence: Synthetic peptide
QDKGNAG

SEQ ID NO: 31295 - protein, 7 aa, Artificial Sequence
  Description of Artificial Sequence: Synthetic peptide
GGSSRTL

SEQ ID NO: 31296 - protein, 7 aa, Artificial Sequence
  Description of Artificial Sequence: Synthetic peptide
PSNRQIA

SEQ ID NO: 31297 - protein, 7 aa, Artificial Sequence
  Description of Artificial Sequence: Synthetic peptide
GTTNSRN

SEQ ID NO: 31298 - protein, 7 aa, Artificial Sequence
  Description of Artificial Sequence: Synthetic peptide
PLRGGSS

SEQ ID NO: 31299 - protein, 7 aa, Artificial Sequence
  Description of Artificial Sequence: Synthetic peptide
SPNSHPS

SEQ ID NO: 31300 - protein, 7 aa, Artificial Sequence
  Description of Artificial Sequence: Synthetic peptide
PSKGTYP

SEQ ID NO: 31301 - protein, 7 aa, Artificial Sequence
  Description of Artificial Sequence: Synthetic peptide
GNGISAR

SEQ ID NO: 31302 - protein, 7 aa, Artificial Sequence
  Description of Artificial Sequence: Synthetic peptide
SSGNRTT

SEQ ID NO: 31303 - protein, 7 aa, Artificial Sequence
  Description of Artificial Sequence: Synthetic peptide
GTINGIT

SEQ ID NO: 31304 - protein, 7 aa, Artificial Sequence
  Description of Artificial Sequence: Synthetic peptide
HTVPRSV

SEQ ID NO: 31305 - protein, 7 aa, Artificial Sequence
  Description of Artificial Sequence: Synthetic peptide
QSKAGNS

SEQ ID NO: 31306 - protein, 7 aa, Artificial Sequence
  Description of Artificial Sequence: Synthetic peptide
GLPLRSV

SEQ ID NO: 31307 - protein, 7 aa, Artificial Sequence
  Description of Artificial Sequence: Synthetic peptide
MPSQRDG

SEQ ID NO: 31308 - protein, 7 aa, Artificial Sequence
  Description of Artificial Sequence: Synthetic peptide
GRANGQT

SEQ ID NO: 31309 - protein, 7 aa, Artificial Sequence
  Description of Artificial Sequence: Synthetic peptide
FRAQANV

SEQ ID NO: 31310 - protein, 7 aa, Artificial Sequence
  Description of Artificial Sequence: Synthetic peptide
TASPNNR

SEQ ID NO: 31311 - protein, 7 aa, Artificial Sequence
  Description of Artificial Sequence: Synthetic peptide
SSTNRPT

SEQ ID NO: 31312 - protein, 7 aa, Artificial Sequence
  Description of Artificial Sequence: Synthetic peptide
GSVNRSS

SEQ ID NO: 31313 - protein, 7 aa, Artificial Sequence
  Description of Artificial Sequence: Synthetic peptide
TMPAQRS

SEQ ID NO: 31314 - protein, 7 aa, Artificial Sequence
  Description of Artificial Sequence: Synthetic peptide
GVTGSRG

SEQ ID NO: 31315 - protein, 7 aa, Artificial Sequence
  Description of Artificial Sequence: Synthetic peptide
STTLRNS

SEQ ID NO: 31316 - protein, 7 aa, Artificial Sequence
  Description of Artificial Sequence: Synthetic peptide
PRTNNPS

SEQ ID NO: 31317 - protein, 7 aa, Artificial Sequence
  Description of Artificial Sequence: Synthetic peptide
EGSGRLT

SEQ ID NO: 31318 - protein, 7 aa, Artificial Sequence
  Description of Artificial Sequence: Synthetic peptide
MRSNPTS

SEQ ID NO: 31319 - protein, 7 aa, Artificial Sequence
  Description of Artificial Sequence: Synthetic peptide
FLGKSGA

SEQ ID NO: 31320 - protein, 7 aa, Artificial Sequence
  Description of Artificial Sequence: Synthetic peptide
VPHNHSL

SEQ ID NO: 31321 - protein, 7 aa, Artificial Sequence
  Description of Artificial Sequence: Synthetic peptide
QVSPASR

SEQ ID NO: 31322 - protein, 7 aa, Artificial Sequence
  Description of Artificial Sequence: Synthetic peptide
SPNANRV

SEQ ID NO: 31323 - protein, 7 aa, Artificial Sequence
  Description of Artificial Sequence: Synthetic peptide
SSPSRSS

SEQ ID NO: 31324 - protein, 7 aa, Artificial Sequence
  Description of Artificial Sequence: Synthetic peptide
EPTHPRG

SEQ ID NO: 31325 - protein, 7 aa, Artificial Sequence
  Description of Artificial Sequence: Synthetic peptide
MQAKSGH

SEQ ID NO: 31326 - protein, 7 aa, Artificial Sequence
  Description of Artificial Sequence: Synthetic peptide
NAARNNA

SEQ ID NO: 31327 - protein, 7 aa, Artificial Sequence
  Description of Artificial Sequence: Synthetic peptide
SANRPSA

SEQ ID NO: 31328 - protein, 7 aa, Artificial Sequence
  Description of Artificial Sequence: Synthetic peptide
RSPTSQS

SEQ ID NO: 31329 - protein, 7 aa, Artificial Sequence
  Description of Artificial Sequence: Synthetic peptide
ALPAKSA

SEQ ID NO: 31330 - protein, 7 aa, Artificial Sequence
  Description of Artificial Sequence: Synthetic peptide
PVMTRTP

SEQ ID NO: 31331 - protein, 7 aa, Artificial Sequence
  Description of Artificial Sequence: Synthetic peptide
GNPSPLV

SEQ ID NO: 31332 - protein, 7 aa, Artificial Sequence
  Description of Artificial Sequence: Synthetic peptide
ANGTKSS

SEQ ID NO: 31333 - protein, 7 aa, Artificial Sequence
  Description of Artificial Sequence: Synthetic peptide
PRDLRAS

SEQ ID NO: 31334 - protein, 7 aa, Artificial Sequence
  Description of Artificial Sequence: Synthetic peptide
QPGVSGR

SEQ ID NO: 31335 - protein, 7 aa, Artificial Sequence
  Description of Artificial Sequence: Synthetic peptide
PLTTRPS

SEQ ID NO: 31336 - protein, 7 aa, Artificial Sequence
  Description of Artificial Sequence: Synthetic peptide
PHSTGSI

SEQ ID NO: 31337 - protein, 7 aa, Artificial Sequence
  Description of Artificial Sequence: Synthetic peptide
GGQNSSK

SEQ ID NO: 31338 - protein, 7 aa, Artificial Sequence
  Description of Artificial Sequence: Synthetic peptide
EPSRSST

SEQ ID NO: 31339 - protein, 7 aa, Artificial Sequence
  Description of Artificial Sequence: Synthetic peptide
AYPSGSS

SEQ ID NO: 31340 - protein, 7 aa, Artificial Sequence
  Description of Artificial Sequence: Synthetic peptide
QLGSTTR

SEQ ID NO: 31341 - protein, 7 aa, Artificial Sequence
  Description of Artificial Sequence: Synthetic peptide
ARSESTA

SEQ ID NO: 31342 - protein, 7 aa, Artificial Sequence
  Description of Artificial Sequence: Synthetic peptide
APSARPS

SEQ ID NO: 31343 - protein, 7 aa, Artificial Sequence
  Description of Artificial Sequence: Synthetic peptide
TSNTKSV

SEQ ID NO: 31344 - protein, 7 aa, Artificial Sequence
  Description of Artificial Sequence: Synthetic peptide
PGIATGR

SEQ ID NO: 31345 - protein, 7 aa, Artificial Sequence
  Description of Artificial Sequence: Synthetic peptide
TSTQKGQ

SEQ ID NO: 31346 - protein, 7 aa, Artificial Sequence
  Description of Artificial Sequence: Synthetic peptide
DRMGTAH

SEQ ID NO: 31347 - protein, 7 aa, Artificial Sequence
  Description of Artificial Sequence: Synthetic peptide
SHTPKLV

SEQ ID NO: 31348 - protein, 7 aa, Artificial Sequence
  Description of Artificial Sequence: Synthetic peptide
RGNGTHG

SEQ ID NO: 31349 - protein, 7 aa, Artificial Sequence
  Description of Artificial Sequence: Synthetic peptide
PSHGQNR

SEQ ID NO: 31350 - protein, 7 aa, Artificial Sequence
  Description of Artificial Sequence: Synthetic peptide
SSPTRGL

SEQ ID NO: 31351 - protein, 7 aa, Artificial Sequence
  Description of Artificial Sequence: Synthetic peptide
TRFTSSA

SEQ ID NO: 31352 - protein, 7 aa, Artificial Sequence
  Description of Artificial Sequence: Synthetic peptide
SPFQSSH

SEQ ID NO: 31353 - protein, 7 aa, Artificial Sequence
  Description of Artificial Sequence: Synthetic peptide
GHSTVGS

SEQ ID NO: 31354 - protein, 7 aa, Artificial Sequence
  Description of Artificial Sequence: Synthetic peptide
SMNSKPT

SEQ ID NO: 31355 - protein, 7 aa, Artificial Sequence
  Description of Artificial Sequence: Synthetic peptide
PHISPKG

SEQ ID NO: 31356 - protein, 7 aa, Artificial Sequence
  Description of Artificial Sequence: Synthetic peptide
AGSSRNL

SEQ ID NO: 31357 - protein, 7 aa, Artificial Sequence
  Description of Artificial Sequence: Synthetic peptide
NRQSSPT

SEQ ID NO: 31358 - protein, 7 aa, Artificial Sequence
  Description of Artificial Sequence: Synthetic peptide
MRPNSGM

SEQ ID NO: 31359 - protein, 7 aa, Artificial Sequence
  Description of Artificial Sequence: Synthetic peptide
GGQASGR

SEQ ID NO: 31360 - protein, 7 aa, Artificial Sequence
  Description of Artificial Sequence: Synthetic peptide
MSTARSA

SEQ ID NO: 31361 - protein, 7 aa, Artificial Sequence
  Description of Artificial Sequence: Synthetic peptide
NLGTNVL

SEQ ID NO: 31362 - protein, 7 aa, Artificial Sequence
  Description of Artificial Sequence: Synthetic peptide
GTPNNRS

SEQ ID NO: 31363 - protein, 7 aa, Artificial Sequence
  Description of Artificial Sequence: Synthetic peptide
PVGSRGG

SEQ ID NO: 31364 - protein, 7 aa, Artificial Sequence
  Description of Artificial Sequence: Synthetic peptide
QVGRPNA

SEQ ID NO: 31365 - protein, 7 aa, Artificial Sequence
  Description of Artificial Sequence: Synthetic peptide
SVNTKAL

SEQ ID NO: 31366 - protein, 7 aa, Artificial Sequence
  Description of Artificial Sequence: Synthetic peptide
SPMRSQV

SEQ ID NO: 31367 - protein, 7 aa, Artificial Sequence
  Description of Artificial Sequence: Synthetic peptide
SSPSKMA

SEQ ID NO: 31368 - protein, 7 aa, Artificial Sequence
  Description of Artificial Sequence: Synthetic peptide
SQPIGAR

SEQ ID NO: 31369 - protein, 7 aa, Artificial Sequence
  Description of Artificial Sequence: Synthetic peptide
SHVNSTR

SEQ ID NO: 31370 - protein, 7 aa, Artificial Sequence
  Description of Artificial Sequence: Synthetic peptide
TTTTRPS

SEQ ID NO: 31371 - protein, 7 aa, Artificial Sequence
  Description of Artificial Sequence: Synthetic peptide
DGSGQNQ

SEQ ID NO: 31372 - protein, 7 aa, Artificial Sequence
  Description of Artificial Sequence: Synthetic peptide
NGSGENQ

SEQ ID NO: 31373 - protein, 7 aa, Artificial Sequence
  Description of Artificial Sequence: Synthetic peptide
HAETNLR

SEQ ID NO: 31374 - protein, 7 aa, Artificial Sequence
  Description of Artificial Sequence: Synthetic peptide
NGSGQDQ

SEQ ID NO: 31375 - protein, 7 aa, Artificial Sequence
  Description of Artificial Sequence: Synthetic peptide
NGPGQNQ

SEQ ID NO: 31376 - protein, 7 aa, Artificial Sequence
  Description of Artificial Sequence: Synthetic peptide
QGTTARS

SEQ ID NO: 31377 - protein, 7 aa, Artificial Sequence
  Description of Artificial Sequence: Synthetic peptide
QPNSASH

SEQ ID NO: 31378 - protein, 7 aa, Artificial Sequence
  Description of Artificial Sequence: Synthetic peptide
NGSEQNQ

SEQ ID NO: 31379 - protein, 7 aa, Artificial Sequence
  Description of Artificial Sequence: Synthetic peptide
HGSGQNQ

SEQ ID NO: 31380 - protein, 7 aa, Artificial Sequence
  Description of Artificial Sequence: Synthetic peptide
VGPSKIQ

SEQ ID NO: 31381 - protein, 7 aa, Artificial Sequence
  Description of Artificial Sequence: Synthetic peptide
MKGNNLS

SEQ ID NO: 31382 - protein, 7 aa, Artificial Sequence
  Description of Artificial Sequence: Synthetic peptide
NGSGQNP

SEQ ID NO: 31383 - protein, 7 aa, Artificial Sequence
  Description of Artificial Sequence: Synthetic peptide
HNTAHAS

SEQ ID NO: 31384 - protein, 7 aa, Artificial Sequence
  Description of Artificial Sequence: Synthetic peptide
SKTGTSL

SEQ ID NO: 31385 - protein, 7 aa, Artificial Sequence
  Description of Artificial Sequence: Synthetic peptide
RPNSLID

SEQ ID NO: 31386 - protein, 7 aa, Artificial Sequence
  Description of Artificial Sequence: Synthetic peptide
NGYGQNQ

SEQ ID NO: 31387 - protein, 7 aa, Artificial Sequence
  Description of Artificial Sequence: Synthetic peptide
DAGSRSS

SEQ ID NO: 31388 - protein, 7 aa, Artificial Sequence
  Description of Artificial Sequence: Synthetic peptide
NGTGQNQ

SEQ ID NO: 31389 - protein, 7 aa, Artificial Sequence
  Description of Artificial Sequence: Synthetic peptide
GTDSKRH

SEQ ID NO: 31390 - protein, 7 aa, Artificial Sequence
  Description of Artificial Sequence: Synthetic peptide
TGQQTAT

SEQ ID NO: 31391 - protein, 7 aa, Artificial Sequence
  Description of Artificial Sequence: Synthetic peptide
NYSGAHT

SEQ ID NO: 31392 - protein, 7 aa, Artificial Sequence
  Description of Artificial Sequence: Synthetic peptide
NGSRQNQ

SEQ ID NO: 31393 - protein, 7 aa, Artificial Sequence
  Description of Artificial Sequence: Synthetic peptide
RSSDRSA

SEQ ID NO: 31394 - protein, 7 aa, Artificial Sequence
  Description of Artificial Sequence: Synthetic peptide
VGSGRAN

SEQ ID NO: 31395 - protein, 7 aa, Artificial Sequence
  Description of Artificial Sequence: Synthetic peptide
TSNMVGK

SEQ ID NO: 31396 - protein, 7 aa, Artificial Sequence
  Description of Artificial Sequence: Synthetic peptide
NGAGQNQ

SEQ ID NO: 31397 - protein, 7 aa, Artificial Sequence
  Description of Artificial Sequence: Synthetic peptide
NGSGQSQ

SEQ ID NO: 31398 - protein, 7 aa, Artificial Sequence
  Description of Artificial Sequence: Synthetic peptide
LATSGSA

SEQ ID NO: 31399 - protein, 7 aa, Artificial Sequence
  Description of Artificial Sequence: Synthetic peptide
ERHSGSK

SEQ ID NO: 31400 - protein, 7 aa, Artificial Sequence
  Description of Artificial Sequence: Synthetic peptide
SAHNRSV

SEQ ID NO: 31401 - protein, 7 aa, Artificial Sequence
  Description of Artificial Sequence: Synthetic peptide
GRLNTNG

SEQ ID NO: 31402 - protein, 7 aa, Artificial Sequence
  Description of Artificial Sequence: Synthetic peptide
PPSKPNT

SEQ ID NO: 31403 - protein, 7 aa, Artificial Sequence
  Description of Artificial Sequence: Synthetic peptide
HQSSSSS

SEQ ID NO: 31404 - protein, 7 aa, Artificial Sequence
  Description of Artificial Sequence: Synthetic peptide
PARDSKS

SEQ ID NO: 31405 - protein, 7 aa, Artificial Sequence
  Description of Artificial Sequence: Synthetic peptide
SVSGRHI

SEQ ID NO: 31406 - protein, 7 aa, Artificial Sequence
  Description of Artificial Sequence: Synthetic peptide
LAPGHGN

SEQ ID NO: 31407 - protein, 7 aa, Artificial Sequence
  Description of Artificial Sequence: Synthetic peptide
HGSKPYI

SEQ ID NO: 31408 - protein, 7 aa, Artificial Sequence
  Description of Artificial Sequence: Synthetic peptide
EVHAKNN

SEQ ID NO: 31409 - protein, 7 aa, Artificial Sequence
  Description of Artificial Sequence: Synthetic peptide
SRTNATA

SEQ ID NO: 31410 - protein, 7 aa, Artificial Sequence
  Description of Artificial Sequence: Synthetic peptide
VQPVKMS

SEQ ID NO: 31411 - protein, 7 aa, Artificial Sequence
  Description of Artificial Sequence: Synthetic peptide
STPMSNR

SEQ ID NO: 31412 - protein, 7 aa, Artificial Sequence
  Description of Artificial Sequence: Synthetic peptide
GSPGVLR

SEQ ID NO: 31413 - protein, 7 aa, Artificial Sequence
  Description of Artificial Sequence: Synthetic peptide
TGIERPM

SEQ ID NO: 31414 - protein, 7 aa, Artificial Sequence
  Description of Artificial Sequence: Synthetic peptide
ISKASTH

SEQ ID NO: 31415 - protein, 7 aa, Artificial Sequence
  Description of Artificial Sequence: Synthetic peptide
RTSTAPQ

SEQ ID NO: 31416 - protein, 7 aa, Artificial Sequence
  Description of Artificial Sequence: Synthetic peptide
REDTKMH

SEQ ID NO: 31417 - protein, 7 aa, Artificial Sequence
  Description of Artificial Sequence: Synthetic peptide
PAHLKHS

SEQ ID NO: 31418 - protein, 7 aa, Artificial Sequence
  Description of Artificial Sequence: Synthetic peptide
HTDTRAV

SEQ ID NO: 31419 - protein, 7 aa, Artificial Sequence
  Description of Artificial Sequence: Synthetic peptide
NNTQKNS

SEQ ID NO: 31420 - protein, 7 aa, Artificial Sequence
  Description of Artificial Sequence: Synthetic peptide
PLERTTK

SEQ ID NO: 31421 - protein, 7 aa, Artificial Sequence
  Description of Artificial Sequence: Synthetic peptide
GTAIPRS

SEQ ID NO: 31422 - protein, 7 aa, Artificial Sequence
  Description of Artificial Sequence: Synthetic peptide
NRVERAV

SEQ ID NO: 31423 - protein, 7 aa, Artificial Sequence
  Description of Artificial Sequence: Synthetic peptide
HHSTLQT

SEQ ID NO: 31424 - protein, 7 aa, Artificial Sequence
  Description of Artificial Sequence: Synthetic peptide
AGAGMYA

SEQ ID NO: 31425 - protein, 7 aa, Artificial Sequence
  Description of Artificial Sequence: Synthetic peptide
GTFQSGT

SEQ ID NO: 31426 - protein, 7 aa, Artificial Sequence
  Description of Artificial Sequence: Synthetic peptide
QGQNRTV

SEQ ID NO: 31427 - protein, 7 aa, Artificial Sequence
  Description of Artificial Sequence: Synthetic peptide
INLSHST

SEQ ID NO: 31428 - protein, 7 aa, Artificial Sequence
  Description of Artificial Sequence: Synthetic peptide
GHVSAMR

SEQ ID NO: 31429 - protein, 7 aa, Artificial Sequence
  Description of Artificial Sequence: Synthetic peptide
SLTTKAN

SEQ ID NO: 31430 - protein, 7 aa, Artificial Sequence
  Description of Artificial Sequence: Synthetic peptide
VNLSPNH

SEQ ID NO: 31431 - protein, 7 aa, Artificial Sequence
  Description of Artificial Sequence: Synthetic peptide
AVTSHAR

SEQ ID NO: 31432 - protein, 7 aa, Artificial Sequence
  Description of Artificial Sequence: Synthetic peptide
NMPMRSG

SEQ ID NO: 31433 - protein, 7 aa, Artificial Sequence
  Description of Artificial Sequence: Synthetic peptide
IRTNSTL

SEQ ID NO: 31434 - protein, 7 aa, Artificial Sequence
  Description of Artificial Sequence: Synthetic peptide
PSTERNR

SEQ ID NO: 31435 - protein, 7 aa, Artificial Sequence
  Description of Artificial Sequence: Synthetic peptide
RPVVAST

SEQ ID NO: 31436 - protein, 7 aa, Artificial Sequence
  Description of Artificial Sequence: Synthetic peptide
YGLPSSR

SEQ ID NO: 31437 - protein, 7 aa, Artificial Sequence
  Description of Artificial Sequence: Synthetic peptide
GSSPKLT

SEQ ID NO: 31438 - protein, 7 aa, Artificial Sequence
  Description of Artificial Sequence: Synthetic peptide
RDSTAAR

SEQ ID NO: 31439 - protein, 7 aa, Artificial Sequence
  Description of Artificial Sequence: Synthetic peptide
NCRPNTT

SEQ ID NO: 31440 - protein, 7 aa, Artificial Sequence
  Description of Artificial Sequence: Synthetic peptide
HPGKPAG

SEQ ID NO: 31441 - protein, 7 aa, Artificial Sequence
  Description of Artificial Sequence: Synthetic peptide
ESPNLHS

SEQ ID NO: 31442 - protein, 7 aa, Artificial Sequence
  Description of Artificial Sequence: Synthetic peptide
SIPSTVR

SEQ ID NO: 31443 - protein, 7 aa, Artificial Sequence
  Description of Artificial Sequence: Synthetic peptide
VRAASNP

SEQ ID NO: 31444 - protein, 7 aa, Artificial Sequence
  Description of Artificial Sequence: Synthetic peptide
MGSSVRS

SEQ ID NO: 31445 - protein, 7 aa, Artificial Sequence
  Description of Artificial Sequence: Synthetic peptide
SVLNRNG

SEQ ID NO: 31446 - protein, 7 aa, Artificial Sequence
  Description of Artificial Sequence: Synthetic peptide
DSRPRLA

SEQ ID NO: 31447 - protein, 7 aa, Artificial Sequence
  Description of Artificial Sequence: Synthetic peptide
GAGTSLH

SEQ ID NO: 31448 - protein, 7 aa, Artificial Sequence
  Description of Artificial Sequence: Synthetic peptide
QPSQGHS

SEQ ID NO: 31449 - protein, 7 aa, Artificial Sequence
  Description of Artificial Sequence: Synthetic peptide
ASTAINQ

SEQ ID NO: 31450 - protein, 7 aa, Artificial Sequence
  Description of Artificial Sequence: Synthetic peptide
NLASSSY

SEQ ID NO: 31451 - protein, 7 aa, Artificial Sequence
  Description of Artificial Sequence: Synthetic peptide
SKVTAQS

SEQ ID NO: 31452 - protein, 7 aa, Artificial Sequence
  Description of Artificial Sequence: Synthetic peptide
HMNRKLE

SEQ ID NO: 31453 - protein, 7 aa, Artificial Sequence
  Description of Artificial Sequence: Synthetic peptide
GARPVLQ

SEQ ID NO: 31454 - protein, 7 aa, Artificial Sequence
  Description of Artificial Sequence: Synthetic peptide
AAQPSLK

SEQ ID NO: 31455 - protein, 7 aa, Artificial Sequence
  Description of Artificial Sequence: Synthetic peptide
DYSETRR

SEQ ID NO: 31456 - protein, 7 aa, Artificial Sequence
  Description of Artificial Sequence: Synthetic peptide
NNSKSQI

SEQ ID NO: 31457 - protein, 7 aa, Artificial Sequence
  Description of Artificial Sequence: Synthetic peptide
PLPAHSP

SEQ ID NO: 31458 - protein, 7 aa, Artificial Sequence
  Description of Artificial Sequence: Synthetic peptide
SPVKGSV

SEQ ID NO: 31459 - protein, 7 aa, Artificial Sequence
  Description of Artificial Sequence: Synthetic peptide
FGSTKAS

SEQ ID NO: 31460 - protein, 7 aa, Artificial Sequence
  Description of Artificial Sequence: Synthetic peptide
PGSGSNN

SEQ ID NO: 31461 - protein, 7 aa, Artificial Sequence
  Description of Artificial Sequence: Synthetic peptide
CLGSNNL

SEQ ID NO: 31462 - protein, 7 aa, Artificial Sequence
  Description of Artificial Sequence: Synthetic peptide
NGSGHNQ

SEQ ID NO: 31463 - protein, 7 aa, Artificial Sequence
  Description of Artificial Sequence: Synthetic peptide
LNKSTLP

SEQ ID NO: 31464 - protein, 7 aa, Artificial Sequence
  Description of Artificial Sequence: Synthetic peptide
GAERILR

SEQ ID NO: 31465 - protein, 7 aa, Artificial Sequence
  Description of Artificial Sequence: Synthetic peptide
SPEKNMR

SEQ ID NO: 31466 - protein, 7 aa, Artificial Sequence
  Description of Artificial Sequence: Synthetic peptide
ESARIGS

SEQ ID NO: 31467 - protein, 7 aa, Artificial Sequence
  Description of Artificial Sequence: Synthetic peptide
AATNSFG

SEQ ID NO: 31468 - protein, 7 aa, Artificial Sequence
  Description of Artificial Sequence: Synthetic peptide
HMNRKLE

SEQ ID NO: 31469 - protein, 7 aa, Artificial Sequence
  Description of Artificial Sequence: Synthetic peptide
AAQPSLK

SEQ ID NO: 31470 - protein, 7 aa, Artificial Sequence
  Description of Artificial Sequence: Synthetic peptide
GARPVLQ

SEQ ID NO: 31471 - protein, 7 aa, Artificial Sequence
  Description of Artificial Sequence: Synthetic peptide
QVLSVAG

SEQ ID NO: 31472 - protein, 7 aa, Artificial Sequence
  Description of Artificial Sequence: Synthetic peptide
KLNKSQA

SEQ ID NO: 31473 - protein, 7 aa, Artificial Sequence
  Description of Artificial Sequence: Synthetic peptide
NNTQKNS

SEQ ID NO: 31474 - protein, 7 aa, Artificial Sequence
  Description of Artificial Sequence: Synthetic peptide
GGTNNLN

SEQ ID NO: 31475 - protein, 7 aa, Artificial Sequence
  Description of Artificial Sequence: Synthetic peptide
GLSPVLK

SEQ ID NO: 31476 - protein, 7 aa, Artificial Sequence
  Description of Artificial Sequence: Synthetic peptide
STTGGAS

SEQ ID NO: 31477 - protein, 7 aa, Artificial Sequence
  Description of Artificial Sequence: Synthetic peptide
NTQSYTS

SEQ ID NO: 31478 - protein, 7 aa, Artificial Sequence
  Description of Artificial Sequence: Synthetic peptide
ETTTPRK

SEQ ID NO: 31479 - protein, 7 aa, Artificial Sequence
  Description of Artificial Sequence: Synthetic peptide
YSQEVFR

SEQ ID NO: 31480 - protein, 7 aa, Artificial Sequence
  Description of Artificial Sequence: Synthetic peptide
IIQDTAR

SEQ ID NO: 31481 - protein, 7 aa, Artificial Sequence
  Description of Artificial Sequence: Synthetic peptide
YINSPSN

SEQ ID NO: 31482 - protein, 7 aa, Artificial Sequence
  Description of Artificial Sequence: Synthetic peptide
HITPATS

SEQ ID NO: 31483 - protein, 7 aa, Artificial Sequence
  Description of Artificial Sequence: Synthetic peptide
VKVDGQI

SEQ ID NO: 31484 - protein, 7 aa, Artificial Sequence
  Description of Artificial Sequence: Synthetic peptide
NSNGINN

SEQ ID NO: 31485 - protein, 7 aa, Artificial Sequence
  Description of Artificial Sequence: Synthetic peptide
SGAGSAG

SEQ ID NO: 31486 - protein, 7 aa, Artificial Sequence
  Description of Artificial Sequence: Synthetic peptide
PRQYQSD

SEQ ID NO: 31487 - protein, 7 aa, Artificial Sequence
  Description of Artificial Sequence: Synthetic peptide
STTNSKN

SEQ ID NO: 31488 - protein, 7 aa, Artificial Sequence
  Description of Artificial Sequence: Synthetic peptide
YSGGNMS

SEQ ID NO: 31489 - protein, 7 aa, Artificial Sequence
  Description of Artificial Sequence: Synthetic peptide
SIKSVTN

SEQ ID NO: 31490 - protein, 7 aa, Artificial Sequence
  Description of Artificial Sequence: Synthetic peptide
LSSTHMT

SEQ ID NO: 31491 - protein, 7 aa, Artificial Sequence
  Description of Artificial Sequence: Synthetic peptide
NSITRSS

SEQ ID NO: 31492 - protein, 7 aa, Artificial Sequence
  Description of Artificial Sequence: Synthetic peptide
DRVGSIY

SEQ ID NO: 31493 - protein, 7 aa, Artificial Sequence
  Description of Artificial Sequence: Synthetic peptide
PYNVSQN

SEQ ID NO: 31494 - protein, 7 aa, Artificial Sequence
  Description of Artificial Sequence: Synthetic peptide
NREKLSY

SEQ ID NO: 31495 - protein, 7 aa, Artificial Sequence
  Description of Artificial Sequence: Synthetic peptide
PGSVTGS

SEQ ID NO: 31496 - protein, 7 aa, Artificial Sequence
  Description of Artificial Sequence: Synthetic peptide
DRVLSQG

SEQ ID NO: 31497 - protein, 7 aa, Artificial Sequence
  Description of Artificial Sequence: Synthetic peptide
RTLNLNT

SEQ ID NO: 31498 - protein, 7 aa, Artificial Sequence
  Description of Artificial Sequence: Synthetic peptide
ARDDQRR

SEQ ID NO: 31499 - protein, 7 aa, Artificial Sequence
  Description of Artificial Sequence: Synthetic peptide
NYDSLKK

SEQ ID NO: 31500 - protein, 7 aa, Artificial Sequence
  Description of Artificial Sequence: Synthetic peptide
LSNQNNQ

SEQ ID NO: 31501 - protein, 7 aa, Artificial Sequence
  Description of Artificial Sequence: Synthetic peptide
SSGGNMS

SEQ ID NO: 31502 - protein, 7 aa, Artificial Sequence
  Description of Artificial Sequence: Synthetic peptide
YEKNSLM

SEQ ID NO: 31503 - protein, 7 aa, Artificial Sequence
  Description of Artificial Sequence: Synthetic peptide
STGSVSK

SEQ ID NO: 31504 - protein, 7 aa, Artificial Sequence
  Description of Artificial Sequence: Synthetic peptide
VSKSPST

SEQ ID NO: 31505 - protein, 7 aa, Artificial Sequence
  Description of Artificial Sequence: Synthetic peptide
IKLDKQI

SEQ ID NO: 31506 - protein, 7 aa, Artificial Sequence
  Description of Artificial Sequence: Synthetic peptide
YSDNKTT

SEQ ID NO: 31507 - protein, 7 aa, Artificial Sequence
  Description of Artificial Sequence: Synthetic peptide
PQNNQAH

SEQ ID NO: 31508 - protein, 7 aa, Artificial Sequence
  Description of Artificial Sequence: Synthetic peptide
TTYGGNR

SEQ ID NO: 31509 - protein, 7 aa, Artificial Sequence
  Description of Artificial Sequence: Synthetic peptide
SPAYDTR

SEQ ID NO: 31510 - protein, 7 aa, Artificial Sequence
  Description of Artificial Sequence: Synthetic peptide
NGAGQNQ

SEQ ID NO: 31511 - protein, 7 aa, Artificial Sequence
  Description of Artificial Sequence: Synthetic peptide
DLTNHTK

SEQ ID NO: 31512 - protein, 7 aa, Artificial Sequence
  Description of Artificial Sequence: Synthetic peptide
IRAKESA

SEQ ID NO: 31513 - protein, 7 aa, Artificial Sequence
  Description of Artificial Sequence: Synthetic peptide
GQIKNLG

SEQ ID NO: 31514 - protein, 7 aa, Artificial Sequence
  Description of Artificial Sequence: Synthetic peptide
IGSGQNQ

SEQ ID NO: 31515 - protein, 7 aa, Artificial Sequence
  Description of Artificial Sequence: Synthetic peptide
GTGNSNL

SEQ ID NO: 31516 - protein, 7 aa, Artificial Sequence
  Description of Artificial Sequence: Synthetic peptide
ASTPNNT

SEQ ID NO: 31517 - protein, 7 aa, Artificial Sequence
  Description of Artificial Sequence: Synthetic peptide
GIQPGSN

SEQ ID NO: 31518 - protein, 7 aa, Artificial Sequence
  Description of Artificial Sequence: Synthetic peptide
DSGSSTK

SEQ ID NO: 31519 - protein, 7 aa, Artificial Sequence
  Description of Artificial Sequence: Synthetic peptide
KTSLNTS

SEQ ID NO: 31520 - protein, 7 aa, Artificial Sequence
  Description of Artificial Sequence: Synthetic peptide
KQPDSTH

SEQ ID NO: 31521 - protein, 7 aa, Artificial Sequence
  Description of Artificial Sequence: Synthetic peptide
NMDGATR

SEQ ID NO: 31522 - protein, 7 aa, Artificial Sequence
  Description of Artificial Sequence: Synthetic peptide
KLSNDNL

SEQ ID NO: 31523 - protein, 7 aa, Artificial Sequence
  Description of Artificial Sequence: Synthetic peptide
MFQKQGN

SEQ ID NO: 31524 - protein, 7 aa, Artificial Sequence
  Description of Artificial Sequence: Synthetic peptide
RVDTITK

SEQ ID NO: 31525 - protein, 7 aa, Artificial Sequence
  Description of Artificial Sequence: Synthetic peptide
STSIPGM

SEQ ID NO: 31526 - protein, 7 aa, Artificial Sequence
  Description of Artificial Sequence: Synthetic peptide
KTDKTVD

SEQ ID NO: 31527 - protein, 7 aa, Artificial Sequence
  Description of Artificial Sequence: Synthetic peptide
SLYTNAV

SEQ ID NO: 31528 - protein, 7 aa, Artificial Sequence
  Description of Artificial Sequence: Synthetic peptide
MSHTNRP

SEQ ID NO: 31529 - protein, 7 aa, Artificial Sequence
  Description of Artificial Sequence: Synthetic peptide
SNSDRAN

SEQ ID NO: 31530 - protein, 7 aa, Artificial Sequence
  Description of Artificial Sequence: Synthetic peptide
HTSPGKN

SEQ ID NO: 31531 - protein, 7 aa, Artificial Sequence
  Description of Artificial Sequence: Synthetic peptide
EPLQGSR

SEQ ID NO: 31532 - protein, 7 aa, Artificial Sequence
  Description of Artificial Sequence: Synthetic peptide
PGNSHKI

SEQ ID NO: 31533 - protein, 7 aa, Artificial Sequence
  Description of Artificial Sequence: Synthetic peptide
SSPQAHN

SEQ ID NO: 31534 - protein, 7 aa, Artificial Sequence
  Description of Artificial Sequence: Synthetic peptide
TTDKKTE

SEQ ID NO: 31535 - protein, 7 aa, Artificial Sequence
  Description of Artificial Sequence: Synthetic peptide
AMSSNNG

SEQ ID NO: 31536 - protein, 7 aa, Artificial Sequence
  Description of Artificial Sequence: Synthetic peptide
SDSRNTN

SEQ ID NO: 31537 - protein, 7 aa, Artificial Sequence
  Description of Artificial Sequence: Synthetic peptide
FNMQRSQ

SEQ ID NO: 31538 - protein, 7 aa, Artificial Sequence
  Description of Artificial Sequence: Synthetic peptide
MALQPNR

SEQ ID NO: 31539 - protein, 7 aa, Artificial Sequence
  Description of Artificial Sequence: Synthetic peptide
NSEARLS

SEQ ID NO: 31540 - protein, 7 aa, Artificial Sequence
  Description of Artificial Sequence: Synthetic peptide
PSSPNSI

SEQ ID NO: 31541 - protein, 7 aa, Artificial Sequence
  Description of Artificial Sequence: Synthetic peptide
LINPAGS

SEQ ID NO: 31542 - protein, 7 aa, Artificial Sequence
  Description of Artificial Sequence: Synthetic peptide
EISRPAS

SEQ ID NO: 31543 - protein, 7 aa, Artificial Sequence
  Description of Artificial Sequence: Synthetic peptide
EVFSSQK

SEQ ID NO: 31544 - protein, 7 aa, Artificial Sequence
  Description of Artificial Sequence: Synthetic peptide
ESNSSRG

SEQ ID NO: 31545 - protein, 7 aa, Artificial Sequence
  Description of Artificial Sequence: Synthetic peptide
QLQPRVA

SEQ ID NO: 31546 - protein, 7 aa, Artificial Sequence
  Description of Artificial Sequence: Synthetic peptide
QSGPGVT

SEQ ID NO: 31547 - protein, 7 aa, Artificial Sequence
  Description of Artificial Sequence: Synthetic peptide
NSAAAMK

SEQ ID NO: 31548 - protein, 7 aa, Artificial Sequence
  Description of Artificial Sequence: Synthetic peptide
FPSVSTT

SEQ ID NO: 31549 - protein, 7 aa, Artificial Sequence
  Description of Artificial Sequence: Synthetic peptide
ENNSRAT

SEQ ID NO: 31550 - protein, 7 aa, Artificial Sequence
  Description of Artificial Sequence: Synthetic peptide
LPSGNTS

SEQ ID NO: 31551 - protein, 7 aa, Artificial Sequence
  Description of Artificial Sequence: Synthetic peptide
NKSNTFL

SEQ ID NO: 31552 - protein, 7 aa, Artificial Sequence
  Description of Artificial Sequence: Synthetic peptide
PGQSTSS

SEQ ID NO: 31553 - protein, 7 aa, Artificial Sequence
  Description of Artificial Sequence: Synthetic peptide
LSGHSPQ

SEQ ID NO: 31554 - protein, 7 aa, Artificial Sequence
  Description of Artificial Sequence: Synthetic peptide
SPLQSIV

SEQ ID NO: 31555 - protein, 7 aa, Artificial Sequence
  Description of Artificial Sequence: Synthetic peptide
RIAGPTV

SEQ ID NO: 31556 - protein, 7 aa, Artificial Sequence
  Description of Artificial Sequence: Synthetic peptide
GVEAMRN

SEQ ID NO: 31557 - protein, 7 aa, Artificial Sequence
  Description of Artificial Sequence: Synthetic peptide
QETRGNS

SEQ ID NO: 31558 - protein, 7 aa, Artificial Sequence
  Description of Artificial Sequence: Synthetic peptide
ARDERAF

SEQ ID NO: 31559 - protein, 7 aa, Artificial Sequence
  Description of Artificial Sequence: Synthetic peptide
YIDASAR

SEQ ID NO: 31560 - protein, 7 aa, Artificial Sequence
  Description of Artificial Sequence: Synthetic peptide
PSTGNSV

SEQ ID NO: 31561 - protein, 7 aa, Artificial Sequence
  Description of Artificial Sequence: Synthetic peptide
RITSSNQ

SEQ ID NO: 31562 - protein, 7 aa, Artificial Sequence
  Description of Artificial Sequence: Synthetic peptide
GRSMERS

SEQ ID NO: 31563 - protein, 7 aa, Artificial Sequence
  Description of Artificial Sequence: Synthetic peptide
VTRGLNV

SEQ ID NO: 31564 - protein, 7 aa, Artificial Sequence
  Description of Artificial Sequence: Synthetic peptide
FHANSTV

SEQ ID NO: 31565 - protein, 7 aa, Artificial Sequence
  Description of Artificial Sequence: Synthetic peptide
MPLKPHL

SEQ ID NO: 31566 - protein, 7 aa, Artificial Sequence
  Description of Artificial Sequence: Synthetic peptide
EATSSTK

SEQ ID NO: 31567 - protein, 7 aa, Artificial Sequence
  Description of Artificial Sequence: Synthetic peptide
INFSGTR

SEQ ID NO: 31568 - protein, 7 aa, Artificial Sequence
  Description of Artificial Sequence: Synthetic peptide
NPAHGLN

SEQ ID NO: 31569 - protein, 7 aa, Artificial Sequence
  Description of Artificial Sequence: Synthetic peptide
MGSSVRS

SEQ ID NO: 31570 - protein, 7 aa, Artificial Sequence
  Description of Artificial Sequence: Synthetic peptide
VSYARTE

SEQ ID NO: 31571 - protein, 7 aa, Artificial Sequence
  Description of Artificial Sequence: Synthetic peptide
QSEIVNK

SEQ ID NO: 31572 - protein, 7 aa, Artificial Sequence
  Description of Artificial Sequence: Synthetic peptide
YSNSRVG

SEQ ID NO: 31573 - protein, 7 aa, Artificial Sequence
  Description of Artificial Sequence: Synthetic peptide
VQRSSNQ

SEQ ID NO: 31574 - protein, 7 aa, Artificial Sequence
  Description of Artificial Sequence: Synthetic peptide
SYVGTTA

SEQ ID NO: 31575 - protein, 7 aa, Artificial Sequence
  Description of Artificial Sequence: Synthetic peptide
TSQTKIV

SEQ ID NO: 31576 - protein, 7 aa, Artificial Sequence
  Description of Artificial Sequence: Synthetic peptide
NREQLRD

SEQ ID NO: 31577 - protein, 7 aa, Artificial Sequence
  Description of Artificial Sequence: Synthetic peptide
QFPGTLR

SEQ ID NO: 31578 - protein, 7 aa, Artificial Sequence
  Description of Artificial Sequence: Synthetic peptide
ELMNKSK

SEQ ID NO: 31579 - protein, 7 aa, Artificial Sequence
  Description of Artificial Sequence: Synthetic peptide
IRTNSTL

SEQ ID NO: 31580 - protein, 7 aa, Artificial Sequence
  Description of Artificial Sequence: Synthetic peptide
EVTNAPK

SEQ ID NO: 31581 - protein, 7 aa, Artificial Sequence
  Description of Artificial Sequence: Synthetic peptide
QQSPRNG

SEQ ID NO: 31582 - protein, 7 aa, Artificial Sequence
  Description of Artificial Sequence: Synthetic peptide
HTSPPFT

SEQ ID NO: 31583 - protein, 7 aa, Artificial Sequence
  Description of Artificial Sequence: Synthetic peptide
GLGQQTN

SEQ ID NO: 31584 - protein, 7 aa, Artificial Sequence
  Description of Artificial Sequence: Synthetic peptide
NSYDPKR

SEQ ID NO: 31585 - protein, 7 aa, Artificial Sequence
  Description of Artificial Sequence: Synthetic peptide
DPRAQSH

SEQ ID NO: 31586 - protein, 7 aa, Artificial Sequence
  Description of Artificial Sequence: Synthetic peptide
HRDTNGK

SEQ ID NO: 31587 - protein, 7 aa, Artificial Sequence
  Description of Artificial Sequence: Synthetic peptide
NNLAGSK

SEQ ID NO: 31588 - protein, 7 aa, Artificial Sequence
  Description of Artificial Sequence: Synthetic peptide
RVSSPSN

SEQ ID NO: 31589 - protein, 7 aa, Artificial Sequence
  Description of Artificial Sequence: Synthetic peptide
IASSGMH

SEQ ID NO: 31590 - protein, 7 aa, Artificial Sequence
  Description of Artificial Sequence: Synthetic peptide
RATPLSG

SEQ ID NO: 31591 - protein, 7 aa, Artificial Sequence
  Description of Artificial Sequence: Synthetic peptide
NRVEHTQ

SEQ ID NO: 31592 - protein, 7 aa, Artificial Sequence
  Description of Artificial Sequence: Synthetic peptide
MLGSSNK

SEQ ID NO: 31593 - protein, 7 aa, Artificial Sequence
  Description of Artificial Sequence: Synthetic peptide
HGISNQS

SEQ ID NO: 31594 - protein, 7 aa, Artificial Sequence
  Description of Artificial Sequence: Synthetic peptide
ALSSQKG

SEQ ID NO: 31595 - protein, 7 aa, Artificial Sequence
  Description of Artificial Sequence: Synthetic peptide
TTASSPT

SEQ ID NO: 31596 - protein, 7 aa, Artificial Sequence
  Description of Artificial Sequence: Synthetic peptide
SLSTGSG

SEQ ID NO: 31597 - protein, 7 aa, Artificial Sequence
  Description of Artificial Sequence: Synthetic peptide
KPQGSLV

SEQ ID NO: 31598 - protein, 7 aa, Artificial Sequence
  Description of Artificial Sequence: Synthetic peptide
PHLPQSA

SEQ ID NO: 31599 - protein, 7 aa, Artificial Sequence
  Description of Artificial Sequence: Synthetic peptide
GELPDRR

SEQ ID NO: 31600 - protein, 7 aa, Artificial Sequence
  Description of Artificial Sequence: Synthetic peptide
SLGSGFQ

SEQ ID NO: 31601 - protein, 7 aa, Artificial Sequence
  Description of Artificial Sequence: Synthetic peptide
PNGAHVT

SEQ ID NO: 31602 - protein, 7 aa, Artificial Sequence
  Description of Artificial Sequence: Synthetic peptide
ATTSRIS

SEQ ID NO: 31603 - protein, 7 aa, Artificial Sequence
  Description of Artificial Sequence: Synthetic peptide
SKVTAQS

SEQ ID NO: 31604 - protein, 7 aa, Artificial Sequence
  Description of Artificial Sequence: Synthetic peptide
SNYKSSN

SEQ ID NO: 31605 - protein, 7 aa, Artificial Sequence
  Description of Artificial Sequence: Synthetic peptide
NFSNPTV

SEQ ID NO: 31606 - protein, 7 aa, Artificial Sequence
  Description of Artificial Sequence: Synthetic peptide
PGYGSNH

SEQ ID NO: 31607 - protein, 7 aa, Artificial Sequence
  Description of Artificial Sequence: Synthetic peptide
FQPRSST

SEQ ID NO: 31608 - protein, 7 aa, Artificial Sequence
  Description of Artificial Sequence: Synthetic peptide
GIREYNK

SEQ ID NO: 31609 - protein, 7 aa, Artificial Sequence
  Description of Artificial Sequence: Synthetic peptide
NNPKNAV

SEQ ID NO: 31610 - protein, 7 aa, Artificial Sequence
  Description of Artificial Sequence: Synthetic peptide
LPSNSIH

SEQ ID NO: 31611 - protein, 7 aa, Artificial Sequence
  Description of Artificial Sequence: Synthetic peptide
RPESSYS

SEQ ID NO: 31612 - protein, 7 aa, Artificial Sequence
  Description of Artificial Sequence: Synthetic peptide
NPSEKML

SEQ ID NO: 31613 - protein, 7 aa, Artificial Sequence
  Description of Artificial Sequence: Synthetic peptide
NGSRQNQ

SEQ ID NO: 31614 - protein, 7 aa, Artificial Sequence
  Description of Artificial Sequence: Synthetic peptide
YVTSSGG

SEQ ID NO: 31615 - protein, 7 aa, Artificial Sequence
  Description of Artificial Sequence: Synthetic peptide
YTASRME

SEQ ID NO: 31616 - protein, 7 aa, Artificial Sequence
  Description of Artificial Sequence: Synthetic peptide
LCASKCD

SEQ ID NO: 31617 - protein, 7 aa, Artificial Sequence
  Description of Artificial Sequence: Synthetic peptide
FSSASFT

SEQ ID NO: 31618 - protein, 7 aa, Artificial Sequence
  Description of Artificial Sequence: Synthetic peptide
LMSAATT

SEQ ID NO: 31619 - protein, 7 aa, Artificial Sequence
  Description of Artificial Sequence: Synthetic peptide
GLPTEKM

SEQ ID NO: 31620 - protein, 7 aa, Artificial Sequence
  Description of Artificial Sequence: Synthetic peptide
FVKTHSA

SEQ ID NO: 31621 - protein, 7 aa, Artificial Sequence
  Description of Artificial Sequence: Synthetic peptide
GSLDNRK

SEQ ID NO: 31622 - protein, 7 aa, Artificial Sequence
  Description of Artificial Sequence: Synthetic peptide
TGSSSSQ

SEQ ID NO: 31623 - protein, 7 aa, Artificial Sequence
  Description of Artificial Sequence: Synthetic peptide
NGATKNS

SEQ ID NO: 31624 - protein, 7 aa, Artificial Sequence
  Description of Artificial Sequence: Synthetic peptide
REDTKMH

SEQ ID NO: 31625 - protein, 7 aa, Artificial Sequence
  Description of Artificial Sequence: Synthetic peptide
RTASSLP

SEQ ID NO: 31626 - protein, 7 aa, Artificial Sequence
  Description of Artificial Sequence: Synthetic peptide
LRDTNMN

SEQ ID NO: 31627 - protein, 7 aa, Artificial Sequence
  Description of Artificial Sequence: Synthetic peptide
TQSHNLA

SEQ ID NO: 31628 - protein, 7 aa, Artificial Sequence
  Description of Artificial Sequence: Synthetic peptide
PFSEMQK

SEQ ID NO: 31629 - protein, 7 aa, Artificial Sequence
  Description of Artificial Sequence: Synthetic peptide
GKTGPNS

SEQ ID NO: 31630 - protein, 7 aa, Artificial Sequence
  Description of Artificial Sequence: Synthetic peptide
QEARVYS

SEQ ID NO: 31631 - protein, 7 aa, Artificial Sequence
  Description of Artificial Sequence: Synthetic peptide
VTTGGSK

SEQ ID NO: 31632 - protein, 7 aa, Artificial Sequence
  Description of Artificial Sequence: Synthetic peptide
TARGGPT

SEQ ID NO: 31633 - protein, 7 aa, Artificial Sequence
  Description of Artificial Sequence: Synthetic peptide
NLGNSLK

SEQ ID NO: 31634 - protein, 7 aa, Artificial Sequence
  Description of Artificial Sequence: Synthetic peptide
SVSSPRD

SEQ ID NO: 31635 - protein, 7 aa, Artificial Sequence
  Description of Artificial Sequence: Synthetic peptide
AMGSSLS

SEQ ID NO: 31636 - protein, 7 aa, Artificial Sequence
  Description of Artificial Sequence: Synthetic peptide
PGSGSKH

SEQ ID NO: 31637 - protein, 7 aa, Artificial Sequence
  Description of Artificial Sequence: Synthetic peptide
QPNASPT

SEQ ID NO: 31638 - protein, 7 aa, Artificial Sequence
  Description of Artificial Sequence: Synthetic peptide
VTQSSSK

SEQ ID NO: 31639 - protein, 7 aa, Artificial Sequence
  Description of Artificial Sequence: Synthetic peptide
AYPSGSS

SEQ ID NO: 31640 - protein, 7 aa, Artificial Sequence
  Description of Artificial Sequence: Synthetic peptide
FSSKTSP

SEQ ID NO: 31641 - protein, 7 aa, Artificial Sequence
  Description of Artificial Sequence: Synthetic peptide
PSHNPTN

SEQ ID NO: 31642 - protein, 7 aa, Artificial Sequence
  Description of Artificial Sequence: Synthetic peptide
TGSSKVG

SEQ ID NO: 31643 - protein, 7 aa, Artificial Sequence
  Description of Artificial Sequence: Synthetic peptide
VSGTKIE

SEQ ID NO: 31644 - protein, 7 aa, Artificial Sequence
  Description of Artificial Sequence: Synthetic peptide
SHSSPYK

SEQ ID NO: 31645 - protein, 7 aa, Artificial Sequence
  Description of Artificial Sequence: Synthetic peptide
QNQNSGR

SEQ ID NO: 31646 - protein, 7 aa, Artificial Sequence
  Description of Artificial Sequence: Synthetic peptide
GLHSVAK

SEQ ID NO: 31647 - protein, 7 aa, Artificial Sequence
  Description of Artificial Sequence: Synthetic peptide
SPTSPMN

SEQ ID NO: 31648 - protein, 7 aa, Artificial Sequence
  Description of Artificial Sequence: Synthetic peptide
SISDKLG

SEQ ID NO: 31649 - protein, 7 aa, Artificial Sequence
  Description of Artificial Sequence: Synthetic peptide
GPNPGNH

SEQ ID NO: 31650 - protein, 7 aa, Artificial Sequence
  Description of Artificial Sequence: Synthetic peptide
PSGSPVR

SEQ ID NO: 31651 - protein, 7 aa, Artificial Sequence
  Description of Artificial Sequence: Synthetic peptide
GITKNLA

SEQ ID NO: 31652 - protein, 7 aa, Artificial Sequence
  Description of Artificial Sequence: Synthetic peptide
AGSNSQG

SEQ ID NO: 31653 - protein, 7 aa, Artificial Sequence
  Description of Artificial Sequence: Synthetic peptide
PARSTLS

SEQ ID NO: 31654 - protein, 7 aa, Artificial Sequence
  Description of Artificial Sequence: Synthetic peptide
ESVRSSS

SEQ ID NO: 31655 - protein, 7 aa, Artificial Sequence
  Description of Artificial Sequence: Synthetic peptide
VNTSHTN

SEQ ID NO: 31656 - protein, 7 aa, Artificial Sequence
  Description of Artificial Sequence: Synthetic peptide
YNGGNRS

SEQ ID NO: 31657 - protein, 7 aa, Artificial Sequence
  Description of Artificial Sequence: Synthetic peptide
GDHNRLN

SEQ ID NO: 31658 - protein, 7 aa, Artificial Sequence
  Description of Artificial Sequence: Synthetic peptide
ARVGSIS

SEQ ID NO: 31659 - protein, 7 aa, Artificial Sequence
  Description of Artificial Sequence: Synthetic peptide
NNVGVRG

SEQ ID NO: 31660 - protein, 7 aa, Artificial Sequence
  Description of Artificial Sequence: Synthetic peptide
TGSGSNH

SEQ ID NO: 31661 - protein, 7 aa, Artificial Sequence
  Description of Artificial Sequence: Synthetic peptide
NGSTSSG

SEQ ID NO: 31662 - protein, 7 aa, Artificial Sequence
  Description of Artificial Sequence: Synthetic peptide
GVLGSKN

SEQ ID NO: 31663 - protein, 7 aa, Artificial Sequence
  Description of Artificial Sequence: Synthetic peptide
IVSGKLT

SEQ ID NO: 31664 - protein, 7 aa, Artificial Sequence
  Description of Artificial Sequence: Synthetic peptide
PSARMSG

SEQ ID NO: 31665 - protein, 7 aa, Artificial Sequence
  Description of Artificial Sequence: Synthetic peptide
FPVNGLS

SEQ ID NO: 31666 - protein, 7 aa, Artificial Sequence
  Description of Artificial Sequence: Synthetic peptide
QGPKNAD

SEQ ID NO: 31667 - protein, 7 aa, Artificial Sequence
  Description of Artificial Sequence: Synthetic peptide
QSNTSPT

SEQ ID NO: 31668 - protein, 7 aa, Artificial Sequence
  Description of Artificial Sequence: Synthetic peptide
AISPTYM

SEQ ID NO: 31669 - protein, 7 aa, Artificial Sequence
  Description of Artificial Sequence: Synthetic peptide
NPVAAAT

SEQ ID NO: 31670 - protein, 7 aa, Artificial Sequence
  Description of Artificial Sequence: Synthetic peptide
NSANKTP

SEQ ID NO: 31671 - protein, 7 aa, Artificial Sequence
  Description of Artificial Sequence: Synthetic peptide
HSVNGHS

SEQ ID NO: 31672 - protein, 7 aa, Artificial Sequence
  Description of Artificial Sequence: Synthetic peptide
AGVTTVN

SEQ ID NO: 31673 - protein, 7 aa, Artificial Sequence
  Description of Artificial Sequence: Synthetic peptide
NASGQNQ

SEQ ID NO: 31674 - protein, 7 aa, Artificial Sequence
  Description of Artificial Sequence: Synthetic peptide
NLSHSAG

SEQ ID NO: 31675 - protein, 7 aa, Artificial Sequence
  Description of Artificial Sequence: Synthetic peptide
HGQTGMI

SEQ ID NO: 31676 - protein, 7 aa, Artificial Sequence
  Description of Artificial Sequence: Synthetic peptide
WTVSRSG

SEQ ID NO: 31677 - protein, 7 aa, Artificial Sequence
  Description of Artificial Sequence: Synthetic peptide
SVSNTNT

SEQ ID NO: 31678 - protein, 7 aa, Artificial Sequence
  Description of Artificial Sequence: Synthetic peptide
QREQLLK

SEQ ID NO: 31679 - protein, 7 aa, Artificial Sequence
  Description of Artificial Sequence: Synthetic peptide
NAEPTSS

SEQ ID NO: 31680 - protein, 7 aa, Artificial Sequence
  Description of Artificial Sequence: Synthetic peptide
PRDTTGS

SEQ ID NO: 31681 - protein, 7 aa, Artificial Sequence
  Description of Artificial Sequence: Synthetic peptide
MSSRSSV

SEQ ID NO: 31682 - protein, 7 aa, Artificial Sequence
  Description of Artificial Sequence: Synthetic peptide
TQQNGRN

SEQ ID NO: 31683 - protein, 7 aa, Artificial Sequence
  Description of Artificial Sequence: Synthetic peptide
TTNNIQG

SEQ ID NO: 31684 - protein, 7 aa, Artificial Sequence
  Description of Artificial Sequence: Synthetic peptide
SQSNSFL

SEQ ID NO: 31685 - protein, 7 aa, Artificial Sequence
  Description of Artificial Sequence: Synthetic peptide
GPKSPGT

SEQ ID NO: 31686 - protein, 7 aa, Artificial Sequence
  Description of Artificial Sequence: Synthetic peptide
AGENKLS

SEQ ID NO: 31687 - protein, 7 aa, Artificial Sequence
  Description of Artificial Sequence: Synthetic peptide
TGERQSS

SEQ ID NO: 31688 - protein, 7 aa, Artificial Sequence
  Description of Artificial Sequence: Synthetic peptide
LHDGQTR

SEQ ID NO: 31689 - protein, 7 aa, Artificial Sequence
  Description of Artificial Sequence: Synthetic peptide
MLSGSRN

SEQ ID NO: 31690 - protein, 7 aa, Artificial Sequence
  Description of Artificial Sequence: Synthetic peptide
SFSPASN

SEQ ID NO: 31691 - protein, 7 aa, Artificial Sequence
  Description of Artificial Sequence: Synthetic peptide
TPITPMT

SEQ ID NO: 31692 - protein, 7 aa, Artificial Sequence
  Description of Artificial Sequence: Synthetic peptide
HQPHQNQ

SEQ ID NO: 31693 - protein, 7 aa, Artificial Sequence
  Description of Artificial Sequence: Synthetic peptide
ATNNGSK

SEQ ID NO: 31694 - protein, 7 aa, Artificial Sequence
  Description of Artificial Sequence: Synthetic peptide
NSISRVT

SEQ ID NO: 31695 - protein, 7 aa, Artificial Sequence
  Description of Artificial Sequence: Synthetic peptide
SNDSNKK

SEQ ID NO: 31696 - protein, 7 aa, Artificial Sequence
  Description of Artificial Sequence: Synthetic peptide
SPVKGSV

SEQ ID NO: 31697 - protein, 7 aa, Artificial Sequence
  Description of Artificial Sequence: Synthetic peptide
RSSNSDH

SEQ ID NO: 31698 - protein, 7 aa, Artificial Sequence
  Description of Artificial Sequence: Synthetic peptide
LQVNMAR

SEQ ID NO: 31699 - protein, 7 aa, Artificial Sequence
  Description of Artificial Sequence: Synthetic peptide
AGTGSSL

SEQ ID NO: 31700 - protein, 7 aa, Artificial Sequence
  Description of Artificial Sequence: Synthetic peptide
GSNLNST

SEQ ID NO: 31701 - protein, 7 aa, Artificial Sequence
  Description of Artificial Sequence: Synthetic peptide
PNHQSLT

SEQ ID NO: 31702 - protein, 7 aa, Artificial Sequence
  Description of Artificial Sequence: Synthetic peptide
TGSGQNQ

SEQ ID NO: 31703 - protein, 7 aa, Artificial Sequence
  Description of Artificial Sequence: Synthetic peptide
ETPNRSQ

SEQ ID NO: 31704 - protein, 7 aa, Artificial Sequence
  Description of Artificial Sequence: Synthetic peptide
NNSSGAQ

SEQ ID NO: 31705 - protein, 7 aa, Artificial Sequence
  Description of Artificial Sequence: Synthetic peptide
SSSGGVK

SEQ ID NO: 31706 - protein, 7 aa, Artificial Sequence
  Description of Artificial Sequence: Synthetic peptide
CTSKSSS

SEQ ID NO: 31707 - protein, 7 aa, Artificial Sequence
  Description of Artificial Sequence: Synthetic peptide
ISPVPLT

SEQ ID NO: 31708 - protein, 7 aa, Artificial Sequence
  Description of Artificial Sequence: Synthetic peptide
QRNVSVV

SEQ ID NO: 31709 - protein, 7 aa, Artificial Sequence
  Description of Artificial Sequence: Synthetic peptide
DFSEKRL

SEQ ID NO: 31710 - protein, 7 aa, Artificial Sequence
  Description of Artificial Sequence: Synthetic peptide
SRPGLSQ

SEQ ID NO: 31711 - protein, 7 aa, Artificial Sequence
  Description of Artificial Sequence: Synthetic peptide
YGSNTPT

SEQ ID NO: 31712 - protein, 7 aa, Artificial Sequence
  Description of Artificial Sequence: Synthetic peptide
RITLNSA

SEQ ID NO: 31713 - protein, 7 aa, Artificial Sequence
  Description of Artificial Sequence: Synthetic peptide
PLNTHQS

SEQ ID NO: 31714 - protein, 7 aa, Artificial Sequence
  Description of Artificial Sequence: Synthetic peptide
FRNTHSE

SEQ ID NO: 31715 - protein, 7 aa, Artificial Sequence
  Description of Artificial Sequence: Synthetic peptide
SSDQPRL

SEQ ID NO: 31716 - protein, 7 aa, Artificial Sequence
  Description of Artificial Sequence: Synthetic peptide
ELAAPSK

SEQ ID NO: 31717 - protein, 7 aa, Artificial Sequence
  Description of Artificial Sequence: Synthetic peptide
ATTKAGI

SEQ ID NO: 31718 - protein, 7 aa, Artificial Sequence
  Description of Artificial Sequence: Synthetic peptide
AEQRPGQ

SEQ ID NO: 31719 - protein, 7 aa, Artificial Sequence
  Description of Artificial Sequence: Synthetic peptide
GIDTKML

SEQ ID NO: 31720 - protein, 7 aa, Artificial Sequence
  Description of Artificial Sequence: Synthetic peptide
SPNKTSL

SEQ ID NO: 31721 - protein, 7 aa, Artificial Sequence
  Description of Artificial Sequence: Synthetic peptide
HTSSNSL

SEQ ID NO: 31722 - protein, 7 aa, Artificial Sequence
  Description of Artificial Sequence: Synthetic peptide
SQTVKTG

SEQ ID NO: 31723 - protein, 7 aa, Artificial Sequence
  Description of Artificial Sequence: Synthetic peptide
PNNQSTR

SEQ ID NO: 31724 - protein, 7 aa, Artificial Sequence
  Description of Artificial Sequence: Synthetic peptide
VNQSGFS

SEQ ID NO: 31725 - protein, 7 aa, Artificial Sequence
  Description of Artificial Sequence: Synthetic peptide
DGKSPRV

SEQ ID NO: 31726 - protein, 7 aa, Artificial Sequence
  Description of Artificial Sequence: Synthetic peptide
YVSNSNA

SEQ ID NO: 31727 - protein, 7 aa, Artificial Sequence
  Description of Artificial Sequence: Synthetic peptide
EYPQQAK

SEQ ID NO: 31728 - protein, 7 aa, Artificial Sequence
  Description of Artificial Sequence: Synthetic peptide
GVQTKLL

SEQ ID NO: 31729 - protein, 7 aa, Artificial Sequence
  Description of Artificial Sequence: Synthetic peptide
GQTGDMR

SEQ ID NO: 31730 - protein, 7 aa, Artificial Sequence
  Description of Artificial Sequence: Synthetic peptide
NGSGTNQ

SEQ ID NO: 31731 - protein, 7 aa, Artificial Sequence
  Description of Artificial Sequence: Synthetic peptide
RNVDKSS

SEQ ID NO: 31732 - protein, 7 aa, Artificial Sequence
  Description of Artificial Sequence: Synthetic peptide
RPYETQL

SEQ ID NO: 31733 - protein, 7 aa, Artificial Sequence
  Description of Artificial Sequence: Synthetic peptide
PARDSKS

SEQ ID NO: 31734 - protein, 7 aa, Artificial Sequence
  Description of Artificial Sequence: Synthetic peptide
YNRSERP

SEQ ID NO: 31735 - protein, 7 aa, Artificial Sequence
  Description of Artificial Sequence: Synthetic peptide
DQVSHKL

SEQ ID NO: 31736 - protein, 7 aa, Artificial Sequence
  Description of Artificial Sequence: Synthetic peptide
YIKSVTN

SEQ ID NO: 31737 - protein, 7 aa, Artificial Sequence
  Description of Artificial Sequence: Synthetic peptide
RSPGSNT

SEQ ID NO: 31738 - protein, 7 aa, Artificial Sequence
  Description of Artificial Sequence: Synthetic peptide
SFDSKPP

SEQ ID NO: 31739 - protein, 7 aa, Artificial Sequence
  Description of Artificial Sequence: Synthetic peptide
VNTTRAE

SEQ ID NO: 31740 - protein, 7 aa, Artificial Sequence
  Description of Artificial Sequence: Synthetic peptide
SMGNSIS

SEQ ID NO: 31741 - protein, 7 aa, Artificial Sequence
  Description of Artificial Sequence: Synthetic peptide
NGSGQNK

SEQ ID NO: 31742 - protein, 7 aa, Artificial Sequence
  Description of Artificial Sequence: Synthetic peptide
TGQQTAT

SEQ ID NO: 31743 - protein, 7 aa, Artificial Sequence
  Description of Artificial Sequence: Synthetic peptide
PSQTKPS

SEQ ID NO: 31744 - protein, 7 aa, Artificial Sequence
  Description of Artificial Sequence: Synthetic peptide
RLEGSMA

SEQ ID NO: 31745 - protein, 7 aa, Artificial Sequence
  Description of Artificial Sequence: Synthetic peptide
PTKANVT

SEQ ID NO: 31746 - protein, 7 aa, Artificial Sequence
  Description of Artificial Sequence: Synthetic peptide
GGSNLRT

SEQ ID NO: 31747 - protein, 7 aa, Artificial Sequence
  Description of Artificial Sequence: Synthetic peptide
GPSSINR

SEQ ID NO: 31748 - protein, 7 aa, Artificial Sequence
  Description of Artificial Sequence: Synthetic peptide
YSGSAGQ

SEQ ID NO: 31749 - protein, 7 aa, Artificial Sequence
  Description of Artificial Sequence: Synthetic peptide
GVPAGHT

SEQ ID NO: 31750 - protein, 7 aa, Artificial Sequence
  Description of Artificial Sequence: Synthetic peptide
PTSSPQR

SEQ ID NO: 31751 - protein, 7 aa, Artificial Sequence
  Description of Artificial Sequence: Synthetic peptide
CNNARVS

SEQ ID NO: 31752 - protein, 7 aa, Artificial Sequence
  Description of Artificial Sequence: Synthetic peptide
VFNRNAS

SEQ ID NO: 31753 - protein, 7 aa, Artificial Sequence
  Description of Artificial Sequence: Synthetic peptide
PTISVDR

SEQ ID NO: 31754 - protein, 7 aa, Artificial Sequence
  Description of Artificial Sequence: Synthetic peptide
PGSGSNH

SEQ ID NO: 31755 - protein, 7 aa, Artificial Sequence
  Description of Artificial Sequence: Synthetic peptide
GPAVTNR

SEQ ID NO: 31756 - protein, 7 aa, Artificial Sequence
  Description of Artificial Sequence: Synthetic peptide
MRQDTSK

SEQ ID NO: 31757 - protein, 7 aa, Artificial Sequence
  Description of Artificial Sequence: Synthetic peptide
YTSKSTA

SEQ ID NO: 31758 - protein, 7 aa, Artificial Sequence
  Description of Artificial Sequence: Synthetic peptide
NVNSQML

SEQ ID NO: 31759 - protein, 7 aa, Artificial Sequence
  Description of Artificial Sequence: Synthetic peptide
NPRGTTL

SEQ ID NO: 31760 - protein, 7 aa, Artificial Sequence
  Description of Artificial Sequence: Synthetic peptide
MSSTRSI

SEQ ID NO: 31761 - protein, 7 aa, Artificial Sequence
  Description of Artificial Sequence: Synthetic peptide
PSTSSAG

SEQ ID NO: 31762 - protein, 7 aa, Artificial Sequence
  Description of Artificial Sequence: Synthetic peptide
VPVTKSS

SEQ ID NO: 31763 - protein, 7 aa, Artificial Sequence
  Description of Artificial Sequence: Synthetic peptide
PGINTNS

SEQ ID NO: 31764 - protein, 7 aa, Artificial Sequence
  Description of Artificial Sequence: Synthetic peptide
RSNGSAA

SEQ ID NO: 31765 - protein, 7 aa, Artificial Sequence
  Description of Artificial Sequence: Synthetic peptide
ERAGLNS

SEQ ID NO: 31766 - protein, 7 aa, Artificial Sequence
  Description of Artificial Sequence: Synthetic peptide
ERYTTSK

SEQ ID NO: 31767 - protein, 7 aa, Artificial Sequence
  Description of Artificial Sequence: Synthetic peptide
LRNSTSV

SEQ ID NO: 31768 - protein, 7 aa, Artificial Sequence
  Description of Artificial Sequence: Synthetic peptide
GDMGISK

SEQ ID NO: 31769 - protein, 7 aa, Artificial Sequence
  Description of Artificial Sequence: Synthetic peptide
NLNSVSK

SEQ ID NO: 31770 - protein, 7 aa, Artificial Sequence
  Description of Artificial Sequence: Synthetic peptide
PPTLEQS

SEQ ID NO: 31771 - protein, 7 aa, Artificial Sequence
  Description of Artificial Sequence: Synthetic peptide
YRLDHSR

SEQ ID NO: 31772 - protein, 7 aa, Artificial Sequence
  Description of Artificial Sequence: Synthetic peptide
RNNPTTV

SEQ ID NO: 31773 - protein, 7 aa, Artificial Sequence
  Description of Artificial Sequence: Synthetic peptide
SFSGANK

SEQ ID NO: 31774 - protein, 7 aa, Artificial Sequence
  Description of Artificial Sequence: Synthetic peptide
HVSHGPG

SEQ ID NO: 31775 - protein, 7 aa, Artificial Sequence
  Description of Artificial Sequence: Synthetic peptide
PYKGNGL

SEQ ID NO: 31776 - protein, 7 aa, Artificial Sequence
  Description of Artificial Sequence: Synthetic peptide
LVSSKSS

SEQ ID NO: 31777 - protein, 7 aa, Artificial Sequence
  Description of Artificial Sequence: Synthetic peptide
GSAGNML

SEQ ID NO: 31778 - protein, 7 aa, Artificial Sequence
  Description of Artificial Sequence: Synthetic peptide
NTTGHAG

SEQ ID NO: 31779 - protein, 7 aa, Artificial Sequence
  Description of Artificial Sequence: Synthetic peptide
NPVALRD

SEQ ID NO: 31780 - protein, 7 aa, Artificial Sequence
  Description of Artificial Sequence: Synthetic peptide
SVSTKSA

SEQ ID NO: 31781 - protein, 7 aa, Artificial Sequence
  Description of Artificial Sequence: Synthetic peptide
RTLSASS

SEQ ID NO: 31782 - protein, 7 aa, Artificial Sequence
  Description of Artificial Sequence: Synthetic peptide
TGSGRLL

SEQ ID NO: 31783 - protein, 7 aa, Artificial Sequence
  Description of Artificial Sequence: Synthetic peptide
VGGGRDN

SEQ ID NO: 31784 - protein, 7 aa, Artificial Sequence
  Description of Artificial Sequence: Synthetic peptide
STSTVHS

SEQ ID NO: 31785 - protein, 7 aa, Artificial Sequence
  Description of Artificial Sequence: Synthetic peptide
PLINRTM

SEQ ID NO: 31786 - protein, 7 aa, Artificial Sequence
  Description of Artificial Sequence: Synthetic peptide
HQGNVIS

SEQ ID NO: 31787 - protein, 7 aa, Artificial Sequence
  Description of Artificial Sequence: Synthetic peptide
SQVSHSV

SEQ ID NO: 31788 - protein, 7 aa, Artificial Sequence
  Description of Artificial Sequence: Synthetic peptide
SVTSPNK

SEQ ID NO: 31789 - protein, 7 aa, Artificial Sequence
  Description of Artificial Sequence: Synthetic peptide
PSRASIT

SEQ ID NO: 31790 - protein, 7 aa, Artificial Sequence
  Description of Artificial Sequence: Synthetic peptide
SKDRSTV

SEQ ID NO: 31791 - protein, 7 aa, Artificial Sequence
  Description of Artificial Sequence: Synthetic peptide
QTSATQR

SEQ ID NO: 31792 - protein, 7 aa, Artificial Sequence
  Description of Artificial Sequence: Synthetic peptide
SSSPNVK

SEQ ID NO: 31793 - protein, 7 aa, Artificial Sequence
  Description of Artificial Sequence: Synthetic peptide
YSGLTGS

SEQ ID NO: 31794 - protein, 7 aa, Artificial Sequence
  Description of Artificial Sequence: Synthetic peptide
LGPGKNT

SEQ ID NO: 31795 - protein, 7 aa, Artificial Sequence
  Description of Artificial Sequence: Synthetic peptide
QTGTSST

SEQ ID NO: 31796 - protein, 7 aa, Artificial Sequence
  Description of Artificial Sequence: Synthetic peptide
PISHTTG

SEQ ID NO: 31797 - protein, 7 aa, Artificial Sequence
  Description of Artificial Sequence: Synthetic peptide
AQTKGTQ

SEQ ID NO: 31798 - protein, 7 aa, Artificial Sequence
  Description of Artificial Sequence: Synthetic peptide
VLAGSNT

SEQ ID NO: 31799 - protein, 7 aa, Artificial Sequence
  Description of Artificial Sequence: Synthetic peptide
QLSGARS

SEQ ID NO: 31800 - protein, 7 aa, Artificial Sequence
  Description of Artificial Sequence: Synthetic peptide
PGDRGKV

SEQ ID NO: 31801 - protein, 7 aa, Artificial Sequence
  Description of Artificial Sequence: Synthetic peptide
SFTKGAG

SEQ ID NO: 31802 - protein, 7 aa, Artificial Sequence
  Description of Artificial Sequence: Synthetic peptide
PSGETSK

SEQ ID NO: 31803 - protein, 7 aa, Artificial Sequence
  Description of Artificial Sequence: Synthetic peptide
PRNMEEM

SEQ ID NO: 31804 - protein, 7 aa, Artificial Sequence
  Description of Artificial Sequence: Synthetic peptide
GPSQHVI

SEQ ID NO: 31805 - protein, 7 aa, Artificial Sequence
  Description of Artificial Sequence: Synthetic peptide
SKTGTSL

SEQ ID NO: 31806 - protein, 7 aa, Artificial Sequence
  Description of Artificial Sequence: Synthetic peptide
MLNTSHY

SEQ ID NO: 31807 - protein, 7 aa, Artificial Sequence
  Description of Artificial Sequence: Synthetic peptide
RSGTSHS

SEQ ID NO: 31808 - protein, 7 aa, Artificial Sequence
  Description of Artificial Sequence: Synthetic peptide
RAEINTR

SEQ ID NO: 31809 - protein, 7 aa, Artificial Sequence
  Description of Artificial Sequence: Synthetic peptide
SASNVSR

SEQ ID NO: 31810 - protein, 7 aa, Artificial Sequence
  Description of Artificial Sequence: Synthetic peptide
MEIKPNR

SEQ ID NO: 31811 - protein, 7 aa, Artificial Sequence
  Description of Artificial Sequence: Synthetic peptide
LSMNTSK

SEQ ID NO: 31812 - protein, 7 aa, Artificial Sequence
  Description of Artificial Sequence: Synthetic peptide
YQNKSLT

SEQ ID NO: 31813 - protein, 7 aa, Artificial Sequence
  Description of Artificial Sequence: Synthetic peptide
RSTQSSP

SEQ ID NO: 31814 - protein, 7 aa, Artificial Sequence
  Description of Artificial Sequence: Synthetic peptide
QVGRPNA

SEQ ID NO: 31815 - protein, 7 aa, Artificial Sequence
  Description of Artificial Sequence: Synthetic peptide
STNMAVV

SEQ ID NO: 31816 - protein, 7 aa, Artificial Sequence
  Description of Artificial Sequence: Synthetic peptide
STPMSNR

SEQ ID NO: 31817 - protein, 7 aa, Artificial Sequence
  Description of Artificial Sequence: Synthetic peptide
SRVTSGG

SEQ ID NO: 31818 - protein, 7 aa, Artificial Sequence
  Description of Artificial Sequence: Synthetic peptide
ATVSKTA

SEQ ID NO: 31819 - protein, 7 aa, Artificial Sequence
  Description of Artificial Sequence: Synthetic peptide
TTSNKDS

SEQ ID NO: 31820 - protein, 7 aa, Artificial Sequence
  Description of Artificial Sequence: Synthetic peptide
NVTTPLI

SEQ ID NO: 31821 - protein, 7 aa, Artificial Sequence
  Description of Artificial Sequence: Synthetic peptide
HNTAHAS

SEQ ID NO: 31822 - protein, 7 aa, Artificial Sequence
  Description of Artificial Sequence: Synthetic peptide
NSNTRGP

SEQ ID NO: 31823 - protein, 7 aa, Artificial Sequence
  Description of Artificial Sequence: Synthetic peptide
QVSPASR

SEQ ID NO: 31824 - protein, 7 aa, Artificial Sequence
  Description of Artificial Sequence: Synthetic peptide
YSGGTQQ

SEQ ID NO: 31825 - protein, 7 aa, Artificial Sequence
  Description of Artificial Sequence: Synthetic peptide
ATNHSPQ

SEQ ID NO: 31826 - protein, 7 aa, Artificial Sequence
  Description of Artificial Sequence: Synthetic peptide
PNNATKN

SEQ ID NO: 31827 - protein, 7 aa, Artificial Sequence
  Description of Artificial Sequence: Synthetic peptide
SSASTYK

SEQ ID NO: 31828 - protein, 7 aa, Artificial Sequence
  Description of Artificial Sequence: Synthetic peptide
PVGSVRG

SEQ ID NO: 31829 - protein, 7 aa, Artificial Sequence
  Description of Artificial Sequence: Synthetic peptide
SPARASL

SEQ ID NO: 31830 - protein, 7 aa, Artificial Sequence
  Description of Artificial Sequence: Synthetic peptide
STPHHTT

SEQ ID NO: 31831 - protein, 7 aa, Artificial Sequence
  Description of Artificial Sequence: Synthetic peptide
PVTRSKD

SEQ ID NO: 31832 - protein, 7 aa, Artificial Sequence
  Description of Artificial Sequence: Synthetic peptide
PTRTASN

SEQ ID NO: 31833 - protein, 7 aa, Artificial Sequence
  Description of Artificial Sequence: Synthetic peptide
SPNSHPS

SEQ ID NO: 31834 - protein, 7 aa, Artificial Sequence
  Description of Artificial Sequence: Synthetic peptide
QRTSDQT

SEQ ID NO: 31835 - protein, 7 aa, Artificial Sequence
  Description of Artificial Sequence: Synthetic peptide
NTRSSSG

SEQ ID NO: 31836 - protein, 7 aa, Artificial Sequence
  Description of Artificial Sequence: Synthetic peptide
DRHNTTS

SEQ ID NO: 31837 - protein, 7 aa, Artificial Sequence
  Description of Artificial Sequence: Synthetic peptide
NGFNSNN

SEQ ID NO: 31838 - protein, 7 aa, Artificial Sequence
  Description of Artificial Sequence: Synthetic peptide
NPVNTKS

SEQ ID NO: 31839 - protein, 7 aa, Artificial Sequence
  Description of Artificial Sequence: Synthetic peptide
MMNRSAS

SEQ ID NO: 31840 - protein, 7 aa, Artificial Sequence
  Description of Artificial Sequence: Synthetic peptide
TSRQSFV

SEQ ID NO: 31841 - protein, 7 aa, Artificial Sequence
  Description of Artificial Sequence: Synthetic peptide
TQDHHVK

SEQ ID NO: 31842 - protein, 7 aa, Artificial Sequence
  Description of Artificial Sequence: Synthetic peptide
ATHNSSQ

SEQ ID NO: 31843 - protein, 7 aa, Artificial Sequence
  Description of Artificial Sequence: Synthetic peptide
LPQGSIS

SEQ ID NO: 31844 - protein, 7 aa, Artificial Sequence
  Description of Artificial Sequence: Synthetic peptide
LLTSPNS

SEQ ID NO: 31845 - protein, 7 aa, Artificial Sequence
  Description of Artificial Sequence: Synthetic peptide
NSSHNVS

SEQ ID NO: 31846 - protein, 7 aa, Artificial Sequence
  Description of Artificial Sequence: Synthetic peptide
CLTDARA

SEQ ID NO: 31847 - protein, 7 aa, Artificial Sequence
  Description of Artificial Sequence: Synthetic peptide
PQSSHQT

SEQ ID NO: 31848 - protein, 7 aa, Artificial Sequence
  Description of Artificial Sequence: Synthetic peptide
LHADQHS

SEQ ID NO: 31849 - protein, 7 aa, Artificial Sequence
  Description of Artificial Sequence: Synthetic peptide
RQLPSGL

SEQ ID NO: 31850 - protein, 7 aa, Artificial Sequence
  Description of Artificial Sequence: Synthetic peptide
SSEQTTR

SEQ ID NO: 31851 - protein, 7 aa, Artificial Sequence
  Description of Artificial Sequence: Synthetic peptide
TVGTTTI

SEQ ID NO: 31852 - protein, 7 aa, Artificial Sequence
  Description of Artificial Sequence: Synthetic peptide
LVQGGVN

SEQ ID NO: 31853 - protein, 7 aa, Artificial Sequence
  Description of Artificial Sequence: Synthetic peptide
GQSGSRL

SEQ ID NO: 31854 - protein, 7 aa, Artificial Sequence
  Description of Artificial Sequence: Synthetic peptide
DTITSRG

SEQ ID NO: 31855 - protein, 7 aa, Artificial Sequence
  Description of Artificial Sequence: Synthetic peptide
SSGSNRS

SEQ ID NO: 31856 - protein, 7 aa, Artificial Sequence
  Description of Artificial Sequence: Synthetic peptide
NSGKPNA

SEQ ID NO: 31857 - protein, 7 aa, Artificial Sequence
  Description of Artificial Sequence: Synthetic peptide
GNTKNGI

SEQ ID NO: 31858 - protein, 7 aa, Artificial Sequence
  Description of Artificial Sequence: Synthetic peptide
ITGSLSK

SEQ ID NO: 31859 - protein, 7 aa, Artificial Sequence
  Description of Artificial Sequence: Synthetic peptide
SANTRIA

SEQ ID NO: 31860 - protein, 7 aa, Artificial Sequence
  Description of Artificial Sequence: Synthetic peptide
SNETKSS

SEQ ID NO: 31861 - protein, 7 aa, Artificial Sequence
  Description of Artificial Sequence: Synthetic peptide
YSMRPTE

SEQ ID NO: 31862 - protein, 7 aa, Artificial Sequence
  Description of Artificial Sequence: Synthetic peptide
GHDGQSR

SEQ ID NO: 31863 - protein, 7 aa, Artificial Sequence
  Description of Artificial Sequence: Synthetic peptide
NANSRPV

SEQ ID NO: 31864 - protein, 7 aa, Artificial Sequence
  Description of Artificial Sequence: Synthetic peptide
STVGHMT

SEQ ID NO: 31865 - protein, 7 aa, Artificial Sequence
  Description of Artificial Sequence: Synthetic peptide
HANSPAT

SEQ ID NO: 31866 - protein, 7 aa, Artificial Sequence
  Description of Artificial Sequence: Synthetic peptide
HDSRSNA

SEQ ID NO: 31867 - protein, 7 aa, Artificial Sequence
  Description of Artificial Sequence: Synthetic peptide
GTPNTKV

SEQ ID NO: 31868 - protein, 7 aa, Artificial Sequence
  Description of Artificial Sequence: Synthetic peptide
AGSKTTS

SEQ ID NO: 31869 - protein, 7 aa, Artificial Sequence
  Description of Artificial Sequence: Synthetic peptide
LSSGRGG

SEQ ID NO: 31870 - protein, 7 aa, Artificial Sequence
  Description of Artificial Sequence: Synthetic peptide
TNPNPHR

SEQ ID NO: 31871 - protein, 7 aa, Artificial Sequence
  Description of Artificial Sequence: Synthetic peptide
VVPERSK

SEQ ID NO: 31872 - protein, 7 aa, Artificial Sequence
  Description of Artificial Sequence: Synthetic peptide
QVTGASH

SEQ ID NO: 31873 - protein, 7 aa, Artificial Sequence
  Description of Artificial Sequence: Synthetic peptide
AAQPSLK

SEQ ID NO: 31874 - protein, 7 aa, Artificial Sequence
  Description of Artificial Sequence: Synthetic peptide
HMNRKLE

SEQ ID NO: 31875 - protein, 7 aa, Artificial Sequence
  Description of Artificial Sequence: Synthetic peptide
LSSDKNV

SEQ ID NO: 31876 - protein, 7 aa, Artificial Sequence
  Description of Artificial Sequence: Synthetic peptide
PGTGSNH

SEQ ID NO: 31877 - protein, 7 aa, Artificial Sequence
  Description of Artificial Sequence: Synthetic peptide
NSNGLNN

SEQ ID NO: 31878 - protein, 7 aa, Artificial Sequence
  Description of Artificial Sequence: Synthetic peptide
GARPVLQ

SEQ ID NO: 31879 - protein, 7 aa, Artificial Sequence
  Description of Artificial Sequence: Synthetic peptide
FPVNAGA

SEQ ID NO: 31880 - protein, 7 aa, Artificial Sequence
  Description of Artificial Sequence: Synthetic peptide
DNMSTPK

SEQ ID NO: 31881 - protein, 7 aa, Artificial Sequence
  Description of Artificial Sequence: Synthetic peptide
LLDQPRN

SEQ ID NO: 31882 - protein, 7 aa, Artificial Sequence
  Description of Artificial Sequence: Synthetic peptide
GLSPVLK

SEQ ID NO: 31883 - protein, 7 aa, Artificial Sequence
  Description of Artificial Sequence: Synthetic peptide
PSSPNSI

SEQ ID NO: 31884 - protein, 7 aa, Artificial Sequence
  Description of Artificial Sequence: Synthetic peptide
VLAGSNT

SEQ ID NO: 31885 - protein, 7 aa, Artificial Sequence
  Description of Artificial Sequence: Synthetic peptide
YSRVQSE

SEQ ID NO: 31886 - protein, 7 aa, Artificial Sequence
  Description of Artificial Sequence: Synthetic peptide
RPYETQL

SEQ ID NO: 31887 - protein, 7 aa, Artificial Sequence
  Description of Artificial Sequence: Synthetic peptide
YGQTKTQ

SEQ ID NO: 31888 - protein, 7 aa, Artificial Sequence
  Description of Artificial Sequence: Synthetic peptide
SITGNRT

SEQ ID NO: 31889 - protein, 7 aa, Artificial Sequence
  Description of Artificial Sequence: Synthetic peptide
SKFSETK

SEQ ID NO: 31890 - protein, 7 aa, Artificial Sequence
  Description of Artificial Sequence: Synthetic peptide
HRVDNQG

SEQ ID NO: 31891 - protein, 7 aa, Artificial Sequence
  Description of Artificial Sequence: Synthetic peptide
KPQGSLV

SEQ ID NO: 31892 - protein, 7 aa, Artificial Sequence
  Description of Artificial Sequence: Synthetic peptide
SGRQDVL

SEQ ID NO: 31893 - protein, 7 aa, Artificial Sequence
  Description of Artificial Sequence: Synthetic peptide
PSTQSSS

SEQ ID NO: 31894 - protein, 7 aa, Artificial Sequence
  Description of Artificial Sequence: Synthetic peptide
SGSNTIG

SEQ ID NO: 31895 - protein, 7 aa, Artificial Sequence
  Description of Artificial Sequence: Synthetic peptide
GTNTGIV

SEQ ID NO: 31896 - protein, 7 aa, Artificial Sequence
  Description of Artificial Sequence: Synthetic peptide
GPHTAVG

SEQ ID NO: 31897 - protein, 7 aa, Artificial Sequence
  Description of Artificial Sequence: Synthetic peptide
FSNNGSH

SEQ ID NO: 31898 - protein, 7 aa, Artificial Sequence
  Description of Artificial Sequence: Synthetic peptide
NSSHNVS

SEQ ID NO: 31899 - protein, 7 aa, Artificial Sequence
  Description of Artificial Sequence: Synthetic peptide
RITSSNQ

SEQ ID NO: 31900 - protein, 7 aa, Artificial Sequence
  Description of Artificial Sequence: Synthetic peptide
MGGHTHT

SEQ ID NO: 31901 - protein, 7 aa, Artificial Sequence
  Description of Artificial Sequence: Synthetic peptide
LPQGSIS

SEQ ID NO: 31902 - protein, 7 aa, Artificial Sequence
  Description of Artificial Sequence: Synthetic peptide
GDTRLNA

SEQ ID NO: 31903 - protein, 7 aa, Artificial Sequence
  Description of Artificial Sequence: Synthetic peptide
LRNSTSV

SEQ ID NO: 31904 - protein, 7 aa, Artificial Sequence
  Description of Artificial Sequence: Synthetic peptide
RESSPSL

SEQ ID NO: 31905 - protein, 7 aa, Artificial Sequence
  Description of Artificial Sequence: Synthetic peptide
IGQSTNG

SEQ ID NO: 31906 - protein, 7 aa, Artificial Sequence
  Description of Artificial Sequence: Synthetic peptide
VVPERSK

SEQ ID NO: 31907 - protein, 7 aa, Artificial Sequence
  Description of Artificial Sequence: Synthetic peptide
NFSNPTV

SEQ ID NO: 31908 - protein, 7 aa, Artificial Sequence
  Description of Artificial Sequence: Synthetic peptide
ITPSNIG

SEQ ID NO: 31909 - protein, 7 aa, Artificial Sequence
  Description of Artificial Sequence: Synthetic peptide
PNNQSTR

SEQ ID NO: 31910 - protein, 7 aa, Artificial Sequence
  Description of Artificial Sequence: Synthetic peptide
GRAQLAS

SEQ ID NO: 31911 - protein, 7 aa, Artificial Sequence
  Description of Artificial Sequence: Synthetic peptide
SSTPRSV

SEQ ID NO: 31912 - protein, 7 aa, Artificial Sequence
  Description of Artificial Sequence: Synthetic peptide
ERPGGTP

SEQ ID NO: 31913 - protein, 7 aa, Artificial Sequence
  Description of Artificial Sequence: Synthetic peptide
AGENKLS

SEQ ID NO: 31914 - protein, 7 aa, Artificial Sequence
  Description of Artificial Sequence: Synthetic peptide
CQPRSAN

SEQ ID NO: 31915 - protein, 7 aa, Artificial Sequence
  Description of Artificial Sequence: Synthetic peptide
QVPTRSD

SEQ ID NO: 31916 - protein, 7 aa, Artificial Sequence
  Description of Artificial Sequence: Synthetic peptide
DHRNTVR

SEQ ID NO: 31917 - protein, 7 aa, Artificial Sequence
  Description of Artificial Sequence: Synthetic peptide
ESNRSQV

SEQ ID NO: 31918 - protein, 7 aa, Artificial Sequence
  Description of Artificial Sequence: Synthetic peptide
LMQTHGS

SEQ ID NO: 31919 - protein, 7 aa, Artificial Sequence
  Description of Artificial Sequence: Synthetic peptide
STTGDSK

SEQ ID NO: 31920 - protein, 7 aa, Artificial Sequence
  Description of Artificial Sequence: Synthetic peptide
PVSTHSS

SEQ ID NO: 31921 - protein, 7 aa, Artificial Sequence
  Description of Artificial Sequence: Synthetic peptide
NEARSAN

SEQ ID NO: 31922 - protein, 7 aa, Artificial Sequence
  Description of Artificial Sequence: Synthetic peptide
AYPKNSN

SEQ ID NO: 31923 - protein, 7 aa, Artificial Sequence
  Description of Artificial Sequence: Synthetic peptide
GQVNHTT

SEQ ID NO: 31924 - protein, 7 aa, Artificial Sequence
  Description of Artificial Sequence: Synthetic peptide
QAQGSMQ

SEQ ID NO: 31925 - protein, 7 aa, Artificial Sequence
  Description of Artificial Sequence: Synthetic peptide
SVTPHVT

SEQ ID NO: 31926 - protein, 7 aa, Artificial Sequence
  Description of Artificial Sequence: Synthetic peptide
NSSSSNH

SEQ ID NO: 31927 - protein, 7 aa, Artificial Sequence
  Description of Artificial Sequence: Synthetic peptide
FSASGAR

SEQ ID NO: 31928 - protein, 7 aa, Artificial Sequence
  Description of Artificial Sequence: Synthetic peptide
PVGTKSG

SEQ ID NO: 31929 - protein, 7 aa, Artificial Sequence
  Description of Artificial Sequence: Synthetic peptide
PLNARGS

SEQ ID NO: 31930 - protein, 7 aa, Artificial Sequence
  Description of Artificial Sequence: Synthetic peptide
RPVVAST

SEQ ID NO: 31931 - protein, 7 aa, Artificial Sequence
  Description of Artificial Sequence: Synthetic peptide
PNLQSSK

SEQ ID NO: 31932 - protein, 7 aa, Artificial Sequence
  Description of Artificial Sequence: Synthetic peptide
GGLDHHA

SEQ ID NO: 31933 - protein, 7 aa, Artificial Sequence
  Description of Artificial Sequence: Synthetic peptide
GHGNNGA

SEQ ID NO: 31934 - protein, 7 aa, Artificial Sequence
  Description of Artificial Sequence: Synthetic peptide
RTLSASS

SEQ ID NO: 31935 - protein, 7 aa, Artificial Sequence
  Description of Artificial Sequence: Synthetic peptide
ATGNGRG

SEQ ID NO: 31936 - protein, 7 aa, Artificial Sequence
  Description of Artificial Sequence: Synthetic peptide
GSGHGTN

SEQ ID NO: 31937 - protein, 7 aa, Artificial Sequence
  Description of Artificial Sequence: Synthetic peptide
SPGNKLL

SEQ ID NO: 31938 - protein, 7 aa, Artificial Sequence
  Description of Artificial Sequence: Synthetic peptide
SHNSKDS

SEQ ID NO: 31939 - protein, 7 aa, Artificial Sequence
  Description of Artificial Sequence: Synthetic peptide
YVSNSNA

SEQ ID NO: 31940 - protein, 7 aa, Artificial Sequence
  Description of Artificial Sequence: Synthetic peptide
SSGSNRS

SEQ ID NO: 31941 - protein, 7 aa, Artificial Sequence
  Description of Artificial Sequence: Synthetic peptide
NGSGQNK

SEQ ID NO: 31942 - protein, 7 aa, Artificial Sequence
  Description of Artificial Sequence: Synthetic peptide
PSQTKPS

SEQ ID NO: 31943 - protein, 7 aa, Artificial Sequence
  Description of Artificial Sequence: Synthetic peptide
GTSTSLR

SEQ ID NO: 31944 - protein, 7 aa, Artificial Sequence
  Description of Artificial Sequence: Synthetic peptide
NGSGLNQ

SEQ ID NO: 31945 - protein, 7 aa, Artificial Sequence
  Description of Artificial Sequence: Synthetic peptide
NRVTQSS

SEQ ID NO: 31946 - protein, 7 aa, Artificial Sequence
  Description of Artificial Sequence: Synthetic peptide
QTRSNGN

SEQ ID NO: 31947 - protein, 7 aa, Artificial Sequence
  Description of Artificial Sequence: Synthetic peptide
SGSTKGQ

SEQ ID NO: 31948 - protein, 7 aa, Artificial Sequence
  Description of Artificial Sequence: Synthetic peptide
TPSVSTK

SEQ ID NO: 31949 - protein, 7 aa, Artificial Sequence
  Description of Artificial Sequence: Synthetic peptide
AQINTPT

SEQ ID NO: 31950 - protein, 7 aa, Artificial Sequence
  Description of Artificial Sequence: Synthetic peptide
GHVSPAF

SEQ ID NO: 31951 - protein, 7 aa, Artificial Sequence
  Description of Artificial Sequence: Synthetic peptide
APSARPS

SEQ ID NO: 31952 - protein, 7 aa, Artificial Sequence
  Description of Artificial Sequence: Synthetic peptide
PTSFSGT

SEQ ID NO: 31953 - protein, 7 aa, Artificial Sequence
  Description of Artificial Sequence: Synthetic peptide
PRLNVGG

SEQ ID NO: 31954 - protein, 7 aa, Artificial Sequence
  Description of Artificial Sequence: Synthetic peptide
RHNTIAG

SEQ ID NO: 31955 - protein, 7 aa, Artificial Sequence
  Description of Artificial Sequence: Synthetic peptide
RGVSTPT

SEQ ID NO: 31956 - protein, 7 aa, Artificial Sequence
  Description of Artificial Sequence: Synthetic peptide
PRVHPLV

SEQ ID NO: 31957 - protein, 7 aa, Artificial Sequence
  Description of Artificial Sequence: Synthetic peptide
QDKHNPG

SEQ ID NO: 31958 - protein, 7 aa, Artificial Sequence
  Description of Artificial Sequence: Synthetic peptide
NNAHSSS

SEQ ID NO: 31959 - protein, 7 aa, Artificial Sequence
  Description of Artificial Sequence: Synthetic peptide
ESPNLHS

SEQ ID NO: 31960 - protein, 7 aa, Artificial Sequence
  Description of Artificial Sequence: Synthetic peptide
SREQGVG

SEQ ID NO: 31961 - protein, 7 aa, Artificial Sequence
  Description of Artificial Sequence: Synthetic peptide
NDSGQNQ

SEQ ID NO: 31962 - protein, 7 aa, Artificial Sequence
  Description of Artificial Sequence: Synthetic peptide
SLTNSAL

SEQ ID NO: 31963 - protein, 7 aa, Artificial Sequence
  Description of Artificial Sequence: Synthetic peptide
QTRTDVT

SEQ ID NO: 31964 - protein, 7 aa, Artificial Sequence
  Description of Artificial Sequence: Synthetic peptide
MAHDGYR

SEQ ID NO: 31965 - protein, 7 aa, Artificial Sequence
  Description of Artificial Sequence: Synthetic peptide
NCSGQNQ

SEQ ID NO: 31966 - protein, 7 aa, Artificial Sequence
  Description of Artificial Sequence: Synthetic peptide
SMGNSIS

SEQ ID NO: 31967 - protein, 7 aa, Artificial Sequence
  Description of Artificial Sequence: Synthetic peptide
FPVTGLS

SEQ ID NO: 31968 - protein, 7 aa, Artificial Sequence
  Description of Artificial Sequence: Synthetic peptide
AIPAVSM

SEQ ID NO: 31969 - protein, 7 aa, Artificial Sequence
  Description of Artificial Sequence: Synthetic peptide
GVTSSGP

SEQ ID NO: 31970 - protein, 7 aa, Artificial Sequence
  Description of Artificial Sequence: Synthetic peptide
SISHARE

SEQ ID NO: 31971 - protein, 7 aa, Artificial Sequence
  Description of Artificial Sequence: Synthetic peptide
LSPTSTN

SEQ ID NO: 31972 - protein, 7 aa, Artificial Sequence
  Description of Artificial Sequence: Synthetic peptide
KSNSSLG

SEQ ID NO: 31973 - protein, 7 aa, Artificial Sequence
  Description of Artificial Sequence: Synthetic peptide
GIDTKML

SEQ ID NO: 31974 - protein, 7 aa, Artificial Sequence
  Description of Artificial Sequence: Synthetic peptide
NGSGQTQ

SEQ ID NO: 31975 - protein, 7 aa, Artificial Sequence
  Description of Artificial Sequence: Synthetic peptide
DGSGQNQ

SEQ ID NO: 31976 - protein, 7 aa, Artificial Sequence
  Description of Artificial Sequence: Synthetic peptide
DIMSPLK

SEQ ID NO: 31977 - protein, 7 aa, Artificial Sequence
  Description of Artificial Sequence: Synthetic peptide
NGSGRNQ

SEQ ID NO: 31978 - protein, 7 aa, Artificial Sequence
  Description of Artificial Sequence: Synthetic peptide
NGSGQNP

SEQ ID NO: 31979 - protein, 7 aa, Artificial Sequence
  Description of Artificial Sequence: Synthetic peptide
SPARASL

SEQ ID NO: 31980 - protein, 7 aa, Artificial Sequence
  Description of Artificial Sequence: Synthetic peptide
SITSVTN

SEQ ID NO: 31981 - protein, 7 aa, Artificial Sequence
  Description of Artificial Sequence: Synthetic peptide
HTSPGKN

SEQ ID NO: 31982 - protein, 7 aa, Artificial Sequence
  Description of Artificial Sequence: Synthetic peptide
LASGTPS

SEQ ID NO: 31983 - protein, 7 aa, Artificial Sequence
  Description of Artificial Sequence: Synthetic peptide
NGSEQNQ

SEQ ID NO: 31984 - protein, 7 aa, Artificial Sequence
  Description of Artificial Sequence: Synthetic peptide
NGTGQNQ

SEQ ID NO: 31985 - protein, 7 aa, Artificial Sequence
  Description of Artificial Sequence: Synthetic peptide
NGSGQKQ

SEQ ID NO: 31986 - protein, 7 aa, Artificial Sequence
  Description of Artificial Sequence: Synthetic peptide
NGSGENQ

SEQ ID NO: 31987 - protein, 7 aa, Artificial Sequence
  Description of Artificial Sequence: Synthetic peptide
RVTDAHL

SEQ ID NO: 31988 - protein, 7 aa, Artificial Sequence
  Description of Artificial Sequence: Synthetic peptide
NGCGQNQ

SEQ ID NO: 31989 - protein, 7 aa, Artificial Sequence
  Description of Artificial Sequence: Synthetic peptide
NGSGQNE

SEQ ID NO: 31990 - protein, 7 aa, Artificial Sequence
  Description of Artificial Sequence: Synthetic peptide
RLDISNK

SEQ ID NO: 31991 - protein, 7 aa, Artificial Sequence
  Description of Artificial Sequence: Synthetic peptide
HMPSCGG

SEQ ID NO: 31992 - protein, 7 aa, Artificial Sequence
  Description of Artificial Sequence: Synthetic peptide
NGSGHNQ

SEQ ID NO: 31993 - protein, 7 aa, Artificial Sequence
  Description of Artificial Sequence: Synthetic peptide
NGAGQNQ

SEQ ID NO: 31994 - protein, 7 aa, Artificial Sequence
  Description of Artificial Sequence: Synthetic peptide
HLGSDSR

SEQ ID NO: 31995 - protein, 7 aa, Artificial Sequence
  Description of Artificial Sequence: Synthetic peptide
NGSGQDQ

SEQ ID NO: 31996 - protein, 7 aa, Artificial Sequence
  Description of Artificial Sequence: Synthetic peptide
NGSGQHQ

SEQ ID NO: 31997 - protein, 7 aa, Artificial Sequence
  Description of Artificial Sequence: Synthetic peptide
TIKSVTN

SEQ ID NO: 31998 - protein, 7 aa, Artificial Sequence
  Description of Artificial Sequence: Synthetic peptide
NGSGQNR

SEQ ID NO: 31999 - protein, 7 aa, Artificial Sequence
  Description of Artificial Sequence: Synthetic peptide
NGSGQSQ

SEQ ID NO: 32000 - protein, 7 aa, Artificial Sequence
  Description of Artificial Sequence: Synthetic peptide
NVSGQNQ

SEQ ID NO: 32001 - protein, 7 aa, Artificial Sequence
  Description of Artificial Sequence: Synthetic peptide
TGSGQNQ

SEQ ID NO: 32002 - protein, 7 aa, Artificial Sequence
  Description of Artificial Sequence: Synthetic peptide
NGSGQIQ

SEQ ID NO: 32003 - protein, 7 aa, Artificial Sequence
  Description of Artificial Sequence: Synthetic peptide
NWSGQNQ

SEQ ID NO: 32004 - protein, 7 aa, Artificial Sequence
  Description of Artificial Sequence: Synthetic peptide
SAVGKAS

SEQ ID NO: 32005 - protein, 7 aa, Artificial Sequence
  Description of Artificial Sequence: Synthetic peptide
AIYSEYK

SEQ ID NO: 32006 - protein, 7 aa, Artificial Sequence
  Description of Artificial Sequence: Synthetic peptide
NGYGQNQ

SEQ ID NO: 32007 - protein, 7 aa, Artificial Sequence
  Description of Artificial Sequence: Synthetic peptide
NGSGPNQ

SEQ ID NO: 32008 - protein, 7 aa, Artificial Sequence
  Description of Artificial Sequence: Synthetic peptide
NGFGQNQ

SEQ ID NO: 32009 - protein, 7 aa, Artificial Sequence
  Description of Artificial Sequence: Synthetic peptide
PGSGSNN

SEQ ID NO: 32010 - protein, 7 aa, Artificial Sequence
  Description of Artificial Sequence: Synthetic peptide
NGSAQNQ

SEQ ID NO: 32011 - protein, 7 aa, Artificial Sequence
  Description of Artificial Sequence: Synthetic peptide
SGATTPR

SEQ ID NO: 32012 - protein, 7 aa, Artificial Sequence
  Description of Artificial Sequence: Synthetic peptide
TTYGSLG

SEQ ID NO: 32013 - protein, 7 aa, Artificial Sequence
  Description of Artificial Sequence: Synthetic peptide
MPSQRDG

SEQ ID NO: 32014 - protein, 7 aa, Artificial Sequence
  Description of Artificial Sequence: Synthetic peptide
SGSGQNQ

SEQ ID NO: 32015 - protein, 7 aa, Artificial Sequence
  Description of Artificial Sequence: Synthetic peptide
NASGQNQ

SEQ ID NO: 32016 - protein, 7 aa, Artificial Sequence
  Description of Artificial Sequence: Synthetic peptide
NSSGQNQ

SEQ ID NO: 32017 - protein, 7 aa, Artificial Sequence
  Description of Artificial Sequence: Synthetic peptide
NGPGQNQ

SEQ ID NO: 32018 - protein, 7 aa, Artificial Sequence
  Description of Artificial Sequence: Synthetic peptide
NGSRQNQ

SEQ ID NO: 32019 - protein, 7 aa, Artificial Sequence
  Description of Artificial Sequence: Synthetic peptide
TPGASLS

SEQ ID NO: 32020 - protein, 7 aa, Artificial Sequence
  Description of Artificial Sequence: Synthetic peptide
SPTSPMN

SEQ ID NO: 32021 - protein, 7 aa, Artificial Sequence
  Description of Artificial Sequence: Synthetic peptide
KGSGQNQ

SEQ ID NO: 32022 - protein, 7 aa, Artificial Sequence
  Description of Artificial Sequence: Synthetic peptide
SGVERVN

SEQ ID NO: 32023 - protein, 7 aa, Artificial Sequence
  Description of Artificial Sequence: Synthetic peptide
RDTRESQ

SEQ ID NO: 32024 - protein, 7 aa, Artificial Sequence
  Description of Artificial Sequence: Synthetic peptide
AGEGMYA

SEQ ID NO: 32025 - protein, 7 aa, Artificial Sequence
  Description of Artificial Sequence: Synthetic peptide
IGSGQNQ

SEQ ID NO: 32026 - protein, 7 aa, Artificial Sequence
  Description of Artificial Sequence: Synthetic peptide
INSGNGS

SEQ ID NO: 32027 - protein, 7 aa, Artificial Sequence
  Description of Artificial Sequence: Synthetic peptide
SVSTNFS

SEQ ID NO: 32028 - protein, 7 aa, Artificial Sequence
  Description of Artificial Sequence: Synthetic peptide
HGSGQNQ

SEQ ID NO: 32029 - protein, 7 aa, Artificial Sequence
  Description of Artificial Sequence: Synthetic peptide
PGSGSNH

SEQ ID NO: 32030 - protein, 7 aa, Artificial Sequence
  Description of Artificial Sequence: Synthetic peptide
NGSVQNQ

SEQ ID NO: 32031 - protein, 7 aa, Artificial Sequence
  Description of Artificial Sequence: Synthetic peptide
FRSKESA

SEQ ID NO: 32032 - protein, 7 aa, Artificial Sequence
  Description of Artificial Sequence: Synthetic peptide
QYMGANS

SEQ ID NO: 32033 - protein, 7 aa, Artificial Sequence
  Description of Artificial Sequence: Synthetic peptide
PFGSSAR

SEQ ID NO: 32034 - protein, 7 aa, Artificial Sequence
  Description of Artificial Sequence: Synthetic peptide
SNETKSS

SEQ ID NO: 32035 - protein, 7 aa, Artificial Sequence
  Description of Artificial Sequence: Synthetic peptide
PGINTNS

SEQ ID NO: 32036 - protein, 7 aa, Artificial Sequence
  Description of Artificial Sequence: Synthetic peptide
SRNSPPQ

SEQ ID NO: 32037 - protein, 7 aa, Artificial Sequence
  Description of Artificial Sequence: Synthetic peptide
RLDGLSR

SEQ ID NO: 32038 - protein, 7 aa, Artificial Sequence
  Description of Artificial Sequence: Synthetic peptide
SSQAQPT

SEQ ID NO: 32039 - protein, 7 aa, Artificial Sequence
  Description of Artificial Sequence: Synthetic peptide
HLSHSPT

SEQ ID NO: 32040 - protein, 7 aa, Artificial Sequence
  Description of Artificial Sequence: Synthetic peptide
RATPLSG

SEQ ID NO: 32041 - protein, 7 aa, Artificial Sequence
  Description of Artificial Sequence: Synthetic peptide
MGAVSVS

SEQ ID NO: 32042 - protein, 7 aa, Artificial Sequence
  Description of Artificial Sequence: Synthetic peptide
DYHNSKL

SEQ ID NO: 32043 - protein, 7 aa, Artificial Sequence
  Description of Artificial Sequence: Synthetic peptide
KNATGIL

SEQ ID NO: 32044 - protein, 7 aa, Artificial Sequence
  Description of Artificial Sequence: Synthetic peptide
CNNARVS

SEQ ID NO: 32045 - protein, 7 aa, Artificial Sequence
  Description of Artificial Sequence: Synthetic peptide
GTASGVA

SEQ ID NO: 32046 - protein, 7 aa, Artificial Sequence
  Description of Artificial Sequence: Synthetic peptide
GQSGSRL

SEQ ID NO: 32047 - protein, 7 aa, Artificial Sequence
  Description of Artificial Sequence: Synthetic peptide
NNAATHS

SEQ ID NO: 32048 - protein, 7 aa, Artificial Sequence
  Description of Artificial Sequence: Synthetic peptide
PGSGSKH

SEQ ID NO: 32049 - protein, 7 aa, Artificial Sequence
  Description of Artificial Sequence: Synthetic peptide
ARASSNS

SEQ ID NO: 32050 - protein, 7 aa, Artificial Sequence
  Description of Artificial Sequence: Synthetic peptide
EPLSKQS

SEQ ID NO: 32051 - protein, 7 aa, Artificial Sequence
  Description of Artificial Sequence: Synthetic peptide
YSRPTTT

SEQ ID NO: 32052 - protein, 7 aa, Artificial Sequence
  Description of Artificial Sequence: Synthetic peptide
NRSGQNQ

SEQ ID NO: 32053 - protein, 7 aa, Artificial Sequence
  Description of Artificial Sequence: Synthetic peptide
EYPQQAK

SEQ ID NO: 32054 - protein, 7 aa, Artificial Sequence
  Description of Artificial Sequence: Synthetic peptide
MGGVTSS

SEQ ID NO: 32055 - protein, 7 aa, Artificial Sequence
  Description of Artificial Sequence: Synthetic peptide
HTDINHQ

SEQ ID NO: 32056 - protein, 7 aa, Artificial Sequence
  Description of Artificial Sequence: Synthetic peptide
HVHDGRT

SEQ ID NO: 32057 - protein, 7 aa, Artificial Sequence
  Description of Artificial Sequence: Synthetic peptide
ESATPIR

SEQ ID NO: 32058 - protein, 7 aa, Artificial Sequence
  Description of Artificial Sequence: Synthetic peptide
YGSGQNQ

SEQ ID NO: 32059 - protein, 7 aa, Artificial Sequence
  Description of Artificial Sequence: Synthetic peptide
VPSQSLH

SEQ ID NO: 32060 - protein, 7 aa, Artificial Sequence
  Description of Artificial Sequence: Synthetic peptide
SNTHSPS

SEQ ID NO: 32061 - protein, 7 aa, Artificial Sequence
  Description of Artificial Sequence: Synthetic peptide
GQTLPIC

SEQ ID NO: 32062 - protein, 7 aa, Artificial Sequence
  Description of Artificial Sequence: Synthetic peptide
KVDKRTD

SEQ ID NO: 32063 - protein, 7 aa, Artificial Sequence
  Description of Artificial Sequence: Synthetic peptide
RTGSYTQ

SEQ ID NO: 32064 - protein, 7 aa, Artificial Sequence
  Description of Artificial Sequence: Synthetic peptide
NGRPQFR

SEQ ID NO: 32065 - protein, 7 aa, Artificial Sequence
  Description of Artificial Sequence: Synthetic peptide
DPVTRKR

SEQ ID NO: 32066 - protein, 7 aa, Artificial Sequence
  Description of Artificial Sequence: Synthetic peptide
ADSNRPG

SEQ ID NO: 32067 - protein, 7 aa, Artificial Sequence
  Description of Artificial Sequence: Synthetic peptide
ITPGGHS

SEQ ID NO: 32068 - protein, 7 aa, Artificial Sequence
  Description of Artificial Sequence: Synthetic peptide
KHEGYNV

SEQ ID NO: 32069 - protein, 7 aa, Artificial Sequence
  Description of Artificial Sequence: Synthetic peptide
IKLDKQI

SEQ ID NO: 32070 - protein, 7 aa, Artificial Sequence
  Description of Artificial Sequence: Synthetic peptide
PRSNKYP

SEQ ID NO: 32071 - protein, 7 aa, Artificial Sequence
  Description of Artificial Sequence: Synthetic peptide
KINTRNM

SEQ ID NO: 32072 - protein, 7 aa, Artificial Sequence
  Description of Artificial Sequence: Synthetic peptide
FHSRDSS

SEQ ID NO: 32073 - protein, 7 aa, Artificial Sequence
  Description of Artificial Sequence: Synthetic peptide
YIKSVTN

SEQ ID NO: 32074 - protein, 7 aa, Artificial Sequence
  Description of Artificial Sequence: Synthetic peptide
NPGRQQF

SEQ ID NO: 32075 - protein, 7 aa, Artificial Sequence
  Description of Artificial Sequence: Synthetic peptide
IIQNQSK

SEQ ID NO: 32076 - protein, 7 aa, Artificial Sequence
  Description of Artificial Sequence: Synthetic peptide
TSSGHSV

SEQ ID NO: 32077 - protein, 7 aa, Artificial Sequence
  Description of Artificial Sequence: Synthetic peptide
YRKHTST

SEQ ID NO: 32078 - protein, 7 aa, Artificial Sequence
  Description of Artificial Sequence: Synthetic peptide
SMTSRNS

SEQ ID NO: 32079 - protein, 7 aa, Artificial Sequence
  Description of Artificial Sequence: Synthetic peptide
DQKTVNR

SEQ ID NO: 32080 - protein, 7 aa, Artificial Sequence
  Description of Artificial Sequence: Synthetic peptide
NSGRNSV

SEQ ID NO: 32081 - protein, 7 aa, Artificial Sequence
  Description of Artificial Sequence: Synthetic peptide
PEIGKQR

SEQ ID NO: 32082 - protein, 7 aa, Artificial Sequence
  Description of Artificial Sequence: Synthetic peptide
PISSRAG

SEQ ID NO: 32083 - protein, 7 aa, Artificial Sequence
  Description of Artificial Sequence: Synthetic peptide
NGFNSNN

SEQ ID NO: 32084 - protein, 7 aa, Artificial Sequence
  Description of Artificial Sequence: Synthetic peptide
FPGGNHT

SEQ ID NO: 32085 - protein, 7 aa, Artificial Sequence
  Description of Artificial Sequence: Synthetic peptide
SSGGNMS

SEQ ID NO: 32086 - protein, 7 aa, Artificial Sequence
  Description of Artificial Sequence: Synthetic peptide
YNRTSIV

SEQ ID NO: 32087 - protein, 7 aa, Artificial Sequence
  Description of Artificial Sequence: Synthetic peptide
MSRSDPP

SEQ ID NO: 32088 - protein, 7 aa, Artificial Sequence
  Description of Artificial Sequence: Synthetic peptide
SPNAKRV

SEQ ID NO: 32089 - protein, 7 aa, Artificial Sequence
  Description of Artificial Sequence: Synthetic peptide
RQLPSGL

SEQ ID NO: 32090 - protein, 7 aa, Artificial Sequence
  Description of Artificial Sequence: Synthetic peptide
GSYSNPT

SEQ ID NO: 32091 - protein, 7 aa, Artificial Sequence
  Description of Artificial Sequence: Synthetic peptide
GQNRNNT

SEQ ID NO: 32092 - protein, 7 aa, Artificial Sequence
  Description of Artificial Sequence: Synthetic peptide
SNYKSSN

SEQ ID NO: 32093 - protein, 7 aa, Artificial Sequence
  Description of Artificial Sequence: Synthetic peptide
MPHPSSK

SEQ ID NO: 32094 - protein, 7 aa, Artificial Sequence
  Description of Artificial Sequence: Synthetic peptide
KIPNYDR

SEQ ID NO: 32095 - protein, 7 aa, Artificial Sequence
  Description of Artificial Sequence: Synthetic peptide
SREKNNA

SEQ ID NO: 32096 - protein, 7 aa, Artificial Sequence
  Description of Artificial Sequence: Synthetic peptide
MSLSKNH

SEQ ID NO: 32097 - protein, 7 aa, Artificial Sequence
  Description of Artificial Sequence: Synthetic peptide
KISSPFI

SEQ ID NO: 32098 - protein, 7 aa, Artificial Sequence
  Description of Artificial Sequence: Synthetic peptide
NPSMAMK

SEQ ID NO: 32099 - protein, 7 aa, Artificial Sequence
  Description of Artificial Sequence: Synthetic peptide
RVSSPSN

SEQ ID NO: 32100 - protein, 7 aa, Artificial Sequence
  Description of Artificial Sequence: Synthetic peptide
RTYSPQI

SEQ ID NO: 32101 - protein, 7 aa, Artificial Sequence
  Description of Artificial Sequence: Synthetic peptide
RNDKQNS

SEQ ID NO: 32102 - protein, 7 aa, Artificial Sequence
  Description of Artificial Sequence: Synthetic peptide
EQGSGNH

SEQ ID NO: 32103 - protein, 7 aa, Artificial Sequence
  Description of Artificial Sequence: Synthetic peptide
DPPKGSR

SEQ ID NO: 32104 - protein, 7 aa, Artificial Sequence
  Description of Artificial Sequence: Synthetic peptide
TIKSVTN

SEQ ID NO: 32105 - protein, 7 aa, Artificial Sequence
  Description of Artificial Sequence: Synthetic peptide
SIKEKTR

SEQ ID NO: 32106 - protein, 7 aa, Artificial Sequence
  Description of Artificial Sequence: Synthetic peptide
QSSIHTK

SEQ ID NO: 32107 - protein, 7 aa, Artificial Sequence
  Description of Artificial Sequence: Synthetic peptide
FGRTNQG

SEQ ID NO: 32108 - protein, 7 aa, Artificial Sequence
  Description of Artificial Sequence: Synthetic peptide
TKNSTHG

SEQ ID NO: 32109 - protein, 7 aa, Artificial Sequence
  Description of Artificial Sequence: Synthetic peptide
AHQSLDR

SEQ ID NO: 32110 - protein, 7 aa, Artificial Sequence
  Description of Artificial Sequence: Synthetic peptide
NRHERVI

SEQ ID NO: 32111 - protein, 7 aa, Artificial Sequence
  Description of Artificial Sequence: Synthetic peptide
YSSRSGP

SEQ ID NO: 32112 - protein, 7 aa, Artificial Sequence
  Description of Artificial Sequence: Synthetic peptide
PSSGHSR

SEQ ID NO: 32113 - protein, 7 aa, Artificial Sequence
  Description of Artificial Sequence: Synthetic peptide
TGSGRLL

SEQ ID NO: 32114 - protein, 7 aa, Artificial Sequence
  Description of Artificial Sequence: Synthetic peptide
TKSTSHV

SEQ ID NO: 32115 - protein, 7 aa, Artificial Sequence
  Description of Artificial Sequence: Synthetic peptide
IRSTSGG

SEQ ID NO: 32116 - protein, 7 aa, Artificial Sequence
  Description of Artificial Sequence: Synthetic peptide
YVRPGTG

SEQ ID NO: 32117 - protein, 7 aa, Artificial Sequence
  Description of Artificial Sequence: Synthetic peptide
VHVTSQT

SEQ ID NO: 32118 - protein, 7 aa, Artificial Sequence
  Description of Artificial Sequence: Synthetic peptide
CAAKGIR

SEQ ID NO: 32119 - protein, 7 aa, Artificial Sequence
  Description of Artificial Sequence: Synthetic peptide
RAPKSSS

SEQ ID NO: 32120 - protein, 7 aa, Artificial Sequence
  Description of Artificial Sequence: Synthetic peptide
NLGRQVG

SEQ ID NO: 32121 - protein, 7 aa, Artificial Sequence
  Description of Artificial Sequence: Synthetic peptide
PLERTTK

SEQ ID NO: 32122 - protein, 7 aa, Artificial Sequence
  Description of Artificial Sequence: Synthetic peptide
DSTLGQS

SEQ ID NO: 32123 - protein, 7 aa, Artificial Sequence
  Description of Artificial Sequence: Synthetic peptide
NNRSGMG

SEQ ID NO: 32124 - protein, 7 aa, Artificial Sequence
  Description of Artificial Sequence: Synthetic peptide
PGREKTV

SEQ ID NO: 32125 - protein, 7 aa, Artificial Sequence
  Description of Artificial Sequence: Synthetic peptide
YNKNAQL

SEQ ID NO: 32126 - protein, 7 aa, Artificial Sequence
  Description of Artificial Sequence: Synthetic peptide
FPLKLGR

SEQ ID NO: 32127 - protein, 7 aa, Artificial Sequence
  Description of Artificial Sequence: Synthetic peptide
KIASKSE

SEQ ID NO: 32128 - protein, 7 aa, Artificial Sequence
  Description of Artificial Sequence: Synthetic peptide
SYGKGSS

SEQ ID NO: 32129 - protein, 7 aa, Artificial Sequence
  Description of Artificial Sequence: Synthetic peptide
FRQTSGN

SEQ ID NO: 32130 - protein, 7 aa, Artificial Sequence
  Description of Artificial Sequence: Synthetic peptide
MNRTGIK

SEQ ID NO: 32131 - protein, 7 aa, Artificial Sequence
  Description of Artificial Sequence: Synthetic peptide
GPNQSGR

SEQ ID NO: 32132 - protein, 7 aa, Artificial Sequence
  Description of Artificial Sequence: Synthetic peptide
IRSKASA

SEQ ID NO: 32133 - protein, 7 aa, Artificial Sequence
  Description of Artificial Sequence: Synthetic peptide
ASRSTNP

SEQ ID NO: 32134 - protein, 7 aa, Artificial Sequence
  Description of Artificial Sequence: Synthetic peptide
DRYNRQL

SEQ ID NO: 32135 - protein, 7 aa, Artificial Sequence
  Description of Artificial Sequence: Synthetic peptide
HITGRQL

SEQ ID NO: 32136 - protein, 7 aa, Artificial Sequence
  Description of Artificial Sequence: Synthetic peptide
RVESPTN

SEQ ID NO: 32137 - protein, 7 aa, Artificial Sequence
  Description of Artificial Sequence: Synthetic peptide
NAQGTAK

SEQ ID NO: 32138 - protein, 7 aa, Artificial Sequence
  Description of Artificial Sequence: Synthetic peptide
AKTNLRS

SEQ ID NO: 32139 - protein, 7 aa, Artificial Sequence
  Description of Artificial Sequence: Synthetic peptide
LINATHR

SEQ ID NO: 32140 - protein, 7 aa, Artificial Sequence
  Description of Artificial Sequence: Synthetic peptide
HASRVNI

SEQ ID NO: 32141 - protein, 7 aa, Artificial Sequence
  Description of Artificial Sequence: Synthetic peptide
FNGLSTQ

SEQ ID NO: 32142 - protein, 7 aa, Artificial Sequence
  Description of Artificial Sequence: Synthetic peptide
IQNSSNT

SEQ ID NO: 32143 - protein, 7 aa, Artificial Sequence
  Description of Artificial Sequence: Synthetic peptide
HYNQTGL

SEQ ID NO: 32144 - protein, 7 aa, Artificial Sequence
  Description of Artificial Sequence: Synthetic peptide
NATSPRK

SEQ ID NO: 32145 - protein, 7 aa, Artificial Sequence
  Description of Artificial Sequence: Synthetic peptide
HLRDKYS

SEQ ID NO: 32146 - protein, 7 aa, Artificial Sequence
  Description of Artificial Sequence: Synthetic peptide
EVTNSPR

SEQ ID NO: 32147 - protein, 7 aa, Artificial Sequence
  Description of Artificial Sequence: Synthetic peptide
GSNRNHA

SEQ ID NO: 32148 - protein, 7 aa, Artificial Sequence
  Description of Artificial Sequence: Synthetic peptide
FNMQRSQ

SEQ ID NO: 32149 - protein, 7 aa, Artificial Sequence
  Description of Artificial Sequence: Synthetic peptide
SVYTHSL

SEQ ID NO: 32150 - protein, 7 aa, Artificial Sequence
  Description of Artificial Sequence: Synthetic peptide
HAARPLV

SEQ ID NO: 32151 - protein, 7 aa, Artificial Sequence
  Description of Artificial Sequence: Synthetic peptide
RATEGVF

SEQ ID NO: 32152 - protein, 7 aa, Artificial Sequence
  Description of Artificial Sequence: Synthetic peptide
AHRNISS

SEQ ID NO: 32153 - protein, 7 aa, Artificial Sequence
  Description of Artificial Sequence: Synthetic peptide
NRSTDFK

SEQ ID NO: 32154 - protein, 7 aa, Artificial Sequence
  Description of Artificial Sequence: Synthetic peptide
RASGPFV

SEQ ID NO: 32155 - protein, 7 aa, Artificial Sequence
  Description of Artificial Sequence: Synthetic peptide
CIRAGSC

SEQ ID NO: 32156 - protein, 7 aa, Artificial Sequence
  Description of Artificial Sequence: Synthetic peptide
MPLKPHL

SEQ ID NO: 32157 - protein, 7 aa, Artificial Sequence
  Description of Artificial Sequence: Synthetic peptide
FTFNAAT

SEQ ID NO: 32158 - protein, 7 aa, Artificial Sequence
  Description of Artificial Sequence: Synthetic peptide
MVSGKSY

SEQ ID NO: 32159 - protein, 7 aa, Artificial Sequence
  Description of Artificial Sequence: Synthetic peptide
SSAGHSK

SEQ ID NO: 32160 - protein, 7 aa, Artificial Sequence
  Description of Artificial Sequence: Synthetic peptide
FNSSSSK

SEQ ID NO: 32161 - protein, 7 aa, Artificial Sequence
  Description of Artificial Sequence: Synthetic peptide
QITPRSG

SEQ ID NO: 32162 - protein, 7 aa, Artificial Sequence
  Description of Artificial Sequence: Synthetic peptide
NSGTHFK

SEQ ID NO: 32163 - protein, 7 aa, Artificial Sequence
  Description of Artificial Sequence: Synthetic peptide
LGNAHQL

SEQ ID NO: 32164 - protein, 7 aa, Artificial Sequence
  Description of Artificial Sequence: Synthetic peptide
HDSKVIS

SEQ ID NO: 32165 - protein, 7 aa, Artificial Sequence
  Description of Artificial Sequence: Synthetic peptide
HQLKNSV

SEQ ID NO: 32166 - protein, 7 aa, Artificial Sequence
  Description of Artificial Sequence: Synthetic peptide
SAHNRSV

SEQ ID NO: 32167 - protein, 7 aa, Artificial Sequence
  Description of Artificial Sequence: Synthetic peptide
YGNPRQA

SEQ ID NO: 32168 - protein, 7 aa, Artificial Sequence
  Description of Artificial Sequence: Synthetic peptide
CLGRPMA

SEQ ID NO: 32169 - protein, 7 aa, Artificial Sequence
  Description of Artificial Sequence: Synthetic peptide
SVQKSVN

SEQ ID NO: 32170 - protein, 7 aa, Artificial Sequence
  Description of Artificial Sequence: Synthetic peptide
PVGSGVP

SEQ ID NO: 32171 - protein, 7 aa, Artificial Sequence
  Description of Artificial Sequence: Synthetic peptide
HGSKPYI

SEQ ID NO: 32172 - protein, 7 aa, Artificial Sequence
  Description of Artificial Sequence: Synthetic peptide
SPGNKST

SEQ ID NO: 32173 - protein, 7 aa, Artificial Sequence
  Description of Artificial Sequence: Synthetic peptide
SLGSGFQ

SEQ ID NO: 32174 - protein, 7 aa, Artificial Sequence
  Description of Artificial Sequence: Synthetic peptide
PDIGKQR

SEQ ID NO: 32175 - protein, 7 aa, Artificial Sequence
  Description of Artificial Sequence: Synthetic peptide
RVTNARN

SEQ ID NO: 32176 - protein, 7 aa, Artificial Sequence
  Description of Artificial Sequence: Synthetic peptide
SFSKGSS

SEQ ID NO: 32177 - protein, 7 aa, Artificial Sequence
  Description of Artificial Sequence: Synthetic peptide
VPGKSAQ

SEQ ID NO: 32178 - protein, 7 aa, Artificial Sequence
  Description of Artificial Sequence: Synthetic peptide
TSKPNSP

SEQ ID NO: 32179 - protein, 7 aa, Artificial Sequence
  Description of Artificial Sequence: Synthetic peptide
SPEKNMR

SEQ ID NO: 32180 - protein, 7 aa, Artificial Sequence
  Description of Artificial Sequence: Synthetic peptide
QGSGSNH

SEQ ID NO: 32181 - protein, 7 aa, Artificial Sequence
  Description of Artificial Sequence: Synthetic peptide
CQSRSGA

SEQ ID NO: 32182 - protein, 7 aa, Artificial Sequence
  Description of Artificial Sequence: Synthetic peptide
PSTERNR

SEQ ID NO: 32183 - protein, 7 aa, Artificial Sequence
  Description of Artificial Sequence: Synthetic peptide
ALGHNHN

SEQ ID NO: 32184 - protein, 7 aa, Artificial Sequence
  Description of Artificial Sequence: Synthetic peptide
QPIISPT

SEQ ID NO: 32185 - protein, 7 aa, Artificial Sequence
  Description of Artificial Sequence: Synthetic peptide
VSGQGNS

SEQ ID NO: 32186 - protein, 7 aa, Artificial Sequence
  Description of Artificial Sequence: Synthetic peptide
AVNTKAL

SEQ ID NO: 32187 - protein, 7 aa, Artificial Sequence
  Description of Artificial Sequence: Synthetic peptide
LNVGSVR

SEQ ID NO: 32188 - protein, 7 aa, Artificial Sequence
  Description of Artificial Sequence: Synthetic peptide
LHDGQTR

SEQ ID NO: 32189 - protein, 7 aa, Artificial Sequence
  Description of Artificial Sequence: Synthetic peptide
IRTGSLH

SEQ ID NO: 32190 - protein, 7 aa, Artificial Sequence
  Description of Artificial Sequence: Synthetic peptide
GTKSAFS

SEQ ID NO: 32191 - protein, 7 aa, Artificial Sequence
  Description of Artificial Sequence: Synthetic peptide
LSSSRMG

SEQ ID NO: 32192 - protein, 7 aa, Artificial Sequence
  Description of Artificial Sequence: Synthetic peptide
ARVVPRL

SEQ ID NO: 32193 - protein, 7 aa, Artificial Sequence
  Description of Artificial Sequence: Synthetic peptide
ESKAASK

SEQ ID NO: 32194 - protein, 7 aa, Artificial Sequence
  Description of Artificial Sequence: Synthetic peptide
PSKGTYP

SEQ ID NO: 32195 - protein, 7 aa, Artificial Sequence
  Description of Artificial Sequence: Synthetic peptide
HVSSTSV

SEQ ID NO: 32196 - protein, 7 aa, Artificial Sequence
  Description of Artificial Sequence: Synthetic peptide
REKQHNG

SEQ ID NO: 32197 - protein, 7 aa, Artificial Sequence
  Description of Artificial Sequence: Synthetic peptide
RNDTKLF

SEQ ID NO: 32198 - protein, 7 aa, Artificial Sequence
  Description of Artificial Sequence: Synthetic peptide
LSANPHN

SEQ ID NO: 32199 - protein, 7 aa, Artificial Sequence
  Description of Artificial Sequence: Synthetic peptide
NRSKESA

SEQ ID NO: 32200 - protein, 7 aa, Artificial Sequence
  Description of Artificial Sequence: Synthetic peptide
MKSQKYA

SEQ ID NO: 32201 - protein, 7 aa, Artificial Sequence
  Description of Artificial Sequence: Synthetic peptide
VLRDGHR

SEQ ID NO: 32202 - protein, 7 aa, Artificial Sequence
  Description of Artificial Sequence: Synthetic peptide
TKGGSQL

SEQ ID NO: 32203 - protein, 7 aa, Artificial Sequence
  Description of Artificial Sequence: Synthetic peptide
ISLTQSR

SEQ ID NO: 32204 - protein, 7 aa, Artificial Sequence
  Description of Artificial Sequence: Synthetic peptide
RELKNSS

SEQ ID NO: 32205 - protein, 7 aa, Artificial Sequence
  Description of Artificial Sequence: Synthetic peptide
RTQAHNV

SEQ ID NO: 32206 - protein, 7 aa, Artificial Sequence
  Description of Artificial Sequence: Synthetic peptide
SPGRTQS

SEQ ID NO: 32207 - protein, 7 aa, Artificial Sequence
  Description of Artificial Sequence: Synthetic peptide
CKTHVSV

SEQ ID NO: 32208 - protein, 7 aa, Artificial Sequence
  Description of Artificial Sequence: Synthetic peptide
SHDNGQS

SEQ ID NO: 32209 - protein, 7 aa, Artificial Sequence
  Description of Artificial Sequence: Synthetic peptide
SSTPRSV

SEQ ID NO: 32210 - protein, 7 aa, Artificial Sequence
  Description of Artificial Sequence: Synthetic peptide
PSARMSG

SEQ ID NO: 32211 - protein, 7 aa, Artificial Sequence
  Description of Artificial Sequence: Synthetic peptide
DIGNPTN

SEQ ID NO: 32212 - protein, 7 aa, Artificial Sequence
  Description of Artificial Sequence: Synthetic peptide
IGPSGVL

SEQ ID NO: 32213 - protein, 7 aa, Artificial Sequence
  Description of Artificial Sequence: Synthetic peptide
SPVKGSV

SEQ ID NO: 32214 - protein, 7 aa, Artificial Sequence
  Description of Artificial Sequence: Synthetic peptide
LRVNATG

SEQ ID NO: 32215 - protein, 7 aa, Artificial Sequence
  Description of Artificial Sequence: Synthetic peptide
GNGTRQN

SEQ ID NO: 32216 - protein, 7 aa, Artificial Sequence
  Description of Artificial Sequence: Synthetic peptide
VRVGQHL

SEQ ID NO: 32217 - protein, 7 aa, Artificial Sequence
  Description of Artificial Sequence: Synthetic peptide
FETHSRP

SEQ ID NO: 32218 - protein, 7 aa, Artificial Sequence
  Description of Artificial Sequence: Synthetic peptide
RMGVSNT

SEQ ID NO: 32219 - protein, 7 aa, Artificial Sequence
  Description of Artificial Sequence: Synthetic peptide
SSRNLVT

SEQ ID NO: 32220 - protein, 7 aa, Artificial Sequence
  Description of Artificial Sequence: Synthetic peptide
SPSFNQG

SEQ ID NO: 32221 - protein, 7 aa, Artificial Sequence
  Description of Artificial Sequence: Synthetic peptide
HSHGKSI

SEQ ID NO: 32222 - protein, 7 aa, Artificial Sequence
  Description of Artificial Sequence: Synthetic peptide
GPDTHSQ

SEQ ID NO: 32223 - protein, 7 aa, Artificial Sequence
  Description of Artificial Sequence: Synthetic peptide
GVINNER

SEQ ID NO: 32224 - protein, 7 aa, Artificial Sequence
  Description of Artificial Sequence: Synthetic peptide
SSMSHQK

SEQ ID NO: 32225 - protein, 7 aa, Artificial Sequence
  Description of Artificial Sequence: Synthetic peptide
SGASSNS

SEQ ID NO: 32226 - protein, 7 aa, Artificial Sequence
  Description of Artificial Sequence: Synthetic peptide
NNSKSQI

SEQ ID NO: 32227 - protein, 7 aa, Artificial Sequence
  Description of Artificial Sequence: Synthetic peptide
AIRPHSG

SEQ ID NO: 32228 - protein, 7 aa, Artificial Sequence
  Description of Artificial Sequence: Synthetic peptide
KLTGQRS

SEQ ID NO: 32229 - protein, 7 aa, Artificial Sequence
  Description of Artificial Sequence: Synthetic peptide
RVQKSSF

SEQ ID NO: 32230 - protein, 7 aa, Artificial Sequence
  Description of Artificial Sequence: Synthetic peptide
RSNPTLV

SEQ ID NO: 32231 - protein, 7 aa, Artificial Sequence
  Description of Artificial Sequence: Synthetic peptide
PTGKLRQ

SEQ ID NO: 32232 - protein, 7 aa, Artificial Sequence
  Description of Artificial Sequence: Synthetic peptide
GAGTSYH

SEQ ID NO: 32233 - protein, 7 aa, Artificial Sequence
  Description of Artificial Sequence: Synthetic peptide
SSQAVFR

SEQ ID NO: 32234 - protein, 7 aa, Artificial Sequence
  Description of Artificial Sequence: Synthetic peptide
GQAVNTA

SEQ ID NO: 32235 - protein, 7 aa, Artificial Sequence
  Description of Artificial Sequence: Synthetic peptide
FIGTRSA

SEQ ID NO: 32236 - protein, 7 aa, Artificial Sequence
  Description of Artificial Sequence: Synthetic peptide
TGRGPDV

SEQ ID NO: 32237 - protein, 7 aa, Artificial Sequence
  Description of Artificial Sequence: Synthetic peptide
LNNQRIA

SEQ ID NO: 32238 - protein, 7 aa, Artificial Sequence
  Description of Artificial Sequence: Synthetic peptide
TPQNSVK

SEQ ID NO: 32239 - protein, 7 aa, Artificial Sequence
  Description of Artificial Sequence: Synthetic peptide
NPSEKML

SEQ ID NO: 32240 - protein, 7 aa, Artificial Sequence
  Description of Artificial Sequence: Synthetic peptide
VFNRNAS

SEQ ID NO: 32241 - protein, 7 aa, Artificial Sequence
  Description of Artificial Sequence: Synthetic peptide
TPTPVNQ

SEQ ID NO: 32242 - protein, 7 aa, Artificial Sequence
  Description of Artificial Sequence: Synthetic peptide
FNSGSGR

SEQ ID NO: 32243 - protein, 7 aa, Artificial Sequence
  Description of Artificial Sequence: Synthetic peptide
HVTKSTA

SEQ ID NO: 32244 - protein, 7 aa, Artificial Sequence
  Description of Artificial Sequence: Synthetic peptide
FVSARSG

SEQ ID NO: 32245 - protein, 7 aa, Artificial Sequence
  Description of Artificial Sequence: Synthetic peptide
TPAGPNK

SEQ ID NO: 32246 - protein, 7 aa, Artificial Sequence
  Description of Artificial Sequence: Synthetic peptide
MSSKQVS

SEQ ID NO: 32247 - protein, 7 aa, Artificial Sequence
  Description of Artificial Sequence: Synthetic peptide
WMSGKNS

SEQ ID NO: 32248 - protein, 7 aa, Artificial Sequence
  Description of Artificial Sequence: Synthetic peptide
ISTPKTA

SEQ ID NO: 32249 - protein, 7 aa, Artificial Sequence
  Description of Artificial Sequence: Synthetic peptide
TRNNKSE

SEQ ID NO: 32250 - protein, 7 aa, Artificial Sequence
  Description of Artificial Sequence: Synthetic peptide
DPVLKPA

SEQ ID NO: 32251 - protein, 7 aa, Artificial Sequence
  Description of Artificial Sequence: Synthetic peptide
PGASGKV

SEQ ID NO: 32252 - protein, 7 aa, Artificial Sequence
  Description of Artificial Sequence: Synthetic peptide
NNVTKAP

SEQ ID NO: 32253 - protein, 7 aa, Artificial Sequence
  Description of Artificial Sequence: Synthetic peptide
NAMNTRG

SEQ ID NO: 32254 - protein, 7 aa, Artificial Sequence
  Description of Artificial Sequence: Synthetic peptide
HGVNKTE

SEQ ID NO: 32255 - protein, 7 aa, Artificial Sequence
  Description of Artificial Sequence: Synthetic peptide
YNRKPAQ

SEQ ID NO: 32256 - protein, 7 aa, Artificial Sequence
  Description of Artificial Sequence: Synthetic peptide
PGGKSQL

SEQ ID NO: 32257 - protein, 7 aa, Artificial Sequence
  Description of Artificial Sequence: Synthetic peptide
YGQTKTQ

SEQ ID NO: 32258 - protein, 7 aa, Artificial Sequence
  Description of Artificial Sequence: Synthetic peptide
GQTHAVR

SEQ ID NO: 32259 - protein, 7 aa, Artificial Sequence
  Description of Artificial Sequence: Synthetic peptide
LTTSVYK

SEQ ID NO: 32260 - protein, 7 aa, Artificial Sequence
  Description of Artificial Sequence: Synthetic peptide
FGNPGIR

SEQ ID NO: 32261 - protein, 7 aa, Artificial Sequence
  Description of Artificial Sequence: Synthetic peptide
RPDRTTL

SEQ ID NO: 32262 - protein, 7 aa, Artificial Sequence
  Description of Artificial Sequence: Synthetic peptide
SFTKGAG

SEQ ID NO: 32263 - protein, 7 aa, Artificial Sequence
  Description of Artificial Sequence: Synthetic peptide
TNRGGTP

SEQ ID NO: 32264 - protein, 7 aa, Artificial Sequence
  Description of Artificial Sequence: Synthetic peptide
LTATNPR

SEQ ID NO: 32265 - protein, 7 aa, Artificial Sequence
  Description of Artificial Sequence: Synthetic peptide
PVSRGSG

SEQ ID NO: 32266 - protein, 7 aa, Artificial Sequence
  Description of Artificial Sequence: Synthetic peptide
GLHPPRT

SEQ ID NO: 32267 - protein, 7 aa, Artificial Sequence
  Description of Artificial Sequence: Synthetic peptide
RVATSVS

SEQ ID NO: 32268 - protein, 7 aa, Artificial Sequence
  Description of Artificial Sequence: Synthetic peptide
THAAHSS

SEQ ID NO: 32269 - protein, 7 aa, Artificial Sequence
  Description of Artificial Sequence: Synthetic peptide
GTNPGTL

SEQ ID NO: 32270 - protein, 7 aa, Artificial Sequence
  Description of Artificial Sequence: Synthetic peptide
TQNTKSI

SEQ ID NO: 32271 - protein, 7 aa, Artificial Sequence
  Description of Artificial Sequence: Synthetic peptide
SHGESQR

SEQ ID NO: 32272 - protein, 7 aa, Artificial Sequence
  Description of Artificial Sequence: Synthetic peptide
LHRAGDA

SEQ ID NO: 32273 - protein, 7 aa, Artificial Sequence
  Description of Artificial Sequence: Synthetic peptide
SIGKGYN

SEQ ID NO: 32274 - protein, 7 aa, Artificial Sequence
  Description of Artificial Sequence: Synthetic peptide
PYKNKPS

SEQ ID NO: 32275 - protein, 7 aa, Artificial Sequence
  Description of Artificial Sequence: Synthetic peptide
LNSMSPR

SEQ ID NO: 32276 - protein, 7 aa, Artificial Sequence
  Description of Artificial Sequence: Synthetic peptide
RYDKQNS

SEQ ID NO: 32277 - protein, 7 aa, Artificial Sequence
  Description of Artificial Sequence: Synthetic peptide
HVNSGKL

SEQ ID NO: 32278 - protein, 7 aa, Artificial Sequence
  Description of Artificial Sequence: Synthetic peptide
VHSSSTK

SEQ ID NO: 32279 - protein, 7 aa, Artificial Sequence
  Description of Artificial Sequence: Synthetic peptide
STGSVSK

SEQ ID NO: 32280 - protein, 7 aa, Artificial Sequence
  Description of Artificial Sequence: Synthetic peptide
TTTTRPS

SEQ ID NO: 32281 - protein, 7 aa, Artificial Sequence
  Description of Artificial Sequence: Synthetic peptide
SVVSEVR

SEQ ID NO: 32282 - protein, 7 aa, Artificial Sequence
  Description of Artificial Sequence: Synthetic peptide
ASLKTQM

SEQ ID NO: 32283 - protein, 7 aa, Artificial Sequence
  Description of Artificial Sequence: Synthetic peptide
FTTGNYC

SEQ ID NO: 32284 - protein, 7 aa, Artificial Sequence
  Description of Artificial Sequence: Synthetic peptide
FSRSPAV

SEQ ID NO: 32285 - protein, 7 aa, Artificial Sequence
  Description of Artificial Sequence: Synthetic peptide
YNIKQGS

SEQ ID NO: 32286 - protein, 7 aa, Artificial Sequence
  Description of Artificial Sequence: Synthetic peptide
DCVSRCK

SEQ ID NO: 32287 - protein, 7 aa, Artificial Sequence
  Description of Artificial Sequence: Synthetic peptide
SIRGGKD

SEQ ID NO: 32288 - protein, 7 aa, Artificial Sequence
  Description of Artificial Sequence: Synthetic peptide
AKTAKNV

SEQ ID NO: 32289 - protein, 7 aa, Artificial Sequence
  Description of Artificial Sequence: Synthetic peptide
FRTQSTK

SEQ ID NO: 32290 - protein, 7 aa, Artificial Sequence
  Description of Artificial Sequence: Synthetic peptide
DSGSSTK

SEQ ID NO: 32291 - protein, 7 aa, Artificial Sequence
  Description of Artificial Sequence: Synthetic peptide
GTARGVA

SEQ ID NO: 32292 - protein, 7 aa, Artificial Sequence
  Description of Artificial Sequence: Synthetic peptide
RATPLSG

SEQ ID NO: 32293 - protein, 7 aa, Artificial Sequence
  Description of Artificial Sequence: Synthetic peptide
SSSGGVK

SEQ ID NO: 32294 - protein, 7 aa, Artificial Sequence
  Description of Artificial Sequence: Synthetic peptide
SGSTKGQ

SEQ ID NO: 32295 - protein, 7 aa, Artificial Sequence
  Description of Artificial Sequence: Synthetic peptide
AKTNLSS

SEQ ID NO: 32296 - protein, 7 aa, Artificial Sequence
  Description of Artificial Sequence: Synthetic peptide
KNPSSVN

SEQ ID NO: 32297 - protein, 7 aa, Artificial Sequence
  Description of Artificial Sequence: Synthetic peptide
MAPRPVP

SEQ ID NO: 32298 - protein, 7 aa, Artificial Sequence
  Description of Artificial Sequence: Synthetic peptide
THRTQNS

SEQ ID NO: 32299 - protein, 7 aa, Artificial Sequence
  Description of Artificial Sequence: Synthetic peptide
LSRNGIN

SEQ ID NO: 32300 - protein, 7 aa, Artificial Sequence
  Description of Artificial Sequence: Synthetic peptide
ARNPTST

SEQ ID NO: 32301 - protein, 7 aa, Artificial Sequence
  Description of Artificial Sequence: Synthetic peptide
GSRSSYV

SEQ ID NO: 32302 - protein, 7 aa, Artificial Sequence
  Description of Artificial Sequence: Synthetic peptide
NAQSRLT

SEQ ID NO: 32303 - protein, 7 aa, Artificial Sequence
  Description of Artificial Sequence: Synthetic peptide
LGDRSFI

SEQ ID NO: 32304 - protein, 7 aa, Artificial Sequence
  Description of Artificial Sequence: Synthetic peptide
LCASKCD

SEQ ID NO: 32305 - protein, 7 aa, Artificial Sequence
  Description of Artificial Sequence: Synthetic peptide
GFERNRE

SEQ ID NO: 32306 - protein, 7 aa, Artificial Sequence
  Description of Artificial Sequence: Synthetic peptide
LSIKGAS

SEQ ID NO: 32307 - protein, 7 aa, Artificial Sequence
  Description of Artificial Sequence: Synthetic peptide
VLKSNGY

SEQ ID NO: 32308 - protein, 7 aa, Artificial Sequence
  Description of Artificial Sequence: Synthetic peptide
FRPSTVV

SEQ ID NO: 32309 - protein, 7 aa, Artificial Sequence
  Description of Artificial Sequence: Synthetic peptide
YPRSGVQ

SEQ ID NO: 32310 - protein, 7 aa, Artificial Sequence
  Description of Artificial Sequence: Synthetic peptide
RANNSQM

SEQ ID NO: 32311 - protein, 7 aa, Artificial Sequence
  Description of Artificial Sequence: Synthetic peptide
MESKANS

SEQ ID NO: 32312 - protein, 7 aa, Artificial Sequence
  Description of Artificial Sequence: Synthetic peptide
VPLAGRP

SEQ ID NO: 32313 - protein, 7 aa, Artificial Sequence
  Description of Artificial Sequence: Synthetic peptide
DPATRKS

SEQ ID NO: 32314 - protein, 7 aa, Artificial Sequence
  Description of Artificial Sequence: Synthetic peptide
NVDNRGF

SEQ ID NO: 32315 - protein, 7 aa, Artificial Sequence
  Description of Artificial Sequence: Synthetic peptide
PSVNRTP

SEQ ID NO: 32316 - protein, 7 aa, Artificial Sequence
  Description of Artificial Sequence: Synthetic peptide
NSHQKPS

SEQ ID NO: 32317 - protein, 7 aa, Artificial Sequence
  Description of Artificial Sequence: Synthetic peptide
RMSNEGK

SEQ ID NO: 32318 - protein, 7 aa, Artificial Sequence
  Description of Artificial Sequence: Synthetic peptide
SRHGSAT

SEQ ID NO: 32319 - protein, 7 aa, Artificial Sequence
  Description of Artificial Sequence: Synthetic peptide
PGTGSNH

SEQ ID NO: 32320 - protein, 7 aa, Artificial Sequence
  Description of Artificial Sequence: Synthetic peptide
AGPLAGP

SEQ ID NO: 32321 - protein, 7 aa, Artificial Sequence
  Description of Artificial Sequence: Synthetic peptide
NVSGQNQ

SEQ ID NO: 32322 - protein, 7 aa, Artificial Sequence
  Description of Artificial Sequence: Synthetic peptide
YHVSKPQ

SEQ ID NO: 32323 - protein, 7 aa, Artificial Sequence
  Description of Artificial Sequence: Synthetic peptide
SGGDYAK

SEQ ID NO: 32324 - protein, 7 aa, Artificial Sequence
  Description of Artificial Sequence: Synthetic peptide
MRSKASM

SEQ ID NO: 32325 - protein, 7 aa, Artificial Sequence
  Description of Artificial Sequence: Synthetic peptide
LGTSQMK

SEQ ID NO: 32326 - protein, 7 aa, Artificial Sequence
  Description of Artificial Sequence: Synthetic peptide
LATNRSN

SEQ ID NO: 32327 - protein, 7 aa, Artificial Sequence
  Description of Artificial Sequence: Synthetic peptide
CIGNKTN

SEQ ID NO: 32328 - protein, 7 aa, Artificial Sequence
  Description of Artificial Sequence: Synthetic peptide
AVSSKVG

SEQ ID NO: 32329 - protein, 7 aa, Artificial Sequence
  Description of Artificial Sequence: Synthetic peptide
NSRISPS

SEQ ID NO: 32330 - protein, 7 aa, Artificial Sequence
  Description of Artificial Sequence: Synthetic peptide
VSGSKVG

SEQ ID NO: 32331 - protein, 7 aa, Artificial Sequence
  Description of Artificial Sequence: Synthetic peptide
RASQSVG

SEQ ID NO: 32332 - protein, 7 aa, Artificial Sequence
  Description of Artificial Sequence: Synthetic peptide
PSTRQSN

SEQ ID NO: 32333 - protein, 7 aa, Artificial Sequence
  Description of Artificial Sequence: Synthetic peptide
TRYNSSL

SEQ ID NO: 32334 - protein, 7 aa, Artificial Sequence
  Description of Artificial Sequence: Synthetic peptide
KTSTPYS

SEQ ID NO: 32335 - protein, 7 aa, Artificial Sequence
  Description of Artificial Sequence: Synthetic peptide
NANSRPV

SEQ ID NO: 32336 - protein, 7 aa, Artificial Sequence
  Description of Artificial Sequence: Synthetic peptide
RSTDPHG

SEQ ID NO: 32337 - protein, 7 aa, Artificial Sequence
  Description of Artificial Sequence: Synthetic peptide
QLGDRNR

SEQ ID NO: 32338 - protein, 7 aa, Artificial Sequence
  Description of Artificial Sequence: Synthetic peptide
SGGKGPT

SEQ ID NO: 32339 - protein, 7 aa, Artificial Sequence
  Description of Artificial Sequence: Synthetic peptide
IQTHTSN

SEQ ID NO: 32340 - protein, 7 aa, Artificial Sequence
  Description of Artificial Sequence: Synthetic peptide
AFGGETK

SEQ ID NO: 32341 - protein, 7 aa, Artificial Sequence
  Description of Artificial Sequence: Synthetic peptide
RGPTGMM

SEQ ID NO: 32342 - protein, 7 aa, Artificial Sequence
  Description of Artificial Sequence: Synthetic peptide
NIASKGP

SEQ ID NO: 32343 - protein, 7 aa, Artificial Sequence
  Description of Artificial Sequence: Synthetic peptide
AVDSTRA

SEQ ID NO: 32344 - protein, 7 aa, Artificial Sequence
  Description of Artificial Sequence: Synthetic peptide
QMKHLQG

SEQ ID NO: 32345 - protein, 7 aa, Artificial Sequence
  Description of Artificial Sequence: Synthetic peptide
GKSQMQL

SEQ ID NO: 32346 - protein, 7 aa, Artificial Sequence
  Description of Artificial Sequence: Synthetic peptide
VNKINGS

SEQ ID NO: 32347 - protein, 7 aa, Artificial Sequence
  Description of Artificial Sequence: Synthetic peptide
ASHLPVN

SEQ ID NO: 32348 - protein, 7 aa, Artificial Sequence
  Description of Artificial Sequence: Synthetic peptide
TGRAPSS

SEQ ID NO: 32349 - protein, 7 aa, Artificial Sequence
  Description of Artificial Sequence: Synthetic peptide
TSGRTTY

SEQ ID NO: 32350 - protein, 7 aa, Artificial Sequence
  Description of Artificial Sequence: Synthetic peptide
PNLNSRG

SEQ ID NO: 32351 - protein, 7 aa, Artificial Sequence
  Description of Artificial Sequence: Synthetic peptide
ETTTPRK

SEQ ID NO: 32352 - protein, 7 aa, Artificial Sequence
  Description of Artificial Sequence: Synthetic peptide
SATKSSC

SEQ ID NO: 32353 - protein, 7 aa, Artificial Sequence
  Description of Artificial Sequence: Synthetic peptide
SKTDHSL

SEQ ID NO: 32354 - protein, 7 aa, Artificial Sequence
  Description of Artificial Sequence: Synthetic peptide
RSTNDGR

SEQ ID NO: 32355 - protein, 7 aa, Artificial Sequence
  Description of Artificial Sequence: Synthetic peptide
QSISHTR

SEQ ID NO: 32356 - protein, 7 aa, Artificial Sequence
  Description of Artificial Sequence: Synthetic peptide
RTNKSVT

SEQ ID NO: 32357 - protein, 7 aa, Artificial Sequence
  Description of Artificial Sequence: Synthetic peptide
NTSTNGI

SEQ ID NO: 32358 - protein, 7 aa, Artificial Sequence
  Description of Artificial Sequence: Synthetic peptide
PMQSMNR

SEQ ID NO: 32359 - protein, 7 aa, Artificial Sequence
  Description of Artificial Sequence: Synthetic peptide
TTAPGLR

SEQ ID NO: 32360 - protein, 7 aa, Artificial Sequence
  Description of Artificial Sequence: Synthetic peptide
SRNVNAM

SEQ ID NO: 32361 - protein, 7 aa, Artificial Sequence
  Description of Artificial Sequence: Synthetic peptide
MSSRSSV

SEQ ID NO: 32362 - protein, 7 aa, Artificial Sequence
  Description of Artificial Sequence: Synthetic peptide
SGGTPGR

SEQ ID NO: 32363 - protein, 7 aa, Artificial Sequence
  Description of Artificial Sequence: Synthetic peptide
PKLSHTG

SEQ ID NO: 32364 - protein, 7 aa, Artificial Sequence
  Description of Artificial Sequence: Synthetic peptide
GNSANRT

SEQ ID NO: 32365 - protein, 7 aa, Artificial Sequence
  Description of Artificial Sequence: Synthetic peptide
HRHEKSV

SEQ ID NO: 32366 - protein, 7 aa, Artificial Sequence
  Description of Artificial Sequence: Synthetic peptide
QSSSQQR

SEQ ID NO: 32367 - protein, 7 aa, Artificial Sequence
  Description of Artificial Sequence: Synthetic peptide
PTTGPQR

SEQ ID NO: 32368 - protein, 7 aa, Artificial Sequence
  Description of Artificial Sequence: Synthetic peptide
NSFSRNS

SEQ ID NO: 32369 - protein, 7 aa, Artificial Sequence
  Description of Artificial Sequence: Synthetic peptide
LTSRSMA

SEQ ID NO: 32370 - protein, 7 aa, Artificial Sequence
  Description of Artificial Sequence: Synthetic peptide
GVNRIPA

SEQ ID NO: 32371 - protein, 7 aa, Artificial Sequence
  Description of Artificial Sequence: Synthetic peptide
KPATPNG

SEQ ID NO: 32372 - protein, 7 aa, Artificial Sequence
  Description of Artificial Sequence: Synthetic peptide
RPASTHT

SEQ ID NO: 32373 - protein, 7 aa, Artificial Sequence
  Description of Artificial Sequence: Synthetic peptide
NLNSVSK

SEQ ID NO: 32374 - protein, 7 aa, Artificial Sequence
  Description of Artificial Sequence: Synthetic peptide
HRTSPVS

SEQ ID NO: 32375 - protein, 7 aa, Artificial Sequence
  Description of Artificial Sequence: Synthetic peptide
PRTDRNT

SEQ ID NO: 32376 - protein, 7 aa, Artificial Sequence
  Description of Artificial Sequence: Synthetic peptide
RTNPGYA

SEQ ID NO: 32377 - protein, 7 aa, Artificial Sequence
  Description of Artificial Sequence: Synthetic peptide
HSTRSSL

SEQ ID NO: 32378 - protein, 7 aa, Artificial Sequence
  Description of Artificial Sequence: Synthetic peptide
PLSKDRL

SEQ ID NO: 32379 - protein, 7 aa, Artificial Sequence
  Description of Artificial Sequence: Synthetic peptide
KNQSLMS

SEQ ID NO: 32380 - protein, 7 aa, Artificial Sequence
  Description of Artificial Sequence: Synthetic peptide
NAQQAQR

SEQ ID NO: 32381 - protein, 7 aa, Artificial Sequence
  Description of Artificial Sequence: Synthetic peptide
PPSNGRL

SEQ ID NO: 32382 - protein, 7 aa, Artificial Sequence
  Description of Artificial Sequence: Synthetic peptide
DHRSKVL

SEQ ID NO: 32383 - protein, 7 aa, Artificial Sequence
  Description of Artificial Sequence: Synthetic peptide
GRLTSSI

SEQ ID NO: 32384 - protein, 7 aa, Artificial Sequence
  Description of Artificial Sequence: Synthetic peptide
GSDQRRM

SEQ ID NO: 32385 - protein, 7 aa, Artificial Sequence
  Description of Artificial Sequence: Synthetic peptide
NANQNQM

SEQ ID NO: 32386 - protein, 7 aa, Artificial Sequence
  Description of Artificial Sequence: Synthetic peptide
FSTRSVV

SEQ ID NO: 32387 - protein, 7 aa, Artificial Sequence
  Description of Artificial Sequence: Synthetic peptide
EYPQQAK

SEQ ID NO: 32388 - protein, 7 aa, Artificial Sequence
  Description of Artificial Sequence: Synthetic peptide
QPSQGHS

SEQ ID NO: 32389 - protein, 7 aa, Artificial Sequence
  Description of Artificial Sequence: Synthetic peptide
PTLASGR

SEQ ID NO: 32390 - protein, 7 aa, Artificial Sequence
  Description of Artificial Sequence: Synthetic peptide
TRGHPLV

SEQ ID NO: 32391 - protein, 7 aa, Artificial Sequence
  Description of Artificial Sequence: Synthetic peptide
PTTLKHD

SEQ ID NO: 32392 - protein, 7 aa, Artificial Sequence
  Description of Artificial Sequence: Synthetic peptide
AYPKNSN

SEQ ID NO: 32393 - protein, 7 aa, Artificial Sequence
  Description of Artificial Sequence: Synthetic peptide
ITSGSTR

SEQ ID NO: 32394 - protein, 7 aa, Artificial Sequence
  Description of Artificial Sequence: Synthetic peptide
PRTNVMP

SEQ ID NO: 32395 - protein, 7 aa, Artificial Sequence
  Description of Artificial Sequence: Synthetic peptide
QLNHSAK

SEQ ID NO: 32396 - protein, 7 aa, Artificial Sequence
  Description of Artificial Sequence: Synthetic peptide
TGSSGRI

SEQ ID NO: 32397 - protein, 7 aa, Artificial Sequence
  Description of Artificial Sequence: Synthetic peptide
NINSRLA

SEQ ID NO: 32398 - protein, 7 aa, Artificial Sequence
  Description of Artificial Sequence: Synthetic peptide
NGPGQNQ

SEQ ID NO: 32399 - protein, 7 aa, Artificial Sequence
  Description of Artificial Sequence: Synthetic peptide
PAAHNAV

SEQ ID NO: 32400 - protein, 7 aa, Artificial Sequence
  Description of Artificial Sequence: Synthetic peptide
QRKSGTS

SEQ ID NO: 32401 - protein, 7 aa, Artificial Sequence
  Description of Artificial Sequence: Synthetic peptide
GGRRVGL

SEQ ID NO: 32402 - protein, 7 aa, Artificial Sequence
  Description of Artificial Sequence: Synthetic peptide
TLSQTVR

SEQ ID NO: 32403 - protein, 7 aa, Artificial Sequence
  Description of Artificial Sequence: Synthetic peptide
WGSGLNH

SEQ ID NO: 32404 - protein, 7 aa, Artificial Sequence
  Description of Artificial Sequence: Synthetic peptide
NSVERTR

SEQ ID NO: 32405 - protein, 7 aa, Artificial Sequence
  Description of Artificial Sequence: Synthetic peptide
ASALRSH

SEQ ID NO: 32406 - protein, 7 aa, Artificial Sequence
  Description of Artificial Sequence: Synthetic peptide
SGRDKIS

SEQ ID NO: 32407 - protein, 7 aa, Artificial Sequence
  Description of Artificial Sequence: Synthetic peptide
DRVLSQG

SEQ ID NO: 32408 - protein, 7 aa, Artificial Sequence
  Description of Artificial Sequence: Synthetic peptide
VHTSGVQ

SEQ ID NO: 32409 - protein, 7 aa, Artificial Sequence
  Description of Artificial Sequence: Synthetic peptide
RYPPATH

SEQ ID NO: 32410 - protein, 7 aa, Artificial Sequence
  Description of Artificial Sequence: Synthetic peptide
VSDNTYK

SEQ ID NO: 32411 - protein, 7 aa, Artificial Sequence
  Description of Artificial Sequence: Synthetic peptide
NVESKSC

SEQ ID NO: 32412 - protein, 7 aa, Artificial Sequence
  Description of Artificial Sequence: Synthetic peptide
PRTNNPS

SEQ ID NO: 32413 - protein, 7 aa, Artificial Sequence
  Description of Artificial Sequence: Synthetic peptide
GTDSKRH

SEQ ID NO: 32414 - protein, 7 aa, Artificial Sequence
  Description of Artificial Sequence: Synthetic peptide
VNTNRAA

SEQ ID NO: 32415 - protein, 7 aa, Artificial Sequence
  Description of Artificial Sequence: Synthetic peptide
VTQSSSK

SEQ ID NO: 32416 - protein, 7 aa, Artificial Sequence
  Description of Artificial Sequence: Synthetic peptide
GITKNLA

SEQ ID NO: 32417 - protein, 7 aa, Artificial Sequence
  Description of Artificial Sequence: Synthetic peptide
SNTNSAN

SEQ ID NO: 32418 - protein, 7 aa, Artificial Sequence
  Description of Artificial Sequence: Synthetic peptide
SSQTRGL

SEQ ID NO: 32419 - protein, 7 aa, Artificial Sequence
  Description of Artificial Sequence: Synthetic peptide
GRVVSMQ

SEQ ID NO: 32420 - protein, 7 aa, Artificial Sequence
  Description of Artificial Sequence: Synthetic peptide
NGSQGRQ

SEQ ID NO: 32421 - protein, 7 aa, Artificial Sequence
  Description of Artificial Sequence: Synthetic peptide
RMSSTHG

SEQ ID NO: 32422 - protein, 7 aa, Artificial Sequence
  Description of Artificial Sequence: Synthetic peptide
SAVGKAS

SEQ ID NO: 32423 - protein, 7 aa, Artificial Sequence
  Description of Artificial Sequence: Synthetic peptide
DRTNTQR

SEQ ID NO: 32424 - protein, 7 aa, Artificial Sequence
  Description of Artificial Sequence: Synthetic peptide
HNSKSQI

SEQ ID NO: 32425 - protein, 7 aa, Artificial Sequence
  Description of Artificial Sequence: Synthetic peptide
PYAGNQR

SEQ ID NO: 32426 - protein, 7 aa, Artificial Sequence
  Description of Artificial Sequence: Synthetic peptide
GGSSRTL

SEQ ID NO: 32427 - protein, 7 aa, Artificial Sequence
  Description of Artificial Sequence: Synthetic peptide
VAGAAQR

SEQ ID NO: 32428 - protein, 7 aa, Artificial Sequence
  Description of Artificial Sequence: Synthetic peptide
RDSTKLV

SEQ ID NO: 32429 - protein, 7 aa, Artificial Sequence
  Description of Artificial Sequence: Synthetic peptide
NSHTPVR

SEQ ID NO: 32430 - protein, 7 aa, Artificial Sequence
  Description of Artificial Sequence: Synthetic peptide
PRVKPAS

SEQ ID NO: 32431 - protein, 7 aa, Artificial Sequence
  Description of Artificial Sequence: Synthetic peptide
PPSKPNT

SEQ ID NO: 32432 - protein, 7 aa, Artificial Sequence
  Description of Artificial Sequence: Synthetic peptide
GSNRILG

SEQ ID NO: 32433 - protein, 7 aa, Artificial Sequence
  Description of Artificial Sequence: Synthetic peptide
GGHSPNR

SEQ ID NO: 32434 - protein, 7 aa, Artificial Sequence
  Description of Artificial Sequence: Synthetic peptide
FVSRERS

SEQ ID NO: 32435 - protein, 7 aa, Artificial Sequence
  Description of Artificial Sequence: Synthetic peptide
YTAAPGR

SEQ ID NO: 32436 - protein, 7 aa, Artificial Sequence
  Description of Artificial Sequence: Synthetic peptide
YNVNRNT

SEQ ID NO: 32437 - protein, 7 aa, Artificial Sequence
  Description of Artificial Sequence: Synthetic peptide
ERKVQNC

SEQ ID NO: 32438 - protein, 7 aa, Artificial Sequence
  Description of Artificial Sequence: Synthetic peptide
GRLNMLS

SEQ ID NO: 32439 - protein, 7 aa, Artificial Sequence
  Description of Artificial Sequence: Synthetic peptide
LQKPSLV

SEQ ID NO: 32440 - protein, 7 aa, Artificial Sequence
  Description of Artificial Sequence: Synthetic peptide
GRTAEGR

SEQ ID NO: 32441 - protein, 7 aa, Artificial Sequence
  Description of Artificial Sequence: Synthetic peptide
HVIAPQQ

SEQ ID NO: 32442 - protein, 7 aa, Artificial Sequence
  Description of Artificial Sequence: Synthetic peptide
HQTTGLK

SEQ ID NO: 32443 - protein, 7 aa, Artificial Sequence
  Description of Artificial Sequence: Synthetic peptide
GQSGSRL

SEQ ID NO: 32444 - protein, 7 aa, Artificial Sequence
  Description of Artificial Sequence: Synthetic peptide
QGSSPQR

SEQ ID NO: 32445 - protein, 7 aa, Artificial Sequence
  Description of Artificial Sequence: Synthetic peptide
AATNRFG

SEQ ID NO: 32446 - protein, 7 aa, Artificial Sequence
  Description of Artificial Sequence: Synthetic peptide
RFPAKEF

SEQ ID NO: 32447 - protein, 7 aa, Artificial Sequence
  Description of Artificial Sequence: Synthetic peptide
TGSGSNH

SEQ ID NO: 32448 - protein, 7 aa, Artificial Sequence
  Description of Artificial Sequence: Synthetic peptide
QVPVRPV

SEQ ID NO: 32449 - protein, 7 aa, Artificial Sequence
  Description of Artificial Sequence: Synthetic peptide
TLAYDNN

SEQ ID NO: 32450 - protein, 7 aa, Artificial Sequence
  Description of Artificial Sequence: Synthetic peptide
PRSSGGF

SEQ ID NO: 32451 - protein, 7 aa, Artificial Sequence
  Description of Artificial Sequence: Synthetic peptide
PSRNTSL

SEQ ID NO: 32452 - protein, 7 aa, Artificial Sequence
  Description of Artificial Sequence: Synthetic peptide
TGMRNIG

SEQ ID NO: 32453 - protein, 7 aa, Artificial Sequence
  Description of Artificial Sequence: Synthetic peptide
GLQTPPR

SEQ ID NO: 32454 - protein, 7 aa, Artificial Sequence
  Description of Artificial Sequence: Synthetic peptide
FQPRSST

SEQ ID NO: 32455 - protein, 7 aa, Artificial Sequence
  Description of Artificial Sequence: Synthetic peptide
PMSHVSG

SEQ ID NO: 32456 - protein, 7 aa, Artificial Sequence
  Description of Artificial Sequence: Synthetic peptide
VRGSDPT

SEQ ID NO: 32457 - protein, 7 aa, Artificial Sequence
  Description of Artificial Sequence: Synthetic peptide
MKGNNLS

SEQ ID NO: 32458 - protein, 7 aa, Artificial Sequence
  Description of Artificial Sequence: Synthetic peptide
RISENMR

SEQ ID NO: 32459 - protein, 7 aa, Artificial Sequence
  Description of Artificial Sequence: Synthetic peptide
YGKSVTP

SEQ ID NO: 32460 - protein, 7 aa, Artificial Sequence
  Description of Artificial Sequence: Synthetic peptide
NANVQTR

SEQ ID NO: 32461 - protein, 7 aa, Artificial Sequence
  Description of Artificial Sequence: Synthetic peptide
KSADQGR

SEQ ID NO: 32462 - protein, 7 aa, Artificial Sequence
  Description of Artificial Sequence: Synthetic peptide
AGSSSRS

SEQ ID NO: 32463 - protein, 7 aa, Artificial Sequence
  Description of Artificial Sequence: Synthetic peptide
HHDASPN

SEQ ID NO: 32464 - protein, 7 aa, Artificial Sequence
  Description of Artificial Sequence: Synthetic peptide
AMGSRLS

SEQ ID NO: 32465 - protein, 7 aa, Artificial Sequence
  Description of Artificial Sequence: Synthetic peptide
YSNSRVG

SEQ ID NO: 32466 - protein, 7 aa, Artificial Sequence
  Description of Artificial Sequence: Synthetic peptide
VRSLPAM

SEQ ID NO: 32467 - protein, 7 aa, Artificial Sequence
  Description of Artificial Sequence: Synthetic peptide
YFNSHSN

SEQ ID NO: 32468 - protein, 7 aa, Artificial Sequence
  Description of Artificial Sequence: Synthetic peptide
PTASNRS

SEQ ID NO: 32469 - protein, 7 aa, Artificial Sequence
  Description of Artificial Sequence: Synthetic peptide
TQQNGSN

SEQ ID NO: 32470 - protein, 7 aa, Artificial Sequence
  Description of Artificial Sequence: Synthetic peptide
STSKDYT

SEQ ID NO: 32471 - protein, 7 aa, Artificial Sequence
  Description of Artificial Sequence: Synthetic peptide
NPAEQYT

SEQ ID NO: 32472 - protein, 7 aa, Artificial Sequence
  Description of Artificial Sequence: Synthetic peptide
SRSHAMT

SEQ ID NO: 32473 - protein, 7 aa, Artificial Sequence
  Description of Artificial Sequence: Synthetic peptide
RSGNGSL

SEQ ID NO: 32474 - protein, 7 aa, Artificial Sequence
  Description of Artificial Sequence: Synthetic peptide
HPTRSTA

SEQ ID NO: 32475 - protein, 7 aa, Artificial Sequence
  Description of Artificial Sequence: Synthetic peptide
TPVNRTH

SEQ ID NO: 32476 - protein, 7 aa, Artificial Sequence
  Description of Artificial Sequence: Synthetic peptide
SSASTYK

SEQ ID NO: 32477 - protein, 7 aa, Artificial Sequence
  Description of Artificial Sequence: Synthetic peptide
STVGHMN

SEQ ID NO: 32478 - protein, 7 aa, Artificial Sequence
  Description of Artificial Sequence: Synthetic peptide
QGPKNAD

SEQ ID NO: 32479 - protein, 7 aa, Artificial Sequence
  Description of Artificial Sequence: Synthetic peptide
SSHSPHR

SEQ ID NO: 32480 - protein, 7 aa, Artificial Sequence
  Description of Artificial Sequence: Synthetic peptide
ENISRSH

SEQ ID NO: 32481 - protein, 7 aa, Artificial Sequence
  Description of Artificial Sequence: Synthetic peptide
TRMNKQT

SEQ ID NO: 32482 - protein, 7 aa, Artificial Sequence
  Description of Artificial Sequence: Synthetic peptide
FSSASFT

SEQ ID NO: 32483 - protein, 7 aa, Artificial Sequence
  Description of Artificial Sequence: Synthetic peptide
CGTLSSC

SEQ ID NO: 32484 - protein, 7 aa, Artificial Sequence
  Description of Artificial Sequence: Synthetic peptide
HGSSVHS

SEQ ID NO: 32485 - protein, 7 aa, Artificial Sequence
  Description of Artificial Sequence: Synthetic peptide
SGSSTFR

SEQ ID NO: 32486 - protein, 7 aa, Artificial Sequence
  Description of Artificial Sequence: Synthetic peptide
SISNQRS

SEQ ID NO: 32487 - protein, 7 aa, Artificial Sequence
  Description of Artificial Sequence: Synthetic peptide
NGSGQNR

SEQ ID NO: 32488 - protein, 7 aa, Artificial Sequence
  Description of Artificial Sequence: Synthetic peptide
RDHSGSR

SEQ ID NO: 32489 - protein, 7 aa, Artificial Sequence
  Description of Artificial Sequence: Synthetic peptide
SSKTNVS

SEQ ID NO: 32490 - protein, 7 aa, Artificial Sequence
  Description of Artificial Sequence: Synthetic peptide
SRAQSIP

SEQ ID NO: 32491 - protein, 7 aa, Artificial Sequence
  Description of Artificial Sequence: Synthetic peptide
LNRGKPV

SEQ ID NO: 32492 - protein, 7 aa, Artificial Sequence
  Description of Artificial Sequence: Synthetic peptide
HSGTRTS

SEQ ID NO: 32493 - protein, 7 aa, Artificial Sequence
  Description of Artificial Sequence: Synthetic peptide
NDQAQLT

SEQ ID NO: 32494 - protein, 7 aa, Artificial Sequence
  Description of Artificial Sequence: Synthetic peptide
NTTAKSS

SEQ ID NO: 32495 - protein, 7 aa, Artificial Sequence
  Description of Artificial Sequence: Synthetic peptide
NGSGKNQ

SEQ ID NO: 32496 - protein, 7 aa, Artificial Sequence
  Description of Artificial Sequence: Synthetic peptide
QTQGQLK

SEQ ID NO: 32497 - protein, 7 aa, Artificial Sequence
  Description of Artificial Sequence: Synthetic peptide
NSAGTRV

SEQ ID NO: 32498 - protein, 7 aa, Artificial Sequence
  Description of Artificial Sequence: Synthetic peptide
PVGSRGG

SEQ ID NO: 32499 - protein, 7 aa, Artificial Sequence
  Description of Artificial Sequence: Synthetic peptide
DTNNRAN

SEQ ID NO: 32500 - protein, 7 aa, Artificial Sequence
  Description of Artificial Sequence: Synthetic peptide
SHPSSFG

SEQ ID NO: 32501 - protein, 7 aa, Artificial Sequence
  Description of Artificial Sequence: Synthetic peptide
KVHRSDN

SEQ ID NO: 32502 - protein, 7 aa, Artificial Sequence
  Description of Artificial Sequence: Synthetic peptide
GSPGVLR

SEQ ID NO: 32503 - protein, 7 aa, Artificial Sequence
  Description of Artificial Sequence: Synthetic peptide
RQTTPLG

SEQ ID NO: 32504 - protein, 7 aa, Artificial Sequence
  Description of Artificial Sequence: Synthetic peptide
DMVSPRN

SEQ ID NO: 32505 - protein, 7 aa, Artificial Sequence
  Description of Artificial Sequence: Synthetic peptide
SNDSRIR

SEQ ID NO: 32506 - protein, 7 aa, Artificial Sequence
  Description of Artificial Sequence: Synthetic peptide
QTMPKLA

SEQ ID NO: 32507 - protein, 7 aa, Artificial Sequence
  Description of Artificial Sequence: Synthetic peptide
GPRSMSN

SEQ ID NO: 32508 - protein, 7 aa, Artificial Sequence
  Description of Artificial Sequence: Synthetic peptide
FRAQANV

SEQ ID NO: 32509 - protein, 7 aa, Artificial Sequence
  Description of Artificial Sequence: Synthetic peptide
STKSKPI

SEQ ID NO: 32510 - protein, 7 aa, Artificial Sequence
  Description of Artificial Sequence: Synthetic peptide
PGNMTSR

SEQ ID NO: 32511 - protein, 7 aa, Artificial Sequence
  Description of Artificial Sequence: Synthetic peptide
SKAGRVT

SEQ ID NO: 32512 - protein, 7 aa, Artificial Sequence
  Description of Artificial Sequence: Synthetic peptide
MGSSVRS

SEQ ID NO: 32513 - protein, 7 aa, Artificial Sequence
  Description of Artificial Sequence: Synthetic peptide
AHSNNSY

SEQ ID NO: 32514 - protein, 7 aa, Artificial Sequence
  Description of Artificial Sequence: Synthetic peptide
QTKPAFR

SEQ ID NO: 32515 - protein, 7 aa, Artificial Sequence
  Description of Artificial Sequence: Synthetic peptide
IATKAVA

SEQ ID NO: 32516 - protein, 7 aa, Artificial Sequence
  Description of Artificial Sequence: Synthetic peptide
TQQKGSN

SEQ ID NO: 32517 - protein, 7 aa, Artificial Sequence
  Description of Artificial Sequence: Synthetic peptide
SDSRNTN

SEQ ID NO: 32518 - protein, 7 aa, Artificial Sequence
  Description of Artificial Sequence: Synthetic peptide
PATVTGV

SEQ ID NO: 32519 - protein, 7 aa, Artificial Sequence
  Description of Artificial Sequence: Synthetic peptide
GITAKLT

SEQ ID NO: 32520 - protein, 7 aa, Artificial Sequence
  Description of Artificial Sequence: Synthetic peptide
PVSDRRG

SEQ ID NO: 32521 - protein, 7 aa, Artificial Sequence
  Description of Artificial Sequence: Synthetic peptide
SKASGFA

SEQ ID NO: 32522 - protein, 7 aa, Artificial Sequence
  Description of Artificial Sequence: Synthetic peptide
PLNARGS

SEQ ID NO: 32523 - protein, 7 aa, Artificial Sequence
  Description of Artificial Sequence: Synthetic peptide
GQTRESS

SEQ ID NO: 32524 - protein, 7 aa, Artificial Sequence
  Description of Artificial Sequence: Synthetic peptide
SPASLPK

SEQ ID NO: 32525 - protein, 7 aa, Artificial Sequence
  Description of Artificial Sequence: Synthetic peptide
NGSGQNK

SEQ ID NO: 32526 - protein, 7 aa, Artificial Sequence
  Description of Artificial Sequence: Synthetic peptide
KGPGSPS

SEQ ID NO: 32527 - protein, 7 aa, Artificial Sequence
  Description of Artificial Sequence: Synthetic peptide
GREIGNY

SEQ ID NO: 32528 - protein, 7 aa, Artificial Sequence
  Description of Artificial Sequence: Synthetic peptide
RSVGAKA

SEQ ID NO: 32529 - protein, 7 aa, Artificial Sequence
  Description of Artificial Sequence: Synthetic peptide
RRLNIED

SEQ ID NO: 32530 - protein, 7 aa, Artificial Sequence
  Description of Artificial Sequence: Synthetic peptide
PSNSNML

SEQ ID NO: 32531 - protein, 7 aa, Artificial Sequence
  Description of Artificial Sequence: Synthetic peptide
DPRNSTS

SEQ ID NO: 32532 - protein, 7 aa, Artificial Sequence
  Description of Artificial Sequence: Synthetic peptide
ETRKQGV

SEQ ID NO: 32533 - protein, 7 aa, Artificial Sequence
  Description of Artificial Sequence: Synthetic peptide
VSYARTE

SEQ ID NO: 32534 - protein, 7 aa, Artificial Sequence
  Description of Artificial Sequence: Synthetic peptide
QPTRSTA

SEQ ID NO: 32535 - protein, 7 aa, Artificial Sequence
  Description of Artificial Sequence: Synthetic peptide
PRTRDTS

SEQ ID NO: 32536 - protein, 7 aa, Artificial Sequence
  Description of Artificial Sequence: Synthetic peptide
ALHASYN

SEQ ID NO: 32537 - protein, 7 aa, Artificial Sequence
  Description of Artificial Sequence: Synthetic peptide
KSKIQHP

SEQ ID NO: 32538 - protein, 7 aa, Artificial Sequence
  Description of Artificial Sequence: Synthetic peptide
KDNTPGR

SEQ ID NO: 32539 - protein, 7 aa, Artificial Sequence
  Description of Artificial Sequence: Synthetic peptide
KPTRSTA

SEQ ID NO: 32540 - protein, 7 aa, Artificial Sequence
  Description of Artificial Sequence: Synthetic peptide
QPNTTYR

SEQ ID NO: 32541 - protein, 7 aa, Artificial Sequence
  Description of Artificial Sequence: Synthetic peptide
YIHNQTG

SEQ ID NO: 32542 - protein, 7 aa, Artificial Sequence
  Description of Artificial Sequence: Synthetic peptide
FNIQGLG

SEQ ID NO: 32543 - protein, 7 aa, Artificial Sequence
  Description of Artificial Sequence: Synthetic peptide
AYSNIQN

SEQ ID NO: 32544 - protein, 7 aa, Artificial Sequence
  Description of Artificial Sequence: Synthetic peptide
KNESMVL

SEQ ID NO: 32545 - protein, 7 aa, Artificial Sequence
  Description of Artificial Sequence: Synthetic peptide
SGSNNFL

SEQ ID NO: 32546 - protein, 7 aa, Artificial Sequence
  Description of Artificial Sequence: Synthetic peptide
AIRSGYV

SEQ ID NO: 32547 - protein, 7 aa, Artificial Sequence
  Description of Artificial Sequence: Synthetic peptide
FSVQGQC

SEQ ID NO: 32548 - protein, 7 aa, Artificial Sequence
  Description of Artificial Sequence: Synthetic peptide
NSTQITP

SEQ ID NO: 32549 - protein, 7 aa, Artificial Sequence
  Description of Artificial Sequence: Synthetic peptide
TNITPPL

SEQ ID NO: 32550 - protein, 7 aa, Artificial Sequence
  Description of Artificial Sequence: Synthetic peptide
FPSNGRT

SEQ ID NO: 32551 - protein, 7 aa, Artificial Sequence
  Description of Artificial Sequence: Synthetic peptide
GNSTRLL

SEQ ID NO: 32552 - protein, 7 aa, Artificial Sequence
  Description of Artificial Sequence: Synthetic peptide
YRHTSTG

SEQ ID NO: 32553 - protein, 7 aa, Artificial Sequence
  Description of Artificial Sequence: Synthetic peptide
NNTQKNS

SEQ ID NO: 32554 - protein, 7 aa, Artificial Sequence
  Description of Artificial Sequence: Synthetic peptide
PLGQSYR

SEQ ID NO: 32555 - protein, 7 aa, Artificial Sequence
  Description of Artificial Sequence: Synthetic peptide
RNSEYTG

SEQ ID NO: 32556 - protein, 7 aa, Artificial Sequence
  Description of Artificial Sequence: Synthetic peptide
SQTVKTG

SEQ ID NO: 32557 - protein, 7 aa, Artificial Sequence
  Description of Artificial Sequence: Synthetic peptide
ALLNINT

SEQ ID NO: 32558 - protein, 7 aa, Artificial Sequence
  Description of Artificial Sequence: Synthetic peptide
MLQRAPG

SEQ ID NO: 32559 - protein, 7 aa, Artificial Sequence
  Description of Artificial Sequence: Synthetic peptide
ENMGRPG

SEQ ID NO: 32560 - protein, 7 aa, Artificial Sequence
  Description of Artificial Sequence: Synthetic peptide
YVRPGTG

SEQ ID NO: 32561 - protein, 7 aa, Artificial Sequence
  Description of Artificial Sequence: Synthetic peptide
PGSGSNN

SEQ ID NO: 32562 - protein, 7 aa, Artificial Sequence
  Description of Artificial Sequence: Synthetic peptide
NSNGINN

SEQ ID NO: 32563 - protein, 7 aa, Artificial Sequence
  Description of Artificial Sequence: Synthetic peptide
NFNSPSN

SEQ ID NO: 32564 - protein, 7 aa, Artificial Sequence
  Description of Artificial Sequence: Synthetic peptide
STYCKDP

SEQ ID NO: 32565 - protein, 7 aa, Artificial Sequence
  Description of Artificial Sequence: Synthetic peptide
NSNGLNN

SEQ ID NO: 32566 - protein, 7 aa, Artificial Sequence
  Description of Artificial Sequence: Synthetic peptide
SIGKGYN

SEQ ID NO: 32567 - protein, 7 aa, Artificial Sequence
  Description of Artificial Sequence: Synthetic peptide
YQKERVV

SEQ ID NO: 32568 - protein, 7 aa, Artificial Sequence
  Description of Artificial Sequence: Synthetic peptide
NSGRNSV

SEQ ID NO: 32569 - protein, 7 aa, Artificial Sequence
  Description of Artificial Sequence: Synthetic peptide
CHKRPGE

SEQ ID NO: 32570 - protein, 7 aa, Artificial Sequence
  Description of Artificial Sequence: Synthetic peptide
NSNLSTQ

SEQ ID NO: 32571 - protein, 7 aa, Artificial Sequence
  Description of Artificial Sequence: Synthetic peptide
SSGGNMS

SEQ ID NO: 32572 - protein, 7 aa, Artificial Sequence
  Description of Artificial Sequence: Synthetic peptide
KDFGQMR

SEQ ID NO: 32573 - protein, 7 aa, Artificial Sequence
  Description of Artificial Sequence: Synthetic peptide
SIKTVTN

SEQ ID NO: 32574 - protein, 7 aa, Artificial Sequence
  Description of Artificial Sequence: Synthetic peptide
EVFSSQK

SEQ ID NO: 32575 - protein, 7 aa, Artificial Sequence
  Description of Artificial Sequence: Synthetic peptide
NGFNSNN

SEQ ID NO: 32576 - protein, 7 aa, Artificial Sequence
  Description of Artificial Sequence: Synthetic peptide
ASRAPPG

SEQ ID NO: 32577 - protein, 7 aa, Artificial Sequence
  Description of Artificial Sequence: Synthetic peptide
HLYSPRG

SEQ ID NO: 32578 - protein, 7 aa, Artificial Sequence
  Description of Artificial Sequence: Synthetic peptide
SQIPPST

SEQ ID NO: 32579 - protein, 7 aa, Artificial Sequence
  Description of Artificial Sequence: Synthetic peptide
NNKGNPG

SEQ ID NO: 32580 - protein, 7 aa, Artificial Sequence
  Description of Artificial Sequence: Synthetic peptide
PKARQHN

SEQ ID NO: 32581 - protein, 7 aa, Artificial Sequence
  Description of Artificial Sequence: Synthetic peptide
KATVPAG

SEQ ID NO: 32582 - protein, 7 aa, Artificial Sequence
  Description of Artificial Sequence: Synthetic peptide
PVREGSI

SEQ ID NO: 32583 - protein, 7 aa, Artificial Sequence
  Description of Artificial Sequence: Synthetic peptide
NPSEKML

SEQ ID NO: 32584 - protein, 7 aa, Artificial Sequence
  Description of Artificial Sequence: Synthetic peptide
KINTRNM

SEQ ID NO: 32585 - protein, 7 aa, Artificial Sequence
  Description of Artificial Sequence: Synthetic peptide
GVNNNIN

SEQ ID NO: 32586 - protein, 7 aa, Artificial Sequence
  Description of Artificial Sequence: Synthetic peptide
SFTKGAG

SEQ ID NO: 32587 - protein, 7 aa, Artificial Sequence
  Description of Artificial Sequence: Synthetic peptide
IQNSSNT

SEQ ID NO: 32588 - protein, 7 aa, Artificial Sequence
  Description of Artificial Sequence: Synthetic peptide
LAQERGT

SEQ ID NO: 32589 - protein, 7 aa, Artificial Sequence
  Description of Artificial Sequence: Synthetic peptide
EVRRQST

SEQ ID NO: 32590 - protein, 7 aa, Artificial Sequence
  Description of Artificial Sequence: Synthetic peptide
LSSTHMT

SEQ ID NO: 32591 - protein, 7 aa, Artificial Sequence
  Description of Artificial Sequence: Synthetic peptide
IQSPGNM

SEQ ID NO: 32592 - protein, 7 aa, Artificial Sequence
  Description of Artificial Sequence: Synthetic peptide
FNSTANR

SEQ ID NO: 32593 - protein, 7 aa, Artificial Sequence
  Description of Artificial Sequence: Synthetic peptide
KNQAPLL

SEQ ID NO: 32594 - protein, 7 aa, Artificial Sequence
  Description of Artificial Sequence: Synthetic peptide
SVDTRTG

SEQ ID NO: 32595 - protein, 7 aa, Artificial Sequence
  Description of Artificial Sequence: Synthetic peptide
KAGQERT

SEQ ID NO: 32596 - protein, 7 aa, Artificial Sequence
  Description of Artificial Sequence: Synthetic peptide
FLTGNTA

SEQ ID NO: 32597 - protein, 7 aa, Artificial Sequence
  Description of Artificial Sequence: Synthetic peptide
DNGDGYP

SEQ ID NO: 32598 - protein, 7 aa, Artificial Sequence
  Description of Artificial Sequence: Synthetic peptide
YSGGNMS

SEQ ID NO: 32599 - protein, 7 aa, Artificial Sequence
  Description of Artificial Sequence: Synthetic peptide
LISTAQR

SEQ ID NO: 32600 - protein, 7 aa, Artificial Sequence
  Description of Artificial Sequence: Synthetic peptide
IPANSFK

SEQ ID NO: 32601 - protein, 7 aa, Artificial Sequence
  Description of Artificial Sequence: Synthetic peptide
SMSEHLK

SEQ ID NO: 32602 - protein, 7 aa, Artificial Sequence
  Description of Artificial Sequence: Synthetic peptide
DYSSDSS

SEQ ID NO: 32603 - protein, 7 aa, Artificial Sequence
  Description of Artificial Sequence: Synthetic peptide
ETTTPRK

SEQ ID NO: 32604 - protein, 7 aa, Artificial Sequence
  Description of Artificial Sequence: Synthetic peptide
NPGESHR

SEQ ID NO: 32605 - protein, 7 aa, Artificial Sequence
  Description of Artificial Sequence: Synthetic peptide
SLGSGFQ

SEQ ID NO: 32606 - protein, 7 aa, Artificial Sequence
  Description of Artificial Sequence: Synthetic peptide
YIHNPTG

SEQ ID NO: 32607 - protein, 7 aa, Artificial Sequence
  Description of Artificial Sequence: Synthetic peptide
HTSSNSL

SEQ ID NO: 32608 - protein, 7 aa, Artificial Sequence
  Description of Artificial Sequence: Synthetic peptide
NNSKSQI

SEQ ID NO: 32609 - protein, 7 aa, Artificial Sequence
  Description of Artificial Sequence: Synthetic peptide
EVNTRSR

SEQ ID NO: 32610 - protein, 7 aa, Artificial Sequence
  Description of Artificial Sequence: Synthetic peptide
HTANSQS

SEQ ID NO: 32611 - protein, 7 aa, Artificial Sequence
  Description of Artificial Sequence: Synthetic peptide
GPANTSG

SEQ ID NO: 32612 - protein, 7 aa, Artificial Sequence
  Description of Artificial Sequence: Synthetic peptide
PAKSPAT

SEQ ID NO: 32613 - protein, 7 aa, Artificial Sequence
  Description of Artificial Sequence: Synthetic peptide
FSASGAR

SEQ ID NO: 32614 - protein, 7 aa, Artificial Sequence
  Description of Artificial Sequence: Synthetic peptide
QQGRTAG

SEQ ID NO: 32615 - protein, 7 aa, Artificial Sequence
  Description of Artificial Sequence: Synthetic peptide
SRAAHYG

SEQ ID NO: 32616 - protein, 7 aa, Artificial Sequence
  Description of Artificial Sequence: Synthetic peptide
GLARAGH

SEQ ID NO: 32617 - protein, 7 aa, Artificial Sequence
  Description of Artificial Sequence: Synthetic peptide
STTGGAS

SEQ ID NO: 32618 - protein, 7 aa, Artificial Sequence
  Description of Artificial Sequence: Synthetic peptide
GSNINNG

SEQ ID NO: 32619 - protein, 7 aa, Artificial Sequence
  Description of Artificial Sequence: Synthetic peptide
IQTHTSN

SEQ ID NO: 32620 - protein, 7 aa, Artificial Sequence
  Description of Artificial Sequence: Synthetic peptide
SYSELVR

SEQ ID NO: 32621 - protein, 7 aa, Artificial Sequence
  Description of Artificial Sequence: Synthetic peptide
LGSSTIF

SEQ ID NO: 32622 - protein, 7 aa, Artificial Sequence
  Description of Artificial Sequence: Synthetic peptide
MAGNSVP

SEQ ID NO: 32623 - protein, 7 aa, Artificial Sequence
  Description of Artificial Sequence: Synthetic peptide
HDSKVIS

SEQ ID NO: 32624 - protein, 7 aa, Artificial Sequence
  Description of Artificial Sequence: Synthetic peptide
FIGTSTP

SEQ ID NO: 32625 - protein, 7 aa, Artificial Sequence
  Description of Artificial Sequence: Synthetic peptide
VLRDGHR

SEQ ID NO: 32626 - protein, 7 aa, Artificial Sequence
  Description of Artificial Sequence: Synthetic peptide
TGDSPLA

SEQ ID NO: 32627 - protein, 7 aa, Artificial Sequence
  Description of Artificial Sequence: Synthetic peptide
PVLGYSY

SEQ ID NO: 32628 - protein, 7 aa, Artificial Sequence
  Description of Artificial Sequence: Synthetic peptide
DFSEKRL

SEQ ID NO: 32629 - protein, 7 aa, Artificial Sequence
  Description of Artificial Sequence: Synthetic peptide
GNQSPRV

SEQ ID NO: 32630 - protein, 7 aa, Artificial Sequence
  Description of Artificial Sequence: Synthetic peptide
PRDTTGS

SEQ ID NO: 32631 - protein, 7 aa, Artificial Sequence
  Description of Artificial Sequence: Synthetic peptide
LRDTNMN

SEQ ID NO: 32632 - protein, 7 aa, Artificial Sequence
  Description of Artificial Sequence: Synthetic peptide
SVTSPNK

SEQ ID NO: 32633 - protein, 7 aa, Artificial Sequence
  Description of Artificial Sequence: Synthetic peptide
DSKHTST

SEQ ID NO: 32634 - protein, 7 aa, Artificial Sequence
  Description of Artificial Sequence: Synthetic peptide
TGQQTAT

SEQ ID NO: 32635 - protein, 7 aa, Artificial Sequence
  Description of Artificial Sequence: Synthetic peptide
FMGRPNV

SEQ ID NO: 32636 - protein, 7 aa, Artificial Sequence
  Description of Artificial Sequence: Synthetic peptide
VQHTHSG

SEQ ID NO: 32637 - protein, 7 aa, Artificial Sequence
  Description of Artificial Sequence: Synthetic peptide
RNDKQNS

SEQ ID NO: 32638 - protein, 7 aa, Artificial Sequence
  Description of Artificial Sequence: Synthetic peptide
NDVKQGH

SEQ ID NO: 32639 - protein, 7 aa, Artificial Sequence
  Description of Artificial Sequence: Synthetic peptide
YNNGGTR

SEQ ID NO: 32640 - protein, 7 aa, Artificial Sequence
  Description of Artificial Sequence: Synthetic peptide
SFSKGSS

SEQ ID NO: 32641 - protein, 7 aa, Artificial Sequence
  Description of Artificial Sequence: Synthetic peptide
LGPGKNT

SEQ ID NO: 32642 - protein, 7 aa, Artificial Sequence
  Description of Artificial Sequence: Synthetic peptide
PSNKTNS

SEQ ID NO: 32643 - protein, 7 aa, Artificial Sequence
  Description of Artificial Sequence: Synthetic peptide
GLQTPPR

SEQ ID NO: 32644 - protein, 7 aa, Artificial Sequence
  Description of Artificial Sequence: Synthetic peptide
THLTGVQ

SEQ ID NO: 32645 - protein, 7 aa, Artificial Sequence
  Description of Artificial Sequence: Synthetic peptide
TGTGSFH

SEQ ID NO: 32646 - protein, 7 aa, Artificial Sequence
  Description of Artificial Sequence: Synthetic peptide
LVRATHE

SEQ ID NO: 32647 - protein, 7 aa, Artificial Sequence
  Description of Artificial Sequence: Synthetic peptide
ALANPQT

SEQ ID NO: 32648 - protein, 7 aa, Artificial Sequence
  Description of Artificial Sequence: Synthetic peptide
FVKTHSA

SEQ ID NO: 32649 - protein, 7 aa, Artificial Sequence
  Description of Artificial Sequence: Synthetic peptide
RVESPTN

SEQ ID NO: 32650 - protein, 7 aa, Artificial Sequence
  Description of Artificial Sequence: Synthetic peptide
TANSPAT

SEQ ID NO: 32651 - protein, 7 aa, Artificial Sequence
  Description of Artificial Sequence: Synthetic peptide
QIKTISA

SEQ ID NO: 32652 - protein, 7 aa, Artificial Sequence
  Description of Artificial Sequence: Synthetic peptide
HYTGKQN

SEQ ID NO: 32653 - protein, 7 aa, Artificial Sequence
  Description of Artificial Sequence: Synthetic peptide
LVQGGVN

SEQ ID NO: 32654 - protein, 7 aa, Artificial Sequence
  Description of Artificial Sequence: Synthetic peptide
SSQAVFR

SEQ ID NO: 32655 - protein, 7 aa, Artificial Sequence
  Description of Artificial Sequence: Synthetic peptide
HGQTGMI

SEQ ID NO: 32656 - protein, 7 aa, Artificial Sequence
  Description of Artificial Sequence: Synthetic peptide
GSVSPMT

SEQ ID NO: 32657 - protein, 7 aa, Artificial Sequence
  Description of Artificial Sequence: Synthetic peptide
SSFQANK

SEQ ID NO: 32658 - protein, 7 aa, Artificial Sequence
  Description of Artificial Sequence: Synthetic peptide
GTDNGIQ

SEQ ID NO: 32659 - protein, 7 aa, Artificial Sequence
  Description of Artificial Sequence: Synthetic peptide
RVMRESQ

SEQ ID NO: 32660 - protein, 7 aa, Artificial Sequence
  Description of Artificial Sequence: Synthetic peptide
QANTSTE

SEQ ID NO: 32661 - protein, 7 aa, Artificial Sequence
  Description of Artificial Sequence: Synthetic peptide
RIPNNPS

SEQ ID NO: 32662 - protein, 7 aa, Artificial Sequence
  Description of Artificial Sequence: Synthetic peptide
NNRSGMG

SEQ ID NO: 32663 - protein, 7 aa, Artificial Sequence
  Description of Artificial Sequence: Synthetic peptide
PTVQVTK

SEQ ID NO: 32664 - protein, 7 aa, Artificial Sequence
  Description of Artificial Sequence: Synthetic peptide
LYSGSQE

SEQ ID NO: 32665 - protein, 7 aa, Artificial Sequence
  Description of Artificial Sequence: Synthetic peptide
KILNVGT

SEQ ID NO: 32666 - protein, 7 aa, Artificial Sequence
  Description of Artificial Sequence: Synthetic peptide
CPQSREK

SEQ ID NO: 32667 - protein, 7 aa, Artificial Sequence
  Description of Artificial Sequence: Synthetic peptide
TSNSNIA

SEQ ID NO: 32668 - protein, 7 aa, Artificial Sequence
  Description of Artificial Sequence: Synthetic peptide
PSVNRTP

SEQ ID NO: 32669 - protein, 7 aa, Artificial Sequence
  Description of Artificial Sequence: Synthetic peptide
KLNKSQA

SEQ ID NO: 32670 - protein, 7 aa, Artificial Sequence
  Description of Artificial Sequence: Synthetic peptide
HNSKSQI

SEQ ID NO: 32671 - protein, 7 aa, Artificial Sequence
  Description of Artificial Sequence: Synthetic peptide
DSKQNLT

SEQ ID NO: 32672 - protein, 7 aa, Artificial Sequence
  Description of Artificial Sequence: Synthetic peptide
ENRTSVQ

SEQ ID NO: 32673 - protein, 7 aa, Artificial Sequence
  Description of Artificial Sequence: Synthetic peptide
GPENGIQ

SEQ ID NO: 32674 - protein, 7 aa, Artificial Sequence
  Description of Artificial Sequence: Synthetic peptide
TRYNSSL

SEQ ID NO: 32675 - protein, 7 aa, Artificial Sequence
  Description of Artificial Sequence: Synthetic peptide
FGSSNAV

SEQ ID NO: 32676 - protein, 7 aa, Artificial Sequence
  Description of Artificial Sequence: Synthetic peptide
SADHIRN

SEQ ID NO: 32677 - protein, 7 aa, Artificial Sequence
  Description of Artificial Sequence: Synthetic peptide
FQKERYQ

SEQ ID NO: 32678 - protein, 7 aa, Artificial Sequence
  Description of Artificial Sequence: Synthetic peptide
LAPGHGN

SEQ ID NO: 32679 - protein, 7 aa, Artificial Sequence
  Description of Artificial Sequence: Synthetic peptide
NTTAKSS

SEQ ID NO: 32680 - protein, 7 aa, Artificial Sequence
  Description of Artificial Sequence: Synthetic peptide
TPVNRTH

SEQ ID NO: 32681 - protein, 7 aa, Artificial Sequence
  Description of Artificial Sequence: Synthetic peptide
PSTGNSV

SEQ ID NO: 32682 - protein, 7 aa, Artificial Sequence
  Description of Artificial Sequence: Synthetic peptide
FSQHSSN

SEQ ID NO: 32683 - protein, 7 aa, Artificial Sequence
  Description of Artificial Sequence: Synthetic peptide
VNDHNVR

SEQ ID NO: 32684 - protein, 7 aa, Artificial Sequence
  Description of Artificial Sequence: Synthetic peptide
GSYSNPT

SEQ ID NO: 32685 - protein, 7 aa, Artificial Sequence
  Description of Artificial Sequence: Synthetic peptide
QDLQARV

SEQ ID NO: 32686 - protein, 7 aa, Artificial Sequence
  Description of Artificial Sequence: Synthetic peptide
LNAGNTR

SEQ ID NO: 32687 - protein, 7 aa, Artificial Sequence
  Description of Artificial Sequence: Synthetic peptide
EVTNAPK

SEQ ID NO: 32688 - protein, 7 aa, Artificial Sequence
  Description of Artificial Sequence: Synthetic peptide
HPSNKPL

SEQ ID NO: 32689 - protein, 7 aa, Artificial Sequence
  Description of Artificial Sequence: Synthetic peptide
NDSGQNQ

SEQ ID NO: 32690 - protein, 7 aa, Artificial Sequence
  Description of Artificial Sequence: Synthetic peptide
LGKPAQP

SEQ ID NO: 32691 - protein, 7 aa, Artificial Sequence
  Description of Artificial Sequence: Synthetic peptide
NIKGAST

SEQ ID NO: 32692 - protein, 7 aa, Artificial Sequence
  Description of Artificial Sequence: Synthetic peptide
NTSTNGI

SEQ ID NO: 32693 - protein, 7 aa, Artificial Sequence
  Description of Artificial Sequence: Synthetic peptide
NLGNSLK

SEQ ID NO: 32694 - protein, 7 aa, Artificial Sequence
  Description of Artificial Sequence: Synthetic peptide
NPGRQQF

SEQ ID NO: 32695 - protein, 7 aa, Artificial Sequence
  Description of Artificial Sequence: Synthetic peptide
TNPKSSS

SEQ ID NO: 32696 - protein, 7 aa, Artificial Sequence
  Description of Artificial Sequence: Synthetic peptide
FPSVSTT

SEQ ID NO: 32697 - protein, 7 aa, Artificial Sequence
  Description of Artificial Sequence: Synthetic peptide
SSDQPRL

SEQ ID NO: 32698 - protein, 7 aa, Artificial Sequence
  Description of Artificial Sequence: Synthetic peptide
AEQRPGQ

SEQ ID NO: 32699 - protein, 7 aa, Artificial Sequence
  Description of Artificial Sequence: Synthetic peptide
HDNANYN

SEQ ID NO: 32700 - protein, 7 aa, Artificial Sequence
  Description of Artificial Sequence: Synthetic peptide
SSVQHTG

SEQ ID NO: 32701 - protein, 7 aa, Artificial Sequence
  Description of Artificial Sequence: Synthetic peptide
MKNTTVV

SEQ ID NO: 32702 - protein, 7 aa, Artificial Sequence
  Description of Artificial Sequence: Synthetic peptide
YPLSRST

SEQ ID NO: 32703 - protein, 7 aa, Artificial Sequence
  Description of Artificial Sequence: Synthetic peptide
NANSRPV

SEQ ID NO: 32704 - protein, 7 aa, Artificial Sequence
  Description of Artificial Sequence: Synthetic peptide
VSGQGNS

SEQ ID NO: 32705 - protein, 7 aa, Artificial Sequence
  Description of Artificial Sequence: Synthetic peptide
RHYTGDS

SEQ ID NO: 32706 - protein, 7 aa, Artificial Sequence
  Description of Artificial Sequence: Synthetic peptide
QQYAKQA

SEQ ID NO: 32707 - protein, 7 aa, Artificial Sequence
  Description of Artificial Sequence: Synthetic peptide
LPQGSIS

SEQ ID NO: 32708 - protein, 7 aa, Artificial Sequence
  Description of Artificial Sequence: Synthetic peptide
PGDRGKV

SEQ ID NO: 32709 - protein, 7 aa, Artificial Sequence
  Description of Artificial Sequence: Synthetic peptide
HNNSKSA

SEQ ID NO: 32710 - protein, 7 aa, Artificial Sequence
  Description of Artificial Sequence: Synthetic peptide
SSTSSPY

SEQ ID NO: 32711 - protein, 7 aa, Artificial Sequence
  Description of Artificial Sequence: Synthetic peptide
ILGNKSS

SEQ ID NO: 32712 - protein, 7 aa, Artificial Sequence
  Description of Artificial Sequence: Synthetic peptide
ASTPNNT

SEQ ID NO: 32713 - protein, 7 aa, Artificial Sequence
  Description of Artificial Sequence: Synthetic peptide
GNTGSYQ

SEQ ID NO: 32714 - protein, 7 aa, Artificial Sequence
  Description of Artificial Sequence: Synthetic peptide
TGQQPAT

SEQ ID NO: 32715 - protein, 7 aa, Artificial Sequence
  Description of Artificial Sequence: Synthetic peptide
SISDKLG

SEQ ID NO: 32716 - protein, 7 aa, Artificial Sequence
  Description of Artificial Sequence: Synthetic peptide
IANAHYN

SEQ ID NO: 32717 - protein, 7 aa, Artificial Sequence
  Description of Artificial Sequence: Synthetic peptide
LGVKTPT

SEQ ID NO: 32718 - protein, 7 aa, Artificial Sequence
  Description of Artificial Sequence: Synthetic peptide
LGGGTLR

SEQ ID NO: 32719 - protein, 7 aa, Artificial Sequence
  Description of Artificial Sequence: Synthetic peptide
RRQDTQE

SEQ ID NO: 32720 - protein, 7 aa, Artificial Sequence
  Description of Artificial Sequence: Synthetic peptide
GTDRTLH

SEQ ID NO: 32721 - protein, 7 aa, Artificial Sequence
  Description of Artificial Sequence: Synthetic peptide
TQQNGRN

SEQ ID NO: 32722 - protein, 7 aa, Artificial Sequence
  Description of Artificial Sequence: Synthetic peptide
SDHQSVR

SEQ ID NO: 32723 - protein, 7 aa, Artificial Sequence
  Description of Artificial Sequence: Synthetic peptide
LLSSKTA

SEQ ID NO: 32724 - protein, 7 aa, Artificial Sequence
  Description of Artificial Sequence: Synthetic peptide
PVQHSSN

SEQ ID NO: 32725 - protein, 7 aa, Artificial Sequence
  Description of Artificial Sequence: Synthetic peptide
NGISKSN

SEQ ID NO: 32726 - protein, 7 aa, Artificial Sequence
  Description of Artificial Sequence: Synthetic peptide
ESATPIR

SEQ ID NO: 32727 - protein, 7 aa, Artificial Sequence
  Description of Artificial Sequence: Synthetic peptide
NTTGSGL

SEQ ID NO: 32728 - protein, 7 aa, Artificial Sequence
  Description of Artificial Sequence: Synthetic peptide
SSSPNVK

SEQ ID NO: 32729 - protein, 7 aa, Artificial Sequence
  Description of Artificial Sequence: Synthetic peptide
ATNSTPR

SEQ ID NO: 32730 - protein, 7 aa, Artificial Sequence
  Description of Artificial Sequence: Synthetic peptide
YRNTHSE

SEQ ID NO: 32731 - protein, 7 aa, Artificial Sequence
  Description of Artificial Sequence: Synthetic peptide
LDKEPRG

SEQ ID NO: 32732 - protein, 7 aa, Artificial Sequence
  Description of Artificial Sequence: Synthetic peptide
VGHKGGP

SEQ ID NO: 32733 - protein, 7 aa, Artificial Sequence
  Description of Artificial Sequence: Synthetic peptide
IVSPVSK

SEQ ID NO: 32734 - protein, 7 aa, Artificial Sequence
  Description of Artificial Sequence: Synthetic peptide
PRMRAVS

SEQ ID NO: 32735 - protein, 7 aa, Artificial Sequence
  Description of Artificial Sequence: Synthetic peptide
YRTTHTL

SEQ ID NO: 32736 - protein, 7 aa, Artificial Sequence
  Description of Artificial Sequence: Synthetic peptide
KNATGIL

SEQ ID NO: 32737 - protein, 7 aa, Artificial Sequence
  Description of Artificial Sequence: Synthetic peptide
NGSGQNK

SEQ ID NO: 32738 - protein, 7 aa, Artificial Sequence
  Description of Artificial Sequence: Synthetic peptide
NQKTRTD

SEQ ID NO: 32739 - protein, 7 aa, Artificial Sequence
  Description of Artificial Sequence: Synthetic peptide
KVGSPTA

SEQ ID NO: 32740 - protein, 7 aa, Artificial Sequence
  Description of Artificial Sequence: Synthetic peptide
TTDKKTE

SEQ ID NO: 32741 - protein, 7 aa, Artificial Sequence
  Description of Artificial Sequence: Synthetic peptide
DSGSSTK

SEQ ID NO: 32742 - protein, 7 aa, Artificial Sequence
  Description of Artificial Sequence: Synthetic peptide
NTQSYTS

SEQ ID NO: 32743 - protein, 7 aa, Artificial Sequence
  Description of Artificial Sequence: Synthetic peptide
FPGGNHT

SEQ ID NO: 32744 - protein, 7 aa, Artificial Sequence
  Description of Artificial Sequence: Synthetic peptide
HTATPLL

SEQ ID NO: 32745 - protein, 7 aa, Artificial Sequence
  Description of Artificial Sequence: Synthetic peptide
NNSTGVA

SEQ ID NO: 32746 - protein, 7 aa, Artificial Sequence
  Description of Artificial Sequence: Synthetic peptide
TPSVTNM

SEQ ID NO: 32747 - protein, 7 aa, Artificial Sequence
  Description of Artificial Sequence: Synthetic peptide
LTFNSSG

SEQ ID NO: 32748 - protein, 7 aa, Artificial Sequence
  Description of Artificial Sequence: Synthetic peptide
RDGTPPT

SEQ ID NO: 32749 - protein, 7 aa, Artificial Sequence
  Description of Artificial Sequence: Synthetic peptide
NRKHTST

SEQ ID NO: 32750 - protein, 7 aa, Artificial Sequence
  Description of Artificial Sequence: Synthetic peptide
HLQSTDP

SEQ ID NO: 32751 - protein, 7 aa, Artificial Sequence
  Description of Artificial Sequence: Synthetic peptide
DPDTRKS

SEQ ID NO: 32752 - protein, 7 aa, Artificial Sequence
  Description of Artificial Sequence: Synthetic peptide
QRFQSSQ

SEQ ID NO: 32753 - protein, 7 aa, Artificial Sequence
  Description of Artificial Sequence: Synthetic peptide
NSNTRGP

SEQ ID NO: 32754 - protein, 7 aa, Artificial Sequence
  Description of Artificial Sequence: Synthetic peptide
GSGGDRN

SEQ ID NO: 32755 - protein, 7 aa, Artificial Sequence
  Description of Artificial Sequence: Synthetic peptide
PSTQSSS

SEQ ID NO: 32756 - protein, 7 aa, Artificial Sequence
  Description of Artificial Sequence: Synthetic peptide
LTTSVYK

SEQ ID NO: 32757 - protein, 7 aa, Artificial Sequence
  Description of Artificial Sequence: Synthetic peptide
GSTGSSI

SEQ ID NO: 32758 - protein, 7 aa, Artificial Sequence
  Description of Artificial Sequence: Synthetic peptide
ASLKTQM

SEQ ID NO: 32759 - protein, 7 aa, Artificial Sequence
  Description of Artificial Sequence: Synthetic peptide
DCVSRCK

SEQ ID NO: 32760 - protein, 7 aa, Artificial Sequence
  Description of Artificial Sequence: Synthetic peptide
SFSPASN

SEQ ID NO: 32761 - protein, 7 aa, Artificial Sequence
  Description of Artificial Sequence: Synthetic peptide
NSTPSTR

SEQ ID NO: 32762 - protein, 7 aa, Artificial Sequence
  Description of Artificial Sequence: Synthetic peptide
HELSRTT

SEQ ID NO: 32763 - protein, 7 aa, Artificial Sequence
  Description of Artificial Sequence: Synthetic peptide
NDRGQNG

SEQ ID NO: 32764 - protein, 7 aa, Artificial Sequence
  Description of Artificial Sequence: Synthetic peptide
PSHEGQQ

SEQ ID NO: 32765 - protein, 7 aa, Artificial Sequence
  Description of Artificial Sequence: Synthetic peptide
QGAGVSS

SEQ ID NO: 32766 - protein, 7 aa, Artificial Sequence
  Description of Artificial Sequence: Synthetic peptide
KTGDQMG

SEQ ID NO: 32767 - protein, 7 aa, Artificial Sequence
  Description of Artificial Sequence: Synthetic peptide
IRSKESA

SEQ ID NO: 32768 - protein, 7 aa, Artificial Sequence
  Description of Artificial Sequence: Synthetic peptide
GLGQQTN

SEQ ID NO: 32769 - protein, 7 aa, Artificial Sequence
  Description of Artificial Sequence: Synthetic peptide
PGYGSNH

SEQ ID NO: 32770 - protein, 7 aa, Artificial Sequence
  Description of Artificial Sequence: Synthetic peptide
QSEIVNK

SEQ ID NO: 32771 - protein, 7 aa, Artificial Sequence
  Description of Artificial Sequence: Synthetic peptide
GIQSGLG

SEQ ID NO: 32772 - protein, 7 aa, Artificial Sequence
  Description of Artificial Sequence: Synthetic peptide
EVYSGSN

SEQ ID NO: 32773 - protein, 7 aa, Artificial Sequence
  Description of Artificial Sequence: Synthetic peptide
KNHTAVQ

SEQ ID NO: 32774 - protein, 7 aa, Artificial Sequence
  Description of Artificial Sequence: Synthetic peptide
NSAALNS

SEQ ID NO: 32775 - protein, 7 aa, Artificial Sequence
  Description of Artificial Sequence: Synthetic peptide
NGSQGRQ

SEQ ID NO: 32776 - protein, 7 aa, Artificial Sequence
  Description of Artificial Sequence: Synthetic peptide
SYSSSQL

SEQ ID NO: 32777 - protein, 7 aa, Artificial Sequence
  Description of Artificial Sequence: Synthetic peptide
TQGLGHL

SEQ ID NO: 32778 - protein, 7 aa, Artificial Sequence
  Description of Artificial Sequence: Synthetic peptide
TMRATPP

SEQ ID NO: 32779 - protein, 7 aa, Artificial Sequence
  Description of Artificial Sequence: Synthetic peptide
SRVSRNL

SEQ ID NO: 32780 - protein, 7 aa, Artificial Sequence
  Description of Artificial Sequence: Synthetic peptide
ISGSGYH

SEQ ID NO: 32781 - protein, 7 aa, Artificial Sequence
  Description of Artificial Sequence: Synthetic peptide
NVDNRGF

SEQ ID NO: 32782 - protein, 7 aa, Artificial Sequence
  Description of Artificial Sequence: Synthetic peptide
LGMRDNT

SEQ ID NO: 32783 - protein, 7 aa, Artificial Sequence
  Description of Artificial Sequence: Synthetic peptide
EQGSGNH

SEQ ID NO: 32784 - protein, 7 aa, Artificial Sequence
  Description of Artificial Sequence: Synthetic peptide
GDMGISK

SEQ ID NO: 32785 - protein, 7 aa, Artificial Sequence
  Description of Artificial Sequence: Synthetic peptide
QNLPKAS

SEQ ID NO: 32786 - protein, 7 aa, Artificial Sequence
  Description of Artificial Sequence: Synthetic peptide
HGGPGAV

SEQ ID NO: 32787 - protein, 7 aa, Artificial Sequence
  Description of Artificial Sequence: Synthetic peptide
GSTGQLM

SEQ ID NO: 32788 - protein, 7 aa, Artificial Sequence
  Description of Artificial Sequence: Synthetic peptide
RDLGHDN

SEQ ID NO: 32789 - protein, 7 aa, Artificial Sequence
  Description of Artificial Sequence: Synthetic peptide
HGISNQS

SEQ ID NO: 32790 - protein, 7 aa, Artificial Sequence
  Description of Artificial Sequence: Synthetic peptide
QNTNAAI

SEQ ID NO: 32791 - protein, 7 aa, Artificial Sequence
  Description of Artificial Sequence: Synthetic peptide
WGSGLNH

SEQ ID NO: 32792 - protein, 7 aa, Artificial Sequence
  Description of Artificial Sequence: Synthetic peptide
PPSKPNT

SEQ ID NO: 32793 - protein, 7 aa, Artificial Sequence
  Description of Artificial Sequence: Synthetic peptide
KFPPNSG

SEQ ID NO: 32794 - protein, 7 aa, Artificial Sequence
  Description of Artificial Sequence: Synthetic peptide
QVVPATN

SEQ ID NO: 32795 - protein, 7 aa, Artificial Sequence
  Description of Artificial Sequence: Synthetic peptide
KDAGEYG

SEQ ID NO: 32796 - protein, 7 aa, Artificial Sequence
  Description of Artificial Sequence: Synthetic peptide
SSSAKSI

SEQ ID NO: 32797 - protein, 7 aa, Artificial Sequence
  Description of Artificial Sequence: Synthetic peptide
FNSSSSK

SEQ ID NO: 32798 - protein, 7 aa, Artificial Sequence
  Description of Artificial Sequence: Synthetic peptide
SNSGRGM

SEQ ID NO: 32799 - protein, 7 aa, Artificial Sequence
  Description of Artificial Sequence: Synthetic peptide
DESGKSK

SEQ ID NO: 32800 - protein, 7 aa, Artificial Sequence
  Description of Artificial Sequence: Synthetic peptide
GERSDVR

SEQ ID NO: 32801 - protein, 7 aa, Artificial Sequence
  Description of Artificial Sequence: Synthetic peptide
INQSTYK

SEQ ID NO: 32802 - protein, 7 aa, Artificial Sequence
  Description of Artificial Sequence: Synthetic peptide
LTQRDFS

SEQ ID NO: 32803 - protein, 7 aa, Artificial Sequence
  Description of Artificial Sequence: Synthetic peptide
SINSQQC

SEQ ID NO: 32804 - protein, 7 aa, Artificial Sequence
  Description of Artificial Sequence: Synthetic peptide
TATQKGQ

SEQ ID NO: 32805 - protein, 7 aa, Artificial Sequence
  Description of Artificial Sequence: Synthetic peptide
SSNEKDR

SEQ ID NO: 32806 - protein, 7 aa, Artificial Sequence
  Description of Artificial Sequence: Synthetic peptide
YVSNSNA

SEQ ID NO: 32807 - protein, 7 aa, Artificial Sequence
  Description of Artificial Sequence: Synthetic peptide
NPGEMRL

SEQ ID NO: 32808 - protein, 7 aa, Artificial Sequence
  Description of Artificial Sequence: Synthetic peptide
HSENGNR

SEQ ID NO: 32809 - protein, 7 aa, Artificial Sequence
  Description of Artificial Sequence: Synthetic peptide
LTPSKIG

SEQ ID NO: 32810 - protein, 7 aa, Artificial Sequence
  Description of Artificial Sequence: Synthetic peptide
PRSNTQR

SEQ ID NO: 32811 - protein, 7 aa, Artificial Sequence
  Description of Artificial Sequence: Synthetic peptide
QMKHLQV

SEQ ID NO: 32812 - protein, 7 aa, Artificial Sequence
  Description of Artificial Sequence: Synthetic peptide
QSTERLA

SEQ ID NO: 32813 - protein, 7 aa, Artificial Sequence
  Description of Artificial Sequence: Synthetic peptide
NFTTSGQ

SEQ ID NO: 32814 - protein, 7 aa, Artificial Sequence
  Description of Artificial Sequence: Synthetic peptide
REYNTTS

SEQ ID NO: 32815 - protein, 7 aa, Artificial Sequence
  Description of Artificial Sequence: Synthetic peptide
LGTSHQQ

SEQ ID NO: 32816 - protein, 7 aa, Artificial Sequence
  Description of Artificial Sequence: Synthetic peptide
NASGQNQ

SEQ ID NO: 32817 - protein, 7 aa, Artificial Sequence
  Description of Artificial Sequence: Synthetic peptide
PGINTNS

SEQ ID NO: 32818 - protein, 7 aa, Artificial Sequence
  Description of Artificial Sequence: Synthetic peptide
ATTKEGI

SEQ ID NO: 32819 - protein, 7 aa, Artificial Sequence
  Description of Artificial Sequence: Synthetic peptide
QTGSNNK

SEQ ID NO: 32820 - protein, 7 aa, Artificial Sequence
  Description of Artificial Sequence: Synthetic peptide
TRESRTN

SEQ ID NO: 32821 - protein, 7 aa, Artificial Sequence
  Description of Artificial Sequence: Synthetic peptide
QRTSDQT

SEQ ID NO: 32822 - protein, 7 aa, Artificial Sequence
  Description of Artificial Sequence: Synthetic peptide
VSGRPTG

SEQ ID NO: 32823 - protein, 7 aa, Artificial Sequence
  Description of Artificial Sequence: Synthetic peptide
PLRELKP

SEQ ID NO: 32824 - protein, 7 aa, Artificial Sequence
  Description of Artificial Sequence: Synthetic peptide
LSIKGAS

SEQ ID NO: 32825 - protein, 7 aa, Artificial Sequence
  Description of Artificial Sequence: Synthetic peptide
NYVGQRS

SEQ ID NO: 32826 - protein, 7 aa, Artificial Sequence
  Description of Artificial Sequence: Synthetic peptide
PNRTSSY

SEQ ID NO: 32827 - protein, 7 aa, Artificial Sequence
  Description of Artificial Sequence: Synthetic peptide
SREKNNA

SEQ ID NO: 32828 - protein, 7 aa, Artificial Sequence
  Description of Artificial Sequence: Synthetic peptide
HSTSLSK

SEQ ID NO: 32829 - protein, 7 aa, Artificial Sequence
  Description of Artificial Sequence: Synthetic peptide
ISGQQTT

SEQ ID NO: 32830 - protein, 7 aa, Artificial Sequence
  Description of Artificial Sequence: Synthetic peptide
CSVAGKR

SEQ ID NO: 32831 - protein, 7 aa, Artificial Sequence
  Description of Artificial Sequence: Synthetic peptide
SKTGTSL

SEQ ID NO: 32832 - protein, 7 aa, Artificial Sequence
  Description of Artificial Sequence: Synthetic peptide
ISVGNTS

SEQ ID NO: 32833 - protein, 7 aa, Artificial Sequence
  Description of Artificial Sequence: Synthetic peptide
RTLSKHG

SEQ ID NO: 32834 - protein, 7 aa, Artificial Sequence
  Description of Artificial Sequence: Synthetic peptide
PGSVTGS

SEQ ID NO: 32835 - protein, 7 aa, Artificial Sequence
  Description of Artificial Sequence: Synthetic peptide
STSKDYT

SEQ ID NO: 32836 - protein, 7 aa, Artificial Sequence
  Description of Artificial Sequence: Synthetic peptide
VRISTQA

SEQ ID NO: 32837 - protein, 7 aa, Artificial Sequence
  Description of Artificial Sequence: Synthetic peptide
YINSPSN

SEQ ID NO: 32838 - protein, 7 aa, Artificial Sequence
  Description of Artificial Sequence: Synthetic peptide
NNKSASQ

SEQ ID NO: 32839 - protein, 7 aa, Artificial Sequence
  Description of Artificial Sequence: Synthetic peptide
FNQAGVN

SEQ ID NO: 32840 - protein, 7 aa, Artificial Sequence
  Description of Artificial Sequence: Synthetic peptide
QQEMSKK

SEQ ID NO: 32841 - protein, 7 aa, Artificial Sequence
  Description of Artificial Sequence: Synthetic peptide
PSHNPTN

SEQ ID NO: 32842 - protein, 7 aa, Artificial Sequence
  Description of Artificial Sequence: Synthetic peptide
SGSNTIG

SEQ ID NO: 32843 - protein, 7 aa, Artificial Sequence
  Description of Artificial Sequence: Synthetic peptide
NSANKTP

SEQ ID NO: 32844 - protein, 7 aa, Artificial Sequence
  Description of Artificial Sequence: Synthetic peptide
GNRGSVI

SEQ ID NO: 32845 - protein, 7 aa, Artificial Sequence
  Description of Artificial Sequence: Synthetic peptide
PNGAHVT

SEQ ID NO: 32846 - protein, 7 aa, Artificial Sequence
  Description of Artificial Sequence: Synthetic peptide
MGVHSIA

SEQ ID NO: 32847 - protein, 7 aa, Artificial Sequence
  Description of Artificial Sequence: Synthetic peptide
LHDGQTR

SEQ ID NO: 32848 - protein, 7 aa, Artificial Sequence
  Description of Artificial Sequence: Synthetic peptide
SFDSKPP

SEQ ID NO: 32849 - protein, 7 aa, Artificial Sequence
  Description of Artificial Sequence: Synthetic peptide
YVTSSGG

SEQ ID NO: 32850 - protein, 7 aa, Artificial Sequence
  Description of Artificial Sequence: Synthetic peptide
PADHGKL

SEQ ID NO: 32851 - protein, 7 aa, Artificial Sequence
  Description of Artificial Sequence: Synthetic peptide
DATKNHS

SEQ ID NO: 32852 - protein, 7 aa, Artificial Sequence
  Description of Artificial Sequence: Synthetic peptide
QREQLLK

SEQ ID NO: 32853 - protein, 7 aa, Artificial Sequence
  Description of Artificial Sequence: Synthetic peptide
HSTSGGH

SEQ ID NO: 32854 - protein, 7 aa, Artificial Sequence
  Description of Artificial Sequence: Synthetic peptide
HNSAVQG

SEQ ID NO: 32855 - protein, 7 aa, Artificial Sequence
  Description of Artificial Sequence: Synthetic peptide
PQSSHQT

SEQ ID NO: 32856 - protein, 7 aa, Artificial Sequence
  Description of Artificial Sequence: Synthetic peptide
LPGVRVA

SEQ ID NO: 32857 - protein, 7 aa, Artificial Sequence
  Description of Artificial Sequence: Synthetic peptide
NSYDPKR

SEQ ID NO: 32858 - protein, 7 aa, Artificial Sequence
  Description of Artificial Sequence: Synthetic peptide
GSNYEVG

SEQ ID NO: 32859 - protein, 7 aa, Artificial Sequence
  Description of Artificial Sequence: Synthetic peptide
GLMTHSI

SEQ ID NO: 32860 - protein, 7 aa, Artificial Sequence
  Description of Artificial Sequence: Synthetic peptide
LSNQNNQ

SEQ ID NO: 32861 - protein, 7 aa, Artificial Sequence
  Description of Artificial Sequence: Synthetic peptide
GLPTEKM

SEQ ID NO: 32862 - protein, 7 aa, Artificial Sequence
  Description of Artificial Sequence: Synthetic peptide
NVTTPLI

SEQ ID NO: 32863 - protein, 7 aa, Artificial Sequence
  Description of Artificial Sequence: Synthetic peptide
TSYPNHR

SEQ ID NO: 32864 - protein, 7 aa, Artificial Sequence
  Description of Artificial Sequence: Synthetic peptide
ATRDSHS

SEQ ID NO: 32865 - protein, 7 aa, Artificial Sequence
  Description of Artificial Sequence: Synthetic peptide
QGSGSNH

SEQ ID NO: 32866 - protein, 7 aa, Artificial Sequence
  Description of Artificial Sequence: Synthetic peptide
SSSTHAV

SEQ ID NO: 32867 - protein, 7 aa, Artificial Sequence
  Description of Artificial Sequence: Synthetic peptide
NNLPRNL

SEQ ID NO: 32868 - protein, 7 aa, Artificial Sequence
  Description of Artificial Sequence: Synthetic peptide
SSEQTTR

SEQ ID NO: 32869 - protein, 7 aa, Artificial Sequence
  Description of Artificial Sequence: Synthetic peptide
DTARPTK

SEQ ID NO: 32870 - protein, 7 aa, Artificial Sequence
  Description of Artificial Sequence: Synthetic peptide
NISTRQS

SEQ ID NO: 32871 - protein, 7 aa, Artificial Sequence
  Description of Artificial Sequence: Synthetic peptide
YTITPQK

SEQ ID NO: 32872 - protein, 7 aa, Artificial Sequence
  Description of Artificial Sequence: Synthetic peptide
ENISRSH

SEQ ID NO: 32873 - protein, 7 aa, Artificial Sequence
  Description of Artificial Sequence: Synthetic peptide
PSKISNA

SEQ ID NO: 32874 - protein, 7 aa, Artificial Sequence
  Description of Artificial Sequence: Synthetic peptide
CNSHNAA

SEQ ID NO: 32875 - protein, 7 aa, Artificial Sequence
  Description of Artificial Sequence: Synthetic peptide
VSFKPNE

SEQ ID NO: 32876 - protein, 7 aa, Artificial Sequence
  Description of Artificial Sequence: Synthetic peptide
DKTQKQL

SEQ ID NO: 32877 - protein, 7 aa, Artificial Sequence
  Description of Artificial Sequence: Synthetic peptide
NNVTKAP

SEQ ID NO: 32878 - protein, 7 aa, Artificial Sequence
  Description of Artificial Sequence: Synthetic peptide
QNVGGIR

SEQ ID NO: 32879 - protein, 7 aa, Artificial Sequence
  Description of Artificial Sequence: Synthetic peptide
SSAKSSL

SEQ ID NO: 32880 - protein, 7 aa, Artificial Sequence
  Description of Artificial Sequence: Synthetic peptide
HHDASPN

SEQ ID NO: 32881 - protein, 7 aa, Artificial Sequence
  Description of Artificial Sequence: Synthetic peptide
TGIGSHL

SEQ ID NO: 32882 - protein, 7 aa, Artificial Sequence
  Description of Artificial Sequence: Synthetic peptide
QVPTRSD

SEQ ID NO: 32883 - protein, 7 aa, Artificial Sequence
  Description of Artificial Sequence: Synthetic peptide
PEPAARN

SEQ ID NO: 32884 - protein, 7 aa, Artificial Sequence
  Description of Artificial Sequence: Synthetic peptide
PSSTPKL

SEQ ID NO: 32885 - protein, 7 aa, Artificial Sequence
  Description of Artificial Sequence: Synthetic peptide
HDSRSNA

SEQ ID NO: 32886 - protein, 7 aa, Artificial Sequence
  Description of Artificial Sequence: Synthetic peptide
DGVGMYA

SEQ ID NO: 32887 - protein, 7 aa, Artificial Sequence
  Description of Artificial Sequence: Synthetic peptide
TRKTPTT

SEQ ID NO: 32888 - protein, 7 aa, Artificial Sequence
  Description of Artificial Sequence: Synthetic peptide
VNTNLVG

SEQ ID NO: 32889 - protein, 7 aa, Artificial Sequence
  Description of Artificial Sequence: Synthetic peptide
YTASRME

SEQ ID NO: 32890 - protein, 7 aa, Artificial Sequence
  Description of Artificial Sequence: Synthetic peptide
GYTVGTN

SEQ ID NO: 32891 - protein, 7 aa, Artificial Sequence
  Description of Artificial Sequence: Synthetic peptide
SNATRAI

SEQ ID NO: 32892 - protein, 7 aa, Artificial Sequence
  Description of Artificial Sequence: Synthetic peptide
RPATSTP

SEQ ID NO: 32893 - protein, 7 aa, Artificial Sequence
  Description of Artificial Sequence: Synthetic peptide
YFNSHSN

SEQ ID NO: 32894 - protein, 7 aa, Artificial Sequence
  Description of Artificial Sequence: Synthetic peptide
KIGSMSG

SEQ ID NO: 32895 - protein, 7 aa, Artificial Sequence
  Description of Artificial Sequence: Synthetic peptide
IRNDLSN

SEQ ID NO: 32896 - protein, 7 aa, Artificial Sequence
  Description of Artificial Sequence: Synthetic peptide
PSNKAGT

SEQ ID NO: 32897 - protein, 7 aa, Artificial Sequence
  Description of Artificial Sequence: Synthetic peptide
GSLTPKA

SEQ ID NO: 32898 - protein, 7 aa, Artificial Sequence
  Description of Artificial Sequence: Synthetic peptide
PVTLRGI

SEQ ID NO: 32899 - protein, 7 aa, Artificial Sequence
  Description of Artificial Sequence: Synthetic peptide
MSTHSSG

SEQ ID NO: 32900 - protein, 7 aa, Artificial Sequence
  Description of Artificial Sequence: Synthetic peptide
VPHGATS

SEQ ID NO: 32901 - protein, 7 aa, Artificial Sequence
  Description of Artificial Sequence: Synthetic peptide
QVPVRPV

SEQ ID NO: 32902 - protein, 7 aa, Artificial Sequence
  Description of Artificial Sequence: Synthetic peptide
SARDRAS

SEQ ID NO: 32903 - protein, 7 aa, Artificial Sequence
  Description of Artificial Sequence: Synthetic peptide
SNMPGMV

SEQ ID NO: 32904 - protein, 7 aa, Artificial Sequence
  Description of Artificial Sequence: Synthetic peptide
NGATKNS

SEQ ID NO: 32905 - protein, 7 aa, Artificial Sequence
  Description of Artificial Sequence: Synthetic peptide
MNTSINN

SEQ ID NO: 32906 - protein, 7 aa, Artificial Sequence
  Description of Artificial Sequence: Synthetic peptide
ILDSHNR

SEQ ID NO: 32907 - protein, 7 aa, Artificial Sequence
  Description of Artificial Sequence: Synthetic peptide
DLQTSAK

SEQ ID NO: 32908 - protein, 7 aa, Artificial Sequence
  Description of Artificial Sequence: Synthetic peptide
DQVSHKL

SEQ ID NO: 32909 - protein, 7 aa, Artificial Sequence
  Description of Artificial Sequence: Synthetic peptide
TASGNLS

SEQ ID NO: 32910 - protein, 7 aa, Artificial Sequence
  Description of Artificial Sequence: Synthetic peptide
ERFTSSS

SEQ ID NO: 32911 - protein, 7 aa, Artificial Sequence
  Description of Artificial Sequence: Synthetic peptide
TLPRVPA

SEQ ID NO: 32912 - protein, 7 aa, Artificial Sequence
  Description of Artificial Sequence: Synthetic peptide
EPLKNNP

SEQ ID NO: 32913 - protein, 7 aa, Artificial Sequence
  Description of Artificial Sequence: Synthetic peptide
HTDTSAV

SEQ ID NO: 32914 - protein, 7 aa, Artificial Sequence
  Description of Artificial Sequence: Synthetic peptide
VVPERSK

SEQ ID NO: 32915 - protein, 7 aa, Artificial Sequence
  Description of Artificial Sequence: Synthetic peptide
THMRTQS

SEQ ID NO: 32916 - protein, 7 aa, Artificial Sequence
  Description of Artificial Sequence: Synthetic peptide
TRGSPLM

SEQ ID NO: 32917 - protein, 7 aa, Artificial Sequence
  Description of Artificial Sequence: Synthetic peptide
TGTKSDN

SEQ ID NO: 32918 - protein, 7 aa, Artificial Sequence
  Description of Artificial Sequence: Synthetic peptide
GPDTHSQ

SEQ ID NO: 32919 - protein, 7 aa, Artificial Sequence
  Description of Artificial Sequence: Synthetic peptide
NGPGQNQ

SEQ ID NO: 32920 - protein, 7 aa, Artificial Sequence
  Description of Artificial Sequence: Synthetic peptide
HYNQTGL

SEQ ID NO: 32921 - protein, 7 aa, Artificial Sequence
  Description of Artificial Sequence: Synthetic peptide
SHQTPGY

SEQ ID NO: 32922 - protein, 7 aa, Artificial Sequence
  Description of Artificial Sequence: Synthetic peptide
NGTRQNQ

SEQ ID NO: 32923 - protein, 7 aa, Artificial Sequence
  Description of Artificial Sequence: Synthetic peptide
FSSKTSP

SEQ ID NO: 32924 - protein, 7 aa, Artificial Sequence
  Description of Artificial Sequence: Synthetic peptide
SMGNSIS

SEQ ID NO: 32925 - protein, 7 aa, Artificial Sequence
  Description of Artificial Sequence: Synthetic peptide
FNEQRVS

SEQ ID NO: 32926 - protein, 7 aa, Artificial Sequence
  Description of Artificial Sequence: Synthetic peptide
DIPAKTA

SEQ ID NO: 32927 - protein, 7 aa, Artificial Sequence
  Description of Artificial Sequence: Synthetic peptide
SHTGNMV

SEQ ID NO: 32928 - protein, 7 aa, Artificial Sequence
  Description of Artificial Sequence: Synthetic peptide
SNVAKRT

SEQ ID NO: 32929 - protein, 7 aa, Artificial Sequence
  Description of Artificial Sequence: Synthetic peptide
SNATRSS

SEQ ID NO: 32930 - protein, 7 aa, Artificial Sequence
  Description of Artificial Sequence: Synthetic peptide
LGETSMR

SEQ ID NO: 32931 - protein, 7 aa, Artificial Sequence
  Description of Artificial Sequence: Synthetic peptide
EGNRSNM

SEQ ID NO: 32932 - protein, 7 aa, Artificial Sequence
  Description of Artificial Sequence: Synthetic peptide
PADRTHI

SEQ ID NO: 32933 - protein, 7 aa, Artificial Sequence
  Description of Artificial Sequence: Synthetic peptide
TPAGPNK

SEQ ID NO: 32934 - protein, 7 aa, Artificial Sequence
  Description of Artificial Sequence: Synthetic peptide
QVSPLIL

SEQ ID NO: 32935 - protein, 7 aa, Artificial Sequence
  Description of Artificial Sequence: Synthetic peptide
SLSTGSG

SEQ ID NO: 32936 - protein, 7 aa, Artificial Sequence
  Description of Artificial Sequence: Synthetic peptide
SASNTSV

SEQ ID NO: 32937 - protein, 7 aa, Artificial Sequence
  Description of Artificial Sequence: Synthetic peptide
RDTTSTD

SEQ ID NO: 32938 - protein, 7 aa, Artificial Sequence
  Description of Artificial Sequence: Synthetic peptide
PSNSGNN

SEQ ID NO: 32939 - protein, 7 aa, Artificial Sequence
  Description of Artificial Sequence: Synthetic peptide
PVGSVRG

SEQ ID NO: 32940 - protein, 7 aa, Artificial Sequence
  Description of Artificial Sequence: Synthetic peptide
ARADSNF

SEQ ID NO: 32941 - protein, 7 aa, Artificial Sequence
  Description of Artificial Sequence: Synthetic peptide
DGKNNNV

SEQ ID NO: 32942 - protein, 7 aa, Artificial Sequence
  Description of Artificial Sequence: Synthetic peptide
KPATPNG

SEQ ID NO: 32943 - protein, 7 aa, Artificial Sequence
  Description of Artificial Sequence: Synthetic peptide
ESNSSRG

SEQ ID NO: 32944 - protein, 7 aa, Artificial Sequence
  Description of Artificial Sequence: Synthetic peptide
EMNHSPC

SEQ ID NO: 32945 - protein, 7 aa, Artificial Sequence
  Description of Artificial Sequence: Synthetic peptide
TAEANSS

SEQ ID NO: 32946 - protein, 7 aa, Artificial Sequence
  Description of Artificial Sequence: Synthetic peptide
PGTGSNH

SEQ ID NO: 32947 - protein, 7 aa, Artificial Sequence
  Description of Artificial Sequence: Synthetic peptide
ELMNKSK

SEQ ID NO: 32948 - protein, 7 aa, Artificial Sequence
  Description of Artificial Sequence: Synthetic peptide
KSAQGGN

SEQ ID NO: 32949 - protein, 7 aa, Artificial Sequence
  Description of Artificial Sequence: Synthetic peptide
TPGASLS

SEQ ID NO: 32950 - protein, 7 aa, Artificial Sequence
  Description of Artificial Sequence: Synthetic peptide
VIEPGST

SEQ ID NO: 32951 - protein, 7 aa, Artificial Sequence
  Description of Artificial Sequence: Synthetic peptide
GVKTNPL

SEQ ID NO: 32952 - protein, 7 aa, Artificial Sequence
  Description of Artificial Sequence: Synthetic peptide
LMGSPRG

SEQ ID NO: 32953 - protein, 7 aa, Artificial Sequence
  Description of Artificial Sequence: Synthetic peptide
ASSKGLT

SEQ ID NO: 32954 - protein, 7 aa, Artificial Sequence
  Description of Artificial Sequence: Synthetic peptide
GHAAGVS

SEQ ID NO: 32955 - protein, 7 aa, Artificial Sequence
  Description of Artificial Sequence: Synthetic peptide
VSMNTTR

SEQ ID NO: 32956 - protein, 7 aa, Artificial Sequence
  Description of Artificial Sequence: Synthetic peptide
SSPANMA

SEQ ID NO: 32957 - protein, 7 aa, Artificial Sequence
  Description of Artificial Sequence: Synthetic peptide
SVEKAQS

SEQ ID NO: 32958 - protein, 7 aa, Artificial Sequence
  Description of Artificial Sequence: Synthetic peptide
VTLPPNA

SEQ ID NO: 32959 - protein, 7 aa, Artificial Sequence
  Description of Artificial Sequence: Synthetic peptide
PNGHEVL

SEQ ID NO: 32960 - protein, 7 aa, Artificial Sequence
  Description of Artificial Sequence: Synthetic peptide
TTDKSRL

SEQ ID NO: 32961 - protein, 7 aa, Artificial Sequence
  Description of Artificial Sequence: Synthetic peptide
PLNTHQS

SEQ ID NO: 32962 - protein, 7 aa, Artificial Sequence
  Description of Artificial Sequence: Synthetic peptide
FRQTSGN

SEQ ID NO: 32963 - protein, 7 aa, Artificial Sequence
  Description of Artificial Sequence: Synthetic peptide
VGEAGKA

SEQ ID NO: 32964 - protein, 7 aa, Artificial Sequence
  Description of Artificial Sequence: Synthetic peptide
GIDTKML

SEQ ID NO: 32965 - protein, 7 aa, Artificial Sequence
  Description of Artificial Sequence: Synthetic peptide
HGMEVAR

SEQ ID NO: 32966 - protein, 7 aa, Artificial Sequence
  Description of Artificial Sequence: Synthetic peptide
ALKSSNE

SEQ ID NO: 32967 - protein, 7 aa, Artificial Sequence
  Description of Artificial Sequence: Synthetic peptide
GPSTHSG

SEQ ID NO: 32968 - protein, 7 aa, Artificial Sequence
  Description of Artificial Sequence: Synthetic peptide
DAGAAPK

SEQ ID NO: 32969 - protein, 7 aa, Artificial Sequence
  Description of Artificial Sequence: Synthetic peptide
SRAPNTL

SEQ ID NO: 32970 - protein, 7 aa, Artificial Sequence
  Description of Artificial Sequence: Synthetic peptide
SDRSVDG

SEQ ID NO: 32971 - protein, 7 aa, Artificial Sequence
  Description of Artificial Sequence: Synthetic peptide
QEARVYS

SEQ ID NO: 32972 - protein, 7 aa, Artificial Sequence
  Description of Artificial Sequence: Synthetic peptide
TTTTRPS

SEQ ID NO: 32973 - protein, 7 aa, Artificial Sequence
  Description of Artificial Sequence: Synthetic peptide
KVSSATP

SEQ ID NO: 32974 - protein, 7 aa, Artificial Sequence
  Description of Artificial Sequence: Synthetic peptide
SGGDYAK

SEQ ID NO: 32975 - protein, 7 aa, Artificial Sequence
  Description of Artificial Sequence: Synthetic peptide
NSEARLS

SEQ ID NO: 32976 - protein, 7 aa, Artificial Sequence
  Description of Artificial Sequence: Synthetic peptide
AAHSTMN

SEQ ID NO: 32977 - protein, 7 aa, Artificial Sequence
  Description of Artificial Sequence: Synthetic peptide
PQTSPRT

SEQ ID NO: 32978 - protein, 7 aa, Artificial Sequence
  Description of Artificial Sequence: Synthetic peptide
DTNNRAN

SEQ ID NO: 32979 - protein, 7 aa, Artificial Sequence
  Description of Artificial Sequence: Synthetic peptide
STMHKNV

SEQ ID NO: 32980 - protein, 7 aa, Artificial Sequence
  Description of Artificial Sequence: Synthetic peptide
PGASGKV

SEQ ID NO: 32981 - protein, 7 aa, Artificial Sequence
  Description of Artificial Sequence: Synthetic peptide
SIQSAAA

SEQ ID NO: 32982 - protein, 7 aa, Artificial Sequence
  Description of Artificial Sequence: Synthetic peptide
HSSHSPS

SEQ ID NO: 32983 - protein, 7 aa, Artificial Sequence
  Description of Artificial Sequence: Synthetic peptide
EYPQQAK

SEQ ID NO: 32984 - protein, 7 aa, Artificial Sequence
  Description of Artificial Sequence: Synthetic peptide
SKPANNV

SEQ ID NO: 32985 - protein, 7 aa, Artificial Sequence
  Description of Artificial Sequence: Synthetic peptide
QKTTIDG

SEQ ID NO: 32986 - protein, 7 aa, Artificial Sequence
  Description of Artificial Sequence: Synthetic peptide
PITRSLL

SEQ ID NO: 32987 - protein, 7 aa, Artificial Sequence
  Description of Artificial Sequence: Synthetic peptide
PTGEKRL

SEQ ID NO: 32988 - protein, 7 aa, Artificial Sequence
  Description of Artificial Sequence: Synthetic peptide
APLQSNL

SEQ ID NO: 32989 - protein, 7 aa, Artificial Sequence
  Description of Artificial Sequence: Synthetic peptide
MNRTGIK

SEQ ID NO: 32990 - protein, 7 aa, Artificial Sequence
  Description of Artificial Sequence: Synthetic peptide
HYGPDSK

SEQ ID NO: 32991 - protein, 7 aa, Artificial Sequence
  Description of Artificial Sequence: Synthetic peptide
HANSPAT

SEQ ID NO: 32992 - protein, 7 aa, Artificial Sequence
  Description of Artificial Sequence: Synthetic peptide
NPSMAMK

SEQ ID NO: 32993 - protein, 7 aa, Artificial Sequence
  Description of Artificial Sequence: Synthetic peptide
EIRAHTT

SEQ ID NO: 32994 - protein, 7 aa, Artificial Sequence
  Description of Artificial Sequence: Synthetic peptide
SPGNKLL

SEQ ID NO: 32995 - protein, 7 aa, Artificial Sequence
  Description of Artificial Sequence: Synthetic peptide
RERTGFN

SEQ ID NO: 32996 - protein, 7 aa, Artificial Sequence
  Description of Artificial Sequence: Synthetic peptide
NPAHGLN

SEQ ID NO: 32997 - protein, 7 aa, Artificial Sequence
  Description of Artificial Sequence: Synthetic peptide
MLPSVSG

SEQ ID NO: 32998 - protein, 7 aa, Artificial Sequence
  Description of Artificial Sequence: Synthetic peptide
KSVSSSG

SEQ ID NO: 32999 - protein, 7 aa, Artificial Sequence
  Description of Artificial Sequence: Synthetic peptide
ACNTSRC

SEQ ID NO: 33000 - protein, 7 aa, Artificial Sequence
  Description of Artificial Sequence: Synthetic peptide
EPLSKQS

SEQ ID NO: 33001 - protein, 7 aa, Artificial Sequence
  Description of Artificial Sequence: Synthetic peptide
NSNNAMA

SEQ ID NO: 33002 - protein, 7 aa, Artificial Sequence
  Description of Artificial Sequence: Synthetic peptide
SNSHKIY

SEQ ID NO: 33003 - protein, 7 aa, Artificial Sequence
  Description of Artificial Sequence: Synthetic peptide
TNPTGYR

SEQ ID NO: 33004 - protein, 7 aa, Artificial Sequence
  Description of Artificial Sequence: Synthetic peptide
GLVPNLI

SEQ ID NO: 33005 - protein, 7 aa, Artificial Sequence
  Description of Artificial Sequence: Synthetic peptide
GTAGRFN

SEQ ID NO: 33006 - protein, 7 aa, Artificial Sequence
  Description of Artificial Sequence: Synthetic peptide
NRNGFNN

SEQ ID NO: 33007 - protein, 7 aa, Artificial Sequence
  Description of Artificial Sequence: Synthetic peptide
AAAVKGG

SEQ ID NO: 33008 - protein, 7 aa, Artificial Sequence
  Description of Artificial Sequence: Synthetic peptide
LMDHRTR

SEQ ID NO: 33009 - protein, 7 aa, Artificial Sequence
  Description of Artificial Sequence: Synthetic peptide
VNANKAC

SEQ ID NO: 33010 - protein, 7 aa, Artificial Sequence
  Description of Artificial Sequence: Synthetic peptide
SHSVTPG

SEQ ID NO: 33011 - protein, 7 aa, Artificial Sequence
  Description of Artificial Sequence: Synthetic peptide
SLLGGLG

SEQ ID NO: 33012 - protein, 7 aa, Artificial Sequence
  Description of Artificial Sequence: Synthetic peptide
GSHTNTS

SEQ ID NO: 33013 - protein, 7 aa, Artificial Sequence
  Description of Artificial Sequence: Synthetic peptide
GPNPING

SEQ ID NO: 33014 - protein, 7 aa, Artificial Sequence
  Description of Artificial Sequence: Synthetic peptide
TGRGSDV

SEQ ID NO: 33015 - protein, 7 aa, Artificial Sequence
  Description of Artificial Sequence: Synthetic peptide
GLQSKQL

SEQ ID NO: 33016 - protein, 7 aa, Artificial Sequence
  Description of Artificial Sequence: Synthetic peptide
SPVKGSV

SEQ ID NO: 33017 - protein, 7 aa, Artificial Sequence
  Description of Artificial Sequence: Synthetic peptide
DPLGKQG

SEQ ID NO: 33018 - protein, 7 aa, Artificial Sequence
  Description of Artificial Sequence: Synthetic peptide
LSSDKNV

SEQ ID NO: 33019 - protein, 7 aa, Artificial Sequence
  Description of Artificial Sequence: Synthetic peptide
HDTHKFL

SEQ ID NO: 33020 - protein, 7 aa, Artificial Sequence
  Description of Artificial Sequence: Synthetic peptide
NLSHSAG

SEQ ID NO: 33021 - protein, 7 aa, Artificial Sequence
  Description of Artificial Sequence: Synthetic peptide
YSGGTQQ

SEQ ID NO: 33022 - protein, 7 aa, Artificial Sequence
  Description of Artificial Sequence: Synthetic peptide
SLPGESK

SEQ ID NO: 33023 - protein, 7 aa, Artificial Sequence
  Description of Artificial Sequence: Synthetic peptide
SRNPNMI

SEQ ID NO: 33024 - protein, 7 aa, Artificial Sequence
  Description of Artificial Sequence: Synthetic peptide
NISSKVA

SEQ ID NO: 33025 - protein, 7 aa, Artificial Sequence
  Description of Artificial Sequence: Synthetic peptide
SNPSGFS

SEQ ID NO: 33026 - protein, 7 aa, Artificial Sequence
  Description of Artificial Sequence: Synthetic peptide
RRIDTIP

SEQ ID NO: 33027 - protein, 7 aa, Artificial Sequence
  Description of Artificial Sequence: Synthetic peptide
HVSHGPG

SEQ ID NO: 33028 - protein, 7 aa, Artificial Sequence
  Description of Artificial Sequence: Synthetic peptide
ASSPQEK

SEQ ID NO: 33029 - protein, 7 aa, Artificial Sequence
  Description of Artificial Sequence: Synthetic peptide
QLNEEHG

SEQ ID NO: 33030 - protein, 7 aa, Artificial Sequence
  Description of Artificial Sequence: Synthetic peptide
ETPNRSQ

SEQ ID NO: 33031 - protein, 7 aa, Artificial Sequence
  Description of Artificial Sequence: Synthetic peptide
KMTPQST

SEQ ID NO: 33032 - protein, 7 aa, Artificial Sequence
  Description of Artificial Sequence: Synthetic peptide
QTSSHAY

SEQ ID NO: 33033 - protein, 7 aa, Artificial Sequence
  Description of Artificial Sequence: Synthetic peptide
RMQPSGN

SEQ ID NO: 33034 - protein, 7 aa, Artificial Sequence
  Description of Artificial Sequence: Synthetic peptide
PRTNVMP

SEQ ID NO: 33035 - protein, 7 aa, Artificial Sequence
  Description of Artificial Sequence: Synthetic peptide
ATTKAGI

SEQ ID NO: 33036 - protein, 7 aa, Artificial Sequence
  Description of Artificial Sequence: Synthetic peptide
KNSSGST

SEQ ID NO: 33037 - protein, 7 aa, Artificial Sequence
  Description of Artificial Sequence: Synthetic peptide
SASPSIK

SEQ ID NO: 33038 - protein, 7 aa, Artificial Sequence
  Description of Artificial Sequence: Synthetic peptide
MPLKPHL

SEQ ID NO: 33039 - protein, 7 aa, Artificial Sequence
  Description of Artificial Sequence: Synthetic peptide
QSKGGSN

SEQ ID NO: 33040 - protein, 7 aa, Artificial Sequence
  Description of Artificial Sequence: Synthetic peptide
NNLAGSK

SEQ ID NO: 33041 - protein, 7 aa, Artificial Sequence
  Description of Artificial Sequence: Synthetic peptide
QSSQSGP

SEQ ID NO: 33042 - protein, 7 aa, Artificial Sequence
  Description of Artificial Sequence: Synthetic peptide
GMGGLKN

SEQ ID NO: 33043 - protein, 7 aa, Artificial Sequence
  Description of Artificial Sequence: Synthetic peptide
RSYEGMQ

SEQ ID NO: 33044 - protein, 7 aa, Artificial Sequence
  Description of Artificial Sequence: Synthetic peptide
NPYTANN

SEQ ID NO: 33045 - protein, 7 aa, Artificial Sequence
  Description of Artificial Sequence: Synthetic peptide
HSTPSTR

SEQ ID NO: 33046 - protein, 7 aa, Artificial Sequence
  Description of Artificial Sequence: Synthetic peptide
CIGNKTN

SEQ ID NO: 33047 - protein, 7 aa, Artificial Sequence
  Description of Artificial Sequence: Synthetic peptide
GVTGSRG

SEQ ID NO: 33048 - protein, 7 aa, Artificial Sequence
  Description of Artificial Sequence: Synthetic peptide
SPTRPMN

SEQ ID NO: 33049 - protein, 7 aa, Artificial Sequence
  Description of Artificial Sequence: Synthetic peptide
CPQRAST

SEQ ID NO: 33050 - protein, 7 aa, Artificial Sequence
  Description of Artificial Sequence: Synthetic peptide
PLQTSRT

SEQ ID NO: 33051 - protein, 7 aa, Artificial Sequence
  Description of Artificial Sequence: Synthetic peptide
DSRNNMT

SEQ ID NO: 33052 - protein, 7 aa, Artificial Sequence
  Description of Artificial Sequence: Synthetic peptide
RYDKQNS

SEQ ID NO: 33053 - protein, 7 aa, Artificial Sequence
  Description of Artificial Sequence: Synthetic peptide
NAGPNYD

SEQ ID NO: 33054 - protein, 7 aa, Artificial Sequence
  Description of Artificial Sequence: Synthetic peptide
IRSKGSA

SEQ ID NO: 33055 - protein, 7 aa, Artificial Sequence
  Description of Artificial Sequence: Synthetic peptide
DYDATSR

SEQ ID NO: 33056 - protein, 7 aa, Artificial Sequence
  Description of Artificial Sequence: Synthetic peptide
LSANPHN

SEQ ID NO: 33057 - protein, 7 aa, Artificial Sequence
  Description of Artificial Sequence: Synthetic peptide
VRIPKSN

SEQ ID NO: 33058 - protein, 7 aa, Artificial Sequence
  Description of Artificial Sequence: Synthetic peptide
IVSGKLT

SEQ ID NO: 33059 - protein, 7 aa, Artificial Sequence
  Description of Artificial Sequence: Synthetic peptide
IGNKQSQ

SEQ ID NO: 33060 - protein, 7 aa, Artificial Sequence
  Description of Artificial Sequence: Synthetic peptide
PYQSHSP

SEQ ID NO: 33061 - protein, 7 aa, Artificial Sequence
  Description of Artificial Sequence: Synthetic peptide
GSISTAH

SEQ ID NO: 33062 - protein, 7 aa, Artificial Sequence
  Description of Artificial Sequence: Synthetic peptide
ENNALSR

SEQ ID NO: 33063 - protein, 7 aa, Artificial Sequence
  Description of Artificial Sequence: Synthetic peptide
SQVSHSV

SEQ ID NO: 33064 - protein, 7 aa, Artificial Sequence
  Description of Artificial Sequence: Synthetic peptide
NYSGAHT

SEQ ID NO: 33065 - protein, 7 aa, Artificial Sequence
  Description of Artificial Sequence: Synthetic peptide
PVSTHSS

SEQ ID NO: 33066 - protein, 7 aa, Artificial Sequence
  Description of Artificial Sequence: Synthetic peptide
VHVTSQT

SEQ ID NO: 33067 - protein, 7 aa, Artificial Sequence
  Description of Artificial Sequence: Synthetic peptide
IRTNSTL

SEQ ID NO: 33068 - protein, 7 aa, Artificial Sequence
  Description of Artificial Sequence: Synthetic peptide
EARKVTS

SEQ ID NO: 33069 - protein, 7 aa, Artificial Sequence
  Description of Artificial Sequence: Synthetic peptide
NSVAGMG

SEQ ID NO: 33070 - protein, 7 aa, Artificial Sequence
  Description of Artificial Sequence: Synthetic peptide
RGNENIN

SEQ ID NO: 33071 - protein, 7 aa, Artificial Sequence
  Description of Artificial Sequence: Synthetic peptide
DPQVRAL

SEQ ID NO: 33072 - protein, 7 aa, Artificial Sequence
  Description of Artificial Sequence: Synthetic peptide
GITHGSH

SEQ ID NO: 33073 - protein, 7 aa, Artificial Sequence
  Description of Artificial Sequence: Synthetic peptide
GQAVNTA

SEQ ID NO: 33074 - protein, 7 aa, Artificial Sequence
  Description of Artificial Sequence: Synthetic peptide
TTYGGNR

SEQ ID NO: 33075 - protein, 7 aa, Artificial Sequence
  Description of Artificial Sequence: Synthetic peptide
NNGASVV

SEQ ID NO: 33076 - protein, 7 aa, Artificial Sequence
  Description of Artificial Sequence: Synthetic peptide
PIGSQHI

SEQ ID NO: 33077 - protein, 7 aa, Artificial Sequence
  Description of Artificial Sequence: Synthetic peptide
SVQKSVN

SEQ ID NO: 33078 - protein, 7 aa, Artificial Sequence
  Description of Artificial Sequence: Synthetic peptide
EPVPKTR

SEQ ID NO: 33079 - protein, 7 aa, Artificial Sequence
  Description of Artificial Sequence: Synthetic peptide
GTSNRYT

SEQ ID NO: 33080 - protein, 7 aa, Artificial Sequence
  Description of Artificial Sequence: Synthetic peptide
RNNPTTV

SEQ ID NO: 33081 - protein, 7 aa, Artificial Sequence
  Description of Artificial Sequence: Synthetic peptide
DPATRKS

SEQ ID NO: 33082 - protein, 7 aa, Artificial Sequence
  Description of Artificial Sequence: Synthetic peptide
PMSHVSG

SEQ ID NO: 33083 - protein, 7 aa, Artificial Sequence
  Description of Artificial Sequence: Synthetic peptide
TNIQASK

SEQ ID NO: 33084 - protein, 7 aa, Artificial Sequence
  Description of Artificial Sequence: Synthetic peptide
KLVNSNG

SEQ ID NO: 33085 - protein, 7 aa, Artificial Sequence
  Description of Artificial Sequence: Synthetic peptide
FTYAEGN

SEQ ID NO: 33086 - protein, 7 aa, Artificial Sequence
  Description of Artificial Sequence: Synthetic peptide
WQEERGQ

SEQ ID NO: 33087 - protein, 7 aa, Artificial Sequence
  Description of Artificial Sequence: Synthetic peptide
YGNPRQA

SEQ ID NO: 33088 - protein, 7 aa, Artificial Sequence
  Description of Artificial Sequence: Synthetic peptide
QSTGRER

SEQ ID NO: 33089 - protein, 7 aa, Artificial Sequence
  Description of Artificial Sequence: Synthetic peptide
NGVQQPK

SEQ ID NO: 33090 - protein, 7 aa, Artificial Sequence
  Description of Artificial Sequence: Synthetic peptide
QYNQAGL

SEQ ID NO: 33091 - protein, 7 aa, Artificial Sequence
  Description of Artificial Sequence: Synthetic peptide
PLNARGS

SEQ ID NO: 33092 - protein, 7 aa, Artificial Sequence
  Description of Artificial Sequence: Synthetic peptide
HAKSSSM

SEQ ID NO: 33093 - protein, 7 aa, Artificial Sequence
  Description of Artificial Sequence: Synthetic peptide
EHETSSR

SEQ ID NO: 33094 - protein, 7 aa, Artificial Sequence
  Description of Artificial Sequence: Synthetic peptide
QKTQTTS

SEQ ID NO: 33095 - protein, 7 aa, Artificial Sequence
  Description of Artificial Sequence: Synthetic peptide
QGAADHS

SEQ ID NO: 33096 - protein, 7 aa, Artificial Sequence
  Description of Artificial Sequence: Synthetic peptide
IASSGMH

SEQ ID NO: 33097 - protein, 7 aa, Artificial Sequence
  Description of Artificial Sequence: Synthetic peptide
SYPSQLN

SEQ ID NO: 33098 - protein, 7 aa, Artificial Sequence
  Description of Artificial Sequence: Synthetic peptide
VRSNVSG

SEQ ID NO: 33099 - protein, 7 aa, Artificial Sequence
  Description of Artificial Sequence: Synthetic peptide
PGTKQSS

SEQ ID NO: 33100 - protein, 7 aa, Artificial Sequence
  Description of Artificial Sequence: Synthetic peptide
THSKSFV

SEQ ID NO: 33101 - protein, 7 aa, Artificial Sequence
  Description of Artificial Sequence: Synthetic peptide
RGTGIGS

SEQ ID NO: 33102 - protein, 7 aa, Artificial Sequence
  Description of Artificial Sequence: Synthetic peptide
PSSPNSI

SEQ ID NO: 33103 - protein, 7 aa, Artificial Sequence
  Description of Artificial Sequence: Synthetic peptide
RATEGVF

SEQ ID NO: 33104 - protein, 7 aa, Artificial Sequence
  Description of Artificial Sequence: Synthetic peptide
PILDRKS

SEQ ID NO: 33105 - protein, 7 aa, Artificial Sequence
  Description of Artificial Sequence: Synthetic peptide
DSIGSSK

SEQ ID NO: 33106 - protein, 7 aa, Artificial Sequence
  Description of Artificial Sequence: Synthetic peptide
MSSERPG

SEQ ID NO: 33107 - protein, 7 aa, Artificial Sequence
  Description of Artificial Sequence: Synthetic peptide
KENPVRS

SEQ ID NO: 33108 - protein, 7 aa, Artificial Sequence
  Description of Artificial Sequence: Synthetic peptide
YSGPDLR

SEQ ID NO: 33109 - protein, 7 aa, Artificial Sequence
  Description of Artificial Sequence: Synthetic peptide
YRVTQSS

SEQ ID NO: 33110 - protein, 7 aa, Artificial Sequence
  Description of Artificial Sequence: Synthetic peptide
STSSSAS

SEQ ID NO: 33111 - protein, 7 aa, Artificial Sequence
  Description of Artificial Sequence: Synthetic peptide
RQYTGDS

SEQ ID NO: 33112 - protein, 7 aa, Artificial Sequence
  Description of Artificial Sequence: Synthetic peptide
RELKNSS

SEQ ID NO: 33113 - protein, 7 aa, Artificial Sequence
  Description of Artificial Sequence: Synthetic peptide
GTGTTFR

SEQ ID NO: 33114 - protein, 7 aa, Artificial Sequence
  Description of Artificial Sequence: Synthetic peptide
LMPSSSS

SEQ ID NO: 33115 - protein, 7 aa, Artificial Sequence
  Description of Artificial Sequence: Synthetic peptide
PDVKVTR

SEQ ID NO: 33116 - protein, 7 aa, Artificial Sequence
  Description of Artificial Sequence: Synthetic peptide
VASSAHV

SEQ ID NO: 33117 - protein, 7 aa, Artificial Sequence
  Description of Artificial Sequence: Synthetic peptide
GKTNVSS

SEQ ID NO: 33118 - protein, 7 aa, Artificial Sequence
  Description of Artificial Sequence: Synthetic peptide
FVSGKVQ

SEQ ID NO: 33119 - protein, 7 aa, Artificial Sequence
  Description of Artificial Sequence: Synthetic peptide
NSRISPS

SEQ ID NO: 33120 - protein, 7 aa, Artificial Sequence
  Description of Artificial Sequence: Synthetic peptide
TSSPQPS

SEQ ID NO: 33121 - protein, 7 aa, Artificial Sequence
  Description of Artificial Sequence: Synthetic peptide
GTNTGIV

SEQ ID NO: 33122 - protein, 7 aa, Artificial Sequence
  Description of Artificial Sequence: Synthetic peptide
STTNSKN

SEQ ID NO: 33123 - protein, 7 aa, Artificial Sequence
  Description of Artificial Sequence: Synthetic peptide
RSLSTEN

SEQ ID NO: 33124 - protein, 7 aa, Artificial Sequence
  Description of Artificial Sequence: Synthetic peptide
LRPANTI

SEQ ID NO: 33125 - protein, 7 aa, Artificial Sequence
  Description of Artificial Sequence: Synthetic peptide
PQESRGM

SEQ ID NO: 33126 - protein, 7 aa, Artificial Sequence
  Description of Artificial Sequence: Synthetic peptide
GDKGLQR

SEQ ID NO: 33127 - protein, 7 aa, Artificial Sequence
  Description of Artificial Sequence: Synthetic peptide
SNSRQAD

SEQ ID NO: 33128 - protein, 7 aa, Artificial Sequence
  Description of Artificial Sequence: Synthetic peptide
DVNPSAK

SEQ ID NO: 33129 - protein, 7 aa, Artificial Sequence
  Description of Artificial Sequence: Synthetic peptide
RSPAYQD

SEQ ID NO: 33130 - protein, 7 aa, Artificial Sequence
  Description of Artificial Sequence: Synthetic peptide
WTVSRSG

SEQ ID NO: 33131 - protein, 7 aa, Artificial Sequence
  Description of Artificial Sequence: Synthetic peptide
VSDNTYK

SEQ ID NO: 33132 - protein, 7 aa, Artificial Sequence
  Description of Artificial Sequence: Synthetic peptide
DRKHTST

SEQ ID NO: 33133 - protein, 7 aa, Artificial Sequence
  Description of Artificial Sequence: Synthetic peptide
GTTNSRN

SEQ ID NO: 33134 - protein, 7 aa, Artificial Sequence
  Description of Artificial Sequence: Synthetic peptide
GTSTSLR

SEQ ID NO: 33135 - protein, 7 aa, Artificial Sequence
  Description of Artificial Sequence: Synthetic peptide
IIQNGQG

SEQ ID NO: 33136 - protein, 7 aa, Artificial Sequence
  Description of Artificial Sequence: Synthetic peptide
SDSRNPV

SEQ ID NO: 33137 - protein, 7 aa, Artificial Sequence
  Description of Artificial Sequence: Synthetic peptide
TGSGSNH

SEQ ID NO: 33138 - protein, 7 aa, Artificial Sequence
  Description of Artificial Sequence: Synthetic peptide
SNETKSS

SEQ ID NO: 33139 - protein, 7 aa, Artificial Sequence
  Description of Artificial Sequence: Synthetic peptide
ATMRSNE

SEQ ID NO: 33140 - protein, 7 aa, Artificial Sequence
  Description of Artificial Sequence: Synthetic peptide
QNTPKST

SEQ ID NO: 33141 - protein, 7 aa, Artificial Sequence
  Description of Artificial Sequence: Synthetic peptide
RSSGGLT

SEQ ID NO: 33142 - protein, 7 aa, Artificial Sequence
  Description of Artificial Sequence: Synthetic peptide
ATVQSAT

SEQ ID NO: 33143 - protein, 7 aa, Artificial Sequence
  Description of Artificial Sequence: Synthetic peptide
TPTPVNQ

SEQ ID NO: 33144 - protein, 7 aa, Artificial Sequence
  Description of Artificial Sequence: Synthetic peptide
SSDLGKR

SEQ ID NO: 33145 - protein, 7 aa, Artificial Sequence
  Description of Artificial Sequence: Synthetic peptide
YGRDKFS

SEQ ID NO: 33146 - protein, 7 aa, Artificial Sequence
  Description of Artificial Sequence: Synthetic peptide
TEQVGTR

SEQ ID NO: 33147 - protein, 7 aa, Artificial Sequence
  Description of Artificial Sequence: Synthetic peptide
STTPGLK

SEQ ID NO: 33148 - protein, 7 aa, Artificial Sequence
  Description of Artificial Sequence: Synthetic peptide
SFTGNTV

SEQ ID NO: 33149 - protein, 7 aa, Artificial Sequence
  Description of Artificial Sequence: Synthetic peptide
CAGTSSV

SEQ ID NO: 33150 - protein, 7 aa, Artificial Sequence
  Description of Artificial Sequence: Synthetic peptide
HLAYDNN

SEQ ID NO: 33151 - protein, 7 aa, Artificial Sequence
  Description of Artificial Sequence: Synthetic peptide
NGSEQNQ

SEQ ID NO: 33152 - protein, 7 aa, Artificial Sequence
  Description of Artificial Sequence: Synthetic peptide
TSRVGQV

SEQ ID NO: 33153 - protein, 7 aa, Artificial Sequence
  Description of Artificial Sequence: Synthetic peptide
NYDSLKK

SEQ ID NO: 33154 - protein, 7 aa, Artificial Sequence
  Description of Artificial Sequence: Synthetic peptide
GVPAGHT

SEQ ID NO: 33155 - protein, 7 aa, Artificial Sequence
  Description of Artificial Sequence: Synthetic peptide
HYGETRN

SEQ ID NO: 33156 - protein, 7 aa, Artificial Sequence
  Description of Artificial Sequence: Synthetic peptide
IGGNKPL

SEQ ID NO: 33157 - protein, 7 aa, Artificial Sequence
  Description of Artificial Sequence: Synthetic peptide
PFGAGRP

SEQ ID NO: 33158 - protein, 7 aa, Artificial Sequence
  Description of Artificial Sequence: Synthetic peptide
MEIKPNR

SEQ ID NO: 33159 - protein, 7 aa, Artificial Sequence
  Description of Artificial Sequence: Synthetic peptide
TLENSRR

SEQ ID NO: 33160 - protein, 7 aa, Artificial Sequence
  Description of Artificial Sequence: Synthetic peptide
SGVKAFS

SEQ ID NO: 33161 - protein, 7 aa, Artificial Sequence
  Description of Artificial Sequence: Synthetic peptide
SRQATSS

SEQ ID NO: 33162 - protein, 7 aa, Artificial Sequence
  Description of Artificial Sequence: Synthetic peptide
TPQNSVK

SEQ ID NO: 33163 - protein, 7 aa, Artificial Sequence
  Description of Artificial Sequence: Synthetic peptide
RVDTITK

SEQ ID NO: 33164 - protein, 7 aa, Artificial Sequence
  Description of Artificial Sequence: Synthetic peptide
LASHKGQ

SEQ ID NO: 33165 - protein, 7 aa, Artificial Sequence
  Description of Artificial Sequence: Synthetic peptide
FSNNGSH

SEQ ID NO: 33166 - protein, 7 aa, Artificial Sequence
  Description of Artificial Sequence: Synthetic peptide
IKQSSSA

SEQ ID NO: 33167 - protein, 7 aa, Artificial Sequence
  Description of Artificial Sequence: Synthetic peptide
HGVNKTE

SEQ ID NO: 33168 - protein, 7 aa, Artificial Sequence
  Description of Artificial Sequence: Synthetic peptide
YDQTRTR

SEQ ID NO: 33169 - protein, 7 aa, Artificial Sequence
  Description of Artificial Sequence: Synthetic peptide
NTTGHAG

SEQ ID NO: 33170 - protein, 7 aa, Artificial Sequence
  Description of Artificial Sequence: Synthetic peptide
PNLSKSL

SEQ ID NO: 33171 - protein, 7 aa, Artificial Sequence
  Description of Artificial Sequence: Synthetic peptide
LPSGNTS

SEQ ID NO: 33172 - protein, 7 aa, Artificial Sequence
  Description of Artificial Sequence: Synthetic peptide
ALSSQKG

SEQ ID NO: 33173 - protein, 7 aa, Artificial Sequence
  Description of Artificial Sequence: Synthetic peptide
AMSEHLK

SEQ ID NO: 33174 - protein, 7 aa, Artificial Sequence
  Description of Artificial Sequence: Synthetic peptide
QDSSIRN

SEQ ID NO: 33175 - protein, 7 aa, Artificial Sequence
  Description of Artificial Sequence: Synthetic peptide
SLSLVKG

SEQ ID NO: 33176 - protein, 7 aa, Artificial Sequence
  Description of Artificial Sequence: Synthetic peptide
YPNSVPS

SEQ ID NO: 33177 - protein, 7 aa, Artificial Sequence
  Description of Artificial Sequence: Synthetic peptide
PRLLDDG

SEQ ID NO: 33178 - protein, 7 aa, Artificial Sequence
  Description of Artificial Sequence: Synthetic peptide
GPNPGNH

SEQ ID NO: 33179 - protein, 7 aa, Artificial Sequence
  Description of Artificial Sequence: Synthetic peptide
HSTTVAK

SEQ ID NO: 33180 - protein, 7 aa, Artificial Sequence
  Description of Artificial Sequence: Synthetic peptide
STDRSFN

SEQ ID NO: 33181 - protein, 7 aa, Artificial Sequence
  Description of Artificial Sequence: Synthetic peptide
PLPAHSP

SEQ ID NO: 33182 - protein, 7 aa, Artificial Sequence
  Description of Artificial Sequence: Synthetic peptide
MVSHTHG

SEQ ID NO: 33183 - protein, 7 aa, Artificial Sequence
  Description of Artificial Sequence: Synthetic peptide
PVSRLTG

SEQ ID NO: 33184 - protein, 7 aa, Artificial Sequence
  Description of Artificial Sequence: Synthetic peptide
IGTSINS

SEQ ID NO: 33185 - protein, 7 aa, Artificial Sequence
  Description of Artificial Sequence: Synthetic peptide
SPNKTSL

SEQ ID NO: 33186 - protein, 7 aa, Artificial Sequence
  Description of Artificial Sequence: Synthetic peptide
QTQGQLK

SEQ ID NO: 33187 - protein, 7 aa, Artificial Sequence
  Description of Artificial Sequence: Synthetic peptide
NLGTNVL

SEQ ID NO: 33188 - protein, 7 aa, Artificial Sequence
  Description of Artificial Sequence: Synthetic peptide
NREKLSY

SEQ ID NO: 33189 - protein, 7 aa, Artificial Sequence
  Description of Artificial Sequence: Synthetic peptide
AQSTYQS

SEQ ID NO: 33190 - protein, 7 aa, Artificial Sequence
  Description of Artificial Sequence: Synthetic peptide
NSSHNVS

SEQ ID NO: 33191 - protein, 7 aa, Artificial Sequence
  Description of Artificial Sequence: Synthetic peptide
SDKGNTR

SEQ ID NO: 33192 - protein, 7 aa, Artificial Sequence
  Description of Artificial Sequence: Synthetic peptide
MNTQGPI

SEQ ID NO: 33193 - protein, 7 aa, Artificial Sequence
  Description of Artificial Sequence: Synthetic peptide
GGQTARI

SEQ ID NO: 33194 - protein, 7 aa, Artificial Sequence
  Description of Artificial Sequence: Synthetic peptide
LHPKGQT

SEQ ID NO: 33195 - protein, 7 aa, Artificial Sequence
  Description of Artificial Sequence: Synthetic peptide
SYGKGSS

SEQ ID NO: 33196 - protein, 7 aa, Artificial Sequence
  Description of Artificial Sequence: Synthetic peptide
YGQTKTQ

SEQ ID NO: 33197 - protein, 7 aa, Artificial Sequence
  Description of Artificial Sequence: Synthetic peptide
MMVSSRS

SEQ ID NO: 33198 - protein, 7 aa, Artificial Sequence
  Description of Artificial Sequence: Synthetic peptide
LGTSQMK

SEQ ID NO: 33199 - protein, 7 aa, Artificial Sequence
  Description of Artificial Sequence: Synthetic peptide
AGHSGRD

SEQ ID NO: 33200 - protein, 7 aa, Artificial Sequence
  Description of Artificial Sequence: Synthetic peptide
HGSRSMS

SEQ ID NO: 33201 - protein, 7 aa, Artificial Sequence
  Description of Artificial Sequence: Synthetic peptide
SQPGSNH

SEQ ID NO: 33202 - protein, 7 aa, Artificial Sequence
  Description of Artificial Sequence: Synthetic peptide
AMGSSLS

SEQ ID NO: 33203 - protein, 7 aa, Artificial Sequence
  Description of Artificial Sequence: Synthetic peptide
DNPRQAY

SEQ ID NO: 33204 - protein, 7 aa, Artificial Sequence
  Description of Artificial Sequence: Synthetic peptide
SSAGTYT

SEQ ID NO: 33205 - protein, 7 aa, Artificial Sequence
  Description of Artificial Sequence: Synthetic peptide
DNMSTPK

SEQ ID NO: 33206 - protein, 7 aa, Artificial Sequence
  Description of Artificial Sequence: Synthetic peptide
NAVRSEN

SEQ ID NO: 33207 - protein, 7 aa, Artificial Sequence
  Description of Artificial Sequence: Synthetic peptide
PLSGSKA

SEQ ID NO: 33208 - protein, 7 aa, Artificial Sequence
  Description of Artificial Sequence: Synthetic peptide
DPLRNSN

SEQ ID NO: 33209 - protein, 7 aa, Artificial Sequence
  Description of Artificial Sequence: Synthetic peptide
FNSNRDS

SEQ ID NO: 33210 - protein, 7 aa, Artificial Sequence
  Description of Artificial Sequence: Synthetic peptide
PLGSRVN

SEQ ID NO: 33211 - protein, 7 aa, Artificial Sequence
  Description of Artificial Sequence: Synthetic peptide
TTHNMQG

SEQ ID NO: 33212 - protein, 7 aa, Artificial Sequence
  Description of Artificial Sequence: Synthetic peptide
QISASTR

SEQ ID NO: 33213 - protein, 7 aa, Artificial Sequence
  Description of Artificial Sequence: Synthetic peptide
RFQNNTG

SEQ ID NO: 33214 - protein, 7 aa, Artificial Sequence
  Description of Artificial Sequence: Synthetic peptide
DPHNTSR

SEQ ID NO: 33215 - protein, 7 aa, Artificial Sequence
  Description of Artificial Sequence: Synthetic peptide
RNDTKLF

SEQ ID NO: 33216 - protein, 7 aa, Artificial Sequence
  Description of Artificial Sequence: Synthetic peptide
ATHSKAS

SEQ ID NO: 33217 - protein, 7 aa, Artificial Sequence
  Description of Artificial Sequence: Synthetic peptide
ERTPPRI

SEQ ID NO: 33218 - protein, 7 aa, Artificial Sequence
  Description of Artificial Sequence: Synthetic peptide
SLTPMGR

SEQ ID NO: 33219 - protein, 7 aa, Artificial Sequence
  Description of Artificial Sequence: Synthetic peptide
TPITPMT

SEQ ID NO: 33220 - protein, 7 aa, Artificial Sequence
  Description of Artificial Sequence: Synthetic peptide
YHLNSQS

SEQ ID NO: 33221 - protein, 7 aa, Artificial Sequence
  Description of Artificial Sequence: Synthetic peptide
FTSNKAS

SEQ ID NO: 33222 - protein, 7 aa, Artificial Sequence
  Description of Artificial Sequence: Synthetic peptide
NSFSRNS

SEQ ID NO: 33223 - protein, 7 aa, Artificial Sequence
  Description of Artificial Sequence: Synthetic peptide
KVDKRTD

SEQ ID NO: 33224 - protein, 7 aa, Artificial Sequence
  Description of Artificial Sequence: Synthetic peptide
KLTGQRS

SEQ ID NO: 33225 - protein, 7 aa, Artificial Sequence
  Description of Artificial Sequence: Synthetic peptide
YSGASGR

SEQ ID NO: 33226 - protein, 7 aa, Artificial Sequence
  Description of Artificial Sequence: Synthetic peptide
SLGNRSL

SEQ ID NO: 33227 - protein, 7 aa, Artificial Sequence
  Description of Artificial Sequence: Synthetic peptide
MLNSRTS

SEQ ID NO: 33228 - protein, 7 aa, Artificial Sequence
  Description of Artificial Sequence: Synthetic peptide
QITPRSG

SEQ ID NO: 33229 - protein, 7 aa, Artificial Sequence
  Description of Artificial Sequence: Synthetic peptide
TNRNTYV

SEQ ID NO: 33230 - protein, 7 aa, Artificial Sequence
  Description of Artificial Sequence: Synthetic peptide
MAGNPHS

SEQ ID NO: 33231 - protein, 7 aa, Artificial Sequence
  Description of Artificial Sequence: Synthetic peptide
MLSGSRN

SEQ ID NO: 33232 - protein, 7 aa, Artificial Sequence
  Description of Artificial Sequence: Synthetic peptide
SNTRDIK

SEQ ID NO: 33233 - protein, 7 aa, Artificial Sequence
  Description of Artificial Sequence: Synthetic peptide
NGSGLNQ

SEQ ID NO: 33234 - protein, 7 aa, Artificial Sequence
  Description of Artificial Sequence: Synthetic peptide
SIKSVTN

SEQ ID NO: 33235 - protein, 7 aa, Artificial Sequence
  Description of Artificial Sequence: Synthetic peptide
SHDNGQS

SEQ ID NO: 33236 - protein, 7 aa, Artificial Sequence
  Description of Artificial Sequence: Synthetic peptide
DYGKGSS

SEQ ID NO: 33237 - protein, 7 aa, Artificial Sequence
  Description of Artificial Sequence: Synthetic peptide
STVGHMN

SEQ ID NO: 33238 - protein, 7 aa, Artificial Sequence
  Description of Artificial Sequence: Synthetic peptide
RMLDGHS

SEQ ID NO: 33239 - protein, 7 aa, Artificial Sequence
  Description of Artificial Sequence: Synthetic peptide
PMDYSRS

SEQ ID NO: 33240 - protein, 7 aa, Artificial Sequence
  Description of Artificial Sequence: Synthetic peptide
KGSNHSG

SEQ ID NO: 33241 - protein, 7 aa, Artificial Sequence
  Description of Artificial Sequence: Synthetic peptide
SSKGILA

SEQ ID NO: 33242 - protein, 7 aa, Artificial Sequence
  Description of Artificial Sequence: Synthetic peptide
SVGSGAL

SEQ ID NO: 33243 - protein, 7 aa, Artificial Sequence
  Description of Artificial Sequence: Synthetic peptide
PISSRAG

SEQ ID NO: 33244 - protein, 7 aa, Artificial Sequence
  Description of Artificial Sequence: Synthetic peptide
NPVAAAT

SEQ ID NO: 33245 - protein, 7 aa, Artificial Sequence
  Description of Artificial Sequence: Synthetic peptide
ARLGVTR

SEQ ID NO: 33246 - protein, 7 aa, Artificial Sequence
  Description of Artificial Sequence: Synthetic peptide
SRVTGGT

SEQ ID NO: 33247 - protein, 7 aa, Artificial Sequence
  Description of Artificial Sequence: Synthetic peptide
SCTTRCL

SEQ ID NO: 33248 - protein, 7 aa, Artificial Sequence
  Description of Artificial Sequence: Synthetic peptide
KNIGSHG

SEQ ID NO: 33249 - protein, 7 aa, Artificial Sequence
  Description of Artificial Sequence: Synthetic peptide
AVVTGHR

SEQ ID NO: 33250 - protein, 7 aa, Artificial Sequence
  Description of Artificial Sequence: Synthetic peptide
NGSGTNQ

SEQ ID NO: 33251 - protein, 7 aa, Artificial Sequence
  Description of Artificial Sequence: Synthetic peptide
RNVSHPG

SEQ ID NO: 33252 - protein, 7 aa, Artificial Sequence
  Description of Artificial Sequence: Synthetic peptide
VYSSPSA

SEQ ID NO: 33253 - protein, 7 aa, Artificial Sequence
  Description of Artificial Sequence: Synthetic peptide
KYNSLAC

SEQ ID NO: 33254 - protein, 7 aa, Artificial Sequence
  Description of Artificial Sequence: Synthetic peptide
AKTQSVN

SEQ ID NO: 33255 - protein, 7 aa, Artificial Sequence
  Description of Artificial Sequence: Synthetic peptide
GSNLNST

SEQ ID NO: 33256 - protein, 7 aa, Artificial Sequence
  Description of Artificial Sequence: Synthetic peptide
KISSPFI

SEQ ID NO: 33257 - protein, 7 aa, Artificial Sequence
  Description of Artificial Sequence: Synthetic peptide
KTSLNTS

SEQ ID NO: 33258 - protein, 7 aa, Artificial Sequence
  Description of Artificial Sequence: Synthetic peptide
KHEGYNV

SEQ ID NO: 33259 - protein, 7 aa, Artificial Sequence
  Description of Artificial Sequence: Synthetic peptide
RTSHTPG

SEQ ID NO: 33260 - protein, 7 aa, Artificial Sequence
  Description of Artificial Sequence: Synthetic peptide
NGLSQTH

SEQ ID NO: 33261 - protein, 7 aa, Artificial Sequence
  Description of Artificial Sequence: Synthetic peptide
DRGRPAG

SEQ ID NO: 33262 - protein, 7 aa, Artificial Sequence
  Description of Artificial Sequence: Synthetic peptide
SNTNAAM

SEQ ID NO: 33263 - protein, 7 aa, Artificial Sequence
  Description of Artificial Sequence: Synthetic peptide
QKGNNLP

SEQ ID NO: 33264 - protein, 7 aa, Artificial Sequence
  Description of Artificial Sequence: Synthetic peptide
KDAGDYG

SEQ ID NO: 33265 - protein, 7 aa, Artificial Sequence
  Description of Artificial Sequence: Synthetic peptide
TLDNHRS

SEQ ID NO: 33266 - protein, 7 aa, Artificial Sequence
  Description of Artificial Sequence: Synthetic peptide
STTKDGI

SEQ ID NO: 33267 - protein, 7 aa, Artificial Sequence
  Description of Artificial Sequence: Synthetic peptide
NSGNIVT

SEQ ID NO: 33268 - protein, 7 aa, Artificial Sequence
  Description of Artificial Sequence: Synthetic peptide
SDGQSSV

SEQ ID NO: 33269 - protein, 7 aa, Artificial Sequence
  Description of Artificial Sequence: Synthetic peptide
AFGEIRQ

SEQ ID NO: 33270 - protein, 7 aa, Artificial Sequence
  Description of Artificial Sequence: Synthetic peptide
KSQLVMH

SEQ ID NO: 33271 - protein, 7 aa, Artificial Sequence
  Description of Artificial Sequence: Synthetic peptide
NAEPTSS

SEQ ID NO: 33272 - protein, 7 aa, Artificial Sequence
  Description of Artificial Sequence: Synthetic peptide
PQYGDKE

SEQ ID NO: 33273 - protein, 7 aa, Artificial Sequence
  Description of Artificial Sequence: Synthetic peptide
SIMHLSS

SEQ ID NO: 33274 - protein, 7 aa, Artificial Sequence
  Description of Artificial Sequence: Synthetic peptide
LNKSTLP

SEQ ID NO: 33275 - protein, 7 aa, Artificial Sequence
  Description of Artificial Sequence: Synthetic peptide
MSTSSSR

SEQ ID NO: 33276 - protein, 7 aa, Artificial Sequence
  Description of Artificial Sequence: Synthetic peptide
TVGARNG

SEQ ID NO: 33277 - protein, 7 aa, Artificial Sequence
  Description of Artificial Sequence: Synthetic peptide
GSTKPSP

SEQ ID NO: 33278 - protein, 7 aa, Artificial Sequence
  Description of Artificial Sequence: Synthetic peptide
NGSGQSQ

SEQ ID NO: 33279 - protein, 7 aa, Artificial Sequence
  Description of Artificial Sequence: Synthetic peptide
SSSAPRL

SEQ ID NO: 33280 - protein, 7 aa, Artificial Sequence
  Description of Artificial Sequence: Synthetic peptide
PSTRQSN

SEQ ID NO: 33281 - protein, 7 aa, Artificial Sequence
  Description of Artificial Sequence: Synthetic peptide
PSEVRSS

SEQ ID NO: 33282 - protein, 7 aa, Artificial Sequence
  Description of Artificial Sequence: Synthetic peptide
VSGSKVG

SEQ ID NO: 33283 - protein, 7 aa, Artificial Sequence
  Description of Artificial Sequence: Synthetic peptide
LISSKSS

SEQ ID NO: 33284 - protein, 7 aa, Artificial Sequence
  Description of Artificial Sequence: Synthetic peptide
PIHPSSG

SEQ ID NO: 33285 - protein, 7 aa, Artificial Sequence
  Description of Artificial Sequence: Synthetic peptide
MISGATR

SEQ ID NO: 33286 - protein, 7 aa, Artificial Sequence
  Description of Artificial Sequence: Synthetic peptide
DRGRNTG

SEQ ID NO: 33287 - protein, 7 aa, Artificial Sequence
  Description of Artificial Sequence: Synthetic peptide
GRLEAQK

SEQ ID NO: 33288 - protein, 7 aa, Artificial Sequence
  Description of Artificial Sequence: Synthetic peptide
AGNMPHS

SEQ ID NO: 33289 - protein, 7 aa, Artificial Sequence
  Description of Artificial Sequence: Synthetic peptide
GPIRPIQ

SEQ ID NO: 33290 - protein, 7 aa, Artificial Sequence
  Description of Artificial Sequence: Synthetic peptide
HLGVPLK

SEQ ID NO: 33291 - protein, 7 aa, Artificial Sequence
  Description of Artificial Sequence: Synthetic peptide
VTRGLNV

SEQ ID NO: 33292 - protein, 7 aa, Artificial Sequence
  Description of Artificial Sequence: Synthetic peptide
EILGTHR

SEQ ID NO: 33293 - protein, 7 aa, Artificial Sequence
  Description of Artificial Sequence: Synthetic peptide
RTDHGGV

SEQ ID NO: 33294 - protein, 7 aa, Artificial Sequence
  Description of Artificial Sequence: Synthetic peptide
SISKTQA

SEQ ID NO: 33295 - protein, 7 aa, Artificial Sequence
  Description of Artificial Sequence: Synthetic peptide
DGIKSYA

SEQ ID NO: 33296 - protein, 7 aa, Artificial Sequence
  Description of Artificial Sequence: Synthetic peptide
QVPATNR

SEQ ID NO: 33297 - protein, 7 aa, Artificial Sequence
  Description of Artificial Sequence: Synthetic peptide
AGAGKVY

SEQ ID NO: 33298 - protein, 7 aa, Artificial Sequence
  Description of Artificial Sequence: Synthetic peptide
VSGMSGS

SEQ ID NO: 33299 - protein, 7 aa, Artificial Sequence
  Description of Artificial Sequence: Synthetic peptide
AGSSPPT

SEQ ID NO: 33300 - protein, 7 aa, Artificial Sequence
  Description of Artificial Sequence: Synthetic peptide
PVSGATI

SEQ ID NO: 33301 - protein, 7 aa, Artificial Sequence
  Description of Artificial Sequence: Synthetic peptide
DQNRVPY

SEQ ID NO: 33302 - protein, 7 aa, Artificial Sequence
  Description of Artificial Sequence: Synthetic peptide
TPTGHRS

SEQ ID NO: 33303 - protein, 7 aa, Artificial Sequence
  Description of Artificial Sequence: Synthetic peptide
MGPNHLP

SEQ ID NO: 33304 - protein, 7 aa, Artificial Sequence
  Description of Artificial Sequence: Synthetic peptide
RVITPST

SEQ ID NO: 33305 - protein, 7 aa, Artificial Sequence
  Description of Artificial Sequence: Synthetic peptide
VPSTAGK

SEQ ID NO: 33306 - protein, 7 aa, Artificial Sequence
  Description of Artificial Sequence: Synthetic peptide
LLHHNTG

SEQ ID NO: 33307 - protein, 7 aa, Artificial Sequence
  Description of Artificial Sequence: Synthetic peptide
SIHSDRT

SEQ ID NO: 33308 - protein, 7 aa, Artificial Sequence
  Description of Artificial Sequence: Synthetic peptide
QNVSTMN

SEQ ID NO: 33309 - protein, 7 aa, Artificial Sequence
  Description of Artificial Sequence: Synthetic peptide
NNPKNVV

SEQ ID NO: 33310 - protein, 7 aa, Artificial Sequence
  Description of Artificial Sequence: Synthetic peptide
MTTQLNS

SEQ ID NO: 33311 - protein, 7 aa, Artificial Sequence
  Description of Artificial Sequence: Synthetic peptide
TQQNGSN

SEQ ID NO: 33312 - protein, 7 aa, Artificial Sequence
  Description of Artificial Sequence: Synthetic peptide
GVINNER

SEQ ID NO: 33313 - protein, 7 aa, Artificial Sequence
  Description of Artificial Sequence: Synthetic peptide
FSQGNRS

SEQ ID NO: 33314 - protein, 7 aa, Artificial Sequence
  Description of Artificial Sequence: Synthetic peptide
PGTTSAM

SEQ ID NO: 33315 - protein, 7 aa, Artificial Sequence
  Description of Artificial Sequence: Synthetic peptide
SHVNSTR

SEQ ID NO: 33316 - protein, 7 aa, Artificial Sequence
  Description of Artificial Sequence: Synthetic peptide
PNLQSSK

SEQ ID NO: 33317 - protein, 7 aa, Artificial Sequence
  Description of Artificial Sequence: Synthetic peptide
AGINSQV

SEQ ID NO: 33318 - protein, 7 aa, Artificial Sequence
  Description of Artificial Sequence: Synthetic peptide
YLGKVQV

SEQ ID NO: 33319 - protein, 7 aa, Artificial Sequence
  Description of Artificial Sequence: Synthetic peptide
ATSNGTL

SEQ ID NO: 33320 - protein, 7 aa, Artificial Sequence
  Description of Artificial Sequence: Synthetic peptide
THQSSTS

SEQ ID NO: 33321 - protein, 7 aa, Artificial Sequence
  Description of Artificial Sequence: Synthetic peptide
LGDRSFI

SEQ ID NO: 33322 - protein, 7 aa, Artificial Sequence
  Description of Artificial Sequence: Synthetic peptide
WSLGSQS

SEQ ID NO: 33323 - protein, 7 aa, Artificial Sequence
  Description of Artificial Sequence: Synthetic peptide
SGTTTFG

SEQ ID NO: 33324 - protein, 7 aa, Artificial Sequence
  Description of Artificial Sequence: Synthetic peptide
CTGSSSM

SEQ ID NO: 33325 - protein, 7 aa, Artificial Sequence
  Description of Artificial Sequence: Synthetic peptide
SRDSSIH

SEQ ID NO: 33326 - protein, 7 aa, Artificial Sequence
  Description of Artificial Sequence: Synthetic peptide
TSSTTSL

SEQ ID NO: 33327 - protein, 7 aa, Artificial Sequence
  Description of Artificial Sequence: Synthetic peptide
FPVNAGA

SEQ ID NO: 33328 - protein, 7 aa, Artificial Sequence
  Description of Artificial Sequence: Synthetic peptide
NGITKSS

SEQ ID NO: 33329 - protein, 7 aa, Artificial Sequence
  Description of Artificial Sequence: Synthetic peptide
TPHQRSS

SEQ ID NO: 33330 - protein, 7 aa, Artificial Sequence
  Description of Artificial Sequence: Synthetic peptide
SGASSNS

SEQ ID NO: 33331 - protein, 7 aa, Artificial Sequence
  Description of Artificial Sequence: Synthetic peptide
TTHSSIN

SEQ ID NO: 33332 - protein, 7 aa, Artificial Sequence
  Description of Artificial Sequence: Synthetic peptide
DTAVNYG

SEQ ID NO: 33333 - protein, 7 aa, Artificial Sequence
  Description of Artificial Sequence: Synthetic peptide
SQWQSSS

SEQ ID NO: 33334 - protein, 7 aa, Artificial Sequence
  Description of Artificial Sequence: Synthetic peptide
NGSGQNE

SEQ ID NO: 33335 - protein, 7 aa, Artificial Sequence
  Description of Artificial Sequence: Synthetic peptide
ISSGTHG

SEQ ID NO: 33336 - protein, 7 aa, Artificial Sequence
  Description of Artificial Sequence: Synthetic peptide
PTDRINR

SEQ ID NO: 33337 - protein, 7 aa, Artificial Sequence
  Description of Artificial Sequence: Synthetic peptide
QQVNTTR

SEQ ID NO: 33338 - protein, 7 aa, Artificial Sequence
  Description of Artificial Sequence: Synthetic peptide
SSHKDYL

SEQ ID NO: 33339 - protein, 7 aa, Artificial Sequence
  Description of Artificial Sequence: Synthetic peptide
VNQSGFS

SEQ ID NO: 33340 - protein, 7 aa, Artificial Sequence
  Description of Artificial Sequence: Synthetic peptide
SVAGTSR

SEQ ID NO: 33341 - protein, 7 aa, Artificial Sequence
  Description of Artificial Sequence: Synthetic peptide
VPHNHSL

SEQ ID NO: 33342 - protein, 7 aa, Artificial Sequence
  Description of Artificial Sequence: Synthetic peptide
FQPRSST

SEQ ID NO: 33343 - protein, 7 aa, Artificial Sequence
  Description of Artificial Sequence: Synthetic peptide
VHEAPLR

SEQ ID NO: 33344 - protein, 7 aa, Artificial Sequence
  Description of Artificial Sequence: Synthetic peptide
LISETSR

SEQ ID NO: 33345 - protein, 7 aa, Artificial Sequence
  Description of Artificial Sequence: Synthetic peptide
GFSSQQR

SEQ ID NO: 33346 - protein, 7 aa, Artificial Sequence
  Description of Artificial Sequence: Synthetic peptide
ATNHSPQ

SEQ ID NO: 33347 - protein, 7 aa, Artificial Sequence
  Description of Artificial Sequence: Synthetic peptide
RGDTKNL

SEQ ID NO: 33348 - protein, 7 aa, Artificial Sequence
  Description of Artificial Sequence: Synthetic peptide
RITSSNQ

SEQ ID NO: 33349 - protein, 7 aa, Artificial Sequence
  Description of Artificial Sequence: Synthetic peptide
MESKANS

SEQ ID NO: 33350 - protein, 7 aa, Artificial Sequence
  Description of Artificial Sequence: Synthetic peptide
YNRTSIV

SEQ ID NO: 33351 - protein, 7 aa, Artificial Sequence
  Description of Artificial Sequence: Synthetic peptide
RTNDTTH

SEQ ID NO: 33352 - protein, 7 aa, Artificial Sequence
  Description of Artificial Sequence: Synthetic peptide
GELPDRR

SEQ ID NO: 33353 - protein, 7 aa, Artificial Sequence
  Description of Artificial Sequence: Synthetic peptide
HLMQPVC

SEQ ID NO: 33354 - protein, 7 aa, Artificial Sequence
  Description of Artificial Sequence: Synthetic peptide
CGTPVAL

SEQ ID NO: 33355 - protein, 7 aa, Artificial Sequence
  Description of Artificial Sequence: Synthetic peptide
NSSGQNP

SEQ ID NO: 33356 - protein, 7 aa, Artificial Sequence
  Description of Artificial Sequence: Synthetic peptide
SQNVSSK

SEQ ID NO: 33357 - protein, 7 aa, Artificial Sequence
  Description of Artificial Sequence: Synthetic peptide
GSIKAPP

SEQ ID NO: 33358 - protein, 7 aa, Artificial Sequence
  Description of Artificial Sequence: Synthetic peptide
MSGGNMR

SEQ ID NO: 33359 - protein, 7 aa, Artificial Sequence
  Description of Artificial Sequence: Synthetic peptide
QTSATQR

SEQ ID NO: 33360 - protein, 7 aa, Artificial Sequence
  Description of Artificial Sequence: Synthetic peptide
SGGSSVL

SEQ ID NO: 33361 - protein, 7 aa, Artificial Sequence
  Description of Artificial Sequence: Synthetic peptide
TTSARPN

SEQ ID NO: 33362 - protein, 7 aa, Artificial Sequence
  Description of Artificial Sequence: Synthetic peptide
VQGTGNT

SEQ ID NO: 33363 - protein, 7 aa, Artificial Sequence
  Description of Artificial Sequence: Synthetic peptide
PSTSGAM

SEQ ID NO: 33364 - protein, 7 aa, Artificial Sequence
  Description of Artificial Sequence: Synthetic peptide
YIDASAR

SEQ ID NO: 33365 - protein, 7 aa, Artificial Sequence
  Description of Artificial Sequence: Synthetic peptide
PISHTTG

SEQ ID NO: 33366 - protein, 7 aa, Artificial Sequence
  Description of Artificial Sequence: Synthetic peptide
GSGIKRE

SEQ ID NO: 33367 - protein, 7 aa, Artificial Sequence
  Description of Artificial Sequence: Synthetic peptide
LPGQGVG

SEQ ID NO: 33368 - protein, 7 aa, Artificial Sequence
  Description of Artificial Sequence: Synthetic peptide
VQRSSNQ

SEQ ID NO: 33369 - protein, 7 aa, Artificial Sequence
  Description of Artificial Sequence: Synthetic peptide
SLSSKQM

SEQ ID NO: 33370 - protein, 7 aa, Artificial Sequence
  Description of Artificial Sequence: Synthetic peptide
PQNNQAH

SEQ ID NO: 33371 - protein, 7 aa, Artificial Sequence
  Description of Artificial Sequence: Synthetic peptide
QLRSDQT

SEQ ID NO: 33372 - protein, 7 aa, Artificial Sequence
  Description of Artificial Sequence: Synthetic peptide
SRETVPT

SEQ ID NO: 33373 - protein, 7 aa, Artificial Sequence
  Description of Artificial Sequence: Synthetic peptide
IKPSSSA

SEQ ID NO: 33374 - protein, 7 aa, Artificial Sequence
  Description of Artificial Sequence: Synthetic peptide
PTSQQRP

SEQ ID NO: 33375 - protein, 7 aa, Artificial Sequence
  Description of Artificial Sequence: Synthetic peptide
QNSKGYV

SEQ ID NO: 33376 - protein, 7 aa, Artificial Sequence
  Description of Artificial Sequence: Synthetic peptide
LATANSR

SEQ ID NO: 33377 - protein, 7 aa, Artificial Sequence
  Description of Artificial Sequence: Synthetic peptide
YSDNKTT

SEQ ID NO: 33378 - protein, 7 aa, Artificial Sequence
  Description of Artificial Sequence: Synthetic peptide
VKVTHQQ

SEQ ID NO: 33379 - protein, 7 aa, Artificial Sequence
  Description of Artificial Sequence: Synthetic peptide
LGTSTIL

SEQ ID NO: 33380 - protein, 7 aa, Artificial Sequence
  Description of Artificial Sequence: Synthetic peptide
NTRSSSG

SEQ ID NO: 33381 - protein, 7 aa, Artificial Sequence
  Description of Artificial Sequence: Synthetic peptide
VVLDTNR

SEQ ID NO: 33382 - protein, 7 aa, Artificial Sequence
  Description of Artificial Sequence: Synthetic peptide
GQVKAIG

SEQ ID NO: 33383 - protein, 7 aa, Artificial Sequence
  Description of Artificial Sequence: Synthetic peptide
PVSRATF

SEQ ID NO: 33384 - protein, 7 aa, Artificial Sequence
  Description of Artificial Sequence: Synthetic peptide
QSGNTIQ

SEQ ID NO: 33385 - protein, 7 aa, Artificial Sequence
  Description of Artificial Sequence: Synthetic peptide
APDVRRC

SEQ ID NO: 33386 - protein, 7 aa, Artificial Sequence
  Description of Artificial Sequence: Synthetic peptide
AARPDVT

SEQ ID NO: 33387 - protein, 7 aa, Artificial Sequence
  Description of Artificial Sequence: Synthetic peptide
CPSQHVI

SEQ ID NO: 33388 - protein, 7 aa, Artificial Sequence
  Description of Artificial Sequence: Synthetic peptide
MSDTSTR

SEQ ID NO: 33389 - protein, 7 aa, Artificial Sequence
  Description of Artificial Sequence: Synthetic peptide
GFHGQGS

SEQ ID NO: 33390 - protein, 7 aa, Artificial Sequence
  Description of Artificial Sequence: Synthetic peptide
HQLEAHK

SEQ ID NO: 33391 - protein, 7 aa, Artificial Sequence
  Description of Artificial Sequence: Synthetic peptide
QGQNRTV

SEQ ID NO: 33392 - protein, 7 aa, Artificial Sequence
  Description of Artificial Sequence: Synthetic peptide
SLPNTNG

SEQ ID NO: 33393 - protein, 7 aa, Artificial Sequence
  Description of Artificial Sequence: Synthetic peptide
SANNKSG

SEQ ID NO: 33394 - protein, 7 aa, Artificial Sequence
  Description of Artificial Sequence: Synthetic peptide
VSKSPST

SEQ ID NO: 33395 - protein, 7 aa, Artificial Sequence
  Description of Artificial Sequence: Synthetic peptide
PYNSKAS

SEQ ID NO: 33396 - protein, 7 aa, Artificial Sequence
  Description of Artificial Sequence: Synthetic peptide
SSSGGVK

SEQ ID NO: 33397 - protein, 7 aa, Artificial Sequence
  Description of Artificial Sequence: Synthetic peptide
IGSGQNQ

SEQ ID NO: 33398 - protein, 7 aa, Artificial Sequence
  Description of Artificial Sequence: Synthetic peptide
NGSRQNQ

SEQ ID NO: 33399 - protein, 7 aa, Artificial Sequence
  Description of Artificial Sequence: Synthetic peptide
GMTQGGK

SEQ ID NO: 33400 - protein, 7 aa, Artificial Sequence
  Description of Artificial Sequence: Synthetic peptide
GSPGVLR

SEQ ID NO: 33401 - protein, 7 aa, Artificial Sequence
  Description of Artificial Sequence: Synthetic peptide
GDQHKPL

SEQ ID NO: 33402 - protein, 7 aa, Artificial Sequence
  Description of Artificial Sequence: Synthetic peptide
AGTGSSL

SEQ ID NO: 33403 - protein, 7 aa, Artificial Sequence
  Description of Artificial Sequence: Synthetic peptide
HGSGQNQ

SEQ ID NO: 33404 - protein, 7 aa, Artificial Sequence
  Description of Artificial Sequence: Synthetic peptide
QSDHRSL

SEQ ID NO: 33405 - protein, 7 aa, Artificial Sequence
  Description of Artificial Sequence: Synthetic peptide
NGSGQIQ

SEQ ID NO: 33406 - protein, 7 aa, Artificial Sequence
  Description of Artificial Sequence: Synthetic peptide
PLDKSMM

SEQ ID NO: 33407 - protein, 7 aa, Artificial Sequence
  Description of Artificial Sequence: Synthetic peptide
KRDAHTA

SEQ ID NO: 33408 - protein, 7 aa, Artificial Sequence
  Description of Artificial Sequence: Synthetic peptide
AGRTHSC

SEQ ID NO: 33409 - protein, 7 aa, Artificial Sequence
  Description of Artificial Sequence: Synthetic peptide
CIRAGSC

SEQ ID NO: 33410 - protein, 7 aa, Artificial Sequence
  Description of Artificial Sequence: Synthetic peptide
GTARGVA

SEQ ID NO: 33411 - protein, 7 aa, Artificial Sequence
  Description of Artificial Sequence: Synthetic peptide
NRSGQNQ

SEQ ID NO: 33412 - protein, 7 aa, Artificial Sequence
  Description of Artificial Sequence: Synthetic peptide
RTGNNHE

SEQ ID NO: 33413 - protein, 7 aa, Artificial Sequence
  Description of Artificial Sequence: Synthetic peptide
HTDINHQ

SEQ ID NO: 33414 - protein, 7 aa, Artificial Sequence
  Description of Artificial Sequence: Synthetic peptide
RTVNSAN

SEQ ID NO: 33415 - protein, 7 aa, Artificial Sequence
  Description of Artificial Sequence: Synthetic peptide
RTTNATY

SEQ ID NO: 33416 - protein, 7 aa, Artificial Sequence
  Description of Artificial Sequence: Synthetic peptide
NPVNTKS

SEQ ID NO: 33417 - protein, 7 aa, Artificial Sequence
  Description of Artificial Sequence: Synthetic peptide
ALAGTKG

SEQ ID NO: 33418 - protein, 7 aa, Artificial Sequence
  Description of Artificial Sequence: Synthetic peptide
PVLNKAT

SEQ ID NO: 33419 - protein, 7 aa, Artificial Sequence
  Description of Artificial Sequence: Synthetic peptide
HQERASM

SEQ ID NO: 33420 - protein, 7 aa, Artificial Sequence
  Description of Artificial Sequence: Synthetic peptide
SQQSPSM

SEQ ID NO: 33421 - protein, 7 aa, Artificial Sequence
  Description of Artificial Sequence: Synthetic peptide
PHGDKTS

SEQ ID NO: 33422 - protein, 7 aa, Artificial Sequence
  Description of Artificial Sequence: Synthetic peptide
LSLNKSQ

SEQ ID NO: 33423 - protein, 7 aa, Artificial Sequence
  Description of Artificial Sequence: Synthetic peptide
PSNRQIA

SEQ ID NO: 33424 - protein, 7 aa, Artificial Sequence
  Description of Artificial Sequence: Synthetic peptide
VHTSGVQ

SEQ ID NO: 33425 - protein, 7 aa, Artificial Sequence
  Description of Artificial Sequence: Synthetic peptide
HKTAGSA

SEQ ID NO: 33426 - protein, 7 aa, Artificial Sequence
  Description of Artificial Sequence: Synthetic peptide
PRLNVGG

SEQ ID NO: 33427 - protein, 7 aa, Artificial Sequence
  Description of Artificial Sequence: Synthetic peptide
TGMRNIG

SEQ ID NO: 33428 - protein, 7 aa, Artificial Sequence
  Description of Artificial Sequence: Synthetic peptide
CPSTKSC

SEQ ID NO: 33429 - protein, 7 aa, Artificial Sequence
  Description of Artificial Sequence: Synthetic peptide
YSGSAGQ

SEQ ID NO: 33430 - protein, 7 aa, Artificial Sequence
  Description of Artificial Sequence: Synthetic peptide
RTLRSVD

SEQ ID NO: 33431 - protein, 7 aa, Artificial Sequence
  Description of Artificial Sequence: Synthetic peptide
RGYGTSV

SEQ ID NO: 33432 - protein, 7 aa, Artificial Sequence
  Description of Artificial Sequence: Synthetic peptide
FSSASFT

SEQ ID NO: 33433 - protein, 7 aa, Artificial Sequence
  Description of Artificial Sequence: Synthetic peptide
MDHSTRS

SEQ ID NO: 33434 - protein, 7 aa, Artificial Sequence
  Description of Artificial Sequence: Synthetic peptide
GYTDKHV

SEQ ID NO: 33435 - protein, 7 aa, Artificial Sequence
  Description of Artificial Sequence: Synthetic peptide
PHLPQSA

SEQ ID NO: 33436 - protein, 7 aa, Artificial Sequence
  Description of Artificial Sequence: Synthetic peptide
CPGSSAY

SEQ ID NO: 33437 - protein, 7 aa, Artificial Sequence
  Description of Artificial Sequence: Synthetic peptide
EPPHKIL

SEQ ID NO: 33438 - protein, 7 aa, Artificial Sequence
  Description of Artificial Sequence: Synthetic peptide
SSQEVLR

SEQ ID NO: 33439 - protein, 7 aa, Artificial Sequence
  Description of Artificial Sequence: Synthetic peptide
NTDTSAV

SEQ ID NO: 33440 - protein, 7 aa, Artificial Sequence
  Description of Artificial Sequence: Synthetic peptide
DSTHRAT

SEQ ID NO: 33441 - protein, 7 aa, Artificial Sequence
  Description of Artificial Sequence: Synthetic peptide
PLERTTK

SEQ ID NO: 33442 - protein, 7 aa, Artificial Sequence
  Description of Artificial Sequence: Synthetic peptide
RQSTNIG

SEQ ID NO: 33443 - protein, 7 aa, Artificial Sequence
  Description of Artificial Sequence: Synthetic peptide
GDSKSTW

SEQ ID NO: 33444 - protein, 7 aa, Artificial Sequence
  Description of Artificial Sequence: Synthetic peptide
GSQIPRI

SEQ ID NO: 33445 - protein, 7 aa, Artificial Sequence
  Description of Artificial Sequence: Synthetic peptide
HERGQNG

SEQ ID NO: 33446 - protein, 7 aa, Artificial Sequence
  Description of Artificial Sequence: Synthetic peptide
REPARGD

SEQ ID NO: 33447 - protein, 7 aa, Artificial Sequence
  Description of Artificial Sequence: Synthetic peptide
VSTQAIS

SEQ ID NO: 33448 - protein, 7 aa, Artificial Sequence
  Description of Artificial Sequence: Synthetic peptide
NNAHSSS

SEQ ID NO: 33449 - protein, 7 aa, Artificial Sequence
  Description of Artificial Sequence: Synthetic peptide
YNQPVGK

SEQ ID NO: 33450 - protein, 7 aa, Artificial Sequence
  Description of Artificial Sequence: Synthetic peptide
APHSAAN

SEQ ID NO: 33451 - protein, 7 aa, Artificial Sequence
  Description of Artificial Sequence: Synthetic peptide
SRTHPVM

SEQ ID NO: 33452 - protein, 7 aa, Artificial Sequence
  Description of Artificial Sequence: Synthetic peptide
DMVSPRN

SEQ ID NO: 33453 - protein, 7 aa, Artificial Sequence
  Description of Artificial Sequence: Synthetic peptide
DPRAQSH

SEQ ID NO: 33454 - protein, 7 aa, Artificial Sequence
  Description of Artificial Sequence: Synthetic peptide
NAQGTAK

SEQ ID NO: 33455 - protein, 7 aa, Artificial Sequence
  Description of Artificial Sequence: Synthetic peptide
TTNNIQG

SEQ ID NO: 33456 - protein, 7 aa, Artificial Sequence
  Description of Artificial Sequence: Synthetic peptide
IRTKESA

SEQ ID NO: 33457 - protein, 7 aa, Artificial Sequence
  Description of Artificial Sequence: Synthetic peptide
NVSTGAT

SEQ ID NO: 33458 - protein, 7 aa, Artificial Sequence
  Description of Artificial Sequence: Synthetic peptide
RIDSAKG

SEQ ID NO: 33459 - protein, 7 aa, Artificial Sequence
  Description of Artificial Sequence: Synthetic peptide
AYPTTGS

SEQ ID NO: 33460 - protein, 7 aa, Artificial Sequence
  Description of Artificial Sequence: Synthetic peptide
RHESKAY

SEQ ID NO: 33461 - protein, 7 aa, Artificial Sequence
  Description of Artificial Sequence: Synthetic peptide
AQVDKRS

SEQ ID NO: 33462 - protein, 7 aa, Artificial Sequence
  Description of Artificial Sequence: Synthetic peptide
GIQSSPT

SEQ ID NO: 33463 - protein, 7 aa, Artificial Sequence
  Description of Artificial Sequence: Synthetic peptide
YQNKSLT

SEQ ID NO: 33464 - protein, 7 aa, Artificial Sequence
  Description of Artificial Sequence: Synthetic peptide
RVLTSNA

SEQ ID NO: 33465 - protein, 7 aa, Artificial Sequence
  Description of Artificial Sequence: Synthetic peptide
TPHDGQR

SEQ ID NO: 33466 - protein, 7 aa, Artificial Sequence
  Description of Artificial Sequence: Synthetic peptide
PVVGKMS

SEQ ID NO: 33467 - protein, 7 aa, Artificial Sequence
  Description of Artificial Sequence: Synthetic peptide
LGSNRYS

SEQ ID NO: 33468 - protein, 7 aa, Artificial Sequence
  Description of Artificial Sequence: Synthetic peptide
EMKGHTA

SEQ ID NO: 33469 - protein, 7 aa, Artificial Sequence
  Description of Artificial Sequence: Synthetic peptide
FGSSTIL

SEQ ID NO: 33470 - protein, 7 aa, Artificial Sequence
  Description of Artificial Sequence: Synthetic peptide
LTTGQSV

SEQ ID NO: 33471 - protein, 7 aa, Artificial Sequence
  Description of Artificial Sequence: Synthetic peptide
ASRDRAG

SEQ ID NO: 33472 - protein, 7 aa, Artificial Sequence
  Description of Artificial Sequence: Synthetic peptide
ASDQAHC

SEQ ID NO: 33473 - protein, 7 aa, Artificial Sequence
  Description of Artificial Sequence: Synthetic peptide
PGNMTSR

SEQ ID NO: 33474 - protein, 7 aa, Artificial Sequence
  Description of Artificial Sequence: Synthetic peptide
PANSPAT

SEQ ID NO: 33475 - protein, 7 aa, Artificial Sequence
  Description of Artificial Sequence: Synthetic peptide
FHANSTV

SEQ ID NO: 33476 - protein, 7 aa, Artificial Sequence
  Description of Artificial Sequence: Synthetic peptide
SVSTNFS

SEQ ID NO: 33477 - protein, 7 aa, Artificial Sequence
  Description of Artificial Sequence: Synthetic peptide
PVSRGSG

SEQ ID NO: 33478 - protein, 7 aa, Artificial Sequence
  Description of Artificial Sequence: Synthetic peptide
NCSGQNQ

SEQ ID NO: 33479 - protein, 7 aa, Artificial Sequence
  Description of Artificial Sequence: Synthetic peptide
YSMRPTE

SEQ ID NO: 33480 - protein, 7 aa, Artificial Sequence
  Description of Artificial Sequence: Synthetic peptide
HGSSVHS

SEQ ID NO: 33481 - protein, 7 aa, Artificial Sequence
  Description of Artificial Sequence: Synthetic peptide
SQSNSFL

SEQ ID NO: 33482 - protein, 7 aa, Artificial Sequence
  Description of Artificial Sequence: Synthetic peptide
AGSQTGV

SEQ ID NO: 33483 - protein, 7 aa, Artificial Sequence
  Description of Artificial Sequence: Synthetic peptide
PTLGTTK

SEQ ID NO: 33484 - protein, 7 aa, Artificial Sequence
  Description of Artificial Sequence: Synthetic peptide
RTSTSLL

SEQ ID NO: 33485 - protein, 7 aa, Artificial Sequence
  Description of Artificial Sequence: Synthetic peptide
NLGIPKG

SEQ ID NO: 33486 - protein, 7 aa, Artificial Sequence
  Description of Artificial Sequence: Synthetic peptide
RMGVSNT

SEQ ID NO: 33487 - protein, 7 aa, Artificial Sequence
  Description of Artificial Sequence: Synthetic peptide
MGIANIG

SEQ ID NO: 33488 - protein, 7 aa, Artificial Sequence
  Description of Artificial Sequence: Synthetic peptide
ALAYNKG

SEQ ID NO: 33489 - protein, 7 aa, Artificial Sequence
  Description of Artificial Sequence: Synthetic peptide
SEHQPLS

SEQ ID NO: 33490 - protein, 7 aa, Artificial Sequence
  Description of Artificial Sequence: Synthetic peptide
VNENRVS

SEQ ID NO: 33491 - protein, 7 aa, Artificial Sequence
  Description of Artificial Sequence: Synthetic peptide
FSTHEVS

SEQ ID NO: 33492 - protein, 7 aa, Artificial Sequence
  Description of Artificial Sequence: Synthetic peptide
DTHVSGR

SEQ ID NO: 33493 - protein, 7 aa, Artificial Sequence
  Description of Artificial Sequence: Synthetic peptide
TSNTPSI

SEQ ID NO: 33494 - protein, 7 aa, Artificial Sequence
  Description of Artificial Sequence: Synthetic peptide
PARDSKS

SEQ ID NO: 33495 - protein, 7 aa, Artificial Sequence
  Description of Artificial Sequence: Synthetic peptide
GLHPPRT

SEQ ID NO: 33496 - protein, 7 aa, Artificial Sequence
  Description of Artificial Sequence: Synthetic peptide
DTNKTSY

SEQ ID NO: 33497 - protein, 7 aa, Artificial Sequence
  Description of Artificial Sequence: Synthetic peptide
SNTHSPS

SEQ ID NO: 33498 - protein, 7 aa, Artificial Sequence
  Description of Artificial Sequence: Synthetic peptide
YLTSTSN

SEQ ID NO: 33499 - protein, 7 aa, Artificial Sequence
  Description of Artificial Sequence: Synthetic peptide
YKPGLQS

SEQ ID NO: 33500 - protein, 7 aa, Artificial Sequence
  Description of Artificial Sequence: Synthetic peptide
FPNVNSA

SEQ ID NO: 33501 - protein, 7 aa, Artificial Sequence
  Description of Artificial Sequence: Synthetic peptide
PGIGTPF

SEQ ID NO: 33502 - protein, 7 aa, Artificial Sequence
  Description of Artificial Sequence: Synthetic peptide
MIRDGSS

SEQ ID NO: 33503 - protein, 7 aa, Artificial Sequence
  Description of Artificial Sequence: Synthetic peptide
WGRSSMD

SEQ ID NO: 33504 - protein, 7 aa, Artificial Sequence
  Description of Artificial Sequence: Synthetic peptide
INTGSVK

SEQ ID NO: 33505 - protein, 7 aa, Artificial Sequence
  Description of Artificial Sequence: Synthetic peptide
PGQKQGI

SEQ ID NO: 33506 - protein, 7 aa, Artificial Sequence
  Description of Artificial Sequence: Synthetic peptide
ITSGSTR

SEQ ID NO: 33507 - protein, 7 aa, Artificial Sequence
  Description of Artificial Sequence: Synthetic peptide
TPVIGQG

SEQ ID NO: 33508 - protein, 7 aa, Artificial Sequence
  Description of Artificial Sequence: Synthetic peptide
PTHSSRD

SEQ ID NO: 33509 - protein, 7 aa, Artificial Sequence
  Description of Artificial Sequence: Synthetic peptide
PFSEMQK

SEQ ID NO: 33510 - protein, 7 aa, Artificial Sequence
  Description of Artificial Sequence: Synthetic peptide
LKSVSGQ

SEQ ID NO: 33511 - protein, 7 aa, Artificial Sequence
  Description of Artificial Sequence: Synthetic peptide
SPEKNMR

SEQ ID NO: 33512 - protein, 7 aa, Artificial Sequence
  Description of Artificial Sequence: Synthetic peptide
SNFRSLG

SEQ ID NO: 33513 - protein, 7 aa, Artificial Sequence
  Description of Artificial Sequence: Synthetic peptide
PLSHSNM

SEQ ID NO: 33514 - protein, 7 aa, Artificial Sequence
  Description of Artificial Sequence: Synthetic peptide
NGNISIG

SEQ ID NO: 33515 - protein, 7 aa, Artificial Sequence
  Description of Artificial Sequence: Synthetic peptide
WSGVSIN

SEQ ID NO: 33516 - protein, 7 aa, Artificial Sequence
  Description of Artificial Sequence: Synthetic peptide
NAPNSSG

SEQ ID NO: 33517 - protein, 7 aa, Artificial Sequence
  Description of Artificial Sequence: Synthetic peptide
TLPRTSG

SEQ ID NO: 33518 - protein, 7 aa, Artificial Sequence
  Description of Artificial Sequence: Synthetic peptide
DLTNHTK

SEQ ID NO: 33519 - protein, 7 aa, Artificial Sequence
  Description of Artificial Sequence: Synthetic peptide
TSNTKSV

SEQ ID NO: 33520 - protein, 7 aa, Artificial Sequence
  Description of Artificial Sequence: Synthetic peptide
SLYPSKG

SEQ ID NO: 33521 - protein, 7 aa, Artificial Sequence
  Description of Artificial Sequence: Synthetic peptide
TSQTKIV

SEQ ID NO: 33522 - protein, 7 aa, Artificial Sequence
  Description of Artificial Sequence: Synthetic peptide
TTHNIKG

SEQ ID NO: 33523 - protein, 7 aa, Artificial Sequence
  Description of Artificial Sequence: Synthetic peptide
PLQATGK

SEQ ID NO: 33524 - protein, 7 aa, Artificial Sequence
  Description of Artificial Sequence: Synthetic peptide
GASENMR

SEQ ID NO: 33525 - protein, 7 aa, Artificial Sequence
  Description of Artificial Sequence: Synthetic peptide
NSTSTSQ

SEQ ID NO: 33526 - protein, 7 aa, Artificial Sequence
  Description of Artificial Sequence: Synthetic peptide
VQPRTST

SEQ ID NO: 33527 - protein, 7 aa, Artificial Sequence
  Description of Artificial Sequence: Synthetic peptide
TTQTPYK

SEQ ID NO: 33528 - protein, 7 aa, Artificial Sequence
  Description of Artificial Sequence: Synthetic peptide
PQTNNPD

SEQ ID NO: 33529 - protein, 7 aa, Artificial Sequence
  Description of Artificial Sequence: Synthetic peptide
HGESRQA

SEQ ID NO: 33530 - protein, 7 aa, Artificial Sequence
  Description of Artificial Sequence: Synthetic peptide
NAMNTRG

SEQ ID NO: 33531 - protein, 7 aa, Artificial Sequence
  Description of Artificial Sequence: Synthetic peptide
SQSSPVA

SEQ ID NO: 33532 - protein, 7 aa, Artificial Sequence
  Description of Artificial Sequence: Synthetic peptide
NGYGQNQ

SEQ ID NO: 33533 - protein, 7 aa, Artificial Sequence
  Description of Artificial Sequence: Synthetic peptide
GNRSSGL

SEQ ID NO: 33534 - protein, 7 aa, Artificial Sequence
  Description of Artificial Sequence: Synthetic peptide
DKTNLSS

SEQ ID NO: 33535 - protein, 7 aa, Artificial Sequence
  Description of Artificial Sequence: Synthetic peptide
SSQEVFR

SEQ ID NO: 33536 - protein, 7 aa, Artificial Sequence
  Description of Artificial Sequence: Synthetic peptide
DREATSR

SEQ ID NO: 33537 - protein, 7 aa, Artificial Sequence
  Description of Artificial Sequence: Synthetic peptide
LPTDSLR

SEQ ID NO: 33538 - protein, 7 aa, Artificial Sequence
  Description of Artificial Sequence: Synthetic peptide
TRDSSLH

SEQ ID NO: 33539 - protein, 7 aa, Artificial Sequence
  Description of Artificial Sequence: Synthetic peptide
NQSSSAR

SEQ ID NO: 33540 - protein, 7 aa, Artificial Sequence
  Description of Artificial Sequence: Synthetic peptide
SNDNSLR

SEQ ID NO: 33541 - protein, 7 aa, Artificial Sequence
  Description of Artificial Sequence: Synthetic peptide
APSAGNS

SEQ ID NO: 33542 - protein, 7 aa, Artificial Sequence
  Description of Artificial Sequence: Synthetic peptide
NSHLALK

SEQ ID NO: 33543 - protein, 7 aa, Artificial Sequence
  Description of Artificial Sequence: Synthetic peptide
LVSSKSS

SEQ ID NO: 33544 - protein, 7 aa, Artificial Sequence
  Description of Artificial Sequence: Synthetic peptide
DQKTVNR

SEQ ID NO: 33545 - protein, 7 aa, Artificial Sequence
  Description of Artificial Sequence: Synthetic peptide
QAVARQA

SEQ ID NO: 33546 - protein, 7 aa, Artificial Sequence
  Description of Artificial Sequence: Synthetic peptide
PRETHKQ

SEQ ID NO: 33547 - protein, 7 aa, Artificial Sequence
  Description of Artificial Sequence: Synthetic peptide
SDQVRSA

SEQ ID NO: 33548 - protein, 7 aa, Artificial Sequence
  Description of Artificial Sequence: Synthetic peptide
SNNKANV

SEQ ID NO: 33549 - protein, 7 aa, Artificial Sequence
  Description of Artificial Sequence: Synthetic peptide
SSTKSSL

SEQ ID NO: 33550 - protein, 7 aa, Artificial Sequence
  Description of Artificial Sequence: Synthetic peptide
VNTSHTN

SEQ ID NO: 33551 - protein, 7 aa, Artificial Sequence
  Description of Artificial Sequence: Synthetic peptide
TTIPKRQ

SEQ ID NO: 33552 - protein, 7 aa, Artificial Sequence
  Description of Artificial Sequence: Synthetic peptide
HVQDGRT

SEQ ID NO: 33553 - protein, 7 aa, Artificial Sequence
  Description of Artificial Sequence: Synthetic peptide
LDFKTLP

SEQ ID NO: 33554 - protein, 7 aa, Artificial Sequence
  Description of Artificial Sequence: Synthetic peptide
SSLGHND

SEQ ID NO: 33555 - protein, 7 aa, Artificial Sequence
  Description of Artificial Sequence: Synthetic peptide
FNTSKLS

SEQ ID NO: 33556 - protein, 7 aa, Artificial Sequence
  Description of Artificial Sequence: Synthetic peptide
GSAQSPR

SEQ ID NO: 33557 - protein, 7 aa, Artificial Sequence
  Description of Artificial Sequence: Synthetic peptide
VQPSGRP

SEQ ID NO: 33558 - protein, 7 aa, Artificial Sequence
  Description of Artificial Sequence: Synthetic peptide
NGSGQYQ

SEQ ID NO: 33559 - protein, 7 aa, Artificial Sequence
  Description of Artificial Sequence: Synthetic peptide
GYSNQMT

SEQ ID NO: 33560 - protein, 7 aa, Artificial Sequence
  Description of Artificial Sequence: Synthetic peptide
KTSETRS

SEQ ID NO: 33561 - protein, 7 aa, Artificial Sequence
  Description of Artificial Sequence: Synthetic peptide
PTTRMVN

SEQ ID NO: 33562 - protein, 7 aa, Artificial Sequence
  Description of Artificial Sequence: Synthetic peptide
SPARASL

SEQ ID NO: 33563 - protein, 7 aa, Artificial Sequence
  Description of Artificial Sequence: Synthetic peptide
TSRTSYE

SEQ ID NO: 33564 - protein, 7 aa, Artificial Sequence
  Description of Artificial Sequence: Synthetic peptide
SSPSRSS

SEQ ID NO: 33565 - protein, 7 aa, Artificial Sequence
  Description of Artificial Sequence: Synthetic peptide
SVNSHHG

SEQ ID NO: 33566 - protein, 7 aa, Artificial Sequence
  Description of Artificial Sequence: Synthetic peptide
LDKRSVE

SEQ ID NO: 33567 - protein, 7 aa, Artificial Sequence
  Description of Artificial Sequence: Synthetic peptide
HITSNHA

SEQ ID NO: 33568 - protein, 7 aa, Artificial Sequence
  Description of Artificial Sequence: Synthetic peptide
SITDRHS

SEQ ID NO: 33569 - protein, 7 aa, Artificial Sequence
  Description of Artificial Sequence: Synthetic peptide
SGVTTRG

SEQ ID NO: 33570 - protein, 7 aa, Artificial Sequence
  Description of Artificial Sequence: Synthetic peptide
HARASTA

SEQ ID NO: 33571 - protein, 7 aa, Artificial Sequence
  Description of Artificial Sequence: Synthetic peptide
LNGTPQS

SEQ ID NO: 33572 - protein, 7 aa, Artificial Sequence
  Description of Artificial Sequence: Synthetic peptide
GMSSPHI

SEQ ID NO: 33573 - protein, 7 aa, Artificial Sequence
  Description of Artificial Sequence: Synthetic peptide
TSMNGNK

SEQ ID NO: 33574 - protein, 7 aa, Artificial Sequence
  Description of Artificial Sequence: Synthetic peptide
SRVEINR

SEQ ID NO: 33575 - protein, 7 aa, Artificial Sequence
  Description of Artificial Sequence: Synthetic peptide
LQKPSLV

SEQ ID NO: 33576 - protein, 7 aa, Artificial Sequence
  Description of Artificial Sequence: Synthetic peptide
GGHKSLN

SEQ ID NO: 33577 - protein, 7 aa, Artificial Sequence
  Description of Artificial Sequence: Synthetic peptide
AESGGSR

SEQ ID NO: 33578 - protein, 7 aa, Artificial Sequence
  Description of Artificial Sequence: Synthetic peptide
DGGNQRS

SEQ ID NO: 33579 - protein, 7 aa, Artificial Sequence
  Description of Artificial Sequence: Synthetic peptide
YGSGQNQ

SEQ ID NO: 33580 - protein, 7 aa, Artificial Sequence
  Description of Artificial Sequence: Synthetic peptide
VGSDSST

SEQ ID NO: 33581 - protein, 7 aa, Artificial Sequence
  Description of Artificial Sequence: Synthetic peptide
HMTHTTA

SEQ ID NO: 33582 - protein, 7 aa, Artificial Sequence
  Description of Artificial Sequence: Synthetic peptide
DNISRSR

SEQ ID NO: 33583 - protein, 7 aa, Artificial Sequence
  Description of Artificial Sequence: Synthetic peptide
MGTHSIG

SEQ ID NO: 33584 - protein, 7 aa, Artificial Sequence
  Description of Artificial Sequence: Synthetic peptide
GQIKNLG

SEQ ID NO: 33585 - protein, 7 aa, Artificial Sequence
  Description of Artificial Sequence: Synthetic peptide
NLASSSY

SEQ ID NO: 33586 - protein, 7 aa, Artificial Sequence
  Description of Artificial Sequence: Synthetic peptide
GSAGNML

SEQ ID NO: 33587 - protein, 7 aa, Artificial Sequence
  Description of Artificial Sequence: Synthetic peptide
LLTSPNS

SEQ ID NO: 33588 - protein, 7 aa, Artificial Sequence
  Description of Artificial Sequence: Synthetic peptide
RPASTHT

SEQ ID NO: 33589 - protein, 7 aa, Artificial Sequence
  Description of Artificial Sequence: Synthetic peptide
SSSDKLR

SEQ ID NO: 33590 - protein, 7 aa, Artificial Sequence
  Description of Artificial Sequence: Synthetic peptide
DGLRNSL

SEQ ID NO: 33591 - protein, 7 aa, Artificial Sequence
  Description of Artificial Sequence: Synthetic peptide
DVLSKSQ

SEQ ID NO: 33592 - protein, 7 aa, Artificial Sequence
  Description of Artificial Sequence: Synthetic peptide
VPSQNRA

SEQ ID NO: 33593 - protein, 7 aa, Artificial Sequence
  Description of Artificial Sequence: Synthetic peptide
VGSQTNS

SEQ ID NO: 33594 - protein, 7 aa, Artificial Sequence
  Description of Artificial Sequence: Synthetic peptide
SPHKQAN

SEQ ID NO: 33595 - protein, 7 aa, Artificial Sequence
  Description of Artificial Sequence: Synthetic peptide
VSVDKRP

SEQ ID NO: 33596 - protein, 7 aa, Artificial Sequence
  Description of Artificial Sequence: Synthetic peptide
SRVTVSQ

SEQ ID NO: 33597 - protein, 7 aa, Artificial Sequence
  Description of Artificial Sequence: Synthetic peptide
ARGASTN

SEQ ID NO: 33598 - protein, 7 aa, Artificial Sequence
  Description of Artificial Sequence: Synthetic peptide
HVTKSTA

SEQ ID NO: 33599 - protein, 7 aa, Artificial Sequence
  Description of Artificial Sequence: Synthetic peptide
VQQSKAY

SEQ ID NO: 33600 - protein, 7 aa, Artificial Sequence
  Description of Artificial Sequence: Synthetic peptide
ANATPHH

SEQ ID NO: 33601 - protein, 7 aa, Artificial Sequence
  Description of Artificial Sequence: Synthetic peptide
NGSGQKQ

SEQ ID NO: 33602 - protein, 7 aa, Artificial Sequence
  Description of Artificial Sequence: Synthetic peptide
YNSTTAT

SEQ ID NO: 33603 - protein, 7 aa, Artificial Sequence
  Description of Artificial Sequence: Synthetic peptide
NRHERVI

SEQ ID NO: 33604 - protein, 7 aa, Artificial Sequence
  Description of Artificial Sequence: Synthetic peptide
RPAGQHS

SEQ ID NO: 33605 - protein, 7 aa, Artificial Sequence
  Description of Artificial Sequence: Synthetic peptide
SAQKNLI

SEQ ID NO: 33606 - protein, 7 aa, Artificial Sequence
  Description of Artificial Sequence: Synthetic peptide
VMDVQHR

SEQ ID NO: 33607 - protein, 7 aa, Artificial Sequence
  Description of Artificial Sequence: Synthetic peptide
NRSNNSV

SEQ ID NO: 33608 - protein, 7 aa, Artificial Sequence
  Description of Artificial Sequence: Synthetic peptide
REVDGIR

SEQ ID NO: 33609 - protein, 7 aa, Artificial Sequence
  Description of Artificial Sequence: Synthetic peptide
GTTSSRD

SEQ ID NO: 33610 - protein, 7 aa, Artificial Sequence
  Description of Artificial Sequence: Synthetic peptide
RYSRDNV

SEQ ID NO: 33611 - protein, 7 aa, Artificial Sequence
  Description of Artificial Sequence: Synthetic peptide
PKLAADL

SEQ ID NO: 33612 - protein, 7 aa, Artificial Sequence
  Description of Artificial Sequence: Synthetic peptide
TTASSPT

SEQ ID NO: 33613 - protein, 7 aa, Artificial Sequence
  Description of Artificial Sequence: Synthetic peptide
GGTNNLN

SEQ ID NO: 33614 - protein, 7 aa, Artificial Sequence
  Description of Artificial Sequence: Synthetic peptide
TNVDKPF

SEQ ID NO: 33615 - protein, 7 aa, Artificial Sequence
  Description of Artificial Sequence: Synthetic peptide
PPLDQVY

SEQ ID NO: 33616 - protein, 7 aa, Artificial Sequence
  Description of Artificial Sequence: Synthetic peptide
VVNALRG

SEQ ID NO: 33617 - protein, 7 aa, Artificial Sequence
  Description of Artificial Sequence: Synthetic peptide
YFTDDTR

SEQ ID NO: 33618 - protein, 7 aa, Artificial Sequence
  Description of Artificial Sequence: Synthetic peptide
RQTDKLS

SEQ ID NO: 33619 - protein, 7 aa, Artificial Sequence
  Description of Artificial Sequence: Synthetic peptide
WNKTSPQ

SEQ ID NO: 33620 - protein, 7 aa, Artificial Sequence
  Description of Artificial Sequence: Synthetic peptide
SADTRPV

SEQ ID NO: 33621 - protein, 7 aa, Artificial Sequence
  Description of Artificial Sequence: Synthetic peptide
PSSGHSR

SEQ ID NO: 33622 - protein, 7 aa, Artificial Sequence
  Description of Artificial Sequence: Synthetic peptide
NRESPQR

SEQ ID NO: 33623 - protein, 7 aa, Artificial Sequence
  Description of Artificial Sequence: Synthetic peptide
STGSVSK

SEQ ID NO: 33624 - protein, 7 aa, Artificial Sequence
  Description of Artificial Sequence: Synthetic peptide
SPASLPK

SEQ ID NO: 33625 - protein, 7 aa, Artificial Sequence
  Description of Artificial Sequence: Synthetic peptide
KLGQDVR

SEQ ID NO: 33626 - protein, 7 aa, Artificial Sequence
  Description of Artificial Sequence: Synthetic peptide
FGESTMR

SEQ ID NO: 33627 - protein, 7 aa, Artificial Sequence
  Description of Artificial Sequence: Synthetic peptide
RDTRESQ

SEQ ID NO: 33628 - protein, 7 aa, Artificial Sequence
  Description of Artificial Sequence: Synthetic peptide
NNPNRDQ

SEQ ID NO: 33629 - protein, 7 aa, Artificial Sequence
  Description of Artificial Sequence: Synthetic peptide
QSSSQQR

SEQ ID NO: 33630 - protein, 7 aa, Artificial Sequence
  Description of Artificial Sequence: Synthetic peptide
GSLDNRK

SEQ ID NO: 33631 - protein, 7 aa, Artificial Sequence
  Description of Artificial Sequence: Synthetic peptide
PGSGSNH

SEQ ID NO: 33632 - protein, 7 aa, Artificial Sequence
  Description of Artificial Sequence: Synthetic peptide
DLDTKAL

SEQ ID NO: 33633 - protein, 7 aa, Artificial Sequence
  Description of Artificial Sequence: Synthetic peptide
QPTRSTA

SEQ ID NO: 33634 - protein, 7 aa, Artificial Sequence
  Description of Artificial Sequence: Synthetic peptide
PSNTGTI

SEQ ID NO: 33635 - protein, 7 aa, Artificial Sequence
  Description of Artificial Sequence: Synthetic peptide
ATSTNGI

SEQ ID NO: 33636 - protein, 7 aa, Artificial Sequence
  Description of Artificial Sequence: Synthetic peptide
EGSGRLT

SEQ ID NO: 33637 - protein, 7 aa, Artificial Sequence
  Description of Artificial Sequence: Synthetic peptide
TQMGKSN

SEQ ID NO: 33638 - protein, 7 aa, Artificial Sequence
  Description of Artificial Sequence: Synthetic peptide
YNKNAQL

SEQ ID NO: 33639 - protein, 7 aa, Artificial Sequence
  Description of Artificial Sequence: Synthetic peptide
TGNKGGV

SEQ ID NO: 33640 - protein, 7 aa, Artificial Sequence
  Description of Artificial Sequence: Synthetic peptide
PPHDGQR

SEQ ID NO: 33641 - protein, 7 aa, Artificial Sequence
  Description of Artificial Sequence: Synthetic peptide
NNVGVRG

SEQ ID NO: 33642 - protein, 7 aa, Artificial Sequence
  Description of Artificial Sequence: Synthetic peptide
REKQHNG

SEQ ID NO: 33643 - protein, 7 aa, Artificial Sequence
  Description of Artificial Sequence: Synthetic peptide
QVPASHG

SEQ ID NO: 33644 - protein, 7 aa, Artificial Sequence
  Description of Artificial Sequence: Synthetic peptide
HPETAFK

SEQ ID NO: 33645 - protein, 7 aa, Artificial Sequence
  Description of Artificial Sequence: Synthetic peptide
LNQHSSI

SEQ ID NO: 33646 - protein, 7 aa, Artificial Sequence
  Description of Artificial Sequence: Synthetic peptide
RTVDSSD

SEQ ID NO: 33647 - protein, 7 aa, Artificial Sequence
  Description of Artificial Sequence: Synthetic peptide
RTRNTPT

SEQ ID NO: 33648 - protein, 7 aa, Artificial Sequence
  Description of Artificial Sequence: Synthetic peptide
FRTQSVG

SEQ ID NO: 33649 - protein, 7 aa, Artificial Sequence
  Description of Artificial Sequence: Synthetic peptide
PTGAHVT

SEQ ID NO: 33650 - protein, 7 aa, Artificial Sequence
  Description of Artificial Sequence: Synthetic peptide
PHSTGSI

SEQ ID NO: 33651 - protein, 7 aa, Artificial Sequence
  Description of Artificial Sequence: Synthetic peptide
AQARLMN

SEQ ID NO: 33652 - protein, 7 aa, Artificial Sequence
  Description of Artificial Sequence: Synthetic peptide
HSSKSHD

SEQ ID NO: 33653 - protein, 7 aa, Artificial Sequence
  Description of Artificial Sequence: Synthetic peptide
GCITNCS

SEQ ID NO: 33654 - protein, 7 aa, Artificial Sequence
  Description of Artificial Sequence: Synthetic peptide
ERMGKNQ

SEQ ID NO: 33655 - protein, 7 aa, Artificial Sequence
  Description of Artificial Sequence: Synthetic peptide
MTQHKQA

SEQ ID NO: 33656 - protein, 7 aa, Artificial Sequence
  Description of Artificial Sequence: Synthetic peptide
KSDAHTA

SEQ ID NO: 33657 - protein, 7 aa, Artificial Sequence
  Description of Artificial Sequence: Synthetic peptide
TVTNAAR

SEQ ID NO: 33658 - protein, 7 aa, Artificial Sequence
  Description of Artificial Sequence: Synthetic peptide
VSGTPRV

SEQ ID NO: 33659 - protein, 7 aa, Artificial Sequence
  Description of Artificial Sequence: Synthetic peptide
YPNGKSS

SEQ ID NO: 33660 - protein, 7 aa, Artificial Sequence
  Description of Artificial Sequence: Synthetic peptide
AVSKGGP

SEQ ID NO: 33661 - protein, 7 aa, Artificial Sequence
  Description of Artificial Sequence: Synthetic peptide
PEISASR

SEQ ID NO: 33662 - protein, 7 aa, Artificial Sequence
  Description of Artificial Sequence: Synthetic peptide
QNRNTVG

SEQ ID NO: 33663 - protein, 7 aa, Artificial Sequence
  Description of Artificial Sequence: Synthetic peptide
SVSGRHI

SEQ ID NO: 33664 - protein, 7 aa, Artificial Sequence
  Description of Artificial Sequence: Synthetic peptide
MPARNVS

SEQ ID NO: 33665 - protein, 7 aa, Artificial Sequence
  Description of Artificial Sequence: Synthetic peptide
NPRMSMS

SEQ ID NO: 33666 - protein, 7 aa, Artificial Sequence
  Description of Artificial Sequence: Synthetic peptide
SRAQSIP

SEQ ID NO: 33667 - protein, 7 aa, Artificial Sequence
  Description of Artificial Sequence: Synthetic peptide
PLINRTM

SEQ ID NO: 33668 - protein, 7 aa, Artificial Sequence
  Description of Artificial Sequence: Synthetic peptide
SAELRVA

SEQ ID NO: 33669 - protein, 7 aa, Artificial Sequence
  Description of Artificial Sequence: Synthetic peptide
AISPTYM

SEQ ID NO: 33670 - protein, 7 aa, Artificial Sequence
  Description of Artificial Sequence: Synthetic peptide
RDDKQNS

SEQ ID NO: 33671 - protein, 7 aa, Artificial Sequence
  Description of Artificial Sequence: Synthetic peptide
PSQEGQQ

SEQ ID NO: 33672 - protein, 7 aa, Artificial Sequence
  Description of Artificial Sequence: Synthetic peptide
PTRTASN

SEQ ID NO: 33673 - protein, 7 aa, Artificial Sequence
  Description of Artificial Sequence: Synthetic peptide
GRLTSSI

SEQ ID NO: 33674 - protein, 7 aa, Artificial Sequence
  Description of Artificial Sequence: Synthetic peptide
MLGSSNK

SEQ ID NO: 33675 - protein, 7 aa, Artificial Sequence
  Description of Artificial Sequence: Synthetic peptide
EVTNSPR

SEQ ID NO: 33676 - protein, 7 aa, Artificial Sequence
  Description of Artificial Sequence: Synthetic peptide
GGVGGKS

SEQ ID NO: 33677 - protein, 7 aa, Artificial Sequence
  Description of Artificial Sequence: Synthetic peptide
NATSPRK

SEQ ID NO: 33678 - protein, 7 aa, Artificial Sequence
  Description of Artificial Sequence: Synthetic peptide
SLSKQAA

SEQ ID NO: 33679 - protein, 7 aa, Artificial Sequence
  Description of Artificial Sequence: Synthetic peptide
GQAMPFK

SEQ ID NO: 33680 - protein, 7 aa, Artificial Sequence
  Description of Artificial Sequence: Synthetic peptide
YRSKEIG

SEQ ID NO: 33681 - protein, 7 aa, Artificial Sequence
  Description of Artificial Sequence: Synthetic peptide
NSHQKPS

SEQ ID NO: 33682 - protein, 7 aa, Artificial Sequence
  Description of Artificial Sequence: Synthetic peptide
ATANTHM

SEQ ID NO: 33683 - protein, 7 aa, Artificial Sequence
  Description of Artificial Sequence: Synthetic peptide
PRHAPLL

SEQ ID NO: 33684 - protein, 7 aa, Artificial Sequence
  Description of Artificial Sequence: Synthetic peptide
GRDTRSS

SEQ ID NO: 33685 - protein, 7 aa, Artificial Sequence
  Description of Artificial Sequence: Synthetic peptide
DSVAGFT

SEQ ID NO: 33686 - protein, 7 aa, Artificial Sequence
  Description of Artificial Sequence: Synthetic peptide
QRVHPSG

SEQ ID NO: 33687 - protein, 7 aa, Artificial Sequence
  Description of Artificial Sequence: Synthetic peptide
YQHRAPS

SEQ ID NO: 33688 - protein, 7 aa, Artificial Sequence
  Description of Artificial Sequence: Synthetic peptide
NGQAGNR

SEQ ID NO: 33689 - protein, 7 aa, Artificial Sequence
  Description of Artificial Sequence: Synthetic peptide
GRETVSR

SEQ ID NO: 33690 - protein, 7 aa, Artificial Sequence
  Description of Artificial Sequence: Synthetic peptide
PQDSRGM

SEQ ID NO: 33691 - protein, 7 aa, Artificial Sequence
  Description of Artificial Sequence: Synthetic peptide
FPLTKPA

SEQ ID NO: 33692 - protein, 7 aa, Artificial Sequence
  Description of Artificial Sequence: Synthetic peptide
GIAGVTR

SEQ ID NO: 33693 - protein, 7 aa, Artificial Sequence
  Description of Artificial Sequence: Synthetic peptide
YNRSERP

SEQ ID NO: 33694 - protein, 7 aa, Artificial Sequence
  Description of Artificial Sequence: Synthetic peptide
VTGRAYL

SEQ ID NO: 33695 - protein, 7 aa, Artificial Sequence
  Description of Artificial Sequence: Synthetic peptide
QNRVSNG

SEQ ID NO: 33696 - protein, 7 aa, Artificial Sequence
  Description of Artificial Sequence: Synthetic peptide
TRSQGIL

SEQ ID NO: 33697 - protein, 7 aa, Artificial Sequence
  Description of Artificial Sequence: Synthetic peptide
YGRGRDL

SEQ ID NO: 33698 - protein, 7 aa, Artificial Sequence
  Description of Artificial Sequence: Synthetic peptide
GSSPSLR

SEQ ID NO: 33699 - protein, 7 aa, Artificial Sequence
  Description of Artificial Sequence: Synthetic peptide
VNTNRAA

SEQ ID NO: 33700 - protein, 7 aa, Artificial Sequence
  Description of Artificial Sequence: Synthetic peptide
RPIASSG

SEQ ID NO: 33701 - protein, 7 aa, Artificial Sequence
  Description of Artificial Sequence: Synthetic peptide
AGSSSPA

SEQ ID NO: 33702 - protein, 7 aa, Artificial Sequence
  Description of Artificial Sequence: Synthetic peptide
PTTGPQR

SEQ ID NO: 33703 - protein, 7 aa, Artificial Sequence
  Description of Artificial Sequence: Synthetic peptide
ISQSTTR

SEQ ID NO: 33704 - protein, 7 aa, Artificial Sequence
  Description of Artificial Sequence: Synthetic peptide
TNLPRSH

SEQ ID NO: 33705 - protein, 7 aa, Artificial Sequence
  Description of Artificial Sequence: Synthetic peptide
GNTNSFL

SEQ ID NO: 33706 - protein, 7 aa, Artificial Sequence
  Description of Artificial Sequence: Synthetic peptide
TLSQTVR

SEQ ID NO: 33707 - protein, 7 aa, Artificial Sequence
  Description of Artificial Sequence: Synthetic peptide
SSKAAIT

SEQ ID NO: 33708 - protein, 7 aa, Artificial Sequence
  Description of Artificial Sequence: Synthetic peptide
SSGPSSG

SEQ ID NO: 33709 - protein, 7 aa, Artificial Sequence
  Description of Artificial Sequence: Synthetic peptide
AEKTRSL

SEQ ID NO: 33710 - protein, 7 aa, Artificial Sequence
  Description of Artificial Sequence: Synthetic peptide
STPIRSV

SEQ ID NO: 33711 - protein, 7 aa, Artificial Sequence
  Description of Artificial Sequence: Synthetic peptide
SFSGANK

SEQ ID NO: 33712 - protein, 7 aa, Artificial Sequence
  Description of Artificial Sequence: Synthetic peptide
VNTTRAE

SEQ ID NO: 33713 - protein, 7 aa, Artificial Sequence
  Description of Artificial Sequence: Synthetic peptide
LINPAGS

SEQ ID NO: 33714 - protein, 7 aa, Artificial Sequence
  Description of Artificial Sequence: Synthetic peptide
MSSTRSI

SEQ ID NO: 33715 - protein, 7 aa, Artificial Sequence
  Description of Artificial Sequence: Synthetic peptide
SPHGAGY

SEQ ID NO: 33716 - protein, 7 aa, Artificial Sequence
  Description of Artificial Sequence: Synthetic peptide
HGTSPLR

SEQ ID NO: 33717 - protein, 7 aa, Artificial Sequence
  Description of Artificial Sequence: Synthetic peptide
SNYKSSN

SEQ ID NO: 33718 - protein, 7 aa, Artificial Sequence
  Description of Artificial Sequence: Synthetic peptide
GNGTRQN

SEQ ID NO: 33719 - protein, 7 aa, Artificial Sequence
  Description of Artificial Sequence: Synthetic peptide
GTDNNTR

SEQ ID NO: 33720 - protein, 7 aa, Artificial Sequence
  Description of Artificial Sequence: Synthetic peptide
TRTAGVD

SEQ ID NO: 33721 - protein, 7 aa, Artificial Sequence
  Description of Artificial Sequence: Synthetic peptide
TGAQSTM

SEQ ID NO: 33722 - protein, 7 aa, Artificial Sequence
  Description of Artificial Sequence: Synthetic peptide
RSASGQL

SEQ ID NO: 33723 - protein, 7 aa, Artificial Sequence
  Description of Artificial Sequence: Synthetic peptide
PRKISNA

SEQ ID NO: 33724 - protein, 7 aa, Artificial Sequence
  Description of Artificial Sequence: Synthetic peptide
ATTSRIS

SEQ ID NO: 33725 - protein, 7 aa, Artificial Sequence
  Description of Artificial Sequence: Synthetic peptide
TTPTYTG

SEQ ID NO: 33726 - protein, 7 aa, Artificial Sequence
  Description of Artificial Sequence: Synthetic peptide
GGQNSSK

SEQ ID NO: 33727 - protein, 7 aa, Artificial Sequence
  Description of Artificial Sequence: Synthetic peptide
SNTNSAN

SEQ ID NO: 33728 - protein, 7 aa, Artificial Sequence
  Description of Artificial Sequence: Synthetic peptide
PTQNGRS

SEQ ID NO: 33729 - protein, 7 aa, Artificial Sequence
  Description of Artificial Sequence: Synthetic peptide
SQHRPSS

SEQ ID NO: 33730 - protein, 7 aa, Artificial Sequence
  Description of Artificial Sequence: Synthetic peptide
SESGQQR

SEQ ID NO: 33731 - protein, 7 aa, Artificial Sequence
  Description of Artificial Sequence: Synthetic peptide
GTGHQRS

SEQ ID NO: 33732 - protein, 7 aa, Artificial Sequence
  Description of Artificial Sequence: Synthetic peptide
PSTSSAG

SEQ ID NO: 33733 - protein, 7 aa, Artificial Sequence
  Description of Artificial Sequence: Synthetic peptide
YTASALR

SEQ ID NO: 33734 - protein, 7 aa, Artificial Sequence
  Description of Artificial Sequence: Synthetic peptide
TGDSGKV

SEQ ID NO: 33735 - protein, 7 aa, Artificial Sequence
  Description of Artificial Sequence: Synthetic peptide
SKVTAQS

SEQ ID NO: 33736 - protein, 7 aa, Artificial Sequence
  Description of Artificial Sequence: Synthetic peptide
MSLSKNH

SEQ ID NO: 33737 - protein, 7 aa, Artificial Sequence
  Description of Artificial Sequence: Synthetic peptide
NRSTDFK

SEQ ID NO: 33738 - protein, 7 aa, Artificial Sequence
  Description of Artificial Sequence: Synthetic peptide
LGLRDNT

SEQ ID NO: 33739 - protein, 7 aa, Artificial Sequence
  Description of Artificial Sequence: Synthetic peptide
SRNAANA

SEQ ID NO: 33740 - protein, 7 aa, Artificial Sequence
  Description of Artificial Sequence: Synthetic peptide
QNQNSGR

SEQ ID NO: 33741 - protein, 7 aa, Artificial Sequence
  Description of Artificial Sequence: Synthetic peptide
SVSNTNT

SEQ ID NO: 33742 - protein, 7 aa, Artificial Sequence
  Description of Artificial Sequence: Synthetic peptide
ASSRESL

SEQ ID NO: 33743 - protein, 7 aa, Artificial Sequence
  Description of Artificial Sequence: Synthetic peptide
KLSQTSQ

SEQ ID NO: 33744 - protein, 7 aa, Artificial Sequence
  Description of Artificial Sequence: Synthetic peptide
RDVGSAA

SEQ ID NO: 33745 - protein, 7 aa, Artificial Sequence
  Description of Artificial Sequence: Synthetic peptide
NSRSHHE

SEQ ID NO: 33746 - protein, 7 aa, Artificial Sequence
  Description of Artificial Sequence: Synthetic peptide
SGSDKFS

SEQ ID NO: 33747 - protein, 7 aa, Artificial Sequence
  Description of Artificial Sequence: Synthetic peptide
SHPSSFG

SEQ ID NO: 33748 - protein, 7 aa, Artificial Sequence
  Description of Artificial Sequence: Synthetic peptide
SGMSRHV

SEQ ID NO: 33749 - protein, 7 aa, Artificial Sequence
  Description of Artificial Sequence: Synthetic peptide
GPTDHKL

SEQ ID NO: 33750 - protein, 7 aa, Artificial Sequence
  Description of Artificial Sequence: Synthetic peptide
INVSRST

SEQ ID NO: 33751 - protein, 7 aa, Artificial Sequence
  Description of Artificial Sequence: Synthetic peptide
PKLSHTG

SEQ ID NO: 33752 - protein, 7 aa, Artificial Sequence
  Description of Artificial Sequence: Synthetic peptide
FNMQRSQ

SEQ ID NO: 33753 - protein, 7 aa, Artificial Sequence
  Description of Artificial Sequence: Synthetic peptide
VPVTKSS

SEQ ID NO: 33754 - protein, 7 aa, Artificial Sequence
  Description of Artificial Sequence: Synthetic peptide
NSAAAMK

SEQ ID NO: 33755 - protein, 7 aa, Artificial Sequence
  Description of Artificial Sequence: Synthetic peptide
LVSPGHV

SEQ ID NO: 33756 - protein, 7 aa, Artificial Sequence
  Description of Artificial Sequence: Synthetic peptide
QVTVRPV

SEQ ID NO: 33757 - protein, 7 aa, Artificial Sequence
  Description of Artificial Sequence: Synthetic peptide
YGSRENS

SEQ ID NO: 33758 - protein, 7 aa, Artificial Sequence
  Description of Artificial Sequence: Synthetic peptide
QSSNARN

SEQ ID NO: 33759 - protein, 7 aa, Artificial Sequence
  Description of Artificial Sequence: Synthetic peptide
RAPGSNT

SEQ ID NO: 33760 - protein, 7 aa, Artificial Sequence
  Description of Artificial Sequence: Synthetic peptide
FNSGSGR

SEQ ID NO: 33761 - protein, 7 aa, Artificial Sequence
  Description of Artificial Sequence: Synthetic peptide
MNSNHRN

SEQ ID NO: 33762 - protein, 7 aa, Artificial Sequence
  Description of Artificial Sequence: Synthetic peptide
MGREMKG

SEQ ID NO: 33763 - protein, 7 aa, Artificial Sequence
  Description of Artificial Sequence: Synthetic peptide
AGPLNSL

SEQ ID NO: 33764 - protein, 7 aa, Artificial Sequence
  Description of Artificial Sequence: Synthetic peptide
NNVPLIK

SEQ ID NO: 33765 - protein, 7 aa, Artificial Sequence
  Description of Artificial Sequence: Synthetic peptide
QAQHTRS

SEQ ID NO: 33766 - protein, 7 aa, Artificial Sequence
  Description of Artificial Sequence: Synthetic peptide
GTASGVA

SEQ ID NO: 33767 - protein, 7 aa, Artificial Sequence
  Description of Artificial Sequence: Synthetic peptide
TSTLDYL

SEQ ID NO: 33768 - protein, 7 aa, Artificial Sequence
  Description of Artificial Sequence: Synthetic peptide
PGPEVGR

SEQ ID NO: 33769 - protein, 7 aa, Artificial Sequence
  Description of Artificial Sequence: Synthetic peptide
VNVSTFT

SEQ ID NO: 33770 - protein, 7 aa, Artificial Sequence
  Description of Artificial Sequence: Synthetic peptide
TAFPGYL

SEQ ID NO: 33771 - protein, 7 aa, Artificial Sequence
  Description of Artificial Sequence: Synthetic peptide
QVSAKSA

SEQ ID NO: 33772 - protein, 7 aa, Artificial Sequence
  Description of Artificial Sequence: Synthetic peptide
LAMERQR

SEQ ID NO: 33773 - protein, 7 aa, Artificial Sequence
  Description of Artificial Sequence: Synthetic peptide
LPQRGVS

SEQ ID NO: 33774 - protein, 7 aa, Artificial Sequence
  Description of Artificial Sequence: Synthetic peptide
RSSPASL

SEQ ID NO: 33775 - protein, 7 aa, Artificial Sequence
  Description of Artificial Sequence: Synthetic peptide
WSNGRTS

SEQ ID NO: 33776 - protein, 7 aa, Artificial Sequence
  Description of Artificial Sequence: Synthetic peptide
SNSASYG

SEQ ID NO: 33777 - protein, 7 aa, Artificial Sequence
  Description of Artificial Sequence: Synthetic peptide
PSQTKPS

SEQ ID NO: 33778 - protein, 7 aa, Artificial Sequence
  Description of Artificial Sequence: Synthetic peptide
YGSESNK

SEQ ID NO: 33779 - protein, 7 aa, Artificial Sequence
  Description of Artificial Sequence: Synthetic peptide
GLSPVLK

SEQ ID NO: 33780 - protein, 7 aa, Artificial Sequence
  Description of Artificial Sequence: Synthetic peptide
REDTKMH

SEQ ID NO: 33781 - protein, 7 aa, Artificial Sequence
  Description of Artificial Sequence: Synthetic peptide
NVLSNKH

SEQ ID NO: 33782 - protein, 7 aa, Artificial Sequence
  Description of Artificial Sequence: Synthetic peptide
SQSQTPE

SEQ ID NO: 33783 - protein, 7 aa, Artificial Sequence
  Description of Artificial Sequence: Synthetic peptide
SSNGNIV

SEQ ID NO: 33784 - protein, 7 aa, Artificial Sequence
  Description of Artificial Sequence: Synthetic peptide
SISGERD

SEQ ID NO: 33785 - protein, 7 aa, Artificial Sequence
  Description of Artificial Sequence: Synthetic peptide
KDASSWL

SEQ ID NO: 33786 - protein, 7 aa, Artificial Sequence
  Description of Artificial Sequence: Synthetic peptide
SPNSHPS

SEQ ID NO: 33787 - protein, 7 aa, Artificial Sequence
  Description of Artificial Sequence: Synthetic peptide
SSGSNRS

SEQ ID NO: 33788 - protein, 7 aa, Artificial Sequence
  Description of Artificial Sequence: Synthetic peptide
TTQSRSL

SEQ ID NO: 33789 - protein, 7 aa, Artificial Sequence
  Description of Artificial Sequence: Synthetic peptide
PGRPQTD

SEQ ID NO: 33790 - protein, 7 aa, Artificial Sequence
  Description of Artificial Sequence: Synthetic peptide
SVHQNRA

SEQ ID NO: 33791 - protein, 7 aa, Artificial Sequence
  Description of Artificial Sequence: Synthetic peptide
VGARTGG

SEQ ID NO: 33792 - protein, 7 aa, Artificial Sequence
  Description of Artificial Sequence: Synthetic peptide
GPGRNLI

SEQ ID NO: 33793 - protein, 7 aa, Artificial Sequence
  Description of Artificial Sequence: Synthetic peptide
NGSVQNQ

SEQ ID NO: 33794 - protein, 7 aa, Artificial Sequence
  Description of Artificial Sequence: Synthetic peptide
GFERNRE

SEQ ID NO: 33795 - protein, 7 aa, Artificial Sequence
  Description of Artificial Sequence: Synthetic peptide
ATHTSVS

SEQ ID NO: 33796 - protein, 7 aa, Artificial Sequence
  Description of Artificial Sequence: Synthetic peptide
IGKNSMA

SEQ ID NO: 33797 - protein, 7 aa, Artificial Sequence
  Description of Artificial Sequence: Synthetic peptide
NRVTQSS

SEQ ID NO: 33798 - protein, 7 aa, Artificial Sequence
  Description of Artificial Sequence: Synthetic peptide
GVNRIPA

SEQ ID NO: 33799 - protein, 7 aa, Artificial Sequence
  Description of Artificial Sequence: Synthetic peptide
VTANRST

SEQ ID NO: 33800 - protein, 7 aa, Artificial Sequence
  Description of Artificial Sequence: Synthetic peptide
SYADKQG

SEQ ID NO: 33801 - protein, 7 aa, Artificial Sequence
  Description of Artificial Sequence: Synthetic peptide
PLGATFA

SEQ ID NO: 33802 - protein, 7 aa, Artificial Sequence
  Description of Artificial Sequence: Synthetic peptide
LTATNPR

SEQ ID NO: 33803 - protein, 7 aa, Artificial Sequence
  Description of Artificial Sequence: Synthetic peptide
WDSKTPR

SEQ ID NO: 33804 - protein, 7 aa, Artificial Sequence
  Description of Artificial Sequence: Synthetic peptide
HTSTNTI

SEQ ID NO: 33805 - protein, 7 aa, Artificial Sequence
  Description of Artificial Sequence: Synthetic peptide
SGRDKIS

SEQ ID NO: 33806 - protein, 7 aa, Artificial Sequence
  Description of Artificial Sequence: Synthetic peptide
VDVRGMS

SEQ ID NO: 33807 - protein, 7 aa, Artificial Sequence
  Description of Artificial Sequence: Synthetic peptide
MVSSKSS

SEQ ID NO: 33808 - protein, 7 aa, Artificial Sequence
  Description of Artificial Sequence: Synthetic peptide
NALPNRG

SEQ ID NO: 33809 - protein, 7 aa, Artificial Sequence
  Description of Artificial Sequence: Synthetic peptide
INSLSSK

SEQ ID NO: 33810 - protein, 7 aa, Artificial Sequence
  Description of Artificial Sequence: Synthetic peptide
SGQHSLN

SEQ ID NO: 33811 - protein, 7 aa, Artificial Sequence
  Description of Artificial Sequence: Synthetic peptide
YAMERVG

SEQ ID NO: 33812 - protein, 7 aa, Artificial Sequence
  Description of Artificial Sequence: Synthetic peptide
NGSGQDQ

SEQ ID NO: 33813 - protein, 7 aa, Artificial Sequence
  Description of Artificial Sequence: Synthetic peptide
DRAGKQS

SEQ ID NO: 33814 - protein, 7 aa, Artificial Sequence
  Description of Artificial Sequence: Synthetic peptide
GGVPSRL

SEQ ID NO: 33815 - protein, 7 aa, Artificial Sequence
  Description of Artificial Sequence: Synthetic peptide
GVSATVK

SEQ ID NO: 33816 - protein, 7 aa, Artificial Sequence
  Description of Artificial Sequence: Synthetic peptide
DYSETRR

SEQ ID NO: 33817 - protein, 7 aa, Artificial Sequence
  Description of Artificial Sequence: Synthetic peptide
ITPSNIG

SEQ ID NO: 33818 - protein, 7 aa, Artificial Sequence
  Description of Artificial Sequence: Synthetic peptide
MATSTRN

SEQ ID NO: 33819 - protein, 7 aa, Artificial Sequence
  Description of Artificial Sequence: Synthetic peptide
MSHTKSN

SEQ ID NO: 33820 - protein, 7 aa, Artificial Sequence
  Description of Artificial Sequence: Synthetic peptide
MNRNGSL

SEQ ID NO: 33821 - protein, 7 aa, Artificial Sequence
  Description of Artificial Sequence: Synthetic peptide
DIMSPLK

SEQ ID NO: 33822 - protein, 7 aa, Artificial Sequence
  Description of Artificial Sequence: Synthetic peptide
NKSNGQS

SEQ ID NO: 33823 - protein, 7 aa, Artificial Sequence
  Description of Artificial Sequence: Synthetic peptide
PGTPSSG

SEQ ID NO: 33824 - protein, 7 aa, Artificial Sequence
  Description of Artificial Sequence: Synthetic peptide
SSVRPYA

SEQ ID NO: 33825 - protein, 7 aa, Artificial Sequence
  Description of Artificial Sequence: Synthetic peptide
MRSGTHN

SEQ ID NO: 33826 - protein, 7 aa, Artificial Sequence
  Description of Artificial Sequence: Synthetic peptide
GTPNTKV

SEQ ID NO: 33827 - protein, 7 aa, Artificial Sequence
  Description of Artificial Sequence: Synthetic peptide
PGLRDTA

SEQ ID NO: 33828 - protein, 7 aa, Artificial Sequence
  Description of Artificial Sequence: Synthetic peptide
STTGDSK

SEQ ID NO: 33829 - protein, 7 aa, Artificial Sequence
  Description of Artificial Sequence: Synthetic peptide
TSKPNSP

SEQ ID NO: 33830 - protein, 7 aa, Artificial Sequence
  Description of Artificial Sequence: Synthetic peptide
NSGTHFK

SEQ ID NO: 33831 - protein, 7 aa, Artificial Sequence
  Description of Artificial Sequence: Synthetic peptide
YGSPVHQ

SEQ ID NO: 33832 - protein, 7 aa, Artificial Sequence
  Description of Artificial Sequence: Synthetic peptide
FTFNAAT

SEQ ID NO: 33833 - protein, 7 aa, Artificial Sequence
  Description of Artificial Sequence: Synthetic peptide
AGENKLS

SEQ ID NO: 33834 - protein, 7 aa, Artificial Sequence
  Description of Artificial Sequence: Synthetic peptide
LIRGGNN

SEQ ID NO: 33835 - protein, 7 aa, Artificial Sequence
  Description of Artificial Sequence: Synthetic peptide
GSNRNPL

SEQ ID NO: 33836 - protein, 7 aa, Artificial Sequence
  Description of Artificial Sequence: Synthetic peptide
ITATHAH

SEQ ID NO: 33837 - protein, 7 aa, Artificial Sequence
  Description of Artificial Sequence: Synthetic peptide
DDYQHKG

SEQ ID NO: 33838 - protein, 7 aa, Artificial Sequence
  Description of Artificial Sequence: Synthetic peptide
QVTAIGA

SEQ ID NO: 33839 - protein, 7 aa, Artificial Sequence
  Description of Artificial Sequence: Synthetic peptide
SNRPSIV

SEQ ID NO: 33840 - protein, 7 aa, Artificial Sequence
  Description of Artificial Sequence: Synthetic peptide
FPTSPTR

SEQ ID NO: 33841 - protein, 7 aa, Artificial Sequence
  Description of Artificial Sequence: Synthetic peptide
PTRNGNM

SEQ ID NO: 33842 - protein, 7 aa, Artificial Sequence
  Description of Artificial Sequence: Synthetic peptide
VLHNASS

SEQ ID NO: 33843 - protein, 7 aa, Artificial Sequence
  Description of Artificial Sequence: Synthetic peptide
VLSSSPK

SEQ ID NO: 33844 - protein, 7 aa, Artificial Sequence
  Description of Artificial Sequence: Synthetic peptide
QSKAGNS

SEQ ID NO: 33845 - protein, 7 aa, Artificial Sequence
  Description of Artificial Sequence: Synthetic peptide
QTSHSAK

SEQ ID NO: 33846 - protein, 7 aa, Artificial Sequence
  Description of Artificial Sequence: Synthetic peptide
DIRNLQR

SEQ ID NO: 33847 - protein, 7 aa, Artificial Sequence
  Description of Artificial Sequence: Synthetic peptide
ATSPRLS

SEQ ID NO: 33848 - protein, 7 aa, Artificial Sequence
  Description of Artificial Sequence: Synthetic peptide
AFGGETK

SEQ ID NO: 33849 - protein, 7 aa, Artificial Sequence
  Description of Artificial Sequence: Synthetic peptide
SSQAQPT

SEQ ID NO: 33850 - protein, 7 aa, Artificial Sequence
  Description of Artificial Sequence: Synthetic peptide
TVLGSSY

SEQ ID NO: 33851 - protein, 7 aa, Artificial Sequence
  Description of Artificial Sequence: Synthetic peptide
FRPSTVV

SEQ ID NO: 33852 - protein, 7 aa, Artificial Sequence
  Description of Artificial Sequence: Synthetic peptide
SAHSLGI

SEQ ID NO: 33853 - protein, 7 aa, Artificial Sequence
  Description of Artificial Sequence: Synthetic peptide
SRSVTAR

SEQ ID NO: 33854 - protein, 7 aa, Artificial Sequence
  Description of Artificial Sequence: Synthetic peptide
AGTSKDI

SEQ ID NO: 33855 - protein, 7 aa, Artificial Sequence
  Description of Artificial Sequence: Synthetic peptide
VTGSVSD

SEQ ID NO: 33856 - protein, 7 aa, Artificial Sequence
  Description of Artificial Sequence: Synthetic peptide
SGNSHNG

SEQ ID NO: 33857 - protein, 7 aa, Artificial Sequence
  Description of Artificial Sequence: Synthetic peptide
GPHTAVG

SEQ ID NO: 33858 - protein, 7 aa, Artificial Sequence
  Description of Artificial Sequence: Synthetic peptide
GRQSQPR

SEQ ID NO: 33859 - protein, 7 aa, Artificial Sequence
  Description of Artificial Sequence: Synthetic peptide
LRPNGQL

SEQ ID NO: 33860 - protein, 7 aa, Artificial Sequence
  Description of Artificial Sequence: Synthetic peptide
RMKSLDN

SEQ ID NO: 33861 - protein, 7 aa, Artificial Sequence
  Description of Artificial Sequence: Synthetic peptide
NVNSQML

SEQ ID NO: 33862 - protein, 7 aa, Artificial Sequence
  Description of Artificial Sequence: Synthetic peptide
SFSSTMG

SEQ ID NO: 33863 - protein, 7 aa, Artificial Sequence
  Description of Artificial Sequence: Synthetic peptide
GNNRPAS

SEQ ID NO: 33864 - protein, 7 aa, Artificial Sequence
  Description of Artificial Sequence: Synthetic peptide
GQTGDMR

SEQ ID NO: 33865 - protein, 7 aa, Artificial Sequence
  Description of Artificial Sequence: Synthetic peptide
TNPNPHR

SEQ ID NO: 33866 - protein, 7 aa, Artificial Sequence
  Description of Artificial Sequence: Synthetic peptide
IPLSSQR

SEQ ID NO: 33867 - protein, 7 aa, Artificial Sequence
  Description of Artificial Sequence: Synthetic peptide
SGVERVN

SEQ ID NO: 33868 - protein, 7 aa, Artificial Sequence
  Description of Artificial Sequence: Synthetic peptide
FNSSSGS

SEQ ID NO: 33869 - protein, 7 aa, Artificial Sequence
  Description of Artificial Sequence: Synthetic peptide
HIGSPHT

SEQ ID NO: 33870 - protein, 7 aa, Artificial Sequence
  Description of Artificial Sequence: Synthetic peptide
GSGHGTN

SEQ ID NO: 33871 - protein, 7 aa, Artificial Sequence
  Description of Artificial Sequence: Synthetic peptide
STHDHSR

SEQ ID NO: 33872 - protein, 7 aa, Artificial Sequence
  Description of Artificial Sequence: Synthetic peptide
PLQQNRS

SEQ ID NO: 33873 - protein, 7 aa, Artificial Sequence
  Description of Artificial Sequence: Synthetic peptide
MMGGVKN

SEQ ID NO: 33874 - protein, 7 aa, Artificial Sequence
  Description of Artificial Sequence: Synthetic peptide
NPVALRD

SEQ ID NO: 33875 - protein, 7 aa, Artificial Sequence
  Description of Artificial Sequence: Synthetic peptide
LLDRRAA

SEQ ID NO: 33876 - protein, 7 aa, Artificial Sequence
  Description of Artificial Sequence: Synthetic peptide
RSMGNSS

SEQ ID NO: 33877 - protein, 7 aa, Artificial Sequence
  Description of Artificial Sequence: Synthetic peptide
KQPDSTH

SEQ ID NO: 33878 - protein, 7 aa, Artificial Sequence
  Description of Artificial Sequence: Synthetic peptide
TQGASNL

SEQ ID NO: 33879 - protein, 7 aa, Artificial Sequence
  Description of Artificial Sequence: Synthetic peptide
RNYTGDS

SEQ ID NO: 33880 - protein, 7 aa, Artificial Sequence
  Description of Artificial Sequence: Synthetic peptide
GTINGIT

SEQ ID NO: 33881 - protein, 7 aa, Artificial Sequence
  Description of Artificial Sequence: Synthetic peptide
VPGNLPS

SEQ ID NO: 33882 - protein, 7 aa, Artificial Sequence
  Description of Artificial Sequence: Synthetic peptide
DRSRVLG

SEQ ID NO: 33883 - protein, 7 aa, Artificial Sequence
  Description of Artificial Sequence: Synthetic peptide
SDINRST

SEQ ID NO: 33884 - protein, 7 aa, Artificial Sequence
  Description of Artificial Sequence: Synthetic peptide
PSVANVM

SEQ ID NO: 33885 - protein, 7 aa, Artificial Sequence
  Description of Artificial Sequence: Synthetic peptide
QFPDETL

SEQ ID NO: 33886 - protein, 7 aa, Artificial Sequence
  Description of Artificial Sequence: Synthetic peptide
SSLEKSN

SEQ ID NO: 33887 - protein, 7 aa, Artificial Sequence
  Description of Artificial Sequence: Synthetic peptide
IGTSPMK

SEQ ID NO: 33888 - protein, 7 aa, Artificial Sequence
  Description of Artificial Sequence: Synthetic peptide
PVTRLSE

SEQ ID NO: 33889 - protein, 7 aa, Artificial Sequence
  Description of Artificial Sequence: Synthetic peptide
DRQGLSG

SEQ ID NO: 33890 - protein, 7 aa, Artificial Sequence
  Description of Artificial Sequence: Synthetic peptide
TQGSRLS

SEQ ID NO: 33891 - protein, 7 aa, Artificial Sequence
  Description of Artificial Sequence: Synthetic peptide
RDRTNAA

SEQ ID NO: 33892 - protein, 7 aa, Artificial Sequence
  Description of Artificial Sequence: Synthetic peptide
VSRSATN

SEQ ID NO: 33893 - protein, 7 aa, Artificial Sequence
  Description of Artificial Sequence: Synthetic peptide
NVSSAIK

SEQ ID NO: 33894 - protein, 7 aa, Artificial Sequence
  Description of Artificial Sequence: Synthetic peptide
PHSGNRH

SEQ ID NO: 33895 - protein, 7 aa, Artificial Sequence
  Description of Artificial Sequence: Synthetic peptide
YPSTPHR

SEQ ID NO: 33896 - protein, 7 aa, Artificial Sequence
  Description of Artificial Sequence: Synthetic peptide
SKATHNI

SEQ ID NO: 33897 - protein, 7 aa, Artificial Sequence
  Description of Artificial Sequence: Synthetic peptide
ELAAPSK

SEQ ID NO: 33898 - protein, 7 aa, Artificial Sequence
  Description of Artificial Sequence: Synthetic peptide
PVGTKSG

SEQ ID NO: 33899 - protein, 7 aa, Artificial Sequence
  Description of Artificial Sequence: Synthetic peptide
SSSRGQN

SEQ ID NO: 33900 - protein, 7 aa, Artificial Sequence
  Description of Artificial Sequence: Synthetic peptide
QVSPLNA

SEQ ID NO: 33901 - protein, 7 aa, Artificial Sequence
  Description of Artificial Sequence: Synthetic peptide
YGASPSL

SEQ ID NO: 33902 - protein, 7 aa, Artificial Sequence
  Description of Artificial Sequence: Synthetic peptide
YNASTNV

SEQ ID NO: 33903 - protein, 7 aa, Artificial Sequence
  Description of Artificial Sequence: Synthetic peptide
SSRASQD

SEQ ID NO: 33904 - protein, 7 aa, Artificial Sequence
  Description of Artificial Sequence: Synthetic peptide
LTPSNMG

SEQ ID NO: 33905 - protein, 7 aa, Artificial Sequence
  Description of Artificial Sequence: Synthetic peptide
VLAGSNT

SEQ ID NO: 33906 - protein, 7 aa, Artificial Sequence
  Description of Artificial Sequence: Synthetic peptide
PSGETSK

SEQ ID NO: 33907 - protein, 7 aa, Artificial Sequence
  Description of Artificial Sequence: Synthetic peptide
GVNTGTQ

SEQ ID NO: 33908 - protein, 7 aa, Artificial Sequence
  Description of Artificial Sequence: Synthetic peptide
SHMTGVT

SEQ ID NO: 33909 - protein, 7 aa, Artificial Sequence
  Description of Artificial Sequence: Synthetic peptide
VAHRPQL

SEQ ID NO: 33910 - protein, 7 aa, Artificial Sequence
  Description of Artificial Sequence: Synthetic peptide
GTDSKRH

SEQ ID NO: 33911 - protein, 7 aa, Artificial Sequence
  Description of Artificial Sequence: Synthetic peptide
GTYGEMR

SEQ ID NO: 33912 - protein, 7 aa, Artificial Sequence
  Description of Artificial Sequence: Synthetic peptide
PQNLAHV

SEQ ID NO: 33913 - protein, 7 aa, Artificial Sequence
  Description of Artificial Sequence: Synthetic peptide
PSARMSG

SEQ ID NO: 33914 - protein, 7 aa, Artificial Sequence
  Description of Artificial Sequence: Synthetic peptide
SHNSKDS

SEQ ID NO: 33915 - protein, 7 aa, Artificial Sequence
  Description of Artificial Sequence: Synthetic peptide
FVSARSG

SEQ ID NO: 33916 - protein, 7 aa, Artificial Sequence
  Description of Artificial Sequence: Synthetic peptide
LNSTAGK

SEQ ID NO: 33917 - protein, 7 aa, Artificial Sequence
  Description of Artificial Sequence: Synthetic peptide
RDPKAGV

SEQ ID NO: 33918 - protein, 7 aa, Artificial Sequence
  Description of Artificial Sequence: Synthetic peptide
HQSSSSS

SEQ ID NO: 33919 - protein, 7 aa, Artificial Sequence
  Description of Artificial Sequence: Synthetic peptide
DIGNPTN

SEQ ID NO: 33920 - protein, 7 aa, Artificial Sequence
  Description of Artificial Sequence: Synthetic peptide
SSPVSAV

SEQ ID NO: 33921 - protein, 7 aa, Artificial Sequence
  Description of Artificial Sequence: Synthetic peptide
AHQRPIQ

SEQ ID NO: 33922 - protein, 7 aa, Artificial Sequence
  Description of Artificial Sequence: Synthetic peptide
GNGISTK

SEQ ID NO: 33923 - protein, 7 aa, Artificial Sequence
  Description of Artificial Sequence: Synthetic peptide
NGSTSSG

SEQ ID NO: 33924 - protein, 7 aa, Artificial Sequence
  Description of Artificial Sequence: Synthetic peptide
QPSQGHS

SEQ ID NO: 33925 - protein, 7 aa, Artificial Sequence
  Description of Artificial Sequence: Synthetic peptide
SMASAYK

SEQ ID NO: 33926 - protein, 7 aa, Artificial Sequence
  Description of Artificial Sequence: Synthetic peptide
TNGGRVT

SEQ ID NO: 33927 - protein, 7 aa, Artificial Sequence
  Description of Artificial Sequence: Synthetic peptide
KRVTYTD

SEQ ID NO: 33928 - protein, 7 aa, Artificial Sequence
  Description of Artificial Sequence: Synthetic peptide
ARDDQRR

SEQ ID NO: 33929 - protein, 7 aa, Artificial Sequence
  Description of Artificial Sequence: Synthetic peptide
IPASSSG

SEQ ID NO: 33930 - protein, 7 aa, Artificial Sequence
  Description of Artificial Sequence: Synthetic peptide
CVTGGLT

SEQ ID NO: 33931 - protein, 7 aa, Artificial Sequence
  Description of Artificial Sequence: Synthetic peptide
VNGKICS

SEQ ID NO: 33932 - protein, 7 aa, Artificial Sequence
  Description of Artificial Sequence: Synthetic peptide
ATGSPSK

SEQ ID NO: 33933 - protein, 7 aa, Artificial Sequence
  Description of Artificial Sequence: Synthetic peptide
VPGKSAQ

SEQ ID NO: 33934 - protein, 7 aa, Artificial Sequence
  Description of Artificial Sequence: Synthetic peptide
TPSVSTK

SEQ ID NO: 33935 - protein, 7 aa, Artificial Sequence
  Description of Artificial Sequence: Synthetic peptide
RTLNLNT

SEQ ID NO: 33936 - protein, 7 aa, Artificial Sequence
  Description of Artificial Sequence: Synthetic peptide
SDMSGQR

SEQ ID NO: 33937 - protein, 7 aa, Artificial Sequence
  Description of Artificial Sequence: Synthetic peptide
STGKATC

SEQ ID NO: 33938 - protein, 7 aa, Artificial Sequence
  Description of Artificial Sequence: Synthetic peptide
GPSSPRL

SEQ ID NO: 33939 - protein, 7 aa, Artificial Sequence
  Description of Artificial Sequence: Synthetic peptide
PRTNNPS

SEQ ID NO: 33940 - protein, 7 aa, Artificial Sequence
  Description of Artificial Sequence: Synthetic peptide
GGNDRFR

SEQ ID NO: 33941 - protein, 7 aa, Artificial Sequence
  Description of Artificial Sequence: Synthetic peptide
TISTRQS

SEQ ID NO: 33942 - protein, 7 aa, Artificial Sequence
  Description of Artificial Sequence: Synthetic peptide
QGTTARS

SEQ ID NO: 33943 - protein, 7 aa, Artificial Sequence
  Description of Artificial Sequence: Synthetic peptide
ELRTNAL

SEQ ID NO: 33944 - protein, 7 aa, Artificial Sequence
  Description of Artificial Sequence: Synthetic peptide
TGVSPLA

SEQ ID NO: 33945 - protein, 7 aa, Artificial Sequence
  Description of Artificial Sequence: Synthetic peptide
SHATAAT

SEQ ID NO: 33946 - protein, 7 aa, Artificial Sequence
  Description of Artificial Sequence: Synthetic peptide
SSSRNVA

SEQ ID NO: 33947 - protein, 7 aa, Artificial Sequence
  Description of Artificial Sequence: Synthetic peptide
GINSRGS

SEQ ID NO: 33948 - protein, 7 aa, Artificial Sequence
  Description of Artificial Sequence: Synthetic peptide
MDGRSTT

SEQ ID NO: 33949 - protein, 7 aa, Artificial Sequence
  Description of Artificial Sequence: Synthetic peptide
ERPGGTP

SEQ ID NO: 33950 - protein, 7 aa, Artificial Sequence
  Description of Artificial Sequence: Synthetic peptide
IPSGVHS

SEQ ID NO: 33951 - protein, 7 aa, Artificial Sequence
  Description of Artificial Sequence: Synthetic peptide
PVGSGVP

SEQ ID NO: 33952 - protein, 7 aa, Artificial Sequence
  Description of Artificial Sequence: Synthetic peptide
DARTMAA

SEQ ID NO: 33953 - protein, 7 aa, Artificial Sequence
  Description of Artificial Sequence: Synthetic peptide
YGSNTPT

SEQ ID NO: 33954 - protein, 7 aa, Artificial Sequence
  Description of Artificial Sequence: Synthetic peptide
RVLSNET

SEQ ID NO: 33955 - protein, 7 aa, Artificial Sequence
  Description of Artificial Sequence: Synthetic peptide
SAIRNVT

SEQ ID NO: 33956 - protein, 7 aa, Artificial Sequence
  Description of Artificial Sequence: Synthetic peptide
SGSLSSA

SEQ ID NO: 33957 - protein, 7 aa, Artificial Sequence
  Description of Artificial Sequence: Synthetic peptide
VQPVKMS

SEQ ID NO: 33958 - protein, 7 aa, Artificial Sequence
  Description of Artificial Sequence: Synthetic peptide
TRSKESP

SEQ ID NO: 33959 - protein, 7 aa, Artificial Sequence
  Description of Artificial Sequence: Synthetic peptide
SPGKLTT

SEQ ID NO: 33960 - protein, 7 aa, Artificial Sequence
  Description of Artificial Sequence: Synthetic peptide
VSSNASM

SEQ ID NO: 33961 - protein, 7 aa, Artificial Sequence
  Description of Artificial Sequence: Synthetic peptide
AMGHPLA

SEQ ID NO: 33962 - protein, 7 aa, Artificial Sequence
  Description of Artificial Sequence: Synthetic peptide
MSSKQVS

SEQ ID NO: 33963 - protein, 7 aa, Artificial Sequence
  Description of Artificial Sequence: Synthetic peptide
SISTRTG

SEQ ID NO: 33964 - protein, 7 aa, Artificial Sequence
  Description of Artificial Sequence: Synthetic peptide
GNPSPLV

SEQ ID NO: 33965 - protein, 7 aa, Artificial Sequence
  Description of Artificial Sequence: Synthetic peptide
GVTGTHV

SEQ ID NO: 33966 - protein, 7 aa, Artificial Sequence
  Description of Artificial Sequence: Synthetic peptide
LGTSPMK

SEQ ID NO: 33967 - protein, 7 aa, Artificial Sequence
  Description of Artificial Sequence: Synthetic peptide
STHHPAS

SEQ ID NO: 33968 - protein, 7 aa, Artificial Sequence
  Description of Artificial Sequence: Synthetic peptide
VAGAAQR

SEQ ID NO: 33969 - protein, 7 aa, Artificial Sequence
  Description of Artificial Sequence: Synthetic peptide
GPRSMSN

SEQ ID NO: 33970 - protein, 7 aa, Artificial Sequence
  Description of Artificial Sequence: Synthetic peptide
SPRASLN

SEQ ID NO: 33971 - protein, 7 aa, Artificial Sequence
  Description of Artificial Sequence: Synthetic peptide
SITSVTN

SEQ ID NO: 33972 - protein, 7 aa, Artificial Sequence
  Description of Artificial Sequence: Synthetic peptide
MGAGALT

SEQ ID NO: 33973 - protein, 7 aa, Artificial Sequence
  Description of Artificial Sequence: Synthetic peptide
YAIERVG

SEQ ID NO: 33974 - protein, 7 aa, Artificial Sequence
  Description of Artificial Sequence: Synthetic peptide
PTSNGSL

SEQ ID NO: 33975 - protein, 7 aa, Artificial Sequence
  Description of Artificial Sequence: Synthetic peptide
LTPPGVG

SEQ ID NO: 33976 - protein, 7 aa, Artificial Sequence
  Description of Artificial Sequence: Synthetic peptide
SPHRDTV

SEQ ID NO: 33977 - protein, 7 aa, Artificial Sequence
  Description of Artificial Sequence: Synthetic peptide
AVESSSS

SEQ ID NO: 33978 - protein, 7 aa, Artificial Sequence
  Description of Artificial Sequence: Synthetic peptide
GTSPSTM

SEQ ID NO: 33979 - protein, 7 aa, Artificial Sequence
  Description of Artificial Sequence: Synthetic peptide
DPGTRKS

SEQ ID NO: 33980 - protein, 7 aa, Artificial Sequence
  Description of Artificial Sequence: Synthetic peptide
VVRNSVS

SEQ ID NO: 33981 - protein, 7 aa, Artificial Sequence
  Description of Artificial Sequence: Synthetic peptide
RKMVPYS

SEQ ID NO: 33982 - protein, 7 aa, Artificial Sequence
  Description of Artificial Sequence: Synthetic peptide
CQGQGVS

SEQ ID NO: 33983 - protein, 7 aa, Artificial Sequence
  Description of Artificial Sequence: Synthetic peptide
RIAGPTV

SEQ ID NO: 33984 - protein, 7 aa, Artificial Sequence
  Description of Artificial Sequence: Synthetic peptide
IISQHGM

SEQ ID NO: 33985 - protein, 7 aa, Artificial Sequence
  Description of Artificial Sequence: Synthetic peptide
GNSTANR

SEQ ID NO: 33986 - protein, 7 aa, Artificial Sequence
  Description of Artificial Sequence: Synthetic peptide
SPGRTQS

SEQ ID NO: 33987 - protein, 7 aa, Artificial Sequence
  Description of Artificial Sequence: Synthetic peptide
PISESTR

SEQ ID NO: 33988 - protein, 7 aa, Artificial Sequence
  Description of Artificial Sequence: Synthetic peptide
SSGLSSS

SEQ ID NO: 33989 - protein, 7 aa, Artificial Sequence
  Description of Artificial Sequence: Synthetic peptide
ERNGNFT

SEQ ID NO: 33990 - protein, 7 aa, Artificial Sequence
  Description of Artificial Sequence: Synthetic peptide
GHSQSHQ

SEQ ID NO: 33991 - protein, 7 aa, Artificial Sequence
  Description of Artificial Sequence: Synthetic peptide
GSLGALT

SEQ ID NO: 33992 - protein, 7 aa, Artificial Sequence
  Description of Artificial Sequence: Synthetic peptide
MRQTASL

SEQ ID NO: 33993 - protein, 7 aa, Artificial Sequence
  Description of Artificial Sequence: Synthetic peptide
GQNRNNT

SEQ ID NO: 33994 - protein, 7 aa, Artificial Sequence
  Description of Artificial Sequence: Synthetic peptide
LQSGGHR

SEQ ID NO: 33995 - protein, 7 aa, Artificial Sequence
  Description of Artificial Sequence: Synthetic peptide
AVNTKAL

SEQ ID NO: 33996 - protein, 7 aa, Artificial Sequence
  Description of Artificial Sequence: Synthetic peptide
MGGVTSS

SEQ ID NO: 33997 - protein, 7 aa, Artificial Sequence
  Description of Artificial Sequence: Synthetic peptide
ENNSRAT

SEQ ID NO: 33998 - protein, 7 aa, Artificial Sequence
  Description of Artificial Sequence: Synthetic peptide
QMPGHTG

SEQ ID NO: 33999 - protein, 7 aa, Artificial Sequence
  Description of Artificial Sequence: Synthetic peptide
KPQGSLV

SEQ ID NO: 34000 - protein, 7 aa, Artificial Sequence
  Description of Artificial Sequence: Synthetic peptide
GTGVPGK

SEQ ID NO: 34001 - protein, 7 aa, Artificial Sequence
  Description of Artificial Sequence: Synthetic peptide
GRDNSRQ

SEQ ID NO: 34002 - protein, 7 aa, Artificial Sequence
  Description of Artificial Sequence: Synthetic peptide
SGNDKNN

SEQ ID NO: 34003 - protein, 7 aa, Artificial Sequence
  Description of Artificial Sequence: Synthetic peptide
SVNSRSE

SEQ ID NO: 34004 - protein, 7 aa, Artificial Sequence
  Description of Artificial Sequence: Synthetic peptide
VTHGRPG

SEQ ID NO: 34005 - protein, 7 aa, Artificial Sequence
  Description of Artificial Sequence: Synthetic peptide
SNSDRAN

SEQ ID NO: 34006 - protein, 7 aa, Artificial Sequence
  Description of Artificial Sequence: Synthetic peptide
HTTGILG

SEQ ID NO: 34007 - protein, 7 aa, Artificial Sequence
  Description of Artificial Sequence: Synthetic peptide
GRVVSMQ

SEQ ID NO: 34008 - protein, 7 aa, Artificial Sequence
  Description of Artificial Sequence: Synthetic peptide
SGPQPVA

SEQ ID NO: 34009 - protein, 7 aa, Artificial Sequence
  Description of Artificial Sequence: Synthetic peptide
TPTTSAN

SEQ ID NO: 34010 - protein, 7 aa, Artificial Sequence
  Description of Artificial Sequence: Synthetic peptide
RQDSTPG

SEQ ID NO: 34011 - protein, 7 aa, Artificial Sequence
  Description of Artificial Sequence: Synthetic peptide
HQPHQNQ

SEQ ID NO: 34012 - protein, 7 aa, Artificial Sequence
  Description of Artificial Sequence: Synthetic peptide
GMIPSSR

SEQ ID NO: 34013 - protein, 7 aa, Artificial Sequence
  Description of Artificial Sequence: Synthetic peptide
RTASSLP

SEQ ID NO: 34014 - protein, 7 aa, Artificial Sequence
  Description of Artificial Sequence: Synthetic peptide
LERNGLK

SEQ ID NO: 34015 - protein, 7 aa, Artificial Sequence
  Description of Artificial Sequence: Synthetic peptide
HMKHLQV

SEQ ID NO: 34016 - protein, 7 aa, Artificial Sequence
  Description of Artificial Sequence: Synthetic peptide
ATIGHNR

SEQ ID NO: 34017 - protein, 7 aa, Artificial Sequence
  Description of Artificial Sequence: Synthetic peptide
HAHSNVG

SEQ ID NO: 34018 - protein, 7 aa, Artificial Sequence
  Description of Artificial Sequence: Synthetic peptide
SNRQHGL

SEQ ID NO: 34019 - protein, 7 aa, Artificial Sequence
  Description of Artificial Sequence: Synthetic peptide
SSMSHQK

SEQ ID NO: 34020 - protein, 7 aa, Artificial Sequence
  Description of Artificial Sequence: Synthetic peptide
YHSKGTT

SEQ ID NO: 34021 - protein, 7 aa, Artificial Sequence
  Description of Artificial Sequence: Synthetic peptide
YQVPLAK

SEQ ID NO: 34022 - protein, 7 aa, Artificial Sequence
  Description of Artificial Sequence: Synthetic peptide
LSRQHNS

SEQ ID NO: 34023 - protein, 7 aa, Artificial Sequence
  Description of Artificial Sequence: Synthetic peptide
NSSGQNQ

SEQ ID NO: 34024 - protein, 7 aa, Artificial Sequence
  Description of Artificial Sequence: Synthetic peptide
PHQRAGS

SEQ ID NO: 34025 - protein, 7 aa, Artificial Sequence
  Description of Artificial Sequence: Synthetic peptide
ALRTSNY

SEQ ID NO: 34026 - protein, 7 aa, Artificial Sequence
  Description of Artificial Sequence: Synthetic peptide
DNTGRNA

SEQ ID NO: 34027 - protein, 7 aa, Artificial Sequence
  Description of Artificial Sequence: Synthetic peptide
HSHGKSI

SEQ ID NO: 34028 - protein, 7 aa, Artificial Sequence
  Description of Artificial Sequence: Synthetic peptide
KTSTPYS

SEQ ID NO: 34029 - protein, 7 aa, Artificial Sequence
  Description of Artificial Sequence: Synthetic peptide
MSLPGQR

SEQ ID NO: 34030 - protein, 7 aa, Artificial Sequence
  Description of Artificial Sequence: Synthetic peptide
HMNRKLE

SEQ ID NO: 34031 - protein, 7 aa, Artificial Sequence
  Description of Artificial Sequence: Synthetic peptide
GGSNSRL

SEQ ID NO: 34032 - protein, 7 aa, Artificial Sequence
  Description of Artificial Sequence: Synthetic peptide
RSDPTRG

SEQ ID NO: 34033 - protein, 7 aa, Artificial Sequence
  Description of Artificial Sequence: Synthetic peptide
RDSTKLV

SEQ ID NO: 34034 - protein, 7 aa, Artificial Sequence
  Description of Artificial Sequence: Synthetic peptide
HVVEQFK

SEQ ID NO: 34035 - protein, 7 aa, Artificial Sequence
  Description of Artificial Sequence: Synthetic peptide
KTNSESM

SEQ ID NO: 34036 - protein, 7 aa, Artificial Sequence
  Description of Artificial Sequence: Synthetic peptide
SRKNNTL

SEQ ID NO: 34037 - protein, 7 aa, Artificial Sequence
  Description of Artificial Sequence: Synthetic peptide
SHNRTND

SEQ ID NO: 34038 - protein, 7 aa, Artificial Sequence
  Description of Artificial Sequence: Synthetic peptide
QSISHTR

SEQ ID NO: 34039 - protein, 7 aa, Artificial Sequence
  Description of Artificial Sequence: Synthetic peptide
TNNSHHS

SEQ ID NO: 34040 - protein, 7 aa, Artificial Sequence
  Description of Artificial Sequence: Synthetic peptide
SLNSREG

SEQ ID NO: 34041 - protein, 7 aa, Artificial Sequence
  Description of Artificial Sequence: Synthetic peptide
SNVSKPQ

SEQ ID NO: 34042 - protein, 7 aa, Artificial Sequence
  Description of Artificial Sequence: Synthetic peptide
TETRSAN

SEQ ID NO: 34043 - protein, 7 aa, Artificial Sequence
  Description of Artificial Sequence: Synthetic peptide
YNGGNRS

SEQ ID NO: 34044 - protein, 7 aa, Artificial Sequence
  Description of Artificial Sequence: Synthetic peptide
LNHSKYS

SEQ ID NO: 34045 - protein, 7 aa, Artificial Sequence
  Description of Artificial Sequence: Synthetic peptide
DPLRSMH

SEQ ID NO: 34046 - protein, 7 aa, Artificial Sequence
  Description of Artificial Sequence: Synthetic peptide
ITSTGSS

SEQ ID NO: 34047 - protein, 7 aa, Artificial Sequence
  Description of Artificial Sequence: Synthetic peptide
YASSRDG

SEQ ID NO: 34048 - protein, 7 aa, Artificial Sequence
  Description of Artificial Sequence: Synthetic peptide
FARSASS

SEQ ID NO: 34049 - protein, 7 aa, Artificial Sequence
  Description of Artificial Sequence: Synthetic peptide
MGHKVEA

SEQ ID NO: 34050 - protein, 7 aa, Artificial Sequence
  Description of Artificial Sequence: Synthetic peptide
DTATRNR

SEQ ID NO: 34051 - protein, 7 aa, Artificial Sequence
  Description of Artificial Sequence: Synthetic peptide
TFSKGTN

SEQ ID NO: 34052 - protein, 7 aa, Artificial Sequence
  Description of Artificial Sequence: Synthetic peptide
MRANHTS

SEQ ID NO: 34053 - protein, 7 aa, Artificial Sequence
  Description of Artificial Sequence: Synthetic peptide
TSTSPMK

SEQ ID NO: 34054 - protein, 7 aa, Artificial Sequence
  Description of Artificial Sequence: Synthetic peptide
STPHHTT

SEQ ID NO: 34055 - protein, 7 aa, Artificial Sequence
  Description of Artificial Sequence: Synthetic peptide
LGHQGHL

SEQ ID NO: 34056 - protein, 7 aa, Artificial Sequence
  Description of Artificial Sequence: Synthetic peptide
AATRQPD

SEQ ID NO: 34057 - protein, 7 aa, Artificial Sequence
  Description of Artificial Sequence: Synthetic peptide
ITGNRHS

SEQ ID NO: 34058 - protein, 7 aa, Artificial Sequence
  Description of Artificial Sequence: Synthetic peptide
NSGPPKP

SEQ ID NO: 34059 - protein, 7 aa, Artificial Sequence
  Description of Artificial Sequence: Synthetic peptide
CQSSRVT

SEQ ID NO: 34060 - protein, 7 aa, Artificial Sequence
  Description of Artificial Sequence: Synthetic peptide
SAGTSVG

SEQ ID NO: 34061 - protein, 7 aa, Artificial Sequence
  Description of Artificial Sequence: Synthetic peptide
SPSSPHD

SEQ ID NO: 34062 - protein, 7 aa, Artificial Sequence
  Description of Artificial Sequence: Synthetic peptide
LRAEHVR

SEQ ID NO: 34063 - protein, 7 aa, Artificial Sequence
  Description of Artificial Sequence: Synthetic peptide
FANTANR

SEQ ID NO: 34064 - protein, 7 aa, Artificial Sequence
  Description of Artificial Sequence: Synthetic peptide
NALPVTQ

SEQ ID NO: 34065 - protein, 7 aa, Artificial Sequence
  Description of Artificial Sequence: Synthetic peptide
RASGVTN

SEQ ID NO: 34066 - protein, 7 aa, Artificial Sequence
  Description of Artificial Sequence: Synthetic peptide
PPSNGRL

SEQ ID NO: 34067 - protein, 7 aa, Artificial Sequence
  Description of Artificial Sequence: Synthetic peptide
GVRSVAG

SEQ ID NO: 34068 - protein, 7 aa, Artificial Sequence
  Description of Artificial Sequence: Synthetic peptide
LGSSTIL

SEQ ID NO: 34069 - protein, 7 aa, Artificial Sequence
  Description of Artificial Sequence: Synthetic peptide
HSVNGHS

SEQ ID NO: 34070 - protein, 7 aa, Artificial Sequence
  Description of Artificial Sequence: Synthetic peptide
LGASTIL

SEQ ID NO: 34071 - protein, 7 aa, Artificial Sequence
  Description of Artificial Sequence: Synthetic peptide
CLSSSAK

SEQ ID NO: 34072 - protein, 7 aa, Artificial Sequence
  Description of Artificial Sequence: Synthetic peptide
EPVTSKS

SEQ ID NO: 34073 - protein, 7 aa, Artificial Sequence
  Description of Artificial Sequence: Synthetic peptide
EMRVERP

SEQ ID NO: 34074 - protein, 7 aa, Artificial Sequence
  Description of Artificial Sequence: Synthetic peptide
YSKQNLT

SEQ ID NO: 34075 - protein, 7 aa, Artificial Sequence
  Description of Artificial Sequence: Synthetic peptide
DGQERSS

SEQ ID NO: 34076 - protein, 7 aa, Artificial Sequence
  Description of Artificial Sequence: Synthetic peptide
LSKQAYC

SEQ ID NO: 34077 - protein, 7 aa, Artificial Sequence
  Description of Artificial Sequence: Synthetic peptide
TGITKLS

SEQ ID NO: 34078 - protein, 7 aa, Artificial Sequence
  Description of Artificial Sequence: Synthetic peptide
NRVGSIS

SEQ ID NO: 34079 - protein, 7 aa, Artificial Sequence
  Description of Artificial Sequence: Synthetic peptide
APSAGMS

SEQ ID NO: 34080 - protein, 7 aa, Artificial Sequence
  Description of Artificial Sequence: Synthetic peptide
HSGTRTS

SEQ ID NO: 34081 - protein, 7 aa, Artificial Sequence
  Description of Artificial Sequence: Synthetic peptide
SPNNRGM

SEQ ID NO: 34082 - protein, 7 aa, Artificial Sequence
  Description of Artificial Sequence: Synthetic peptide
PSVRTLG

SEQ ID NO: 34083 - protein, 7 aa, Artificial Sequence
  Description of Artificial Sequence: Synthetic peptide
RENNTSS

SEQ ID NO: 34084 - protein, 7 aa, Artificial Sequence
  Description of Artificial Sequence: Synthetic peptide
QPTQRMG

SEQ ID NO: 34085 - protein, 7 aa, Artificial Sequence
  Description of Artificial Sequence: Synthetic peptide
QEGVRSS

SEQ ID NO: 34086 - protein, 7 aa, Artificial Sequence
  Description of Artificial Sequence: Synthetic peptide
WTGVPPS

SEQ ID NO: 34087 - protein, 7 aa, Artificial Sequence
  Description of Artificial Sequence: Synthetic peptide
QPTTSAL

SEQ ID NO: 34088 - protein, 7 aa, Artificial Sequence
  Description of Artificial Sequence: Synthetic peptide
HATSGTR

SEQ ID NO: 34089 - protein, 7 aa, Artificial Sequence
  Description of Artificial Sequence: Synthetic peptide
DRVTGKM

SEQ ID NO: 34090 - protein, 7 aa, Artificial Sequence
  Description of Artificial Sequence: Synthetic peptide
STFSPSK

SEQ ID NO: 34091 - protein, 7 aa, Artificial Sequence
  Description of Artificial Sequence: Synthetic peptide
QRNVSVV

SEQ ID NO: 34092 - protein, 7 aa, Artificial Sequence
  Description of Artificial Sequence: Synthetic peptide
DSPNRGR

SEQ ID NO: 34093 - protein, 7 aa, Artificial Sequence
  Description of Artificial Sequence: Synthetic peptide
IPHAGTA

SEQ ID NO: 34094 - protein, 7 aa, Artificial Sequence
  Description of Artificial Sequence: Synthetic peptide
SHTPKLV

SEQ ID NO: 34095 - protein, 7 aa, Artificial Sequence
  Description of Artificial Sequence: Synthetic peptide
FLKGTGS

SEQ ID NO: 34096 - protein, 7 aa, Artificial Sequence
  Description of Artificial Sequence: Synthetic peptide
SRSTGTL

SEQ ID NO: 34097 - protein, 7 aa, Artificial Sequence
  Description of Artificial Sequence: Synthetic peptide
SPLLDYK

SEQ ID NO: 34098 - protein, 7 aa, Artificial Sequence
  Description of Artificial Sequence: Synthetic peptide
GDTRLNA

SEQ ID NO: 34099 - protein, 7 aa, Artificial Sequence
  Description of Artificial Sequence: Synthetic peptide
TQRSQAA

SEQ ID NO: 34100 - protein, 7 aa, Artificial Sequence
  Description of Artificial Sequence: Synthetic peptide
EISRPAS

SEQ ID NO: 34101 - protein, 7 aa, Artificial Sequence
  Description of Artificial Sequence: Synthetic peptide
RSNGSAA

SEQ ID NO: 34102 - protein, 7 aa, Artificial Sequence
  Description of Artificial Sequence: Synthetic peptide
SDRNMSR

SEQ ID NO: 34103 - protein, 7 aa, Artificial Sequence
  Description of Artificial Sequence: Synthetic peptide
YRHERLS

SEQ ID NO: 34104 - protein, 7 aa, Artificial Sequence
  Description of Artificial Sequence: Synthetic peptide
SQQTTEA

SEQ ID NO: 34105 - protein, 7 aa, Artificial Sequence
  Description of Artificial Sequence: Synthetic peptide
RSGNGSL

SEQ ID NO: 34106 - protein, 7 aa, Artificial Sequence
  Description of Artificial Sequence: Synthetic peptide
FSTIKGV

SEQ ID NO: 34107 - protein, 7 aa, Artificial Sequence
  Description of Artificial Sequence: Synthetic peptide
VGSSIKT

SEQ ID NO: 34108 - protein, 7 aa, Artificial Sequence
  Description of Artificial Sequence: Synthetic peptide
PSGPVRG

SEQ ID NO: 34109 - protein, 7 aa, Artificial Sequence
  Description of Artificial Sequence: Synthetic peptide
ARDPGGV

SEQ ID NO: 34110 - protein, 7 aa, Artificial Sequence
  Description of Artificial Sequence: Synthetic peptide
QVTGASH

SEQ ID NO: 34111 - protein, 7 aa, Artificial Sequence
  Description of Artificial Sequence: Synthetic peptide
LRNGIAS

SEQ ID NO: 34112 - protein, 7 aa, Artificial Sequence
  Description of Artificial Sequence: Synthetic peptide
TGSSSSQ

SEQ ID NO: 34113 - protein, 7 aa, Artificial Sequence
  Description of Artificial Sequence: Synthetic peptide
STSRDAT

SEQ ID NO: 34114 - protein, 7 aa, Artificial Sequence
  Description of Artificial Sequence: Synthetic peptide
NTLQGHR

SEQ ID NO: 34115 - protein, 7 aa, Artificial Sequence
  Description of Artificial Sequence: Synthetic peptide
MSGVTAR

SEQ ID NO: 34116 - protein, 7 aa, Artificial Sequence
  Description of Artificial Sequence: Synthetic peptide
PHTNNPD

SEQ ID NO: 34117 - protein, 7 aa, Artificial Sequence
  Description of Artificial Sequence: Synthetic peptide
HQPEKIA

SEQ ID NO: 34118 - protein, 7 aa, Artificial Sequence
  Description of Artificial Sequence: Synthetic peptide
GASTPRL

SEQ ID NO: 34119 - protein, 7 aa, Artificial Sequence
  Description of Artificial Sequence: Synthetic peptide
PTMQGVH

SEQ ID NO: 34120 - protein, 7 aa, Artificial Sequence
  Description of Artificial Sequence: Synthetic peptide
STMTTRR

SEQ ID NO: 34121 - protein, 7 aa, Artificial Sequence
  Description of Artificial Sequence: Synthetic peptide
DSTLGQS

SEQ ID NO: 34122 - protein, 7 aa, Artificial Sequence
  Description of Artificial Sequence: Synthetic peptide
VATRGDH

SEQ ID NO: 34123 - protein, 7 aa, Artificial Sequence
  Description of Artificial Sequence: Synthetic peptide
CLTDARA

SEQ ID NO: 34124 - protein, 7 aa, Artificial Sequence
  Description of Artificial Sequence: Synthetic peptide
STNGNGL

SEQ ID NO: 34125 - protein, 7 aa, Artificial Sequence
  Description of Artificial Sequence: Synthetic peptide
YNHGSVD

SEQ ID NO: 34126 - protein, 7 aa, Artificial Sequence
  Description of Artificial Sequence: Synthetic peptide
HDSSART

SEQ ID NO: 34127 - protein, 7 aa, Artificial Sequence
  Description of Artificial Sequence: Synthetic peptide
VSDSNTK

SEQ ID NO: 34128 - protein, 7 aa, Artificial Sequence
  Description of Artificial Sequence: Synthetic peptide
HTTGIIG

SEQ ID NO: 34129 - protein, 7 aa, Artificial Sequence
  Description of Artificial Sequence: Synthetic peptide
ASSLLNV

SEQ ID NO: 34130 - protein, 7 aa, Artificial Sequence
  Description of Artificial Sequence: Synthetic peptide
PYAPRKD

SEQ ID NO: 34131 - protein, 7 aa, Artificial Sequence
  Description of Artificial Sequence: Synthetic peptide
SVTGGRG

SEQ ID NO: 34132 - protein, 7 aa, Artificial Sequence
  Description of Artificial Sequence: Synthetic peptide
TLPTSIR

SEQ ID NO: 34133 - protein, 7 aa, Artificial Sequence
  Description of Artificial Sequence: Synthetic peptide
GRHGAPT

SEQ ID NO: 34134 - protein, 7 aa, Artificial Sequence
  Description of Artificial Sequence: Synthetic peptide
KSTHGMT

SEQ ID NO: 34135 - protein, 7 aa, Artificial Sequence
  Description of Artificial Sequence: Synthetic peptide
NLHATPL

SEQ ID NO: 34136 - protein, 7 aa, Artificial Sequence
  Description of Artificial Sequence: Synthetic peptide
VSGQTSG

SEQ ID NO: 34137 - protein, 7 aa, Artificial Sequence
  Description of Artificial Sequence: Synthetic peptide
PGREKTV

SEQ ID NO: 34138 - protein, 7 aa, Artificial Sequence
  Description of Artificial Sequence: Synthetic peptide
PTSSPQR

SEQ ID NO: 34139 - protein, 7 aa, Artificial Sequence
  Description of Artificial Sequence: Synthetic peptide
TTMSKVG

SEQ ID NO: 34140 - protein, 7 aa, Artificial Sequence
  Description of Artificial Sequence: Synthetic peptide
TYNSSQA

SEQ ID NO: 34141 - protein, 7 aa, Artificial Sequence
  Description of Artificial Sequence: Synthetic peptide
LNVGSVR

SEQ ID NO: 34142 - protein, 7 aa, Artificial Sequence
  Description of Artificial Sequence: Synthetic peptide
RDATSIG

SEQ ID NO: 34143 - protein, 7 aa, Artificial Sequence
  Description of Artificial Sequence: Synthetic peptide
VSTGSFT

SEQ ID NO: 34144 - protein, 7 aa, Artificial Sequence
  Description of Artificial Sequence: Synthetic peptide
RFDSVKD

SEQ ID NO: 34145 - protein, 7 aa, Artificial Sequence
  Description of Artificial Sequence: Synthetic peptide
LLGDTKP

SEQ ID NO: 34146 - protein, 7 aa, Artificial Sequence
  Description of Artificial Sequence: Synthetic peptide
GSKNADY

SEQ ID NO: 34147 - protein, 7 aa, Artificial Sequence
  Description of Artificial Sequence: Synthetic peptide
NNGRPIA

SEQ ID NO: 34148 - protein, 7 aa, Artificial Sequence
  Description of Artificial Sequence: Synthetic peptide
EVPKPGR

SEQ ID NO: 34149 - protein, 7 aa, Artificial Sequence
  Description of Artificial Sequence: Synthetic peptide
NTHNIQG

SEQ ID NO: 34150 - protein, 7 aa, Artificial Sequence
  Description of Artificial Sequence: Synthetic peptide
SGRDKFS

SEQ ID NO: 34151 - protein, 7 aa, Artificial Sequence
  Description of Artificial Sequence: Synthetic peptide
PRTDRNT

SEQ ID NO: 34152 - protein, 7 aa, Artificial Sequence
  Description of Artificial Sequence: Synthetic peptide
VSSPRMS

SEQ ID NO: 34153 - protein, 7 aa, Artificial Sequence
  Description of Artificial Sequence: Synthetic peptide
QTHAPTS

SEQ ID NO: 34154 - protein, 7 aa, Artificial Sequence
  Description of Artificial Sequence: Synthetic peptide
SDSRNTN

SEQ ID NO: 34155 - protein, 7 aa, Artificial Sequence
  Description of Artificial Sequence: Synthetic peptide
RQTTPLG

SEQ ID NO: 34156 - protein, 7 aa, Artificial Sequence
  Description of Artificial Sequence: Synthetic peptide
EATSSTK

SEQ ID NO: 34157 - protein, 7 aa, Artificial Sequence
  Description of Artificial Sequence: Synthetic peptide
GSRNSSA

SEQ ID NO: 34158 - protein, 7 aa, Artificial Sequence
  Description of Artificial Sequence: Synthetic peptide
LNIANSK

SEQ ID NO: 34159 - protein, 7 aa, Artificial Sequence
  Description of Artificial Sequence: Synthetic peptide
LMSNNQP

SEQ ID NO: 34160 - protein, 7 aa, Artificial Sequence
  Description of Artificial Sequence: Synthetic peptide
HLAMNRN

SEQ ID NO: 34161 - protein, 7 aa, Artificial Sequence
  Description of Artificial Sequence: Synthetic peptide
SVSSPRD

SEQ ID NO: 34162 - protein, 7 aa, Artificial Sequence
  Description of Artificial Sequence: Synthetic peptide
IMDKHLN

SEQ ID NO: 34163 - protein, 7 aa, Artificial Sequence
  Description of Artificial Sequence: Synthetic peptide
RGLDSIN

SEQ ID NO: 34164 - protein, 7 aa, Artificial Sequence
  Description of Artificial Sequence: Synthetic peptide
GAKPGLA

SEQ ID NO: 34165 - protein, 7 aa, Artificial Sequence
  Description of Artificial Sequence: Synthetic peptide
VRSRESP

SEQ ID NO: 34166 - protein, 7 aa, Artificial Sequence
  Description of Artificial Sequence: Synthetic peptide
TVNTRSA

SEQ ID NO: 34167 - protein, 7 aa, Artificial Sequence
  Description of Artificial Sequence: Synthetic peptide
GTPNNRS

SEQ ID NO: 34168 - protein, 7 aa, Artificial Sequence
  Description of Artificial Sequence: Synthetic peptide
EGLNTSR

SEQ ID NO: 34169 - protein, 7 aa, Artificial Sequence
  Description of Artificial Sequence: Synthetic peptide
PGLSNSR

SEQ ID NO: 34170 - protein, 7 aa, Artificial Sequence
  Description of Artificial Sequence: Synthetic peptide
VGNNNRL

SEQ ID NO: 34171 - protein, 7 aa, Artificial Sequence
  Description of Artificial Sequence: Synthetic peptide
PMEVRSD

SEQ ID NO: 34172 - protein, 7 aa, Artificial Sequence
  Description of Artificial Sequence: Synthetic peptide
LPITARN

SEQ ID NO: 34173 - protein, 7 aa, Artificial Sequence
  Description of Artificial Sequence: Synthetic peptide
AQRSTMV

SEQ ID NO: 34174 - protein, 7 aa, Artificial Sequence
  Description of Artificial Sequence: Synthetic peptide
GNSMAGT

SEQ ID NO: 34175 - protein, 7 aa, Artificial Sequence
  Description of Artificial Sequence: Synthetic peptide
PLPKNSS

SEQ ID NO: 34176 - protein, 7 aa, Artificial Sequence
  Description of Artificial Sequence: Synthetic peptide
SGSSKPT

SEQ ID NO: 34177 - protein, 7 aa, Artificial Sequence
  Description of Artificial Sequence: Synthetic peptide
INFSGTR

SEQ ID NO: 34178 - protein, 7 aa, Artificial Sequence
  Description of Artificial Sequence: Synthetic peptide
SPMGVTR

SEQ ID NO: 34179 - protein, 7 aa, Artificial Sequence
  Description of Artificial Sequence: Synthetic peptide
MYQKPAS

SEQ ID NO: 34180 - protein, 7 aa, Artificial Sequence
  Description of Artificial Sequence: Synthetic peptide
GTFSTQS

SEQ ID NO: 34181 - protein, 7 aa, Artificial Sequence
  Description of Artificial Sequence: Synthetic peptide
ANTSGQA

SEQ ID NO: 34182 - protein, 7 aa, Artificial Sequence
  Description of Artificial Sequence: Synthetic peptide
FGSRNEG

SEQ ID NO: 34183 - protein, 7 aa, Artificial Sequence
  Description of Artificial Sequence: Synthetic peptide
PGDSGKV

SEQ ID NO: 34184 - protein, 7 aa, Artificial Sequence
  Description of Artificial Sequence: Synthetic peptide
NASTANM

SEQ ID NO: 34185 - protein, 7 aa, Artificial Sequence
  Description of Artificial Sequence: Synthetic peptide
NSRESQG

SEQ ID NO: 34186 - protein, 7 aa, Artificial Sequence
  Description of Artificial Sequence: Synthetic peptide
SGAGSAG

SEQ ID NO: 34187 - protein, 7 aa, Artificial Sequence
  Description of Artificial Sequence: Synthetic peptide
ATGNGRG

SEQ ID NO: 34188 - protein, 7 aa, Artificial Sequence
  Description of Artificial Sequence: Synthetic peptide
LTAKSSQ

SEQ ID NO: 34189 - protein, 7 aa, Artificial Sequence
  Description of Artificial Sequence: Synthetic peptide
SSYTGQR

SEQ ID NO: 34190 - protein, 7 aa, Artificial Sequence
  Description of Artificial Sequence: Synthetic peptide
QSLTRTH

SEQ ID NO: 34191 - protein, 7 aa, Artificial Sequence
  Description of Artificial Sequence: Synthetic peptide
NSASLNH

SEQ ID NO: 34192 - protein, 7 aa, Artificial Sequence
  Description of Artificial Sequence: Synthetic peptide
LNQHSSL

SEQ ID NO: 34193 - protein, 7 aa, Artificial Sequence
  Description of Artificial Sequence: Synthetic peptide
PTLGGPM

SEQ ID NO: 34194 - protein, 7 aa, Artificial Sequence
  Description of Artificial Sequence: Synthetic peptide
PNVGVVR

SEQ ID NO: 34195 - protein, 7 aa, Artificial Sequence
  Description of Artificial Sequence: Synthetic peptide
SSAPSLS

SEQ ID NO: 34196 - protein, 7 aa, Artificial Sequence
  Description of Artificial Sequence: Synthetic peptide
PLSKSAL

SEQ ID NO: 34197 - protein, 7 aa, Artificial Sequence
  Description of Artificial Sequence: Synthetic peptide
YATDGLK

SEQ ID NO: 34198 - protein, 7 aa, Artificial Sequence
  Description of Artificial Sequence: Synthetic peptide
DISRSHG

SEQ ID NO: 34199 - protein, 7 aa, Artificial Sequence
  Description of Artificial Sequence: Synthetic peptide
GTARTTG

SEQ ID NO: 34200 - protein, 7 aa, Artificial Sequence
  Description of Artificial Sequence: Synthetic peptide
CRHTPGN

SEQ ID NO: 34201 - protein, 7 aa, Artificial Sequence
  Description of Artificial Sequence: Synthetic peptide
CPQSREK

SEQ ID NO: 34202 - protein, 7 aa, Artificial Sequence
  Description of Artificial Sequence: Synthetic peptide
HTTGIIG

SEQ ID NO: 34203 - protein, 7 aa, Artificial Sequence
  Description of Artificial Sequence: Synthetic peptide
GLVPNLI

SEQ ID NO: 34204 - protein, 7 aa, Artificial Sequence
  Description of Artificial Sequence: Synthetic peptide
FTASGGN

SEQ ID NO: 34205 - protein, 7 aa, Artificial Sequence
  Description of Artificial Sequence: Synthetic peptide
SIKSVTN

SEQ ID NO: 34206 - protein, 7 aa, Artificial Sequence
  Description of Artificial Sequence: Synthetic peptide
SYSSSQL

SEQ ID NO: 34207 - protein, 7 aa, Artificial Sequence
  Description of Artificial Sequence: Synthetic peptide
LSSDKNV

SEQ ID NO: 34208 - protein, 7 aa, Artificial Sequence
  Description of Artificial Sequence: Synthetic peptide
DRYNRQL

SEQ ID NO: 34209 - protein, 7 aa, Artificial Sequence
  Description of Artificial Sequence: Synthetic peptide
SSDQPRL

SEQ ID NO: 34210 - protein, 7 aa, Artificial Sequence
  Description of Artificial Sequence: Synthetic peptide
HYNQTGL

SEQ ID NO: 34211 - protein, 7 aa, Artificial Sequence
  Description of Artificial Sequence: Synthetic peptide
GGTNNLN

SEQ ID NO: 34212 - protein, 7 aa, Artificial Sequence
  Description of Artificial Sequence: Synthetic peptide
QVPVRPV

SEQ ID NO: 34213 - protein, 7 aa, Artificial Sequence
  Description of Artificial Sequence: Synthetic peptide
IQTHTSN

SEQ ID NO: 34214 - protein, 7 aa, Artificial Sequence
  Description of Artificial Sequence: Synthetic peptide
QYNQAGL

SEQ ID NO: 34215 - protein, 7 aa, Artificial Sequence
  Description of Artificial Sequence: Synthetic peptide
YEKNSLM

SEQ ID NO: 34216 - protein, 7 aa, Artificial Sequence
  Description of Artificial Sequence: Synthetic peptide
NDVKQGH

SEQ ID NO: 34217 - protein, 7 aa, Artificial Sequence
  Description of Artificial Sequence: Synthetic peptide
NSITRSS

SEQ ID NO: 34218 - protein, 7 aa, Artificial Sequence
  Description of Artificial Sequence: Synthetic peptide
PQHSVYS

SEQ ID NO: 34219 - protein, 7 aa, Artificial Sequence
  Description of Artificial Sequence: Synthetic peptide
DKTESLG

SEQ ID NO: 34220 - protein, 7 aa, Artificial Sequence
  Description of Artificial Sequence: Synthetic peptide
STSGTSS

SEQ ID NO: 34221 - protein, 7 aa, Artificial Sequence
  Description of Artificial Sequence: Synthetic peptide
ITATAES

SEQ ID NO: 34222 - protein, 7 aa, Artificial Sequence
  Description of Artificial Sequence: Synthetic peptide
MSSERPG

SEQ ID NO: 34223 - protein, 7 aa, Artificial Sequence
  Description of Artificial Sequence: Synthetic peptide
HQLEAHK

SEQ ID NO: 34224 - protein, 7 aa, Artificial Sequence
  Description of Artificial Sequence: Synthetic peptide
TTHSSIN

SEQ ID NO: 34225 - protein, 7 aa, Artificial Sequence
  Description of Artificial Sequence: Synthetic peptide
YRVGSIS

SEQ ID NO: 34226 - protein, 7 aa, Artificial Sequence
  Description of Artificial Sequence: Synthetic peptide
RFDSVKD

SEQ ID NO: 34227 - protein, 7 aa, Artificial Sequence
  Description of Artificial Sequence: Synthetic peptide
LGSSTIL

SEQ ID NO: 34228 - protein, 7 aa, Artificial Sequence
  Description of Artificial Sequence: Synthetic peptide
RLSNAYA

SEQ ID NO: 34229 - protein, 7 aa, Artificial Sequence
  Description of Artificial Sequence: Synthetic peptide
ASLKTQM

SEQ ID NO: 34230 - protein, 7 aa, Artificial Sequence
  Description of Artificial Sequence: Synthetic peptide
AGGINKL

SEQ ID NO: 34231 - protein, 7 aa, Artificial Sequence
  Description of Artificial Sequence: Synthetic peptide
NTYQSKN

SEQ ID NO: 34232 - protein, 7 aa, Artificial Sequence
  Description of Artificial Sequence: Synthetic peptide
STMKSAA

SEQ ID NO: 34233 - protein, 7 aa, Artificial Sequence
  Description of Artificial Sequence: Synthetic peptide
RDLGHDN

SEQ ID NO: 34234 - protein, 7 aa, Artificial Sequence
  Description of Artificial Sequence: Synthetic peptide
MTASLGM

SEQ ID NO: 34235 - protein, 7 aa, Artificial Sequence
  Description of Artificial Sequence: Synthetic peptide
RQIGKQV

SEQ ID NO: 34236 - protein, 7 aa, Artificial Sequence
  Description of Artificial Sequence: Synthetic peptide
VLATKDC

SEQ ID NO: 34237 - protein, 7 aa, Artificial Sequence
  Description of Artificial Sequence: Synthetic peptide
GVNNNIN

SEQ ID NO: 34238 - protein, 7 aa, Artificial Sequence
  Description of Artificial Sequence: Synthetic peptide
KTGDQMG

SEQ ID NO: 34239 - protein, 7 aa, Artificial Sequence
  Description of Artificial Sequence: Synthetic peptide
VSGMSGS

SEQ ID NO: 34240 - protein, 7 aa, Artificial Sequence
  Description of Artificial Sequence: Synthetic peptide
PDSTFSS

SEQ ID NO: 34241 - protein, 7 aa, Artificial Sequence
  Description of Artificial Sequence: Synthetic peptide
LILPGNN

SEQ ID NO: 34242 - protein, 7 aa, Artificial Sequence
  Description of Artificial Sequence: Synthetic peptide
GSNINNG

SEQ ID NO: 34243 - protein, 7 aa, Artificial Sequence
  Description of Artificial Sequence: Synthetic peptide
KNGSVAL

SEQ ID NO: 34244 - protein, 7 aa, Artificial Sequence
  Description of Artificial Sequence: Synthetic peptide
KFPPNSG

SEQ ID NO: 34245 - protein, 7 aa, Artificial Sequence
  Description of Artificial Sequence: Synthetic peptide
INTGSVK

SEQ ID NO: 34246 - protein, 7 aa, Artificial Sequence
  Description of Artificial Sequence: Synthetic peptide
ENNALSR

SEQ ID NO: 34247 - protein, 7 aa, Artificial Sequence
  Description of Artificial Sequence: Synthetic peptide
SPRDRTS

SEQ ID NO: 34248 - protein, 7 aa, Artificial Sequence
  Description of Artificial Sequence: Synthetic peptide
HSENGNR

SEQ ID NO: 34249 - protein, 7 aa, Artificial Sequence
  Description of Artificial Sequence: Synthetic peptide
YRSKEIG

SEQ ID NO: 34250 - protein, 7 aa, Artificial Sequence
  Description of Artificial Sequence: Synthetic peptide
GSAGNML

SEQ ID NO: 34251 - protein, 7 aa, Artificial Sequence
  Description of Artificial Sequence: Synthetic peptide
NIAQKEL

SEQ ID NO: 34252 - protein, 7 aa, Artificial Sequence
  Description of Artificial Sequence: Synthetic peptide
PQNNQAH

SEQ ID NO: 34253 - protein, 7 aa, Artificial Sequence
  Description of Artificial Sequence: Synthetic peptide
LSNQNNQ

SEQ ID NO: 34254 - protein, 7 aa, Artificial Sequence
  Description of Artificial Sequence: Synthetic peptide
ESNSSRG

SEQ ID NO: 34255 - protein, 7 aa, Artificial Sequence
  Description of Artificial Sequence: Synthetic peptide
NSSGQNP

SEQ ID NO: 34256 - protein, 7 aa, Artificial Sequence
  Description of Artificial Sequence: Synthetic peptide
SNVAKRT

SEQ ID NO: 34257 - protein, 7 aa, Artificial Sequence
  Description of Artificial Sequence: Synthetic peptide
VSKSPST

SEQ ID NO: 34258 - protein, 7 aa, Artificial Sequence
  Description of Artificial Sequence: Synthetic peptide
SREKNNA

SEQ ID NO: 34259 - protein, 7 aa, Artificial Sequence
  Description of Artificial Sequence: Synthetic peptide
GVSNLAS

SEQ ID NO: 34260 - protein, 7 aa, Artificial Sequence
  Description of Artificial Sequence: Synthetic peptide
ERNGNFT

SEQ ID NO: 34261 - protein, 7 aa, Artificial Sequence
  Description of Artificial Sequence: Synthetic peptide
DQGNGYG

SEQ ID NO: 34262 - protein, 7 aa, Artificial Sequence
  Description of Artificial Sequence: Synthetic peptide
CRSAPTR

SEQ ID NO: 34263 - protein, 7 aa, Artificial Sequence
  Description of Artificial Sequence: Synthetic peptide
DSKQNLT

SEQ ID NO: 34264 - protein, 7 aa, Artificial Sequence
  Description of Artificial Sequence: Synthetic peptide
NGSAQNQ

SEQ ID NO: 34265 - protein, 7 aa, Artificial Sequence
  Description of Artificial Sequence: Synthetic peptide
LREGERT

SEQ ID NO: 34266 - protein, 7 aa, Artificial Sequence
  Description of Artificial Sequence: Synthetic peptide
STSRLPS

SEQ ID NO: 34267 - protein, 7 aa, Artificial Sequence
  Description of Artificial Sequence: Synthetic peptide
SSSAKSI

SEQ ID NO: 34268 - protein, 7 aa, Artificial Sequence
  Description of Artificial Sequence: Synthetic peptide
GHVSSYM

SEQ ID NO: 34269 - protein, 7 aa, Artificial Sequence
  Description of Artificial Sequence: Synthetic peptide
QAKNIHS

SEQ ID NO: 34270 - protein, 7 aa, Artificial Sequence
  Description of Artificial Sequence: Synthetic peptide
LNSMSPR

SEQ ID NO: 34271 - protein, 7 aa, Artificial Sequence
  Description of Artificial Sequence: Synthetic peptide
MSHTNRP

SEQ ID NO: 34272 - protein, 7 aa, Artificial Sequence
  Description of Artificial Sequence: Synthetic peptide
GSNRMSS

SEQ ID NO: 34273 - protein, 7 aa, Artificial Sequence
  Description of Artificial Sequence: Synthetic peptide
HMNRKLE

SEQ ID NO: 34274 - protein, 7 aa, Artificial Sequence
  Description of Artificial Sequence: Synthetic peptide
SDRSVDG

SEQ ID NO: 34275 - protein, 7 aa, Artificial Sequence
  Description of Artificial Sequence: Synthetic peptide
HTANSQS

SEQ ID NO: 34276 - protein, 7 aa, Artificial Sequence
  Description of Artificial Sequence: Synthetic peptide
PSTGNSV

SEQ ID NO: 34277 - protein, 7 aa, Artificial Sequence
  Description of Artificial Sequence: Synthetic peptide
TSHMQLS

SEQ ID NO: 34278 - protein, 7 aa, Artificial Sequence
  Description of Artificial Sequence: Synthetic peptide
VSDNTYK

SEQ ID NO: 34279 - protein, 7 aa, Artificial Sequence
  Description of Artificial Sequence: Synthetic peptide
FRQTSGN

SEQ ID NO: 34280 - protein, 7 aa, Artificial Sequence
  Description of Artificial Sequence: Synthetic peptide
VHTSGVQ

SEQ ID NO: 34281 - protein, 7 aa, Artificial Sequence
  Description of Artificial Sequence: Synthetic peptide
PQSSHQT

SEQ ID NO: 34282 - protein, 7 aa, Artificial Sequence
  Description of Artificial Sequence: Synthetic peptide
HGMEVAR

SEQ ID NO: 34283 - protein, 7 aa, Artificial Sequence
  Description of Artificial Sequence: Synthetic peptide
TEARSAN

SEQ ID NO: 34284 - protein, 7 aa, Artificial Sequence
  Description of Artificial Sequence: Synthetic peptide
SNTNAAM

SEQ ID NO: 34285 - protein, 7 aa, Artificial Sequence
  Description of Artificial Sequence: Synthetic peptide
QLGDRNR

SEQ ID NO: 34286 - protein, 7 aa, Artificial Sequence
  Description of Artificial Sequence: Synthetic peptide
TPSVTNM

SEQ ID NO: 34287 - protein, 7 aa, Artificial Sequence
  Description of Artificial Sequence: Synthetic peptide
NLGNSLK

SEQ ID NO: 34288 - protein, 7 aa, Artificial Sequence
  Description of Artificial Sequence: Synthetic peptide
SLITMKD

SEQ ID NO: 34289 - protein, 7 aa, Artificial Sequence
  Description of Artificial Sequence: Synthetic peptide
SSPSNMA

SEQ ID NO: 34290 - protein, 7 aa, Artificial Sequence
  Description of Artificial Sequence: Synthetic peptide
PSLERGS

SEQ ID NO: 34291 - protein, 7 aa, Artificial Sequence
  Description of Artificial Sequence: Synthetic peptide
QTSSHAY

SEQ ID NO: 34292 - protein, 7 aa, Artificial Sequence
  Description of Artificial Sequence: Synthetic peptide
GVERMRG

SEQ ID NO: 34293 - protein, 7 aa, Artificial Sequence
  Description of Artificial Sequence: Synthetic peptide
DYSETRR

SEQ ID NO: 34294 - protein, 7 aa, Artificial Sequence
  Description of Artificial Sequence: Synthetic peptide
FPNVNSA

SEQ ID NO: 34295 - protein, 7 aa, Artificial Sequence
  Description of Artificial Sequence: Synthetic peptide
HGSKPYI

SEQ ID NO: 34296 - protein, 7 aa, Artificial Sequence
  Description of Artificial Sequence: Synthetic peptide
RYPPATH

SEQ ID NO: 34297 - protein, 7 aa, Artificial Sequence
  Description of Artificial Sequence: Synthetic peptide
ATVSKTA

SEQ ID NO: 34298 - protein, 7 aa, Artificial Sequence
  Description of Artificial Sequence: Synthetic peptide
GPDTHSQ

SEQ ID NO: 34299 - protein, 7 aa, Artificial Sequence
  Description of Artificial Sequence: Synthetic peptide
GDLNPPS

SEQ ID NO: 34300 - protein, 7 aa, Artificial Sequence
  Description of Artificial Sequence: Synthetic peptide
AQRNISS

SEQ ID NO: 34301 - protein, 7 aa, Artificial Sequence
  Description of Artificial Sequence: Synthetic peptide
RTNVMAG

SEQ ID NO: 34302 - protein, 7 aa, Artificial Sequence
  Description of Artificial Sequence: Synthetic peptide
TPTPVNQ

SEQ ID NO: 34303 - protein, 7 aa, Artificial Sequence
  Description of Artificial Sequence: Synthetic peptide
IHATSLA

SEQ ID NO: 34304 - protein, 7 aa, Artificial Sequence
  Description of Artificial Sequence: Synthetic peptide
QSEIVNK

SEQ ID NO: 34305 - protein, 7 aa, Artificial Sequence
  Description of Artificial Sequence: Synthetic peptide
FNSSSSK

SEQ ID NO: 34306 - protein, 7 aa, Artificial Sequence
  Description of Artificial Sequence: Synthetic peptide
WQTGSTM

SEQ ID NO: 34307 - protein, 7 aa, Artificial Sequence
  Description of Artificial Sequence: Synthetic peptide
TSLSPSV

SEQ ID NO: 34308 - protein, 7 aa, Artificial Sequence
  Description of Artificial Sequence: Synthetic peptide
YSTHLNN

SEQ ID NO: 34309 - protein, 7 aa, Artificial Sequence
  Description of Artificial Sequence: Synthetic peptide
VTNSAPT

SEQ ID NO: 34310 - protein, 7 aa, Artificial Sequence
  Description of Artificial Sequence: Synthetic peptide
QDKHNPG

SEQ ID NO: 34311 - protein, 7 aa, Artificial Sequence
  Description of Artificial Sequence: Synthetic peptide
DGGNQRS

SEQ ID NO: 34312 - protein, 7 aa, Artificial Sequence
  Description of Artificial Sequence: Synthetic peptide
HQPEKIA

SEQ ID NO: 34313 - protein, 7 aa, Artificial Sequence
  Description of Artificial Sequence: Synthetic peptide
YIDASAR

SEQ ID NO: 34314 - protein, 7 aa, Artificial Sequence
  Description of Artificial Sequence: Synthetic peptide
NISSKVA

SEQ ID NO: 34315 - protein, 7 aa, Artificial Sequence
  Description of Artificial Sequence: Synthetic peptide
MATAHGG

SEQ ID NO: 34316 - protein, 7 aa, Artificial Sequence
  Description of Artificial Sequence: Synthetic peptide
CSTGTRK

SEQ ID NO: 34317 - protein, 7 aa, Artificial Sequence
  Description of Artificial Sequence: Synthetic peptide
SGSLSSA

SEQ ID NO: 34318 - protein, 7 aa, Artificial Sequence
  Description of Artificial Sequence: Synthetic peptide
NLKNQVA

SEQ ID NO: 34319 - protein, 7 aa, Artificial Sequence
  Description of Artificial Sequence: Synthetic peptide
PRENKFS

SEQ ID NO: 34320 - protein, 7 aa, Artificial Sequence
  Description of Artificial Sequence: Synthetic peptide
GARPVLQ

SEQ ID NO: 34321 - protein, 7 aa, Artificial Sequence
  Description of Artificial Sequence: Synthetic peptide
NFSNPTV

SEQ ID NO: 34322 - protein, 7 aa, Artificial Sequence
  Description of Artificial Sequence: Synthetic peptide
LGNAHQL

SEQ ID NO: 34323 - protein, 7 aa, Artificial Sequence
  Description of Artificial Sequence: Synthetic peptide
HTPDVGK

SEQ ID NO: 34324 - protein, 7 aa, Artificial Sequence
  Description of Artificial Sequence: Synthetic peptide
VKSNNLP

SEQ ID NO: 34325 - protein, 7 aa, Artificial Sequence
  Description of Artificial Sequence: Synthetic peptide
PRKDDSM

SEQ ID NO: 34326 - protein, 7 aa, Artificial Sequence
  Description of Artificial Sequence: Synthetic peptide
GVPAGHT

SEQ ID NO: 34327 - protein, 7 aa, Artificial Sequence
  Description of Artificial Sequence: Synthetic peptide
DREATSR

SEQ ID NO: 34328 - protein, 7 aa, Artificial Sequence
  Description of Artificial Sequence: Synthetic peptide
ARADSNF

SEQ ID NO: 34329 - protein, 7 aa, Artificial Sequence
  Description of Artificial Sequence: Synthetic peptide
GTVDKAS

SEQ ID NO: 34330 - protein, 7 aa, Artificial Sequence
  Description of Artificial Sequence: Synthetic peptide
RSTNTDN

SEQ ID NO: 34331 - protein, 7 aa, Artificial Sequence
  Description of Artificial Sequence: Synthetic peptide
TGAGGYC

SEQ ID NO: 34332 - protein, 7 aa, Artificial Sequence
  Description of Artificial Sequence: Synthetic peptide
YIHNQTG

SEQ ID NO: 34333 - protein, 7 aa, Artificial Sequence
  Description of Artificial Sequence: Synthetic peptide
RTVPSSL

SEQ ID NO: 34334 - protein, 7 aa, Artificial Sequence
  Description of Artificial Sequence: Synthetic peptide
AMSSNNG

SEQ ID NO: 34335 - protein, 7 aa, Artificial Sequence
  Description of Artificial Sequence: Synthetic peptide
GGHKSLN

SEQ ID NO: 34336 - protein, 7 aa, Artificial Sequence
  Description of Artificial Sequence: Synthetic peptide
AFGGETK

SEQ ID NO: 34337 - protein, 7 aa, Artificial Sequence
  Description of Artificial Sequence: Synthetic peptide
QGSGSNH

SEQ ID NO: 34338 - protein, 7 aa, Artificial Sequence
  Description of Artificial Sequence: Synthetic peptide
CLRSSSN

SEQ ID NO: 34339 - protein, 7 aa, Artificial Sequence
  Description of Artificial Sequence: Synthetic peptide
ENRTSVQ

SEQ ID NO: 34340 - protein, 7 aa, Artificial Sequence
  Description of Artificial Sequence: Synthetic peptide
NSVAGMG

SEQ ID NO: 34341 - protein, 7 aa, Artificial Sequence
  Description of Artificial Sequence: Synthetic peptide
SRHDGKG

SEQ ID NO: 34342 - protein, 7 aa, Artificial Sequence
  Description of Artificial Sequence: Synthetic peptide
QKTQTTS

SEQ ID NO: 34343 - protein, 7 aa, Artificial Sequence
  Description of Artificial Sequence: Synthetic peptide
HRLPSHS

SEQ ID NO: 34344 - protein, 7 aa, Artificial Sequence
  Description of Artificial Sequence: Synthetic peptide
NNRSGMG

SEQ ID NO: 34345 - protein, 7 aa, Artificial Sequence
  Description of Artificial Sequence: Synthetic peptide
GAKESQS

SEQ ID NO: 34346 - protein, 7 aa, Artificial Sequence
  Description of Artificial Sequence: Synthetic peptide
MTESSRT

SEQ ID NO: 34347 - protein, 7 aa, Artificial Sequence
  Description of Artificial Sequence: Synthetic peptide
TEQVGTR

SEQ ID NO: 34348 - protein, 7 aa, Artificial Sequence
  Description of Artificial Sequence: Synthetic peptide
DVLSKSQ

SEQ ID NO: 34349 - protein, 7 aa, Artificial Sequence
  Description of Artificial Sequence: Synthetic peptide
QGSSLRT

SEQ ID NO: 34350 - protein, 7 aa, Artificial Sequence
  Description of Artificial Sequence: Synthetic peptide
LGIMDKG

SEQ ID NO: 34351 - protein, 7 aa, Artificial Sequence
  Description of Artificial Sequence: Synthetic peptide
PMINSSD

SEQ ID NO: 34352 - protein, 7 aa, Artificial Sequence
  Description of Artificial Sequence: Synthetic peptide
GAYNHVT

SEQ ID NO: 34353 - protein, 7 aa, Artificial Sequence
  Description of Artificial Sequence: Synthetic peptide
ITSASPC

SEQ ID NO: 34354 - protein, 7 aa, Artificial Sequence
  Description of Artificial Sequence: Synthetic peptide
TSRGNLS

SEQ ID NO: 34355 - protein, 7 aa, Artificial Sequence
  Description of Artificial Sequence: Synthetic peptide
TPGSTIR

SEQ ID NO: 34356 - protein, 7 aa, Artificial Sequence
  Description of Artificial Sequence: Synthetic peptide
GPDNGIQ

SEQ ID NO: 34357 - protein, 7 aa, Artificial Sequence
  Description of Artificial Sequence: Synthetic peptide
YSMRPTE

SEQ ID NO: 34358 - protein, 7 aa, Artificial Sequence
  Description of Artificial Sequence: Synthetic peptide
DMVSPRN

SEQ ID NO: 34359 - protein, 7 aa, Artificial Sequence
  Description of Artificial Sequence: Synthetic peptide
KNQAPLL

SEQ ID NO: 34360 - protein, 7 aa, Artificial Sequence
  Description of Artificial Sequence: Synthetic peptide
LDAGVAR

SEQ ID NO: 34361 - protein, 7 aa, Artificial Sequence
  Description of Artificial Sequence: Synthetic peptide
PRTRENQ

SEQ ID NO: 34362 - protein, 7 aa, Artificial Sequence
  Description of Artificial Sequence: Synthetic peptide
RTSSTYS

SEQ ID NO: 34363 - protein, 7 aa, Artificial Sequence
  Description of Artificial Sequence: Synthetic peptide
SVVAHGP

SEQ ID NO: 34364 - protein, 7 aa, Artificial Sequence
  Description of Artificial Sequence: Synthetic peptide
NPVAAAT

SEQ ID NO: 34365 - protein, 7 aa, Artificial Sequence
  Description of Artificial Sequence: Synthetic peptide
LAQERGT

SEQ ID NO: 34366 - protein, 7 aa, Artificial Sequence
  Description of Artificial Sequence: Synthetic peptide
AHKSAMN

SEQ ID NO: 34367 - protein, 7 aa, Artificial Sequence
  Description of Artificial Sequence: Synthetic peptide
LTQRDFS

SEQ ID NO: 34368 - protein, 7 aa, Artificial Sequence
  Description of Artificial Sequence: Synthetic peptide
QSGNTIQ

SEQ ID NO: 34369 - protein, 7 aa, Artificial Sequence
  Description of Artificial Sequence: Synthetic peptide
NLNSVSK

SEQ ID NO: 34370 - protein, 7 aa, Artificial Sequence
  Description of Artificial Sequence: Synthetic peptide
YGSNTPT

SEQ ID NO: 34371 - protein, 7 aa, Artificial Sequence
  Description of Artificial Sequence: Synthetic peptide
REGGQMV

SEQ ID NO: 34372 - protein, 7 aa, Artificial Sequence
  Description of Artificial Sequence: Synthetic peptide
NDQAKLT

SEQ ID NO: 34373 - protein, 7 aa, Artificial Sequence
  Description of Artificial Sequence: Synthetic peptide
VSGTKIE

SEQ ID NO: 34374 - protein, 7 aa, Artificial Sequence
  Description of Artificial Sequence: Synthetic peptide
QSHGITN

SEQ ID NO: 34375 - protein, 7 aa, Artificial Sequence
  Description of Artificial Sequence: Synthetic peptide
HRVDNQG

SEQ ID NO: 34376 - protein, 7 aa, Artificial Sequence
  Description of Artificial Sequence: Synthetic peptide
HSTSGGH

SEQ ID NO: 34377 - protein, 7 aa, Artificial Sequence
  Description of Artificial Sequence: Synthetic peptide
SDSRNPV

SEQ ID NO: 34378 - protein, 7 aa, Artificial Sequence
  Description of Artificial Sequence: Synthetic peptide
DINRQRT

SEQ ID NO: 34379 - protein, 7 aa, Artificial Sequence
  Description of Artificial Sequence: Synthetic peptide
PGTGSNH

SEQ ID NO: 34380 - protein, 7 aa, Artificial Sequence
  Description of Artificial Sequence: Synthetic peptide
SHDNGQS

SEQ ID NO: 34381 - protein, 7 aa, Artificial Sequence
  Description of Artificial Sequence: Synthetic peptide
VLHNASS

SEQ ID NO: 34382 - protein, 7 aa, Artificial Sequence
  Description of Artificial Sequence: Synthetic peptide
YSGASGR

SEQ ID NO: 34383 - protein, 7 aa, Artificial Sequence
  Description of Artificial Sequence: Synthetic peptide
RDHSGSR

SEQ ID NO: 34384 - protein, 7 aa, Artificial Sequence
  Description of Artificial Sequence: Synthetic peptide
GVNLHAD

SEQ ID NO: 34385 - protein, 7 aa, Artificial Sequence
  Description of Artificial Sequence: Synthetic peptide
VNGHGVS

SEQ ID NO: 34386 - protein, 7 aa, Artificial Sequence
  Description of Artificial Sequence: Synthetic peptide
DPLGKQG

SEQ ID NO: 34387 - protein, 7 aa, Artificial Sequence
  Description of Artificial Sequence: Synthetic peptide
FVSREHT

SEQ ID NO: 34388 - protein, 7 aa, Artificial Sequence
  Description of Artificial Sequence: Synthetic peptide
NSAAAPA

SEQ ID NO: 34389 - protein, 7 aa, Artificial Sequence
  Description of Artificial Sequence: Synthetic peptide
HTTGILG

SEQ ID NO: 34390 - protein, 7 aa, Artificial Sequence
  Description of Artificial Sequence: Synthetic peptide
NAQVTTG

SEQ ID NO: 34391 - protein, 7 aa, Artificial Sequence
  Description of Artificial Sequence: Synthetic peptide
YAQSPSS

SEQ ID NO: 34392 - protein, 7 aa, Artificial Sequence
  Description of Artificial Sequence: Synthetic peptide
NIAQKDL

SEQ ID NO: 34393 - protein, 7 aa, Artificial Sequence
  Description of Artificial Sequence: Synthetic peptide
MIRDGSS

SEQ ID NO: 34394 - protein, 7 aa, Artificial Sequence
  Description of Artificial Sequence: Synthetic peptide
PNGHEVL

SEQ ID NO: 34395 - protein, 7 aa, Artificial Sequence
  Description of Artificial Sequence: Synthetic peptide
SVSSPRD

SEQ ID NO: 34396 - protein, 7 aa, Artificial Sequence
  Description of Artificial Sequence: Synthetic peptide
RTLRSVD

SEQ ID NO: 34397 - protein, 7 aa, Artificial Sequence
  Description of Artificial Sequence: Synthetic peptide
NSHNGAS

SEQ ID NO: 34398 - protein, 7 aa, Artificial Sequence
  Description of Artificial Sequence: Synthetic peptide
TLPTKYP

SEQ ID NO: 34399 - protein, 7 aa, Artificial Sequence
  Description of Artificial Sequence: Synthetic peptide
LSTANKS

SEQ ID NO: 34400 - protein, 7 aa, Artificial Sequence
  Description of Artificial Sequence: Synthetic peptide
YPNSVPS

SEQ ID NO: 34401 - protein, 7 aa, Artificial Sequence
  Description of Artificial Sequence: Synthetic peptide
IISQHGM

SEQ ID NO: 34402 - protein, 7 aa, Artificial Sequence
  Description of Artificial Sequence: Synthetic peptide
PGPEVGR

SEQ ID NO: 34403 - protein, 7 aa, Artificial Sequence
  Description of Artificial Sequence: Synthetic peptide
ATNKTTN

SEQ ID NO: 34404 - protein, 7 aa, Artificial Sequence
  Description of Artificial Sequence: Synthetic peptide
LPHHTSA

SEQ ID NO: 34405 - protein, 7 aa, Artificial Sequence
  Description of Artificial Sequence: Synthetic peptide
SYGGQSR

SEQ ID NO: 34406 - protein, 7 aa, Artificial Sequence
  Description of Artificial Sequence: Synthetic peptide
HMAASTG

SEQ ID NO: 34407 - protein, 7 aa, Artificial Sequence
  Description of Artificial Sequence: Synthetic peptide
PIHTRID

SEQ ID NO: 34408 - protein, 7 aa, Artificial Sequence
  Description of Artificial Sequence: Synthetic peptide
PRSLSTS

SEQ ID NO: 34409 - protein, 7 aa, Artificial Sequence
  Description of Artificial Sequence: Synthetic peptide
RAGNAPT

SEQ ID NO: 34410 - protein, 7 aa, Artificial Sequence
  Description of Artificial Sequence: Synthetic peptide
PYAGNQR

SEQ ID NO: 34411 - protein, 7 aa, Artificial Sequence
  Description of Artificial Sequence: Synthetic peptide
SRDSSIH

SEQ ID NO: 34412 - protein, 7 aa, Artificial Sequence
  Description of Artificial Sequence: Synthetic peptide
NVTTPLI

SEQ ID NO: 34413 - protein, 7 aa, Artificial Sequence
  Description of Artificial Sequence: Synthetic peptide
SNQVRQI

SEQ ID NO: 34414 - protein, 7 aa, Artificial Sequence
  Description of Artificial Sequence: Synthetic peptide
TLDNHRS

SEQ ID NO: 34415 - protein, 7 aa, Artificial Sequence
  Description of Artificial Sequence: Synthetic peptide
ELHSKNA

SEQ ID NO: 34416 - protein, 7 aa, Artificial Sequence
  Description of Artificial Sequence: Synthetic peptide
RSYDPNR

SEQ ID NO: 34417 - protein, 7 aa, Artificial Sequence
  Description of Artificial Sequence: Synthetic peptide
LPTDSLR

SEQ ID NO: 34418 - protein, 7 aa, Artificial Sequence
  Description of Artificial Sequence: Synthetic peptide
EVTNSPR

SEQ ID NO: 34419 - protein, 7 aa, Artificial Sequence
  Description of Artificial Sequence: Synthetic peptide
GGQTARI

SEQ ID NO: 34420 - protein, 7 aa, Artificial Sequence
  Description of Artificial Sequence: Synthetic peptide
SAGGAVS

SEQ ID NO: 34421 - protein, 7 aa, Artificial Sequence
  Description of Artificial Sequence: Synthetic peptide
PSHGPPA

SEQ ID NO: 34422 - protein, 7 aa, Artificial Sequence
  Description of Artificial Sequence: Synthetic peptide
YTAASHR

SEQ ID NO: 34423 - protein, 7 aa, Artificial Sequence
  Description of Artificial Sequence: Synthetic peptide
MRANHTS

SEQ ID NO: 34424 - protein, 7 aa, Artificial Sequence
  Description of Artificial Sequence: Synthetic peptide
DVAIQPR

SEQ ID NO: 34425 - protein, 7 aa, Artificial Sequence
  Description of Artificial Sequence: Synthetic peptide
FPSNGRT

SEQ ID NO: 34426 - protein, 7 aa, Artificial Sequence
  Description of Artificial Sequence: Synthetic peptide
SDSRSRS

SEQ ID NO: 34427 - protein, 7 aa, Artificial Sequence
  Description of Artificial Sequence: Synthetic peptide
LMQTHGS

SEQ ID NO: 34428 - protein, 7 aa, Artificial Sequence
  Description of Artificial Sequence: Synthetic peptide
IQSSDRL

SEQ ID NO: 34429 - protein, 7 aa, Artificial Sequence
  Description of Artificial Sequence: Synthetic peptide
IPANSFK

SEQ ID NO: 34430 - protein, 7 aa, Artificial Sequence
  Description of Artificial Sequence: Synthetic peptide
SMSPRNG

SEQ ID NO: 34431 - protein, 7 aa, Artificial Sequence
  Description of Artificial Sequence: Synthetic peptide
GTFSTQS

SEQ ID NO: 34432 - protein, 7 aa, Artificial Sequence
  Description of Artificial Sequence: Synthetic peptide
SASPSIK

SEQ ID NO: 34433 - protein, 7 aa, Artificial Sequence
  Description of Artificial Sequence: Synthetic peptide
YASSRDG

SEQ ID NO: 34434 - protein, 7 aa, Artificial Sequence
  Description of Artificial Sequence: Synthetic peptide
RMKSLDN

SEQ ID NO: 34435 - protein, 7 aa, Artificial Sequence
  Description of Artificial Sequence: Synthetic peptide
PADHGKL

SEQ ID NO: 34436 - protein, 7 aa, Artificial Sequence
  Description of Artificial Sequence: Synthetic peptide
VSDSNTK

SEQ ID NO: 34437 - protein, 7 aa, Artificial Sequence
  Description of Artificial Sequence: Synthetic peptide
KLGQDVR

SEQ ID NO: 34438 - protein, 7 aa, Artificial Sequence
  Description of Artificial Sequence: Synthetic peptide
VGDRSWS

SEQ ID NO: 34439 - protein, 7 aa, Artificial Sequence
  Description of Artificial Sequence: Synthetic peptide
RNGAMSN

SEQ ID NO: 34440 - protein, 7 aa, Artificial Sequence
  Description of Artificial Sequence: Synthetic peptide
SKPANNV

SEQ ID NO: 34441 - protein, 7 aa, Artificial Sequence
  Description of Artificial Sequence: Synthetic peptide
RGAADSN

SEQ ID NO: 34442 - protein, 7 aa, Artificial Sequence
  Description of Artificial Sequence: Synthetic peptide
ALPGSTS

SEQ ID NO: 34443 - protein, 7 aa, Artificial Sequence
  Description of Artificial Sequence: Synthetic peptide
HVQDGRT

SEQ ID NO: 34444 - protein, 7 aa, Artificial Sequence
  Description of Artificial Sequence: Synthetic peptide
NGSGQDQ

SEQ ID NO: 34445 - protein, 7 aa, Artificial Sequence
  Description of Artificial Sequence: Synthetic peptide
NIHLAGT

SEQ ID NO: 34446 - protein, 7 aa, Artificial Sequence
  Description of Artificial Sequence: Synthetic peptide
HGESRQA

SEQ ID NO: 34447 - protein, 7 aa, Artificial Sequence
  Description of Artificial Sequence: Synthetic peptide
ERGKNAL

SEQ ID NO: 34448 - protein, 7 aa, Artificial Sequence
  Description of Artificial Sequence: Synthetic peptide
GIQSSPT

SEQ ID NO: 34449 - protein, 7 aa, Artificial Sequence
  Description of Artificial Sequence: Synthetic peptide
VGSQTNS

SEQ ID NO: 34450 - protein, 7 aa, Artificial Sequence
  Description of Artificial Sequence: Synthetic peptide
DTHVSGR

SEQ ID NO: 34451 - protein, 7 aa, Artificial Sequence
  Description of Artificial Sequence: Synthetic peptide
SSTKSSL

SEQ ID NO: 34452 - protein, 7 aa, Artificial Sequence
  Description of Artificial Sequence: Synthetic peptide
GQIKNLG

SEQ ID NO: 34453 - protein, 7 aa, Artificial Sequence
  Description of Artificial Sequence: Synthetic peptide
KSDAHTA

SEQ ID NO: 34454 - protein, 7 aa, Artificial Sequence
  Description of Artificial Sequence: Synthetic peptide
GQVKAIG

SEQ ID NO: 34455 - protein, 7 aa, Artificial Sequence
  Description of Artificial Sequence: Synthetic peptide
ESATPIR

SEQ ID NO: 34456 - protein, 7 aa, Artificial Sequence
  Description of Artificial Sequence: Synthetic peptide
NNTQKNS

SEQ ID NO: 34457 - protein, 7 aa, Artificial Sequence
  Description of Artificial Sequence: Synthetic peptide
SPGKLTT

SEQ ID NO: 34458 - protein, 7 aa, Artificial Sequence
  Description of Artificial Sequence: Synthetic peptide
LTTGNHI

SEQ ID NO: 34459 - protein, 7 aa, Artificial Sequence
  Description of Artificial Sequence: Synthetic peptide
DDRSARG

SEQ ID NO: 34460 - protein, 7 aa, Artificial Sequence
  Description of Artificial Sequence: Synthetic peptide
FRTQSVG

SEQ ID NO: 34461 - protein, 7 aa, Artificial Sequence
  Description of Artificial Sequence: Synthetic peptide
SAGNHDI

SEQ ID NO: 34462 - protein, 7 aa, Artificial Sequence
  Description of Artificial Sequence: Synthetic peptide
NPGESHR

SEQ ID NO: 34463 - protein, 7 aa, Artificial Sequence
  Description of Artificial Sequence: Synthetic peptide
GTSNRYT

SEQ ID NO: 34464 - protein, 7 aa, Artificial Sequence
  Description of Artificial Sequence: Synthetic peptide
QDATPRS

SEQ ID NO: 34465 - protein, 7 aa, Artificial Sequence
  Description of Artificial Sequence: Synthetic peptide
QMPGHTG

SEQ ID NO: 34466 - protein, 7 aa, Artificial Sequence
  Description of Artificial Sequence: Synthetic peptide
TNRVGYG

SEQ ID NO: 34467 - protein, 7 aa, Artificial Sequence
  Description of Artificial Sequence: Synthetic peptide
QVTAIGA

SEQ ID NO: 34468 - protein, 7 aa, Artificial Sequence
  Description of Artificial Sequence: Synthetic peptide
NGLSQTH

SEQ ID NO: 34469 - protein, 7 aa, Artificial Sequence
  Description of Artificial Sequence: Synthetic peptide
NVATLSA

SEQ ID NO: 34470 - protein, 7 aa, Artificial Sequence
  Description of Artificial Sequence: Synthetic peptide
PSTRQSN

SEQ ID NO: 34471 - protein, 7 aa, Artificial Sequence
  Description of Artificial Sequence: Synthetic peptide
YSGGNMS

SEQ ID NO: 34472 - protein, 7 aa, Artificial Sequence
  Description of Artificial Sequence: Synthetic peptide
TPITPMT

SEQ ID NO: 34473 - protein, 7 aa, Artificial Sequence
  Description of Artificial Sequence: Synthetic peptide
SYASTQQ

SEQ ID NO: 34474 - protein, 7 aa, Artificial Sequence
  Description of Artificial Sequence: Synthetic peptide
TSRTSYE

SEQ ID NO: 34475 - protein, 7 aa, Artificial Sequence
  Description of Artificial Sequence: Synthetic peptide
QGSSPME

SEQ ID NO: 34476 - protein, 7 aa, Artificial Sequence
  Description of Artificial Sequence: Synthetic peptide
LNQIGKS

SEQ ID NO: 34477 - protein, 7 aa, Artificial Sequence
  Description of Artificial Sequence: Synthetic peptide
TSERPTC

SEQ ID NO: 34478 - protein, 7 aa, Artificial Sequence
  Description of Artificial Sequence: Synthetic peptide
DISRSHG

SEQ ID NO: 34479 - protein, 7 aa, Artificial Sequence
  Description of Artificial Sequence: Synthetic peptide
RNNNTPG

SEQ ID NO: 34480 - protein, 7 aa, Artificial Sequence
  Description of Artificial Sequence: Synthetic peptide
RQYTGDS

SEQ ID NO: 34481 - protein, 7 aa, Artificial Sequence
  Description of Artificial Sequence: Synthetic peptide
APTSDHH

SEQ ID NO: 34482 - protein, 7 aa, Artificial Sequence
  Description of Artificial Sequence: Synthetic peptide
CLAQPRV

SEQ ID NO: 34483 - protein, 7 aa, Artificial Sequence
  Description of Artificial Sequence: Synthetic peptide
SSTSLGS

SEQ ID NO: 34484 - protein, 7 aa, Artificial Sequence
  Description of Artificial Sequence: Synthetic peptide
KTPQLSQ

SEQ ID NO: 34485 - protein, 7 aa, Artificial Sequence
  Description of Artificial Sequence: Synthetic peptide
MGVGMNG

SEQ ID NO: 34486 - protein, 7 aa, Artificial Sequence
  Description of Artificial Sequence: Synthetic peptide
SVSNTNT

SEQ ID NO: 34487 - protein, 7 aa, Artificial Sequence
  Description of Artificial Sequence: Synthetic peptide
HVIAPQQ

SEQ ID NO: 34488 - protein, 7 aa, Artificial Sequence
  Description of Artificial Sequence: Synthetic peptide
GNTNSFL

SEQ ID NO: 34489 - protein, 7 aa, Artificial Sequence
  Description of Artificial Sequence: Synthetic peptide
GAKPGLA

SEQ ID NO: 34490 - protein, 7 aa, Artificial Sequence
  Description of Artificial Sequence: Synthetic peptide
VSGTPRV

SEQ ID NO: 34491 - protein, 7 aa, Artificial Sequence
  Description of Artificial Sequence: Synthetic peptide
SSYVGPS

SEQ ID NO: 34492 - protein, 7 aa, Artificial Sequence
  Description of Artificial Sequence: Synthetic peptide
LIRGGNN

SEQ ID NO: 34493 - protein, 7 aa, Artificial Sequence
  Description of Artificial Sequence: Synthetic peptide
DSIGSSK

SEQ ID NO: 34494 - protein, 7 aa, Artificial Sequence
  Description of Artificial Sequence: Synthetic peptide
RFQNNTG

SEQ ID NO: 34495 - protein, 7 aa, Artificial Sequence
  Description of Artificial Sequence: Synthetic peptide
TSNSNIA

SEQ ID NO: 34496 - protein, 7 aa, Artificial Sequence
  Description of Artificial Sequence: Synthetic peptide
GMHVSNP

SEQ ID NO: 34497 - protein, 7 aa, Artificial Sequence
  Description of Artificial Sequence: Synthetic peptide
SLPNTNG

SEQ ID NO: 34498 - protein, 7 aa, Artificial Sequence
  Description of Artificial Sequence: Synthetic peptide
DPRNSTS

SEQ ID NO: 34499 - protein, 7 aa, Artificial Sequence
  Description of Artificial Sequence: Synthetic peptide
SGSGQNQ

SEQ ID NO: 34500 - protein, 7 aa, Artificial Sequence
  Description of Artificial Sequence: Synthetic peptide
STDRSFN

SEQ ID NO: 34501 - protein, 7 aa, Artificial Sequence
  Description of Artificial Sequence: Synthetic peptide
ETNSRLG

SEQ ID NO: 34502 - protein, 7 aa, Artificial Sequence
  Description of Artificial Sequence: Synthetic peptide
VRHTTDS

SEQ ID NO: 34503 - protein, 7 aa, Artificial Sequence
  Description of Artificial Sequence: Synthetic peptide
TAVTANQ

SEQ ID NO: 34504 - protein, 7 aa, Artificial Sequence
  Description of Artificial Sequence: Synthetic peptide
NNPKNAV

SEQ ID NO: 34505 - protein, 7 aa, Artificial Sequence
  Description of Artificial Sequence: Synthetic peptide
PLRIGTQ

SEQ ID NO: 34506 - protein, 7 aa, Artificial Sequence
  Description of Artificial Sequence: Synthetic peptide
PASLGQG

SEQ ID NO: 34507 - protein, 7 aa, Artificial Sequence
  Description of Artificial Sequence: Synthetic peptide
HNSGNGS

SEQ ID NO: 34508 - protein, 7 aa, Artificial Sequence
  Description of Artificial Sequence: Synthetic peptide
ATHNSSQ

SEQ ID NO: 34509 - protein, 7 aa, Artificial Sequence
  Description of Artificial Sequence: Synthetic peptide
GSHNDSR

SEQ ID NO: 34510 - protein, 7 aa, Artificial Sequence
  Description of Artificial Sequence: Synthetic peptide
AFSHSSG

SEQ ID NO: 34511 - protein, 7 aa, Artificial Sequence
  Description of Artificial Sequence: Synthetic peptide
INSGNGS

SEQ ID NO: 34512 - protein, 7 aa, Artificial Sequence
  Description of Artificial Sequence: Synthetic peptide
SSSHATR

SEQ ID NO: 34513 - protein, 7 aa, Artificial Sequence
  Description of Artificial Sequence: Synthetic peptide
ATGNGRG

SEQ ID NO: 34514 - protein, 7 aa, Artificial Sequence
  Description of Artificial Sequence: Synthetic peptide
LRAGTVR

SEQ ID NO: 34515 - protein, 7 aa, Artificial Sequence
  Description of Artificial Sequence: Synthetic peptide
SNGQRKE

SEQ ID NO: 34516 - protein, 7 aa, Artificial Sequence
  Description of Artificial Sequence: Synthetic peptide
APSAGMS

SEQ ID NO: 34517 - protein, 7 aa, Artificial Sequence
  Description of Artificial Sequence: Synthetic peptide
DRKHTST

SEQ ID NO: 34518 - protein, 7 aa, Artificial Sequence
  Description of Artificial Sequence: Synthetic peptide
GFPVSSM

SEQ ID NO: 34519 - protein, 7 aa, Artificial Sequence
  Description of Artificial Sequence: Synthetic peptide
TVAHPSH

SEQ ID NO: 34520 - protein, 7 aa, Artificial Sequence
  Description of Artificial Sequence: Synthetic peptide
PHTSGRP

SEQ ID NO: 34521 - protein, 7 aa, Artificial Sequence
  Description of Artificial Sequence: Synthetic peptide
NVSSAIK

SEQ ID NO: 34522 - protein, 7 aa, Artificial Sequence
  Description of Artificial Sequence: Synthetic peptide
HYTGKQN

SEQ ID NO: 34523 - protein, 7 aa, Artificial Sequence
  Description of Artificial Sequence: Synthetic peptide
HSSHSPS

SEQ ID NO: 34524 - protein, 7 aa, Artificial Sequence
  Description of Artificial Sequence: Synthetic peptide
TLENSRR

SEQ ID NO: 34525 - protein, 7 aa, Artificial Sequence
  Description of Artificial Sequence: Synthetic peptide
RGNENIN

SEQ ID NO: 34526 - protein, 7 aa, Artificial Sequence
  Description of Artificial Sequence: Synthetic peptide
GQTRESS

SEQ ID NO: 34527 - protein, 7 aa, Artificial Sequence
  Description of Artificial Sequence: Synthetic peptide
NGNISIG

SEQ ID NO: 34528 - protein, 7 aa, Artificial Sequence
  Description of Artificial Sequence: Synthetic peptide
PSSNHVK

SEQ ID NO: 34529 - protein, 7 aa, Artificial Sequence
  Description of Artificial Sequence: Synthetic peptide
GRLNTNG

SEQ ID NO: 34530 - protein, 7 aa, Artificial Sequence
  Description of Artificial Sequence: Synthetic peptide
PTASNRS

SEQ ID NO: 34531 - protein, 7 aa, Artificial Sequence
  Description of Artificial Sequence: Synthetic peptide
CTGSRSM

SEQ ID NO: 34532 - protein, 7 aa, Artificial Sequence
  Description of Artificial Sequence: Synthetic peptide
TSSSQHD

SEQ ID NO: 34533 - protein, 7 aa, Artificial Sequence
  Description of Artificial Sequence: Synthetic peptide
RLPSVSS

SEQ ID NO: 34534 - protein, 7 aa, Artificial Sequence
  Description of Artificial Sequence: Synthetic peptide
YADGARN

SEQ ID NO: 34535 - protein, 7 aa, Artificial Sequence
  Description of Artificial Sequence: Synthetic peptide
PFSEMQK

SEQ ID NO: 34536 - protein, 7 aa, Artificial Sequence
  Description of Artificial Sequence: Synthetic peptide
PDVKVTR

SEQ ID NO: 34537 - protein, 7 aa, Artificial Sequence
  Description of Artificial Sequence: Synthetic peptide
NSSDSLT

SEQ ID NO: 34538 - protein, 7 aa, Artificial Sequence
  Description of Artificial Sequence: Synthetic peptide
MAAKPND

SEQ ID NO: 34539 - protein, 7 aa, Artificial Sequence
  Description of Artificial Sequence: Synthetic peptide
HGDSGKV

SEQ ID NO: 34540 - protein, 7 aa, Artificial Sequence
  Description of Artificial Sequence: Synthetic peptide
GPNISLG

SEQ ID NO: 34541 - protein, 7 aa, Artificial Sequence
  Description of Artificial Sequence: Synthetic peptide
ESARIGS

SEQ ID NO: 34542 - protein, 7 aa, Artificial Sequence
  Description of Artificial Sequence: Synthetic peptide
GGTPTHR

SEQ ID NO: 34543 - protein, 7 aa, Artificial Sequence
  Description of Artificial Sequence: Synthetic peptide
ARNPTST

SEQ ID NO: 34544 - protein, 7 aa, Artificial Sequence
  Description of Artificial Sequence: Synthetic peptide
NTSSSHT

SEQ ID NO: 34545 - protein, 7 aa, Artificial Sequence
  Description of Artificial Sequence: Synthetic peptide
SSGKSFS

SEQ ID NO: 34546 - protein, 7 aa, Artificial Sequence
  Description of Artificial Sequence: Synthetic peptide
SISKTQA

SEQ ID NO: 34547 - protein, 7 aa, Artificial Sequence
  Description of Artificial Sequence: Synthetic peptide
TQSSSRT

SEQ ID NO: 34548 - protein, 7 aa, Artificial Sequence
  Description of Artificial Sequence: Synthetic peptide
HKSSAVG

SEQ ID NO: 34549 - protein, 7 aa, Artificial Sequence
  Description of Artificial Sequence: Synthetic peptide
QEGVRSS

SEQ ID NO: 34550 - protein, 7 aa, Artificial Sequence
  Description of Artificial Sequence: Synthetic peptide
PVRPANL

SEQ ID NO: 34551 - protein, 7 aa, Artificial Sequence
  Description of Artificial Sequence: Synthetic peptide
SVGAPTL

SEQ ID NO: 34552 - protein, 7 aa, Artificial Sequence
  Description of Artificial Sequence: Synthetic peptide
AGSQTGV

SEQ ID NO: 34553 - protein, 7 aa, Artificial Sequence
  Description of Artificial Sequence: Synthetic peptide
FGTNKVD

SEQ ID NO: 34554 - protein, 7 aa, Artificial Sequence
  Description of Artificial Sequence: Synthetic peptide
RGDPHRA

SEQ ID NO: 34555 - protein, 7 aa, Artificial Sequence
  Description of Artificial Sequence: Synthetic peptide
GNRPTTL

SEQ ID NO: 34556 - protein, 7 aa, Artificial Sequence
  Description of Artificial Sequence: Synthetic peptide
TMRPSSD

SEQ ID NO: 34557 - protein, 7 aa, Artificial Sequence
  Description of Artificial Sequence: Synthetic peptide
YGRDKFS

SEQ ID NO: 34558 - protein, 7 aa, Artificial Sequence
  Description of Artificial Sequence: Synthetic peptide
QTRSNGN

SEQ ID NO: 34559 - protein, 7 aa, Artificial Sequence
  Description of Artificial Sequence: Synthetic peptide
SPASLPK

SEQ ID NO: 34560 - protein, 7 aa, Artificial Sequence
  Description of Artificial Sequence: Synthetic peptide
SEVNRGT

SEQ ID NO: 34561 - protein, 7 aa, Artificial Sequence
  Description of Artificial Sequence: Synthetic peptide
GRANGQT

SEQ ID NO: 34562 - protein, 7 aa, Artificial Sequence
  Description of Artificial Sequence: Synthetic peptide
NSYDPKR

SEQ ID NO: 34563 - protein, 7 aa, Artificial Sequence
  Description of Artificial Sequence: Synthetic peptide
FTVTGLS

SEQ ID NO: 34564 - protein, 7 aa, Artificial Sequence
  Description of Artificial Sequence: Synthetic peptide
KADATRT

SEQ ID NO: 34565 - protein, 7 aa, Artificial Sequence
  Description of Artificial Sequence: Synthetic peptide
QMNHLQV

SEQ ID NO: 34566 - protein, 7 aa, Artificial Sequence
  Description of Artificial Sequence: Synthetic peptide
TSGSARG

SEQ ID NO: 34567 - protein, 7 aa, Artificial Sequence
  Description of Artificial Sequence: Synthetic peptide
TGTQGTR

SEQ ID NO: 34568 - protein, 7 aa, Artificial Sequence
  Description of Artificial Sequence: Synthetic peptide
GLESMRQ

SEQ ID NO: 34569 - protein, 7 aa, Artificial Sequence
  Description of Artificial Sequence: Synthetic peptide
PGTTSAM

SEQ ID NO: 34570 - protein, 7 aa, Artificial Sequence
  Description of Artificial Sequence: Synthetic peptide
RTDHGGV

SEQ ID NO: 34571 - protein, 7 aa, Artificial Sequence
  Description of Artificial Sequence: Synthetic peptide
DRVGSIS

SEQ ID NO: 34572 - protein, 7 aa, Artificial Sequence
  Description of Artificial Sequence: Synthetic peptide
DYHNSKL

SEQ ID NO: 34573 - protein, 7 aa, Artificial Sequence
  Description of Artificial Sequence: Synthetic peptide
TPTTSAN

SEQ ID NO: 34574 - protein, 7 aa, Artificial Sequence
  Description of Artificial Sequence: Synthetic peptide
QPINVHN

SEQ ID NO: 34575 - protein, 7 aa, Artificial Sequence
  Description of Artificial Sequence: Synthetic peptide
HGIGNSA

SEQ ID NO: 34576 - protein, 7 aa, Artificial Sequence
  Description of Artificial Sequence: Synthetic peptide
GRTNSYS

SEQ ID NO: 34577 - protein, 7 aa, Artificial Sequence
  Description of Artificial Sequence: Synthetic peptide
TDTSRRQ

SEQ ID NO: 34578 - protein, 7 aa, Artificial Sequence
  Description of Artificial Sequence: Synthetic peptide
LRNSTSV

SEQ ID NO: 34579 - protein, 7 aa, Artificial Sequence
  Description of Artificial Sequence: Synthetic peptide
TRESRTN

SEQ ID NO: 34580 - protein, 7 aa, Artificial Sequence
  Description of Artificial Sequence: Synthetic peptide
GNGISTK

SEQ ID NO: 34581 - protein, 7 aa, Artificial Sequence
  Description of Artificial Sequence: Synthetic peptide
ERHVPSS

SEQ ID NO: 34582 - protein, 7 aa, Artificial Sequence
  Description of Artificial Sequence: Synthetic peptide
FARSASS

SEQ ID NO: 34583 - protein, 7 aa, Artificial Sequence
  Description of Artificial Sequence: Synthetic peptide
PMAQQRA

SEQ ID NO: 34584 - protein, 7 aa, Artificial Sequence
  Description of Artificial Sequence: Synthetic peptide
DRVLSQG

SEQ ID NO: 34585 - protein, 7 aa, Artificial Sequence
  Description of Artificial Sequence: Synthetic peptide
NSASLNH

SEQ ID NO: 34586 - protein, 7 aa, Artificial Sequence
  Description of Artificial Sequence: Synthetic peptide
HRVEGSL

SEQ ID NO: 34587 - protein, 7 aa, Artificial Sequence
  Description of Artificial Sequence: Synthetic peptide
SKATHNI

SEQ ID NO: 34588 - protein, 7 aa, Artificial Sequence
  Description of Artificial Sequence: Synthetic peptide
LSLNKSQ

SEQ ID NO: 34589 - protein, 7 aa, Artificial Sequence
  Description of Artificial Sequence: Synthetic peptide
RDPKSST

SEQ ID NO: 34590 - protein, 7 aa, Artificial Sequence
  Description of Artificial Sequence: Synthetic peptide
TSAAPHA

SEQ ID NO: 34591 - protein, 7 aa, Artificial Sequence
  Description of Artificial Sequence: Synthetic peptide
PTISVDR

SEQ ID NO: 34592 - protein, 7 aa, Artificial Sequence
  Description of Artificial Sequence: Synthetic peptide
HSSKSHD

SEQ ID NO: 34593 - protein, 7 aa, Artificial Sequence
  Description of Artificial Sequence: Synthetic peptide
MGIRDNT

SEQ ID NO: 34594 - protein, 7 aa, Artificial Sequence
  Description of Artificial Sequence: Synthetic peptide
RSSNSDH

SEQ ID NO: 34595 - protein, 7 aa, Artificial Sequence
  Description of Artificial Sequence: Synthetic peptide
DVHRSSG

SEQ ID NO: 34596 - protein, 7 aa, Artificial Sequence
  Description of Artificial Sequence: Synthetic peptide
LSAARSQ

SEQ ID NO: 34597 - protein, 7 aa, Artificial Sequence
  Description of Artificial Sequence: Synthetic peptide
PSKSSSA

SEQ ID NO: 34598 - protein, 7 aa, Artificial Sequence
  Description of Artificial Sequence: Synthetic peptide
QSSQSGP

SEQ ID NO: 34599 - protein, 7 aa, Artificial Sequence
  Description of Artificial Sequence: Synthetic peptide
GGNKQGC

SEQ ID NO: 34600 - protein, 7 aa, Artificial Sequence
  Description of Artificial Sequence: Synthetic peptide
TQRPAQM

SEQ ID NO: 34601 - protein, 7 aa, Artificial Sequence
  Description of Artificial Sequence: Synthetic peptide
AGTRQSC

SEQ ID NO: 34602 - protein, 7 aa, Artificial Sequence
  Description of Artificial Sequence: Synthetic peptide
ANTSGQA

SEQ ID NO: 34603 - protein, 7 aa, Artificial Sequence
  Description of Artificial Sequence: Synthetic peptide
SVGSGAL

SEQ ID NO: 34604 - protein, 7 aa, Artificial Sequence
  Description of Artificial Sequence: Synthetic peptide
DVNTKAL

SEQ ID NO: 34605 - protein, 7 aa, Artificial Sequence
  Description of Artificial Sequence: Synthetic peptide
QGKTAPY

SEQ ID NO: 34606 - protein, 7 aa, Artificial Sequence
  Description of Artificial Sequence: Synthetic peptide
IASSGMH

SEQ ID NO: 34607 - protein, 7 aa, Artificial Sequence
  Description of Artificial Sequence: Synthetic peptide
PSRGVAM

SEQ ID NO: 34608 - protein, 7 aa, Artificial Sequence
  Description of Artificial Sequence: Synthetic peptide
RPATSTP

SEQ ID NO: 34609 - protein, 7 aa, Artificial Sequence
  Description of Artificial Sequence: Synthetic peptide
PIGSQHI

SEQ ID NO: 34610 - protein, 7 aa, Artificial Sequence
  Description of Artificial Sequence: Synthetic peptide
ASSKGLT

SEQ ID NO: 34611 - protein, 7 aa, Artificial Sequence
  Description of Artificial Sequence: Synthetic peptide
YQPERSS

SEQ ID NO: 34612 - protein, 7 aa, Artificial Sequence
  Description of Artificial Sequence: Synthetic peptide
HYGPDSK

SEQ ID NO: 34613 - protein, 7 aa, Artificial Sequence
  Description of Artificial Sequence: Synthetic peptide
PSNKAGT

SEQ ID NO: 34614 - protein, 7 aa, Artificial Sequence
  Description of Artificial Sequence: Synthetic peptide
RVATSVS

SEQ ID NO: 34615 - protein, 7 aa, Artificial Sequence
  Description of Artificial Sequence: Synthetic peptide
QSSNARN

SEQ ID NO: 34616 - protein, 7 aa, Artificial Sequence
  Description of Artificial Sequence: Synthetic peptide
GDMGISK

SEQ ID NO: 34617 - protein, 7 aa, Artificial Sequence
  Description of Artificial Sequence: Synthetic peptide
SSISRTS

SEQ ID NO: 34618 - protein, 7 aa, Artificial Sequence
  Description of Artificial Sequence: Synthetic peptide
HLGVPLK

SEQ ID NO: 34619 - protein, 7 aa, Artificial Sequence
  Description of Artificial Sequence: Synthetic peptide
PNGGIPP

SEQ ID NO: 34620 - protein, 7 aa, Artificial Sequence
  Description of Artificial Sequence: Synthetic peptide
ANPVRPE

SEQ ID NO: 34621 - protein, 7 aa, Artificial Sequence
  Description of Artificial Sequence: Synthetic peptide
SVQGERM

SEQ ID NO: 34622 - protein, 7 aa, Artificial Sequence
  Description of Artificial Sequence: Synthetic peptide
YQHPKMA

SEQ ID NO: 34623 - protein, 7 aa, Artificial Sequence
  Description of Artificial Sequence: Synthetic peptide
TPTLAHG

SEQ ID NO: 34624 - protein, 7 aa, Artificial Sequence
  Description of Artificial Sequence: Synthetic peptide
QPNTTYR

SEQ ID NO: 34625 - protein, 7 aa, Artificial Sequence
  Description of Artificial Sequence: Synthetic peptide
NNAHSSS

SEQ ID NO: 34626 - protein, 7 aa, Artificial Sequence
  Description of Artificial Sequence: Synthetic peptide
HANNGTS

SEQ ID NO: 34627 - protein, 7 aa, Artificial Sequence
  Description of Artificial Sequence: Synthetic peptide
PTGAHVT

SEQ ID NO: 34628 - protein, 7 aa, Artificial Sequence
  Description of Artificial Sequence: Synthetic peptide
GMKGSVN

SEQ ID NO: 34629 - protein, 7 aa, Artificial Sequence
  Description of Artificial Sequence: Synthetic peptide
ISSGTHG

SEQ ID NO: 34630 - protein, 7 aa, Artificial Sequence
  Description of Artificial Sequence: Synthetic peptide
SQSQTPE

SEQ ID NO: 34631 - protein, 7 aa, Artificial Sequence
  Description of Artificial Sequence: Synthetic peptide
RSMSSAV

SEQ ID NO: 34632 - protein, 7 aa, Artificial Sequence
  Description of Artificial Sequence: Synthetic peptide
LRNGIAS

SEQ ID NO: 34633 - protein, 7 aa, Artificial Sequence
  Description of Artificial Sequence: Synthetic peptide
LPSNSIH

SEQ ID NO: 34634 - protein, 7 aa, Artificial Sequence
  Description of Artificial Sequence: Synthetic peptide
PHVMGKH

SEQ ID NO: 34635 - protein, 7 aa, Artificial Sequence
  Description of Artificial Sequence: Synthetic peptide
NRVTQSS

SEQ ID NO: 34636 - protein, 7 aa, Artificial Sequence
  Description of Artificial Sequence: Synthetic peptide
SKSTHQA

SEQ ID NO: 34637 - protein, 7 aa, Artificial Sequence
  Description of Artificial Sequence: Synthetic peptide
LRPANTI

SEQ ID NO: 34638 - protein, 7 aa, Artificial Sequence
  Description of Artificial Sequence: Synthetic peptide
GVEAMRN

SEQ ID NO: 34639 - protein, 7 aa, Artificial Sequence
  Description of Artificial Sequence: Synthetic peptide
QSSHEGR

SEQ ID NO: 34640 - protein, 7 aa, Artificial Sequence
  Description of Artificial Sequence: Synthetic peptide
PKVRDGY

SEQ ID NO: 34641 - protein, 7 aa, Artificial Sequence
  Description of Artificial Sequence: Synthetic peptide
TPAGPNK

SEQ ID NO: 34642 - protein, 7 aa, Artificial Sequence
  Description of Artificial Sequence: Synthetic peptide
NNVGVRG

SEQ ID NO: 34643 - protein, 7 aa, Artificial Sequence
  Description of Artificial Sequence: Synthetic peptide
SKTGTSL

SEQ ID NO: 34644 - protein, 7 aa, Artificial Sequence
  Description of Artificial Sequence: Synthetic peptide
PTVRSST

SEQ ID NO: 34645 - protein, 7 aa, Artificial Sequence
  Description of Artificial Sequence: Synthetic peptide
SVLNRNG

SEQ ID NO: 34646 - protein, 7 aa, Artificial Sequence
  Description of Artificial Sequence: Synthetic peptide
SGSDKFS

SEQ ID NO: 34647 - protein, 7 aa, Artificial Sequence
  Description of Artificial Sequence: Synthetic peptide
IRDSTLG

SEQ ID NO: 34648 - protein, 7 aa, Artificial Sequence
  Description of Artificial Sequence: Synthetic peptide
PSSPTDR

SEQ ID NO: 34649 - protein, 7 aa, Artificial Sequence
  Description of Artificial Sequence: Synthetic peptide
TGHHPPS

SEQ ID NO: 34650 - protein, 7 aa, Artificial Sequence
  Description of Artificial Sequence: Synthetic peptide
NNAATHS

SEQ ID NO: 34651 - protein, 7 aa, Artificial Sequence
  Description of Artificial Sequence: Synthetic peptide
RSGNGSL

SEQ ID NO: 34652 - protein, 7 aa, Artificial Sequence
  Description of Artificial Sequence: Synthetic peptide
LGTSHQQ

SEQ ID NO: 34653 - protein, 7 aa, Artificial Sequence
  Description of Artificial Sequence: Synthetic peptide
TTASSPT

SEQ ID NO: 34654 - protein, 7 aa, Artificial Sequence
  Description of Artificial Sequence: Synthetic peptide
FPLTKPA

SEQ ID NO: 34655 - protein, 7 aa, Artificial Sequence
  Description of Artificial Sequence: Synthetic peptide
PSGETSK

SEQ ID NO: 34656 - protein, 7 aa, Artificial Sequence
  Description of Artificial Sequence: Synthetic peptide
PGLSNSR

SEQ ID NO: 34657 - protein, 7 aa, Artificial Sequence
  Description of Artificial Sequence: Synthetic peptide
DLQTSAK

SEQ ID NO: 34658 - protein, 7 aa, Artificial Sequence
  Description of Artificial Sequence: Synthetic peptide
SSTRALS

SEQ ID NO: 34659 - protein, 7 aa, Artificial Sequence
  Description of Artificial Sequence: Synthetic peptide
GITAKLT

SEQ ID NO: 34660 - protein, 7 aa, Artificial Sequence
  Description of Artificial Sequence: Synthetic peptide
TTSNKDS

SEQ ID NO: 34661 - protein, 7 aa, Artificial Sequence
  Description of Artificial Sequence: Synthetic peptide
PSSPNSI

SEQ ID NO: 34662 - protein, 7 aa, Artificial Sequence
  Description of Artificial Sequence: Synthetic peptide
GRHGAPT

SEQ ID NO: 34663 - protein, 7 aa, Artificial Sequence
  Description of Artificial Sequence: Synthetic peptide
PGMKVSP

SEQ ID NO: 34664 - protein, 7 aa, Artificial Sequence
  Description of Artificial Sequence: Synthetic peptide
NAVRSEN

SEQ ID NO: 34665 - protein, 7 aa, Artificial Sequence
  Description of Artificial Sequence: Synthetic peptide
VVPERSK

SEQ ID NO: 34666 - protein, 7 aa, Artificial Sequence
  Description of Artificial Sequence: Synthetic peptide
DSRSIKG

SEQ ID NO: 34667 - protein, 7 aa, Artificial Sequence
  Description of Artificial Sequence: Synthetic peptide
QRTSDQT

SEQ ID NO: 34668 - protein, 7 aa, Artificial Sequence
  Description of Artificial Sequence: Synthetic peptide
NNSRVLG

SEQ ID NO: 34669 - protein, 7 aa, Artificial Sequence
  Description of Artificial Sequence: Synthetic peptide
LRPNGQL

SEQ ID NO: 34670 - protein, 7 aa, Artificial Sequence
  Description of Artificial Sequence: Synthetic peptide
ENNSRAT

SEQ ID NO: 34671 - protein, 7 aa, Artificial Sequence
  Description of Artificial Sequence: Synthetic peptide
CVTGGLT

SEQ ID NO: 34672 - protein, 7 aa, Artificial Sequence
  Description of Artificial Sequence: Synthetic peptide
PANSPAT

SEQ ID NO: 34673 - protein, 7 aa, Artificial Sequence
  Description of Artificial Sequence: Synthetic peptide
VSFKPNE

SEQ ID NO: 34674 - protein, 7 aa, Artificial Sequence
  Description of Artificial Sequence: Synthetic peptide
MRSKESA

SEQ ID NO: 34675 - protein, 7 aa, Artificial Sequence
  Description of Artificial Sequence: Synthetic peptide
AHSNNSY

SEQ ID NO: 34676 - protein, 7 aa, Artificial Sequence
  Description of Artificial Sequence: Synthetic peptide
KSNSSLG

SEQ ID NO: 34677 - protein, 7 aa, Artificial Sequence
  Description of Artificial Sequence: Synthetic peptide
GSNLNST

SEQ ID NO: 34678 - protein, 7 aa, Artificial Sequence
  Description of Artificial Sequence: Synthetic peptide
SAHSLGI

SEQ ID NO: 34679 - protein, 7 aa, Artificial Sequence
  Description of Artificial Sequence: Synthetic peptide
GTRSAVV

SEQ ID NO: 34680 - protein, 7 aa, Artificial Sequence
  Description of Artificial Sequence: Synthetic peptide
NPGEMRL

SEQ ID NO: 34681 - protein, 7 aa, Artificial Sequence
  Description of Artificial Sequence: Synthetic peptide
RSANTNA

SEQ ID NO: 34682 - protein, 7 aa, Artificial Sequence
  Description of Artificial Sequence: Synthetic peptide
GVNIHAT

SEQ ID NO: 34683 - protein, 7 aa, Artificial Sequence
  Description of Artificial Sequence: Synthetic peptide
ITATHAH

SEQ ID NO: 34684 - protein, 7 aa, Artificial Sequence
  Description of Artificial Sequence: Synthetic peptide
RITSSNQ

SEQ ID NO: 34685 - protein, 7 aa, Artificial Sequence
  Description of Artificial Sequence: Synthetic peptide
LGGGTLR

SEQ ID NO: 34686 - protein, 7 aa, Artificial Sequence
  Description of Artificial Sequence: Synthetic peptide
TASGSNA

SEQ ID NO: 34687 - protein, 7 aa, Artificial Sequence
  Description of Artificial Sequence: Synthetic peptide
GAAVQAN

SEQ ID NO: 34688 - protein, 7 aa, Artificial Sequence
  Description of Artificial Sequence: Synthetic peptide
NSSHNVS

SEQ ID NO: 34689 - protein, 7 aa, Artificial Sequence
  Description of Artificial Sequence: Synthetic peptide
GKSQMQL

SEQ ID NO: 34690 - protein, 7 aa, Artificial Sequence
  Description of Artificial Sequence: Synthetic peptide
GVSATVK

SEQ ID NO: 34691 - protein, 7 aa, Artificial Sequence
  Description of Artificial Sequence: Synthetic peptide
GAGRALQ

SEQ ID NO: 34692 - protein, 7 aa, Artificial Sequence
  Description of Artificial Sequence: Synthetic peptide
LPGVRVA

SEQ ID NO: 34693 - protein, 7 aa, Artificial Sequence
  Description of Artificial Sequence: Synthetic peptide
ARDPGGV

SEQ ID NO: 34694 - protein, 7 aa, Artificial Sequence
  Description of Artificial Sequence: Synthetic peptide
QNIGRPS

SEQ ID NO: 34695 - protein, 7 aa, Artificial Sequence
  Description of Artificial Sequence: Synthetic peptide
ARDDQRR

SEQ ID NO: 34696 - protein, 7 aa, Artificial Sequence
  Description of Artificial Sequence: Synthetic peptide
MYQKPAS

SEQ ID NO: 34697 - protein, 7 aa, Artificial Sequence
  Description of Artificial Sequence: Synthetic peptide
GNSMAGT

SEQ ID NO: 34698 - protein, 7 aa, Artificial Sequence
  Description of Artificial Sequence: Synthetic peptide
GLSAINN

SEQ ID NO: 34699 - protein, 7 aa, Artificial Sequence
  Description of Artificial Sequence: Synthetic peptide
TSTRSSC

SEQ ID NO: 34700 - protein, 7 aa, Artificial Sequence
  Description of Artificial Sequence: Synthetic peptide
VTMPPSA

SEQ ID NO: 34701 - protein, 7 aa, Artificial Sequence
  Description of Artificial Sequence: Synthetic peptide
MSHTKSN

SEQ ID NO: 34702 - protein, 7 aa, Artificial Sequence
  Description of Artificial Sequence: Synthetic peptide
KQPASTH

SEQ ID NO: 34703 - protein, 7 aa, Artificial Sequence
  Description of Artificial Sequence: Synthetic peptide
HDSSART

SEQ ID NO: 34704 - protein, 7 aa, Artificial Sequence
  Description of Artificial Sequence: Synthetic peptide
QRNVSVV

SEQ ID NO: 34705 - protein, 7 aa, Artificial Sequence
  Description of Artificial Sequence: Synthetic peptide
RIGQGSS

SEQ ID NO: 34706 - protein, 7 aa, Artificial Sequence
  Description of Artificial Sequence: Synthetic peptide
RSTRISE

SEQ ID NO: 34707 - protein, 7 aa, Artificial Sequence
  Description of Artificial Sequence: Synthetic peptide
QVNSIPA

SEQ ID NO: 34708 - protein, 7 aa, Artificial Sequence
  Description of Artificial Sequence: Synthetic peptide
QRPSTGN

SEQ ID NO: 34709 - protein, 7 aa, Artificial Sequence
  Description of Artificial Sequence: Synthetic peptide
SFRAQEG

SEQ ID NO: 34710 - protein, 7 aa, Artificial Sequence
  Description of Artificial Sequence: Synthetic peptide
DSTHRAT

SEQ ID NO: 34711 - protein, 7 aa, Artificial Sequence
  Description of Artificial Sequence: Synthetic peptide
LMHSAVS

SEQ ID NO: 34712 - protein, 7 aa, Artificial Sequence
  Description of Artificial Sequence: Synthetic peptide
THQSSTS

SEQ ID NO: 34713 - protein, 7 aa, Artificial Sequence
  Description of Artificial Sequence: Synthetic peptide
PNGAHVT

SEQ ID NO: 34714 - protein, 7 aa, Artificial Sequence
  Description of Artificial Sequence: Synthetic peptide
QTSSREM

SEQ ID NO: 34715 - protein, 7 aa, Artificial Sequence
  Description of Artificial Sequence: Synthetic peptide
ARGASTN

SEQ ID NO: 34716 - protein, 7 aa, Artificial Sequence
  Description of Artificial Sequence: Synthetic peptide
NGFSPRV

SEQ ID NO: 34717 - protein, 7 aa, Artificial Sequence
  Description of Artificial Sequence: Synthetic peptide
RSLPNVA

SEQ ID NO: 34718 - protein, 7 aa, Artificial Sequence
  Description of Artificial Sequence: Synthetic peptide
GTTSSRD

SEQ ID NO: 34719 - protein, 7 aa, Artificial Sequence
  Description of Artificial Sequence: Synthetic peptide
AQRSTMV

SEQ ID NO: 34720 - protein, 7 aa, Artificial Sequence
  Description of Artificial Sequence: Synthetic peptide
SGGGTRT

SEQ ID NO: 34721 - protein, 7 aa, Artificial Sequence
  Description of Artificial Sequence: Synthetic peptide
QPAGKVV

SEQ ID NO: 34722 - protein, 7 aa, Artificial Sequence
  Description of Artificial Sequence: Synthetic peptide
HQSGSTC

SEQ ID NO: 34723 - protein, 7 aa, Artificial Sequence
  Description of Artificial Sequence: Synthetic peptide
QLGTNNS

SEQ ID NO: 34724 - protein, 7 aa, Artificial Sequence
  Description of Artificial Sequence: Synthetic peptide
FRAQANV

SEQ ID NO: 34725 - protein, 7 aa, Artificial Sequence
  Description of Artificial Sequence: Synthetic peptide
SRAQSQI

SEQ ID NO: 34726 - protein, 7 aa, Artificial Sequence
  Description of Artificial Sequence: Synthetic peptide
PRTDRNT

SEQ ID NO: 34727 - protein, 7 aa, Artificial Sequence
  Description of Artificial Sequence: Synthetic peptide
RTLSASS

SEQ ID NO: 34728 - protein, 7 aa, Artificial Sequence
  Description of Artificial Sequence: Synthetic peptide
SFSPASN

SEQ ID NO: 34729 - protein, 7 aa, Artificial Sequence
  Description of Artificial Sequence: Synthetic peptide
DRALHMS

SEQ ID NO: 34730 - protein, 7 aa, Artificial Sequence
  Description of Artificial Sequence: Synthetic peptide
KIASKSE

SEQ ID NO: 34731 - protein, 7 aa, Artificial Sequence
  Description of Artificial Sequence: Synthetic peptide
SGGDYAK

SEQ ID NO: 34732 - protein, 7 aa, Artificial Sequence
  Description of Artificial Sequence: Synthetic peptide
PLRDSMP

SEQ ID NO: 34733 - protein, 7 aa, Artificial Sequence
  Description of Artificial Sequence: Synthetic peptide
TQPSHDS

SEQ ID NO: 34734 - protein, 7 aa, Artificial Sequence
  Description of Artificial Sequence: Synthetic peptide
VQTHQVR

SEQ ID NO: 34735 - protein, 7 aa, Artificial Sequence
  Description of Artificial Sequence: Synthetic peptide
GINSRGS

SEQ ID NO: 34736 - protein, 7 aa, Artificial Sequence
  Description of Artificial Sequence: Synthetic peptide
LISETSR

SEQ ID NO: 34737 - protein, 7 aa, Artificial Sequence
  Description of Artificial Sequence: Synthetic peptide
SSVGRLN

SEQ ID NO: 34738 - protein, 7 aa, Artificial Sequence
  Description of Artificial Sequence: Synthetic peptide
NYSGAHT

SEQ ID NO: 34739 - protein, 7 aa, Artificial Sequence
  Description of Artificial Sequence: Synthetic peptide
GTNSTRG

SEQ ID NO: 34740 - protein, 7 aa, Artificial Sequence
  Description of Artificial Sequence: Synthetic peptide
NQSRPGV

SEQ ID NO: 34741 - protein, 7 aa, Artificial Sequence
  Description of Artificial Sequence: Synthetic peptide
YVSNSNA

SEQ ID NO: 34742 - protein, 7 aa, Artificial Sequence
  Description of Artificial Sequence: Synthetic peptide
DNISRSR

SEQ ID NO: 34743 - protein, 7 aa, Artificial Sequence
  Description of Artificial Sequence: Synthetic peptide
TYSSKAD

SEQ ID NO: 34744 - protein, 7 aa, Artificial Sequence
  Description of Artificial Sequence: Synthetic peptide
RVESPTN

SEQ ID NO: 34745 - protein, 7 aa, Artificial Sequence
  Description of Artificial Sequence: Synthetic peptide
NSAALNS

SEQ ID NO: 34746 - protein, 7 aa, Artificial Sequence
  Description of Artificial Sequence: Synthetic peptide
AQINTPT

SEQ ID NO: 34747 - protein, 7 aa, Artificial Sequence
  Description of Artificial Sequence: Synthetic peptide
PLGATFA

SEQ ID NO: 34748 - protein, 7 aa, Artificial Sequence
  Description of Artificial Sequence: Synthetic peptide
SYSGTLG

SEQ ID NO: 34749 - protein, 7 aa, Artificial Sequence
  Description of Artificial Sequence: Synthetic peptide
FVSGKVQ

SEQ ID NO: 34750 - protein, 7 aa, Artificial Sequence
  Description of Artificial Sequence: Synthetic peptide
MNGKDVV

SEQ ID NO: 34751 - protein, 7 aa, Artificial Sequence
  Description of Artificial Sequence: Synthetic peptide
PTSNGSL

SEQ ID NO: 34752 - protein, 7 aa, Artificial Sequence
  Description of Artificial Sequence: Synthetic peptide
YSGLTGS

SEQ ID NO: 34753 - protein, 7 aa, Artificial Sequence
  Description of Artificial Sequence: Synthetic peptide
NIGSQGR

SEQ ID NO: 34754 - protein, 7 aa, Artificial Sequence
  Description of Artificial Sequence: Synthetic peptide
MGHAKTA

SEQ ID NO: 34755 - protein, 7 aa, Artificial Sequence
  Description of Artificial Sequence: Synthetic peptide
PLQPRVA

SEQ ID NO: 34756 - protein, 7 aa, Artificial Sequence
  Description of Artificial Sequence: Synthetic peptide
RDGGQDR

SEQ ID NO: 34757 - protein, 7 aa, Artificial Sequence
  Description of Artificial Sequence: Synthetic peptide
QCNSACQ

SEQ ID NO: 34758 - protein, 7 aa, Artificial Sequence
  Description of Artificial Sequence: Synthetic peptide
TGLKDQH

SEQ ID NO: 34759 - protein, 7 aa, Artificial Sequence
  Description of Artificial Sequence: Synthetic peptide
HELSRTT

SEQ ID NO: 34760 - protein, 7 aa, Artificial Sequence
  Description of Artificial Sequence: Synthetic peptide
GRSSHMD

SEQ ID NO: 34761 - protein, 7 aa, Artificial Sequence
  Description of Artificial Sequence: Synthetic peptide
SAAKPGP

SEQ ID NO: 34762 - protein, 7 aa, Artificial Sequence
  Description of Artificial Sequence: Synthetic peptide
IGSNARQ

SEQ ID NO: 34763 - protein, 7 aa, Artificial Sequence
  Description of Artificial Sequence: Synthetic peptide
LSGHSPQ

SEQ ID NO: 34764 - protein, 7 aa, Artificial Sequence
  Description of Artificial Sequence: Synthetic peptide
TSNSIQG

SEQ ID NO: 34765 - protein, 7 aa, Artificial Sequence
  Description of Artificial Sequence: Synthetic peptide
PLQTSRT

SEQ ID NO: 34766 - protein, 7 aa, Artificial Sequence
  Description of Artificial Sequence: Synthetic peptide
PNTKPVL

SEQ ID NO: 34767 - protein, 7 aa, Artificial Sequence
  Description of Artificial Sequence: Synthetic peptide
SLNSREG

SEQ ID NO: 34768 - protein, 7 aa, Artificial Sequence
  Description of Artificial Sequence: Synthetic peptide
HRDTNGK

SEQ ID NO: 34769 - protein, 7 aa, Artificial Sequence
  Description of Artificial Sequence: Synthetic peptide
AEQRPGQ

SEQ ID NO: 34770 - protein, 7 aa, Artificial Sequence
  Description of Artificial Sequence: Synthetic peptide
PVLNKAT

SEQ ID NO: 34771 - protein, 7 aa, Artificial Sequence
  Description of Artificial Sequence: Synthetic peptide
PRTNNPS

SEQ ID NO: 34772 - protein, 7 aa, Artificial Sequence
  Description of Artificial Sequence: Synthetic peptide
PLDKSMM

SEQ ID NO: 34773 - protein, 7 aa, Artificial Sequence
  Description of Artificial Sequence: Synthetic peptide
MSTGVSP

SEQ ID NO: 34774 - protein, 7 aa, Artificial Sequence
  Description of Artificial Sequence: Synthetic peptide
KQPVSTH

SEQ ID NO: 34775 - protein, 7 aa, Artificial Sequence
  Description of Artificial Sequence: Synthetic peptide
VRSKEAH

SEQ ID NO: 34776 - protein, 7 aa, Artificial Sequence
  Description of Artificial Sequence: Synthetic peptide
TQQNGSN

SEQ ID NO: 34777 - protein, 7 aa, Artificial Sequence
  Description of Artificial Sequence: Synthetic peptide
CQSSRVT

SEQ ID NO: 34778 - protein, 7 aa, Artificial Sequence
  Description of Artificial Sequence: Synthetic peptide
TQMGKSN

SEQ ID NO: 34779 - protein, 7 aa, Artificial Sequence
  Description of Artificial Sequence: Synthetic peptide
EYPQQAK

SEQ ID NO: 34780 - protein, 7 aa, Artificial Sequence
  Description of Artificial Sequence: Synthetic peptide
PNNATKN

SEQ ID NO: 34781 - protein, 7 aa, Artificial Sequence
  Description of Artificial Sequence: Synthetic peptide
GSLPSCR

SEQ ID NO: 34782 - protein, 7 aa, Artificial Sequence
  Description of Artificial Sequence: Synthetic peptide
TQRSQAA

SEQ ID NO: 34783 - protein, 7 aa, Artificial Sequence
  Description of Artificial Sequence: Synthetic peptide
EGNRSNM

SEQ ID NO: 34784 - protein, 7 aa, Artificial Sequence
  Description of Artificial Sequence: Synthetic peptide
MGVRPSA

SEQ ID NO: 34785 - protein, 7 aa, Artificial Sequence
  Description of Artificial Sequence: Synthetic peptide
HGVGSMV

SEQ ID NO: 34786 - protein, 7 aa, Artificial Sequence
  Description of Artificial Sequence: Synthetic peptide
STTAQVK

SEQ ID NO: 34787 - protein, 7 aa, Artificial Sequence
  Description of Artificial Sequence: Synthetic peptide
SHNRTND

SEQ ID NO: 34788 - protein, 7 aa, Artificial Sequence
  Description of Artificial Sequence: Synthetic peptide
NNSISNP

SEQ ID NO: 34789 - protein, 7 aa, Artificial Sequence
  Description of Artificial Sequence: Synthetic peptide
GGLSPKV

SEQ ID NO: 34790 - protein, 7 aa, Artificial Sequence
  Description of Artificial Sequence: Synthetic peptide
SIPSTSQ

SEQ ID NO: 34791 - protein, 7 aa, Artificial Sequence
  Description of Artificial Sequence: Synthetic peptide
TGSGTIL

SEQ ID NO: 34792 - protein, 7 aa, Artificial Sequence
  Description of Artificial Sequence: Synthetic peptide
TATTLSS

SEQ ID NO: 34793 - protein, 7 aa, Artificial Sequence
  Description of Artificial Sequence: Synthetic peptide
PPSNGRL

SEQ ID NO: 34794 - protein, 7 aa, Artificial Sequence
  Description of Artificial Sequence: Synthetic peptide
HQSSPPC

SEQ ID NO: 34795 - protein, 7 aa, Artificial Sequence
  Description of Artificial Sequence: Synthetic peptide
SFSSTMG

SEQ ID NO: 34796 - protein, 7 aa, Artificial Sequence
  Description of Artificial Sequence: Synthetic peptide
MRSERAA

SEQ ID NO: 34797 - protein, 7 aa, Artificial Sequence
  Description of Artificial Sequence: Synthetic peptide
GSTGSSI

SEQ ID NO: 34798 - protein, 7 aa, Artificial Sequence
  Description of Artificial Sequence: Synthetic peptide
GITHGSH

SEQ ID NO: 34799 - protein, 7 aa, Artificial Sequence
  Description of Artificial Sequence: Synthetic peptide
GTPNTKV

SEQ ID NO: 34800 - protein, 7 aa, Artificial Sequence
  Description of Artificial Sequence: Synthetic peptide
GFPNVAT

SEQ ID NO: 34801 - protein, 7 aa, Artificial Sequence
  Description of Artificial Sequence: Synthetic peptide
PLSGSKA

SEQ ID NO: 34802 - protein, 7 aa, Artificial Sequence
  Description of Artificial Sequence: Synthetic peptide
VTKSGNG

SEQ ID NO: 34803 - protein, 7 aa, Artificial Sequence
  Description of Artificial Sequence: Synthetic peptide
ARSESTA

SEQ ID NO: 34804 - protein, 7 aa, Artificial Sequence
  Description of Artificial Sequence: Synthetic peptide
YVSSGKA

SEQ ID NO: 34805 - protein, 7 aa, Artificial Sequence
  Description of Artificial Sequence: Synthetic peptide
QKGNNLP

SEQ ID NO: 34806 - protein, 7 aa, Artificial Sequence
  Description of Artificial Sequence: Synthetic peptide
QPIISPT

SEQ ID NO: 34807 - protein, 7 aa, Artificial Sequence
  Description of Artificial Sequence: Synthetic peptide
GRDNSRQ

SEQ ID NO: 34808 - protein, 7 aa, Artificial Sequence
  Description of Artificial Sequence: Synthetic peptide
VPSQSLH

SEQ ID NO: 34809 - protein, 7 aa, Artificial Sequence
  Description of Artificial Sequence: Synthetic peptide
PTVQVTK

SEQ ID NO: 34810 - protein, 7 aa, Artificial Sequence
  Description of Artificial Sequence: Synthetic peptide
LTAIHPA

SEQ ID NO: 34811 - protein, 7 aa, Artificial Sequence
  Description of Artificial Sequence: Synthetic peptide
LSQSNTH

SEQ ID NO: 34812 - protein, 7 aa, Artificial Sequence
  Description of Artificial Sequence: Synthetic peptide
RDRTNAA

SEQ ID NO: 34813 - protein, 7 aa, Artificial Sequence
  Description of Artificial Sequence: Synthetic peptide
VGSSKGC

SEQ ID NO: 34814 - protein, 7 aa, Artificial Sequence
  Description of Artificial Sequence: Synthetic peptide
LPTSSVA

SEQ ID NO: 34815 - protein, 7 aa, Artificial Sequence
  Description of Artificial Sequence: Synthetic peptide
NGISKSN

SEQ ID NO: 34816 - protein, 7 aa, Artificial Sequence
  Description of Artificial Sequence: Synthetic peptide
SGVERVN

SEQ ID NO: 34817 - protein, 7 aa, Artificial Sequence
  Description of Artificial Sequence: Synthetic peptide
LVRTTTA

SEQ ID NO: 34818 - protein, 7 aa, Artificial Sequence
  Description of Artificial Sequence: Synthetic peptide
SQSNSFL

SEQ ID NO: 34819 - protein, 7 aa, Artificial Sequence
  Description of Artificial Sequence: Synthetic peptide
PSGPVRG

SEQ ID NO: 34820 - protein, 7 aa, Artificial Sequence
  Description of Artificial Sequence: Synthetic peptide
HRSNSTT

SEQ ID NO: 34821 - protein, 7 aa, Artificial Sequence
  Description of Artificial Sequence: Synthetic peptide
RDSTAAR

SEQ ID NO: 34822 - protein, 7 aa, Artificial Sequence
  Description of Artificial Sequence: Synthetic peptide
QSISHTR

SEQ ID NO: 34823 - protein, 7 aa, Artificial Sequence
  Description of Artificial Sequence: Synthetic peptide
HNTAHAS

SEQ ID NO: 34824 - protein, 7 aa, Artificial Sequence
  Description of Artificial Sequence: Synthetic peptide
SPHRDTV

SEQ ID NO: 34825 - protein, 7 aa, Artificial Sequence
  Description of Artificial Sequence: Synthetic peptide
SPMGVTR

SEQ ID NO: 34826 - protein, 7 aa, Artificial Sequence
  Description of Artificial Sequence: Synthetic peptide
RGPTGMM

SEQ ID NO: 34827 - protein, 7 aa, Artificial Sequence
  Description of Artificial Sequence: Synthetic peptide
TTYGSLG

SEQ ID NO: 34828 - protein, 7 aa, Artificial Sequence
  Description of Artificial Sequence: Synthetic peptide
SLHQVGG

SEQ ID NO: 34829 - protein, 7 aa, Artificial Sequence
  Description of Artificial Sequence: Synthetic peptide
SGQHSLN

SEQ ID NO: 34830 - protein, 7 aa, Artificial Sequence
  Description of Artificial Sequence: Synthetic peptide
GNSNTLA

SEQ ID NO: 34831 - protein, 7 aa, Artificial Sequence
  Description of Artificial Sequence: Synthetic peptide
NTHNIQG

SEQ ID NO: 34832 - protein, 7 aa, Artificial Sequence
  Description of Artificial Sequence: Synthetic peptide
VQPVKMS

SEQ ID NO: 34833 - protein, 7 aa, Artificial Sequence
  Description of Artificial Sequence: Synthetic peptide
NASGQNQ

SEQ ID NO: 34834 - protein, 7 aa, Artificial Sequence
  Description of Artificial Sequence: Synthetic peptide
GPNPGNH

SEQ ID NO: 34835 - protein, 7 aa, Artificial Sequence
  Description of Artificial Sequence: Synthetic peptide
SRNAANA

SEQ ID NO: 34836 - protein, 7 aa, Artificial Sequence
  Description of Artificial Sequence: Synthetic peptide
MSRSDPP

SEQ ID NO: 34837 - protein, 7 aa, Artificial Sequence
  Description of Artificial Sequence: Synthetic peptide
TGTKSDN

SEQ ID NO: 34838 - protein, 7 aa, Artificial Sequence
  Description of Artificial Sequence: Synthetic peptide
NGSGQTQ

SEQ ID NO: 34839 - protein, 7 aa, Artificial Sequence
  Description of Artificial Sequence: Synthetic peptide
NSGARLS

SEQ ID NO: 34840 - protein, 7 aa, Artificial Sequence
  Description of Artificial Sequence: Synthetic peptide
TNSQKLA

SEQ ID NO: 34841 - protein, 7 aa, Artificial Sequence
  Description of Artificial Sequence: Synthetic peptide
LGAGQRE

SEQ ID NO: 34842 - protein, 7 aa, Artificial Sequence
  Description of Artificial Sequence: Synthetic peptide
SMSEHLK

SEQ ID NO: 34843 - protein, 7 aa, Artificial Sequence
  Description of Artificial Sequence: Synthetic peptide
GTGHQRS

SEQ ID NO: 34844 - protein, 7 aa, Artificial Sequence
  Description of Artificial Sequence: Synthetic peptide
HHSTLQT

SEQ ID NO: 34845 - protein, 7 aa, Artificial Sequence
  Description of Artificial Sequence: Synthetic peptide
SGGKSAL

SEQ ID NO: 34846 - protein, 7 aa, Artificial Sequence
  Description of Artificial Sequence: Synthetic peptide
APNGMQA

SEQ ID NO: 34847 - protein, 7 aa, Artificial Sequence
  Description of Artificial Sequence: Synthetic peptide
YQANALG

SEQ ID NO: 34848 - protein, 7 aa, Artificial Sequence
  Description of Artificial Sequence: Synthetic peptide
RTGNNHE

SEQ ID NO: 34849 - protein, 7 aa, Artificial Sequence
  Description of Artificial Sequence: Synthetic peptide
SQSSPVA

SEQ ID NO: 34850 - protein, 7 aa, Artificial Sequence
  Description of Artificial Sequence: Synthetic peptide
DGLRNSL

SEQ ID NO: 34851 - protein, 7 aa, Artificial Sequence
  Description of Artificial Sequence: Synthetic peptide
DHRNISS

SEQ ID NO: 34852 - protein, 7 aa, Artificial Sequence
  Description of Artificial Sequence: Synthetic peptide
SGGTHIA

SEQ ID NO: 34853 - protein, 7 aa, Artificial Sequence
  Description of Artificial Sequence: Synthetic peptide
SNTRSLS

SEQ ID NO: 34854 - protein, 7 aa, Artificial Sequence
  Description of Artificial Sequence: Synthetic peptide
ERPGGTP

SEQ ID NO: 34855 - protein, 7 aa, Artificial Sequence
  Description of Artificial Sequence: Synthetic peptide
SVADTRL

SEQ ID NO: 34856 - protein, 7 aa, Artificial Sequence
  Description of Artificial Sequence: Synthetic peptide
PMSHVSG

SEQ ID NO: 34857 - protein, 7 aa, Artificial Sequence
  Description of Artificial Sequence: Synthetic peptide
DRSATAT

SEQ ID NO: 34858 - protein, 7 aa, Artificial Sequence
  Description of Artificial Sequence: Synthetic peptide
CLPNHCN

SEQ ID NO: 34859 - protein, 7 aa, Artificial Sequence
  Description of Artificial Sequence: Synthetic peptide
PTSQQRP

SEQ ID NO: 34860 - protein, 7 aa, Artificial Sequence
  Description of Artificial Sequence: Synthetic peptide
PNLNSRG

SEQ ID NO: 34861 - protein, 7 aa, Artificial Sequence
  Description of Artificial Sequence: Synthetic peptide
MNSGRHV

SEQ ID NO: 34862 - protein, 7 aa, Artificial Sequence
  Description of Artificial Sequence: Synthetic peptide
RNQGALQ

SEQ ID NO: 34863 - protein, 7 aa, Artificial Sequence
  Description of Artificial Sequence: Synthetic peptide
SASHGAL

SEQ ID NO: 34864 - protein, 7 aa, Artificial Sequence
  Description of Artificial Sequence: Synthetic peptide
GKTNVSS

SEQ ID NO: 34865 - protein, 7 aa, Artificial Sequence
  Description of Artificial Sequence: Synthetic peptide
GFTGSHV

SEQ ID NO: 34866 - protein, 7 aa, Artificial Sequence
  Description of Artificial Sequence: Synthetic peptide
SLGSRPS

SEQ ID NO: 34867 - protein, 7 aa, Artificial Sequence
  Description of Artificial Sequence: Synthetic peptide
NRNGFNN

SEQ ID NO: 34868 - protein, 7 aa, Artificial Sequence
  Description of Artificial Sequence: Synthetic peptide
SYVGTTA

SEQ ID NO: 34869 - protein, 7 aa, Artificial Sequence
  Description of Artificial Sequence: Synthetic peptide
VNQSGFS

SEQ ID NO: 34870 - protein, 7 aa, Artificial Sequence
  Description of Artificial Sequence: Synthetic peptide
QPSQGHS

SEQ ID NO: 34871 - protein, 7 aa, Artificial Sequence
  Description of Artificial Sequence: Synthetic peptide
NGSGKNQ

SEQ ID NO: 34872 - protein, 7 aa, Artificial Sequence
  Description of Artificial Sequence: Synthetic peptide
SRNGGPL

SEQ ID NO: 34873 - protein, 7 aa, Artificial Sequence
  Description of Artificial Sequence: Synthetic peptide
EGISSIS

SEQ ID NO: 34874 - protein, 7 aa, Artificial Sequence
  Description of Artificial Sequence: Synthetic peptide
PYNSKAS

SEQ ID NO: 34875 - protein, 7 aa, Artificial Sequence
  Description of Artificial Sequence: Synthetic peptide
AVTGASG

SEQ ID NO: 34876 - protein, 7 aa, Artificial Sequence
  Description of Artificial Sequence: Synthetic peptide
SVTPHVT

SEQ ID NO: 34877 - protein, 7 aa, Artificial Sequence
  Description of Artificial Sequence: Synthetic peptide
PVSGATI

SEQ ID NO: 34878 - protein, 7 aa, Artificial Sequence
  Description of Artificial Sequence: Synthetic peptide
GSRDNSR

SEQ ID NO: 34879 - protein, 7 aa, Artificial Sequence
  Description of Artificial Sequence: Synthetic peptide
REPARGD

SEQ ID NO: 34880 - protein, 7 aa, Artificial Sequence
  Description of Artificial Sequence: Synthetic peptide
PRSQPVP

SEQ ID NO: 34881 - protein, 7 aa, Artificial Sequence
  Description of Artificial Sequence: Synthetic peptide
TSSGHSV

SEQ ID NO: 34882 - protein, 7 aa, Artificial Sequence
  Description of Artificial Sequence: Synthetic peptide
ADLTRSS

SEQ ID NO: 34883 - protein, 7 aa, Artificial Sequence
  Description of Artificial Sequence: Synthetic peptide
LGPGKNT

SEQ ID NO: 34884 - protein, 7 aa, Artificial Sequence
  Description of Artificial Sequence: Synthetic peptide
STFSPSK

SEQ ID NO: 34885 - protein, 7 aa, Artificial Sequence
  Description of Artificial Sequence: Synthetic peptide
SPGNKST

SEQ ID NO: 34886 - protein, 7 aa, Artificial Sequence
  Description of Artificial Sequence: Synthetic peptide
DRQGLSG

SEQ ID NO: 34887 - protein, 7 aa, Artificial Sequence
  Description of Artificial Sequence: Synthetic peptide
FNEQRVS

SEQ ID NO: 34888 - protein, 7 aa, Artificial Sequence
  Description of Artificial Sequence: Synthetic peptide
RSYEGMQ

SEQ ID NO: 34889 - protein, 7 aa, Artificial Sequence
  Description of Artificial Sequence: Synthetic peptide
IPSGVHS

SEQ ID NO: 34890 - protein, 7 aa, Artificial Sequence
  Description of Artificial Sequence: Synthetic peptide
DTITSRG

SEQ ID NO: 34891 - protein, 7 aa, Artificial Sequence
  Description of Artificial Sequence: Synthetic peptide
PSVNRTP

SEQ ID NO: 34892 - protein, 7 aa, Artificial Sequence
  Description of Artificial Sequence: Synthetic peptide
PVSTHSS

SEQ ID NO: 34893 - protein, 7 aa, Artificial Sequence
  Description of Artificial Sequence: Synthetic peptide
SRVTSVS

SEQ ID NO: 34894 - protein, 7 aa, Artificial Sequence
  Description of Artificial Sequence: Synthetic peptide
RSSGGLT

SEQ ID NO: 34895 - protein, 7 aa, Artificial Sequence
  Description of Artificial Sequence: Synthetic peptide
SKGLSMV

SEQ ID NO: 34896 - protein, 7 aa, Artificial Sequence
  Description of Artificial Sequence: Synthetic peptide
DNPRQAY

SEQ ID NO: 34897 - protein, 7 aa, Artificial Sequence
  Description of Artificial Sequence: Synthetic peptide
GTTNSRN

SEQ ID NO: 34898 - protein, 7 aa, Artificial Sequence
  Description of Artificial Sequence: Synthetic peptide
GSSRSLG

SEQ ID NO: 34899 - protein, 7 aa, Artificial Sequence
  Description of Artificial Sequence: Synthetic peptide
MLPQNGR

SEQ ID NO: 34900 - protein, 7 aa, Artificial Sequence
  Description of Artificial Sequence: Synthetic peptide
GSNRNPL

SEQ ID NO: 34901 - protein, 7 aa, Artificial Sequence
  Description of Artificial Sequence: Synthetic peptide
STSRDAT

SEQ ID NO: 34902 - protein, 7 aa, Artificial Sequence
  Description of Artificial Sequence: Synthetic peptide
HGSSSFT

SEQ ID NO: 34903 - protein, 7 aa, Artificial Sequence
  Description of Artificial Sequence: Synthetic peptide
SDMSGQR

SEQ ID NO: 34904 - protein, 7 aa, Artificial Sequence
  Description of Artificial Sequence: Synthetic peptide
RSGSVNP

SEQ ID NO: 34905 - protein, 7 aa, Artificial Sequence
  Description of Artificial Sequence: Synthetic peptide
GTADRHL

SEQ ID NO: 34906 - protein, 7 aa, Artificial Sequence
  Description of Artificial Sequence: Synthetic peptide
CTSKSSS

SEQ ID NO: 34907 - protein, 7 aa, Artificial Sequence
  Description of Artificial Sequence: Synthetic peptide
EGTRGVG

SEQ ID NO: 34908 - protein, 7 aa, Artificial Sequence
  Description of Artificial Sequence: Synthetic peptide
RVTNQNA

SEQ ID NO: 34909 - protein, 7 aa, Artificial Sequence
  Description of Artificial Sequence: Synthetic peptide
SRNVNAM

SEQ ID NO: 34910 - protein, 7 aa, Artificial Sequence
  Description of Artificial Sequence: Synthetic peptide
AGGPANR

SEQ ID NO: 34911 - protein, 7 aa, Artificial Sequence
  Description of Artificial Sequence: Synthetic peptide
TGSGSNH

SEQ ID NO: 34912 - protein, 7 aa, Artificial Sequence
  Description of Artificial Sequence: Synthetic peptide
GLQSKQL

SEQ ID NO: 34913 - protein, 7 aa, Artificial Sequence
  Description of Artificial Sequence: Synthetic peptide
AMTGSHT

SEQ ID NO: 34914 - protein, 7 aa, Artificial Sequence
  Description of Artificial Sequence: Synthetic peptide
PSTSGAM

SEQ ID NO: 34915 - protein, 7 aa, Artificial Sequence
  Description of Artificial Sequence: Synthetic peptide
SSANHPR

SEQ ID NO: 34916 - protein, 7 aa, Artificial Sequence
  Description of Artificial Sequence: Synthetic peptide
GHVSPAF

SEQ ID NO: 34917 - protein, 7 aa, Artificial Sequence
  Description of Artificial Sequence: Synthetic peptide
RNVDKSS

SEQ ID NO: 34918 - protein, 7 aa, Artificial Sequence
  Description of Artificial Sequence: Synthetic peptide
YPKTNVT

SEQ ID NO: 34919 - protein, 7 aa, Artificial Sequence
  Description of Artificial Sequence: Synthetic peptide
NPNQSLG

SEQ ID NO: 34920 - protein, 7 aa, Artificial Sequence
  Description of Artificial Sequence: Synthetic peptide
AVDSTRA

SEQ ID NO: 34921 - protein, 7 aa, Artificial Sequence
  Description of Artificial Sequence: Synthetic peptide
DTSRAPG

SEQ ID NO: 34922 - protein, 7 aa, Artificial Sequence
  Description of Artificial Sequence: Synthetic peptide
ANTTRLT

SEQ ID NO: 34923 - protein, 7 aa, Artificial Sequence
  Description of Artificial Sequence: Synthetic peptide
VPHGATS

SEQ ID NO: 34924 - protein, 7 aa, Artificial Sequence
  Description of Artificial Sequence: Synthetic peptide
TSTSPMK

SEQ ID NO: 34925 - protein, 7 aa, Artificial Sequence
  Description of Artificial Sequence: Synthetic peptide
ETPNRSQ

SEQ ID NO: 34926 - protein, 7 aa, Artificial Sequence
  Description of Artificial Sequence: Synthetic peptide
RSNPTLV

SEQ ID NO: 34927 - protein, 7 aa, Artificial Sequence
  Description of Artificial Sequence: Synthetic peptide
TATQKGQ

SEQ ID NO: 34928 - protein, 7 aa, Artificial Sequence
  Description of Artificial Sequence: Synthetic peptide
GHSSNNA

SEQ ID NO: 34929 - protein, 7 aa, Artificial Sequence
  Description of Artificial Sequence: Synthetic peptide
GGLHGSG

SEQ ID NO: 34930 - protein, 7 aa, Artificial Sequence
  Description of Artificial Sequence: Synthetic peptide
PRSTTGG

SEQ ID NO: 34931 - protein, 7 aa, Artificial Sequence
  Description of Artificial Sequence: Synthetic peptide
NSGKPNA

SEQ ID NO: 34932 - protein, 7 aa, Artificial Sequence
  Description of Artificial Sequence: Synthetic peptide
NTVSKSQ

SEQ ID NO: 34933 - protein, 7 aa, Artificial Sequence
  Description of Artificial Sequence: Synthetic peptide
DVKSTHA

SEQ ID NO: 34934 - protein, 7 aa, Artificial Sequence
  Description of Artificial Sequence: Synthetic peptide
AGTGSSL

SEQ ID NO: 34935 - protein, 7 aa, Artificial Sequence
  Description of Artificial Sequence: Synthetic peptide
TTHNMQG

SEQ ID NO: 34936 - protein, 7 aa, Artificial Sequence
  Description of Artificial Sequence: Synthetic peptide
SRETVPT

SEQ ID NO: 34937 - protein, 7 aa, Artificial Sequence
  Description of Artificial Sequence: Synthetic peptide
QSHSGIS

SEQ ID NO: 34938 - protein, 7 aa, Artificial Sequence
  Description of Artificial Sequence: Synthetic peptide
PPNLKLS

SEQ ID NO: 34939 - protein, 7 aa, Artificial Sequence
  Description of Artificial Sequence: Synthetic peptide
QHTTTNQ

SEQ ID NO: 34940 - protein, 7 aa, Artificial Sequence
  Description of Artificial Sequence: Synthetic peptide
SNETKSS

SEQ ID NO: 34941 - protein, 7 aa, Artificial Sequence
  Description of Artificial Sequence: Synthetic peptide
EQGSGNH

SEQ ID NO: 34942 - protein, 7 aa, Artificial Sequence
  Description of Artificial Sequence: Synthetic peptide
GTDNNTR

SEQ ID NO: 34943 - protein, 7 aa, Artificial Sequence
  Description of Artificial Sequence: Synthetic peptide
HGTSPLR

SEQ ID NO: 34944 - protein, 7 aa, Artificial Sequence
  Description of Artificial Sequence: Synthetic peptide
ATNSTPR

SEQ ID NO: 34945 - protein, 7 aa, Artificial Sequence
  Description of Artificial Sequence: Synthetic peptide
QSNPRPG

SEQ ID NO: 34946 - protein, 7 aa, Artificial Sequence
  Description of Artificial Sequence: Synthetic peptide
SSLQPFT

SEQ ID NO: 34947 - protein, 7 aa, Artificial Sequence
  Description of Artificial Sequence: Synthetic peptide
GTARGVA

SEQ ID NO: 34948 - protein, 7 aa, Artificial Sequence
  Description of Artificial Sequence: Synthetic peptide
AASTVPR

SEQ ID NO: 34949 - protein, 7 aa, Artificial Sequence
  Description of Artificial Sequence: Synthetic peptide
TGMQSLS

SEQ ID NO: 34950 - protein, 7 aa, Artificial Sequence
  Description of Artificial Sequence: Synthetic peptide
ASSRESL

SEQ ID NO: 34951 - protein, 7 aa, Artificial Sequence
  Description of Artificial Sequence: Synthetic peptide
HGSGQNQ

SEQ ID NO: 34952 - protein, 7 aa, Artificial Sequence
  Description of Artificial Sequence: Synthetic peptide
RAGSAVE

SEQ ID NO: 34953 - protein, 7 aa, Artificial Sequence
  Description of Artificial Sequence: Synthetic peptide
GSTTSGR

SEQ ID NO: 34954 - protein, 7 aa, Artificial Sequence
  Description of Artificial Sequence: Synthetic peptide
VHTGQNG

SEQ ID NO: 34955 - protein, 7 aa, Artificial Sequence
  Description of Artificial Sequence: Synthetic peptide
RGPGHNT

SEQ ID NO: 34956 - protein, 7 aa, Artificial Sequence
  Description of Artificial Sequence: Synthetic peptide
TRDSQVL

SEQ ID NO: 34957 - protein, 7 aa, Artificial Sequence
  Description of Artificial Sequence: Synthetic peptide
PGGVPGS

SEQ ID NO: 34958 - protein, 7 aa, Artificial Sequence
  Description of Artificial Sequence: Synthetic peptide
HYGETRN

SEQ ID NO: 34959 - protein, 7 aa, Artificial Sequence
  Description of Artificial Sequence: Synthetic peptide
HKSGLVD

SEQ ID NO: 34960 - protein, 7 aa, Artificial Sequence
  Description of Artificial Sequence: Synthetic peptide
AGVTTVN

SEQ ID NO: 34961 - protein, 7 aa, Artificial Sequence
  Description of Artificial Sequence: Synthetic peptide
YINSPSN

SEQ ID NO: 34962 - protein, 7 aa, Artificial Sequence
  Description of Artificial Sequence: Synthetic peptide
SRSTGTL

SEQ ID NO: 34963 - protein, 7 aa, Artificial Sequence
  Description of Artificial Sequence: Synthetic peptide
ALRNQSQ

SEQ ID NO: 34964 - protein, 7 aa, Artificial Sequence
  Description of Artificial Sequence: Synthetic peptide
GDSKSTW

SEQ ID NO: 34965 - protein, 7 aa, Artificial Sequence
  Description of Artificial Sequence: Synthetic peptide
EPLQGSR

SEQ ID NO: 34966 - protein, 7 aa, Artificial Sequence
  Description of Artificial Sequence: Synthetic peptide
AHFSTER

SEQ ID NO: 34967 - protein, 7 aa, Artificial Sequence
  Description of Artificial Sequence: Synthetic peptide
LVSKSGT

SEQ ID NO: 34968 - protein, 7 aa, Artificial Sequence
  Description of Artificial Sequence: Synthetic peptide
SATSVPI

SEQ ID NO: 34969 - protein, 7 aa, Artificial Sequence
  Description of Artificial Sequence: Synthetic peptide
SSPTNMA

SEQ ID NO: 34970 - protein, 7 aa, Artificial Sequence
  Description of Artificial Sequence: Synthetic peptide
QISASTR

SEQ ID NO: 34971 - protein, 7 aa, Artificial Sequence
  Description of Artificial Sequence: Synthetic peptide
RDPKAGV

SEQ ID NO: 34972 - protein, 7 aa, Artificial Sequence
  Description of Artificial Sequence: Synthetic peptide
ERAKGSS

SEQ ID NO: 34973 - protein, 7 aa, Artificial Sequence
  Description of Artificial Sequence: Synthetic peptide
QANTIGK

SEQ ID NO: 34974 - protein, 7 aa, Artificial Sequence
  Description of Artificial Sequence: Synthetic peptide
MALQPNR

SEQ ID NO: 34975 - protein, 7 aa, Artificial Sequence
  Description of Artificial Sequence: Synthetic peptide
PSSTPKL

SEQ ID NO: 34976 - protein, 7 aa, Artificial Sequence
  Description of Artificial Sequence: Synthetic peptide
SGSSPPT

SEQ ID NO: 34977 - protein, 7 aa, Artificial Sequence
  Description of Artificial Sequence: Synthetic peptide
QVTGASH

SEQ ID NO: 34978 - protein, 7 aa, Artificial Sequence
  Description of Artificial Sequence: Synthetic peptide
SLGSGFQ

SEQ ID NO: 34979 - protein, 7 aa, Artificial Sequence
  Description of Artificial Sequence: Synthetic peptide
VNTSHTN

SEQ ID NO: 34980 - protein, 7 aa, Artificial Sequence
  Description of Artificial Sequence: Synthetic peptide
YLTSTSN

SEQ ID NO: 34981 - protein, 7 aa, Artificial Sequence
  Description of Artificial Sequence: Synthetic peptide
MLNSRTS

SEQ ID NO: 34982 - protein, 7 aa, Artificial Sequence
  Description of Artificial Sequence: Synthetic peptide
PFGAGRP

SEQ ID NO: 34983 - protein, 7 aa, Artificial Sequence
  Description of Artificial Sequence: Synthetic peptide
PLPKNSS

SEQ ID NO: 34984 - protein, 7 aa, Artificial Sequence
  Description of Artificial Sequence: Synthetic peptide
HAKSSSM

SEQ ID NO: 34985 - protein, 7 aa, Artificial Sequence
  Description of Artificial Sequence: Synthetic peptide
TNAARDS

SEQ ID NO: 34986 - protein, 7 aa, Artificial Sequence
  Description of Artificial Sequence: Synthetic peptide
GLQTPPR

SEQ ID NO: 34987 - protein, 7 aa, Artificial Sequence
  Description of Artificial Sequence: Synthetic peptide
GHDGQSR

SEQ ID NO: 34988 - protein, 7 aa, Artificial Sequence
  Description of Artificial Sequence: Synthetic peptide
ATSQLPR

SEQ ID NO: 34989 - protein, 7 aa, Artificial Sequence
  Description of Artificial Sequence: Synthetic peptide
STTPGLK

SEQ ID NO: 34990 - protein, 7 aa, Artificial Sequence
  Description of Artificial Sequence: Synthetic peptide
RATSREA

SEQ ID NO: 34991 - protein, 7 aa, Artificial Sequence
  Description of Artificial Sequence: Synthetic peptide
GPVNAHS

SEQ ID NO: 34992 - protein, 7 aa, Artificial Sequence
  Description of Artificial Sequence: Synthetic peptide
SANNKSG

SEQ ID NO: 34993 - protein, 7 aa, Artificial Sequence
  Description of Artificial Sequence: Synthetic peptide
SQPGSNH

SEQ ID NO: 34994 - protein, 7 aa, Artificial Sequence
  Description of Artificial Sequence: Synthetic peptide
GSISTAH

SEQ ID NO: 34995 - protein, 7 aa, Artificial Sequence
  Description of Artificial Sequence: Synthetic peptide
AGTNSRQ

SEQ ID NO: 34996 - protein, 7 aa, Artificial Sequence
  Description of Artificial Sequence: Synthetic peptide
NAQGTAK

SEQ ID NO: 34997 - protein, 7 aa, Artificial Sequence
  Description of Artificial Sequence: Synthetic peptide
MSTSSSR

SEQ ID NO: 34998 - protein, 7 aa, Artificial Sequence
  Description of Artificial Sequence: Synthetic peptide
TRTAGVD

SEQ ID NO: 34999 - protein, 7 aa, Artificial Sequence
  Description of Artificial Sequence: Synthetic peptide
FGQQAGM

SEQ ID NO: 35000 - protein, 7 aa, Artificial Sequence
  Description of Artificial Sequence: Synthetic peptide
DSRNNMT

SEQ ID NO: 35001 - protein, 7 aa, Artificial Sequence
  Description of Artificial Sequence: Synthetic peptide
QNLPKAS

SEQ ID NO: 35002 - protein, 7 aa, Artificial Sequence
  Description of Artificial Sequence: Synthetic peptide
AAHSTMN

SEQ ID NO: 35003 - protein, 7 aa, Artificial Sequence
  Description of Artificial Sequence: Synthetic peptide
VPHNHSL

SEQ ID NO: 35004 - protein, 7 aa, Artificial Sequence
  Description of Artificial Sequence: Synthetic peptide
GMGNDPR

SEQ ID NO: 35005 - protein, 7 aa, Artificial Sequence
  Description of Artificial Sequence: Synthetic peptide
SSPSRSS

SEQ ID NO: 35006 - protein, 7 aa, Artificial Sequence
  Description of Artificial Sequence: Synthetic peptide
PGSGSNN

SEQ ID NO: 35007 - protein, 7 aa, Artificial Sequence
  Description of Artificial Sequence: Synthetic peptide
TTLPSSK

SEQ ID NO: 35008 - protein, 7 aa, Artificial Sequence
  Description of Artificial Sequence: Synthetic peptide
VRESRSS

SEQ ID NO: 35009 - protein, 7 aa, Artificial Sequence
  Description of Artificial Sequence: Synthetic peptide
SSTVKSG

SEQ ID NO: 35010 - protein, 7 aa, Artificial Sequence
  Description of Artificial Sequence: Synthetic peptide
TSSGNLS

SEQ ID NO: 35011 - protein, 7 aa, Artificial Sequence
  Description of Artificial Sequence: Synthetic peptide
TMSTRQS

SEQ ID NO: 35012 - protein, 7 aa, Artificial Sequence
  Description of Artificial Sequence: Synthetic peptide
STLNAGA

SEQ ID NO: 35013 - protein, 7 aa, Artificial Sequence
  Description of Artificial Sequence: Synthetic peptide
HLHASPA

SEQ ID NO: 35014 - protein, 7 aa, Artificial Sequence
  Description of Artificial Sequence: Synthetic peptide
GPAVTNR

SEQ ID NO: 35015 - protein, 7 aa, Artificial Sequence
  Description of Artificial Sequence: Synthetic peptide
ANGSGVG

SEQ ID NO: 35016 - protein, 7 aa, Artificial Sequence
  Description of Artificial Sequence: Synthetic peptide
SALMNNG

SEQ ID NO: 35017 - protein, 7 aa, Artificial Sequence
  Description of Artificial Sequence: Synthetic peptide
SQVSKPQ

SEQ ID NO: 35018 - protein, 7 aa, Artificial Sequence
  Description of Artificial Sequence: Synthetic peptide
PSTQSSS

SEQ ID NO: 35019 - protein, 7 aa, Artificial Sequence
  Description of Artificial Sequence: Synthetic peptide
NGFNSNN

SEQ ID NO: 35020 - protein, 7 aa, Artificial Sequence
  Description of Artificial Sequence: Synthetic peptide
SLSKSQS

SEQ ID NO: 35021 - protein, 7 aa, Artificial Sequence
  Description of Artificial Sequence: Synthetic peptide
SQQSPSM

SEQ ID NO: 35022 - protein, 7 aa, Artificial Sequence
  Description of Artificial Sequence: Synthetic peptide
QVHGKTQ

SEQ ID NO: 35023 - protein, 7 aa, Artificial Sequence
  Description of Artificial Sequence: Synthetic peptide
GQASHMK

SEQ ID NO: 35024 - protein, 7 aa, Artificial Sequence
  Description of Artificial Sequence: Synthetic peptide
APHSAAN

SEQ ID NO: 35025 - protein, 7 aa, Artificial Sequence
  Description of Artificial Sequence: Synthetic peptide
HANNKLM

SEQ ID NO: 35026 - protein, 7 aa, Artificial Sequence
  Description of Artificial Sequence: Synthetic peptide
SDINRST

SEQ ID NO: 35027 - protein, 7 aa, Artificial Sequence
  Description of Artificial Sequence: Synthetic peptide
GQNTHLT

SEQ ID NO: 35028 - protein, 7 aa, Artificial Sequence
  Description of Artificial Sequence: Synthetic peptide
SVSTKSA

SEQ ID NO: 35029 - protein, 7 aa, Artificial Sequence
  Description of Artificial Sequence: Synthetic peptide
SKVTAQS

SEQ ID NO: 35030 - protein, 7 aa, Artificial Sequence
  Description of Artificial Sequence: Synthetic peptide
SHNSKDS

SEQ ID NO: 35031 - protein, 7 aa, Artificial Sequence
  Description of Artificial Sequence: Synthetic peptide
VSSNASM

SEQ ID NO: 35032 - protein, 7 aa, Artificial Sequence
  Description of Artificial Sequence: Synthetic peptide
IKPSSSA

SEQ ID NO: 35033 - protein, 7 aa, Artificial Sequence
  Description of Artificial Sequence: Synthetic peptide
LVHKGPV

SEQ ID NO: 35034 - protein, 7 aa, Artificial Sequence
  Description of Artificial Sequence: Synthetic peptide
PPVTTRP

SEQ ID NO: 35035 - protein, 7 aa, Artificial Sequence
  Description of Artificial Sequence: Synthetic peptide
STHHPAS

SEQ ID NO: 35036 - protein, 7 aa, Artificial Sequence
  Description of Artificial Sequence: Synthetic peptide
SSSPNVK

SEQ ID NO: 35037 - protein, 7 aa, Artificial Sequence
  Description of Artificial Sequence: Synthetic peptide
AQTKGTQ

SEQ ID NO: 35038 - protein, 7 aa, Artificial Sequence
  Description of Artificial Sequence: Synthetic peptide
STTGGAS

SEQ ID NO: 35039 - protein, 7 aa, Artificial Sequence
  Description of Artificial Sequence: Synthetic peptide
VNMRNTM

SEQ ID NO: 35040 - protein, 7 aa, Artificial Sequence
  Description of Artificial Sequence: Synthetic peptide
CGRPLPA

SEQ ID NO: 35041 - protein, 7 aa, Artificial Sequence
  Description of Artificial Sequence: Synthetic peptide
GTGTTFR

SEQ ID NO: 35042 - protein, 7 aa, Artificial Sequence
  Description of Artificial Sequence: Synthetic peptide
NTTPSRG

SEQ ID NO: 35043 - protein, 7 aa, Artificial Sequence
  Description of Artificial Sequence: Synthetic peptide
GHVNAHV

SEQ ID NO: 35044 - protein, 7 aa, Artificial Sequence
  Description of Artificial Sequence: Synthetic peptide
NTNGSQR

SEQ ID NO: 35045 - protein, 7 aa, Artificial Sequence
  Description of Artificial Sequence: Synthetic peptide
ASLRESR

SEQ ID NO: 35046 - protein, 7 aa, Artificial Sequence
  Description of Artificial Sequence: Synthetic peptide
GSGNKVN

SEQ ID NO: 35047 - protein, 7 aa, Artificial Sequence
  Description of Artificial Sequence: Synthetic peptide
MQTSQST

SEQ ID NO: 35048 - protein, 7 aa, Artificial Sequence
  Description of Artificial Sequence: Synthetic peptide
SSSAPRL

SEQ ID NO: 35049 - protein, 7 aa, Artificial Sequence
  Description of Artificial Sequence: Synthetic peptide
IPHAGTA

SEQ ID NO: 35050 - protein, 7 aa, Artificial Sequence
  Description of Artificial Sequence: Synthetic peptide
RASQSVG

SEQ ID NO: 35051 - protein, 7 aa, Artificial Sequence
  Description of Artificial Sequence: Synthetic peptide
ATNNGSK

SEQ ID NO: 35052 - protein, 7 aa, Artificial Sequence
  Description of Artificial Sequence: Synthetic peptide
TVTNAAR

SEQ ID NO: 35053 - protein, 7 aa, Artificial Sequence
  Description of Artificial Sequence: Synthetic peptide
SSGLSSS

SEQ ID NO: 35054 - protein, 7 aa, Artificial Sequence
  Description of Artificial Sequence: Synthetic peptide
DPLRHSV

SEQ ID NO: 35055 - protein, 7 aa, Artificial Sequence
  Description of Artificial Sequence: Synthetic peptide
GAISNEH

SEQ ID NO: 35056 - protein, 7 aa, Artificial Sequence
  Description of Artificial Sequence: Synthetic peptide
NRVEHTQ

SEQ ID NO: 35057 - protein, 7 aa, Artificial Sequence
  Description of Artificial Sequence: Synthetic peptide
ERTPPRI

SEQ ID NO: 35058 - protein, 7 aa, Artificial Sequence
  Description of Artificial Sequence: Synthetic peptide
MPLKPHL

SEQ ID NO: 35059 - protein, 7 aa, Artificial Sequence
  Description of Artificial Sequence: Synthetic peptide
GDKTQAM

SEQ ID NO: 35060 - protein, 7 aa, Artificial Sequence
  Description of Artificial Sequence: Synthetic peptide
STNPANR

SEQ ID NO: 35061 - protein, 7 aa, Artificial Sequence
  Description of Artificial Sequence: Synthetic peptide
TPHQRSS

SEQ ID NO: 35062 - protein, 7 aa, Artificial Sequence
  Description of Artificial Sequence: Synthetic peptide
AQVDKRS

SEQ ID NO: 35063 - protein, 7 aa, Artificial Sequence
  Description of Artificial Sequence: Synthetic peptide
RSSDRSA

SEQ ID NO: 35064 - protein, 7 aa, Artificial Sequence
  Description of Artificial Sequence: Synthetic peptide
MSRLPST

SEQ ID NO: 35065 - protein, 7 aa, Artificial Sequence
  Description of Artificial Sequence: Synthetic peptide
TKYEGYT

SEQ ID NO: 35066 - protein, 7 aa, Artificial Sequence
  Description of Artificial Sequence: Synthetic peptide
RDGAHLR

SEQ ID NO: 35067 - protein, 7 aa, Artificial Sequence
  Description of Artificial Sequence: Synthetic peptide
YGSRPPS

SEQ ID NO: 35068 - protein, 7 aa, Artificial Sequence
  Description of Artificial Sequence: Synthetic peptide
RNDSRPP

SEQ ID NO: 35069 - protein, 7 aa, Artificial Sequence
  Description of Artificial Sequence: Synthetic peptide
GGNPSGS

SEQ ID NO: 35070 - protein, 7 aa, Artificial Sequence
  Description of Artificial Sequence: Synthetic peptide
SLSKQAA

SEQ ID NO: 35071 - protein, 7 aa, Artificial Sequence
  Description of Artificial Sequence: Synthetic peptide
ATGRSPN

SEQ ID NO: 35072 - protein, 7 aa, Artificial Sequence
  Description of Artificial Sequence: Synthetic peptide
VGGGRDN

SEQ ID NO: 35073 - protein, 7 aa, Artificial Sequence
  Description of Artificial Sequence: Synthetic peptide
SSQQKAS

SEQ ID NO: 35074 - protein, 7 aa, Artificial Sequence
  Description of Artificial Sequence: Synthetic peptide
NRSNNSV

SEQ ID NO: 35075 - protein, 7 aa, Artificial Sequence
  Description of Artificial Sequence: Synthetic peptide
SRGDGVT

SEQ ID NO: 35076 - protein, 7 aa, Artificial Sequence
  Description of Artificial Sequence: Synthetic peptide
ALANPQT

SEQ ID NO: 35077 - protein, 7 aa, Artificial Sequence
  Description of Artificial Sequence: Synthetic peptide
IPGHPTA

SEQ ID NO: 35078 - protein, 7 aa, Artificial Sequence
  Description of Artificial Sequence: Synthetic peptide
GFPSGTR

SEQ ID NO: 35079 - protein, 7 aa, Artificial Sequence
  Description of Artificial Sequence: Synthetic peptide
PTTLKHD

SEQ ID NO: 35080 - protein, 7 aa, Artificial Sequence
  Description of Artificial Sequence: Synthetic peptide
SIPSTVR

SEQ ID NO: 35081 - protein, 7 aa, Artificial Sequence
  Description of Artificial Sequence: Synthetic peptide
NRLPATK

SEQ ID NO: 35082 - protein, 7 aa, Artificial Sequence
  Description of Artificial Sequence: Synthetic peptide
SDNKGSV

SEQ ID NO: 35083 - protein, 7 aa, Artificial Sequence
  Description of Artificial Sequence: Synthetic peptide
MATSTVK

SEQ ID NO: 35084 - protein, 7 aa, Artificial Sequence
  Description of Artificial Sequence: Synthetic peptide
YNGGNRS

SEQ ID NO: 35085 - protein, 7 aa, Artificial Sequence
  Description of Artificial Sequence: Synthetic peptide
GTSLKMS

SEQ ID NO: 35086 - protein, 7 aa, Artificial Sequence
  Description of Artificial Sequence: Synthetic peptide
LLNSTGM

SEQ ID NO: 35087 - protein, 7 aa, Artificial Sequence
  Description of Artificial Sequence: Synthetic peptide
FMGSPTT

SEQ ID NO: 35088 - protein, 7 aa, Artificial Sequence
  Description of Artificial Sequence: Synthetic peptide
SGSEHLR

SEQ ID NO: 35089 - protein, 7 aa, Artificial Sequence
  Description of Artificial Sequence: Synthetic peptide
GNTKNGI

SEQ ID NO: 35090 - protein, 7 aa, Artificial Sequence
  Description of Artificial Sequence: Synthetic peptide
IRSTSGG

SEQ ID NO: 35091 - protein, 7 aa, Artificial Sequence
  Description of Artificial Sequence: Synthetic peptide
SGVVKSS

SEQ ID NO: 35092 - protein, 7 aa, Artificial Sequence
  Description of Artificial Sequence: Synthetic peptide
SSAGTYT

SEQ ID NO: 35093 - protein, 7 aa, Artificial Sequence
  Description of Artificial Sequence: Synthetic peptide
AQQRAQA

SEQ ID NO: 35094 - protein, 7 aa, Artificial Sequence
  Description of Artificial Sequence: Synthetic peptide
SSPTRSL

SEQ ID NO: 35095 - protein, 7 aa, Artificial Sequence
  Description of Artificial Sequence: Synthetic peptide
WGNELRR

SEQ ID NO: 35096 - protein, 7 aa, Artificial Sequence
  Description of Artificial Sequence: Synthetic peptide
PLSKSAL

SEQ ID NO: 35097 - protein, 7 aa, Artificial Sequence
  Description of Artificial Sequence: Synthetic peptide
PISSKIH

SEQ ID NO: 35098 - protein, 7 aa, Artificial Sequence
  Description of Artificial Sequence: Synthetic peptide
TGNKGGV

SEQ ID NO: 35099 - protein, 7 aa, Artificial Sequence
  Description of Artificial Sequence: Synthetic peptide
RTVNSAN

SEQ ID NO: 35100 - protein, 7 aa, Artificial Sequence
  Description of Artificial Sequence: Synthetic peptide
TGIERPM

SEQ ID NO: 35101 - protein, 7 aa, Artificial Sequence
  Description of Artificial Sequence: Synthetic peptide
QLSGARS

SEQ ID NO: 35102 - protein, 7 aa, Artificial Sequence
  Description of Artificial Sequence: Synthetic peptide
RSPSTNP

SEQ ID NO: 35103 - protein, 7 aa, Artificial Sequence
  Description of Artificial Sequence: Synthetic peptide
HDRGQNG

SEQ ID NO: 35104 - protein, 7 aa, Artificial Sequence
  Description of Artificial Sequence: Synthetic peptide
VSNSPSR

SEQ ID NO: 35105 - protein, 7 aa, Artificial Sequence
  Description of Artificial Sequence: Synthetic peptide
HSSRPLE

SEQ ID NO: 35106 - protein, 7 aa, Artificial Sequence
  Description of Artificial Sequence: Synthetic peptide
RKPGSMM

SEQ ID NO: 35107 - protein, 7 aa, Artificial Sequence
  Description of Artificial Sequence: Synthetic peptide
NSVGHSR

SEQ ID NO: 35108 - protein, 7 aa, Artificial Sequence
  Description of Artificial Sequence: Synthetic peptide
RQTDKLS

SEQ ID NO: 35109 - protein, 7 aa, Artificial Sequence
  Description of Artificial Sequence: Synthetic peptide
APLQSNL

SEQ ID NO: 35110 - protein, 7 aa, Artificial Sequence
  Description of Artificial Sequence: Synthetic peptide
ARGKPAL

SEQ ID NO: 35111 - protein, 7 aa, Artificial Sequence
  Description of Artificial Sequence: Synthetic peptide
PGRPQTD

SEQ ID NO: 35112 - protein, 7 aa, Artificial Sequence
  Description of Artificial Sequence: Synthetic peptide
TRQGMGS

SEQ ID NO: 35113 - protein, 7 aa, Artificial Sequence
  Description of Artificial Sequence: Synthetic peptide
GAERTVL

SEQ ID NO: 35114 - protein, 7 aa, Artificial Sequence
  Description of Artificial Sequence: Synthetic peptide
MGQVGVR

SEQ ID NO: 35115 - protein, 7 aa, Artificial Sequence
  Description of Artificial Sequence: Synthetic peptide
NNGRPIA

SEQ ID NO: 35116 - protein, 7 aa, Artificial Sequence
  Description of Artificial Sequence: Synthetic peptide
YRNVNSS

SEQ ID NO: 35117 - protein, 7 aa, Artificial Sequence
  Description of Artificial Sequence: Synthetic peptide
NGSGQHQ

SEQ ID NO: 35118 - protein, 7 aa, Artificial Sequence
  Description of Artificial Sequence: Synthetic peptide
SIPISHV

SEQ ID NO: 35119 - protein, 7 aa, Artificial Sequence
  Description of Artificial Sequence: Synthetic peptide
SNGQGPA

SEQ ID NO: 35120 - protein, 7 aa, Artificial Sequence
  Description of Artificial Sequence: Synthetic peptide
GMHSVAK

SEQ ID NO: 35121 - protein, 7 aa, Artificial Sequence
  Description of Artificial Sequence: Synthetic peptide
GASTPRL

SEQ ID NO: 35122 - protein, 7 aa, Artificial Sequence
  Description of Artificial Sequence: Synthetic peptide
GLKGSFP

SEQ ID NO: 35123 - protein, 7 aa, Artificial Sequence
  Description of Artificial Sequence: Synthetic peptide
SNPSGFS

SEQ ID NO: 35124 - protein, 7 aa, Artificial Sequence
  Description of Artificial Sequence: Synthetic peptide
STVGHMT

SEQ ID NO: 35125 - protein, 7 aa, Artificial Sequence
  Description of Artificial Sequence: Synthetic peptide
GPSSPRL

SEQ ID NO: 35126 - protein, 7 aa, Artificial Sequence
  Description of Artificial Sequence: Synthetic peptide
GQAVNTA

SEQ ID NO: 35127 - protein, 7 aa, Artificial Sequence
  Description of Artificial Sequence: Synthetic peptide
GASVNQG

SEQ ID NO: 35128 - protein, 7 aa, Artificial Sequence
  Description of Artificial Sequence: Synthetic peptide
TTMSKPS

SEQ ID NO: 35129 - protein, 7 aa, Artificial Sequence
  Description of Artificial Sequence: Synthetic peptide
TSSARVT

SEQ ID NO: 35130 - protein, 7 aa, Artificial Sequence
  Description of Artificial Sequence: Synthetic peptide
GDKNHGS

SEQ ID NO: 35131 - protein, 7 aa, Artificial Sequence
  Description of Artificial Sequence: Synthetic peptide
PTLGTTK

SEQ ID NO: 35132 - protein, 7 aa, Artificial Sequence
  Description of Artificial Sequence: Synthetic peptide
HMTHTTA

SEQ ID NO: 35133 - protein, 7 aa, Artificial Sequence
  Description of Artificial Sequence: Synthetic peptide
VASSAHV

SEQ ID NO: 35134 - protein, 7 aa, Artificial Sequence
  Description of Artificial Sequence: Synthetic peptide
SYPSQLN

SEQ ID NO: 35135 - protein, 7 aa, Artificial Sequence
  Description of Artificial Sequence: Synthetic peptide
PTKANVT

SEQ ID NO: 35136 - protein, 7 aa, Artificial Sequence
  Description of Artificial Sequence: Synthetic peptide
GRSPTAS

SEQ ID NO: 35137 - protein, 7 aa, Artificial Sequence
  Description of Artificial Sequence: Synthetic peptide
ATGRNTA

SEQ ID NO: 35138 - protein, 7 aa, Artificial Sequence
  Description of Artificial Sequence: Synthetic peptide
SSGSNRS

SEQ ID NO: 35139 - protein, 7 aa, Artificial Sequence
  Description of Artificial Sequence: Synthetic peptide
APTSGPS

SEQ ID NO: 35140 - protein, 7 aa, Artificial Sequence
  Description of Artificial Sequence: Synthetic peptide
SPTSASL

SEQ ID NO: 35141 - protein, 7 aa, Artificial Sequence
  Description of Artificial Sequence: Synthetic peptide
VPSSRSN

SEQ ID NO: 35142 - protein, 7 aa, Artificial Sequence
  Description of Artificial Sequence: Synthetic peptide
TSTQKGQ

SEQ ID NO: 35143 - protein, 7 aa, Artificial Sequence
  Description of Artificial Sequence: Synthetic peptide
NQINAPR

SEQ ID NO: 35144 - protein, 7 aa, Artificial Sequence
  Description of Artificial Sequence: Synthetic peptide
SATGSRL

SEQ ID NO: 35145 - protein, 7 aa, Artificial Sequence
  Description of Artificial Sequence: Synthetic peptide
VSYARTE

SEQ ID NO: 35146 - protein, 7 aa, Artificial Sequence
  Description of Artificial Sequence: Synthetic peptide
GLDHLRT

SEQ ID NO: 35147 - protein, 7 aa, Artificial Sequence
  Description of Artificial Sequence: Synthetic peptide
LPHTSQS

SEQ ID NO: 35148 - protein, 7 aa, Artificial Sequence
  Description of Artificial Sequence: Synthetic peptide
SPNKTSL

SEQ ID NO: 35149 - protein, 7 aa, Artificial Sequence
  Description of Artificial Sequence: Synthetic peptide
GLATLSG

SEQ ID NO: 35150 - protein, 7 aa, Artificial Sequence
  Description of Artificial Sequence: Synthetic peptide
SYGKESS

SEQ ID NO: 35151 - protein, 7 aa, Artificial Sequence
  Description of Artificial Sequence: Synthetic peptide
QGRANGS

SEQ ID NO: 35152 - protein, 7 aa, Artificial Sequence
  Description of Artificial Sequence: Synthetic peptide
PGGTTKG

SEQ ID NO: 35153 - protein, 7 aa, Artificial Sequence
  Description of Artificial Sequence: Synthetic peptide
SPMRSQV

SEQ ID NO: 35154 - protein, 7 aa, Artificial Sequence
  Description of Artificial Sequence: Synthetic peptide
ALGGKHV

SEQ ID NO: 35155 - protein, 7 aa, Artificial Sequence
  Description of Artificial Sequence: Synthetic peptide
FANTANR

SEQ ID NO: 35156 - protein, 7 aa, Artificial Sequence
  Description of Artificial Sequence: Synthetic peptide
FGDHTRT

SEQ ID NO: 35157 - protein, 7 aa, Artificial Sequence
  Description of Artificial Sequence: Synthetic peptide
NVVGTGA

SEQ ID NO: 35158 - protein, 7 aa, Artificial Sequence
  Description of Artificial Sequence: Synthetic peptide
SRSPGTS

SEQ ID NO: 35159 - protein, 7 aa, Artificial Sequence
  Description of Artificial Sequence: Synthetic peptide
PVPYRAD

SEQ ID NO: 35160 - protein, 7 aa, Artificial Sequence
  Description of Artificial Sequence: Synthetic peptide
PTKGANA

SEQ ID NO: 35161 - protein, 7 aa, Artificial Sequence
  Description of Artificial Sequence: Synthetic peptide
TTNTVSR

SEQ ID NO: 35162 - protein, 7 aa, Artificial Sequence
  Description of Artificial Sequence: Synthetic peptide
NGSARMT

SEQ ID NO: 35163 - protein, 7 aa, Artificial Sequence
  Description of Artificial Sequence: Synthetic peptide
QNSKGYV

SEQ ID NO: 35164 - protein, 7 aa, Artificial Sequence
  Description of Artificial Sequence: Synthetic peptide
SGGTPGR

SEQ ID NO: 35165 - protein, 7 aa, Artificial Sequence
  Description of Artificial Sequence: Synthetic peptide
NSSGHYQ

SEQ ID NO: 35166 - protein, 7 aa, Artificial Sequence
  Description of Artificial Sequence: Synthetic peptide
NVPSISR

SEQ ID NO: 35167 - protein, 7 aa, Artificial Sequence
  Description of Artificial Sequence: Synthetic peptide
GLAGSLQ

SEQ ID NO: 35168 - protein, 7 aa, Artificial Sequence
  Description of Artificial Sequence: Synthetic peptide
HQSSSSS

SEQ ID NO: 35169 - protein, 7 aa, Artificial Sequence
  Description of Artificial Sequence: Synthetic peptide
DRAGKQS

SEQ ID NO: 35170 - protein, 7 aa, Artificial Sequence
  Description of Artificial Sequence: Synthetic peptide
NALPVTQ

SEQ ID NO: 35171 - protein, 7 aa, Artificial Sequence
  Description of Artificial Sequence: Synthetic peptide
EVHAKNN

SEQ ID NO: 35172 - protein, 7 aa, Artificial Sequence
  Description of Artificial Sequence: Synthetic peptide
GTSGGIV

SEQ ID NO: 35173 - protein, 7 aa, Artificial Sequence
  Description of Artificial Sequence: Synthetic peptide
WGGSADR

SEQ ID NO: 35174 - protein, 7 aa, Artificial Sequence
  Description of Artificial Sequence: Synthetic peptide
NQSAKST

SEQ ID NO: 35175 - protein, 7 aa, Artificial Sequence
  Description of Artificial Sequence: Synthetic peptide
ASSSRPS

SEQ ID NO: 35176 - protein, 7 aa, Artificial Sequence
  Description of Artificial Sequence: Synthetic peptide
DRLDHSR

SEQ ID NO: 35177 - protein, 7 aa, Artificial Sequence
  Description of Artificial Sequence: Synthetic peptide
SIPTSAR

SEQ ID NO: 35178 - protein, 7 aa, Artificial Sequence
  Description of Artificial Sequence: Synthetic peptide
TRNGQGD

SEQ ID NO: 35179 - protein, 7 aa, Artificial Sequence
  Description of Artificial Sequence: Synthetic peptide
PYSRPAQ

SEQ ID NO: 35180 - protein, 7 aa, Artificial Sequence
  Description of Artificial Sequence: Synthetic peptide
VGSGRAN

SEQ ID NO: 35181 - protein, 7 aa, Artificial Sequence
  Description of Artificial Sequence: Synthetic peptide
NRVGSIS

SEQ ID NO: 35182 - protein, 7 aa, Artificial Sequence
  Description of Artificial Sequence: Synthetic peptide
GTNPGTL

SEQ ID NO: 35183 - protein, 7 aa, Artificial Sequence
  Description of Artificial Sequence: Synthetic peptide
NGNHGLI

SEQ ID NO: 35184 - protein, 7 aa, Artificial Sequence
  Description of Artificial Sequence: Synthetic peptide
PGINTNS

SEQ ID NO: 35185 - protein, 7 aa, Artificial Sequence
  Description of Artificial Sequence: Synthetic peptide
RPSSVKD

SEQ ID NO: 35186 - protein, 7 aa, Artificial Sequence
  Description of Artificial Sequence: Synthetic peptide
CLGSNNL

SEQ ID NO: 35187 - protein, 7 aa, Artificial Sequence
  Description of Artificial Sequence: Synthetic peptide
DPDTRKS

SEQ ID NO: 35188 - protein, 7 aa, Artificial Sequence
  Description of Artificial Sequence: Synthetic peptide
QLQPRVA

SEQ ID NO: 35189 - protein, 7 aa, Artificial Sequence
  Description of Artificial Sequence: Synthetic peptide
RPASTHT

SEQ ID NO: 35190 - protein, 7 aa, Artificial Sequence
  Description of Artificial Sequence: Synthetic peptide
ASSSKSV

SEQ ID NO: 35191 - protein, 7 aa, Artificial Sequence
  Description of Artificial Sequence: Synthetic peptide
HTRPNSM

SEQ ID NO: 35192 - protein, 7 aa, Artificial Sequence
  Description of Artificial Sequence: Synthetic peptide
NGVPQPK

SEQ ID NO: 35193 - protein, 7 aa, Artificial Sequence
  Description of Artificial Sequence: Synthetic peptide
SHASSTA

SEQ ID NO: 35194 - protein, 7 aa, Artificial Sequence
  Description of Artificial Sequence: Synthetic peptide
TGERQSS

SEQ ID NO: 35195 - protein, 7 aa, Artificial Sequence
  Description of Artificial Sequence: Synthetic peptide
PTHASSL

SEQ ID NO: 35196 - protein, 7 aa, Artificial Sequence
  Description of Artificial Sequence: Synthetic peptide
VASSPLR

SEQ ID NO: 35197 - protein, 7 aa, Artificial Sequence
  Description of Artificial Sequence: Synthetic peptide
RPGGKDG

SEQ ID NO: 35198 - protein, 7 aa, Artificial Sequence
  Description of Artificial Sequence: Synthetic peptide
RDTNRFG

SEQ ID NO: 35199 - protein, 7 aa, Artificial Sequence
  Description of Artificial Sequence: Synthetic peptide
APSSQLL

SEQ ID NO: 35200 - protein, 7 aa, Artificial Sequence
  Description of Artificial Sequence: Synthetic peptide
VNTNLVG

SEQ ID NO: 35201 - protein, 7 aa, Artificial Sequence
  Description of Artificial Sequence: Synthetic peptide
SSPSHMA

SEQ ID NO: 35202 - protein, 7 aa, Artificial Sequence
  Description of Artificial Sequence: Synthetic peptide
SHATAAT

SEQ ID NO: 35203 - protein, 7 aa, Artificial Sequence
  Description of Artificial Sequence: Synthetic peptide
DAGSRSS

SEQ ID NO: 35204 - protein, 7 aa, Artificial Sequence
  Description of Artificial Sequence: Synthetic peptide
HGTTPAR

SEQ ID NO: 35205 - protein, 7 aa, Artificial Sequence
  Description of Artificial Sequence: Synthetic peptide
EPLSKQS

SEQ ID NO: 35206 - protein, 7 aa, Artificial Sequence
  Description of Artificial Sequence: Synthetic peptide
RHQGTLQ

SEQ ID NO: 35207 - protein, 7 aa, Artificial Sequence
  Description of Artificial Sequence: Synthetic peptide
PLTTRPS

SEQ ID NO: 35208 - protein, 7 aa, Artificial Sequence
  Description of Artificial Sequence: Synthetic peptide
SSSTHAV

SEQ ID NO: 35209 - protein, 7 aa, Artificial Sequence
  Description of Artificial Sequence: Synthetic peptide
QTHAPTS

SEQ ID NO: 35210 - protein, 7 aa, Artificial Sequence
  Description of Artificial Sequence: Synthetic peptide
NGTGQNQ

SEQ ID NO: 35211 - protein, 7 aa, Artificial Sequence
  Description of Artificial Sequence: Synthetic peptide
SYGHPGA

SEQ ID NO: 35212 - protein, 7 aa, Artificial Sequence
  Description of Artificial Sequence: Synthetic peptide
QSGSKPG

SEQ ID NO: 35213 - protein, 7 aa, Artificial Sequence
  Description of Artificial Sequence: Synthetic peptide
SFAKSAS

SEQ ID NO: 35214 - protein, 7 aa, Artificial Sequence
  Description of Artificial Sequence: Synthetic peptide
RPVGGLA

SEQ ID NO: 35215 - protein, 7 aa, Artificial Sequence
  Description of Artificial Sequence: Synthetic peptide
LVSHTHG

SEQ ID NO: 35216 - protein, 7 aa, Artificial Sequence
  Description of Artificial Sequence: Synthetic peptide
LTPSSTV

SEQ ID NO: 35217 - protein, 7 aa, Artificial Sequence
  Description of Artificial Sequence: Synthetic peptide
SIHSTKA

SEQ ID NO: 35218 - protein, 7 aa, Artificial Sequence
  Description of Artificial Sequence: Synthetic peptide
GVINNER

SEQ ID NO: 35219 - protein, 7 aa, Artificial Sequence
  Description of Artificial Sequence: Synthetic peptide
DPLRNSN

SEQ ID NO: 35220 - protein, 7 aa, Artificial Sequence
  Description of Artificial Sequence: Synthetic peptide
NANQNQM

SEQ ID NO: 35221 - protein, 7 aa, Artificial Sequence
  Description of Artificial Sequence: Synthetic peptide
SQVSHSV

SEQ ID NO: 35222 - protein, 7 aa, Artificial Sequence
  Description of Artificial Sequence: Synthetic peptide
GHSTVGS

SEQ ID NO: 35223 - protein, 7 aa, Artificial Sequence
  Description of Artificial Sequence: Synthetic peptide
RFSDSNT

SEQ ID NO: 35224 - protein, 7 aa, Artificial Sequence
  Description of Artificial Sequence: Synthetic peptide
TGTATLR

SEQ ID NO: 35225 - protein, 7 aa, Artificial Sequence
  Description of Artificial Sequence: Synthetic peptide
GQGVRAM

SEQ ID NO: 35226 - protein, 7 aa, Artificial Sequence
  Description of Artificial Sequence: Synthetic peptide
AGSHKGV

SEQ ID NO: 35227 - protein, 7 aa, Artificial Sequence
  Description of Artificial Sequence: Synthetic peptide
SGNSHNG

SEQ ID NO: 35228 - protein, 7 aa, Artificial Sequence
  Description of Artificial Sequence: Synthetic peptide
SGATTPR

SEQ ID NO: 35229 - protein, 7 aa, Artificial Sequence
  Description of Artificial Sequence: Synthetic peptide
TGMRPPG

SEQ ID NO: 35230 - protein, 7 aa, Artificial Sequence
  Description of Artificial Sequence: Synthetic peptide
KQTHSGS

SEQ ID NO: 35231 - protein, 7 aa, Artificial Sequence
  Description of Artificial Sequence: Synthetic peptide
QGQTAMR

SEQ ID NO: 35232 - protein, 7 aa, Artificial Sequence
  Description of Artificial Sequence: Synthetic peptide
GQVNHTT

SEQ ID NO: 35233 - protein, 7 aa, Artificial Sequence
  Description of Artificial Sequence: Synthetic peptide
GNSTRLL

SEQ ID NO: 35234 - protein, 7 aa, Artificial Sequence
  Description of Artificial Sequence: Synthetic peptide
HVHDGRT

SEQ ID NO: 35235 - protein, 7 aa, Artificial Sequence
  Description of Artificial Sequence: Synthetic peptide
PLGNRPS

SEQ ID NO: 35236 - protein, 7 aa, Artificial Sequence
  Description of Artificial Sequence: Synthetic peptide
EPVTSKS

SEQ ID NO: 35237 - protein, 7 aa, Artificial Sequence
  Description of Artificial Sequence: Synthetic peptide
HKTTSMA

SEQ ID NO: 35238 - protein, 7 aa, Artificial Sequence
  Description of Artificial Sequence: Synthetic peptide
TTAGSRC

SEQ ID NO: 35239 - protein, 7 aa, Artificial Sequence
  Description of Artificial Sequence: Synthetic peptide
DIPSRAA

SEQ ID NO: 35240 - protein, 7 aa, Artificial Sequence
  Description of Artificial Sequence: Synthetic peptide
REDTKMH

SEQ ID NO: 35241 - protein, 7 aa, Artificial Sequence
  Description of Artificial Sequence: Synthetic peptide
RLNDRPG

SEQ ID NO: 35242 - protein, 7 aa, Artificial Sequence
  Description of Artificial Sequence: Synthetic peptide
RTGHYQD

SEQ ID NO: 35243 - protein, 7 aa, Artificial Sequence
  Description of Artificial Sequence: Synthetic peptide
NCSGQNQ

SEQ ID NO: 35244 - protein, 7 aa, Artificial Sequence
  Description of Artificial Sequence: Synthetic peptide
NVSGQNQ

SEQ ID NO: 35245 - protein, 7 aa, Artificial Sequence
  Description of Artificial Sequence: Synthetic peptide
SRTNATA

SEQ ID NO: 35246 - protein, 7 aa, Artificial Sequence
  Description of Artificial Sequence: Synthetic peptide
SSTNRPT

SEQ ID NO: 35247 - protein, 7 aa, Artificial Sequence
  Description of Artificial Sequence: Synthetic peptide
VGLQSPE

SEQ ID NO: 35248 - protein, 7 aa, Artificial Sequence
  Description of Artificial Sequence: Synthetic peptide
GIGSAAV

SEQ ID NO: 35249 - protein, 7 aa, Artificial Sequence
  Description of Artificial Sequence: Synthetic peptide
SSPSKMA

SEQ ID NO: 35250 - protein, 7 aa, Artificial Sequence
  Description of Artificial Sequence: Synthetic peptide
RAETNAI

SEQ ID NO: 35251 - protein, 7 aa, Artificial Sequence
  Description of Artificial Sequence: Synthetic peptide
CPGSSAY

SEQ ID NO: 35252 - protein, 7 aa, Artificial Sequence
  Description of Artificial Sequence: Synthetic peptide
ENISRSH

SEQ ID NO: 35253 - protein, 7 aa, Artificial Sequence
  Description of Artificial Sequence: Synthetic peptide
SSSSHPL

SEQ ID NO: 35254 - protein, 7 aa, Artificial Sequence
  Description of Artificial Sequence: Synthetic peptide
EPTHPRG

SEQ ID NO: 35255 - protein, 7 aa, Artificial Sequence
  Description of Artificial Sequence: Synthetic peptide
HAHSNVG

SEQ ID NO: 35256 - protein, 7 aa, Artificial Sequence
  Description of Artificial Sequence: Synthetic peptide
GNPSPLV

SEQ ID NO: 35257 - protein, 7 aa, Artificial Sequence
  Description of Artificial Sequence: Synthetic peptide
QSNTSPT

SEQ ID NO: 35258 - protein, 7 aa, Artificial Sequence
  Description of Artificial Sequence: Synthetic peptide
GIQNPTC

SEQ ID NO: 35259 - protein, 7 aa, Artificial Sequence
  Description of Artificial Sequence: Synthetic peptide
QSDHRSL

SEQ ID NO: 35260 - protein, 7 aa, Artificial Sequence
  Description of Artificial Sequence: Synthetic peptide
QETRGNS

SEQ ID NO: 35261 - protein, 7 aa, Artificial Sequence
  Description of Artificial Sequence: Synthetic peptide
SMAPAGL

SEQ ID NO: 35262 - protein, 7 aa, Artificial Sequence
  Description of Artificial Sequence: Synthetic peptide
TGTGSFH

SEQ ID NO: 35263 - protein, 7 aa, Artificial Sequence
  Description of Artificial Sequence: Synthetic peptide
KSCKGMV

SEQ ID NO: 35264 - protein, 7 aa, Artificial Sequence
  Description of Artificial Sequence: Synthetic peptide
GGDNKLT

SEQ ID NO: 35265 - protein, 7 aa, Artificial Sequence
  Description of Artificial Sequence: Synthetic peptide
DRADANS

SEQ ID NO: 35266 - protein, 7 aa, Artificial Sequence
  Description of Artificial Sequence: Synthetic peptide
APSARPS

SEQ ID NO: 35267 - protein, 7 aa, Artificial Sequence
  Description of Artificial Sequence: Synthetic peptide
GYGSKVS

SEQ ID NO: 35268 - protein, 7 aa, Artificial Sequence
  Description of Artificial Sequence: Synthetic peptide
SSAKSSL

SEQ ID NO: 35269 - protein, 7 aa, Artificial Sequence
  Description of Artificial Sequence: Synthetic peptide
FVSARSG

SEQ ID NO: 35270 - protein, 7 aa, Artificial Sequence
  Description of Artificial Sequence: Synthetic peptide
PNGSPLS

SEQ ID NO: 35271 - protein, 7 aa, Artificial Sequence
  Description of Artificial Sequence: Synthetic peptide
KNSSGST

SEQ ID NO: 35272 - protein, 7 aa, Artificial Sequence
  Description of Artificial Sequence: Synthetic peptide
NMRASTE

SEQ ID NO: 35273 - protein, 7 aa, Artificial Sequence
  Description of Artificial Sequence: Synthetic peptide
DGSGQNQ

SEQ ID NO: 35274 - protein, 7 aa, Artificial Sequence
  Description of Artificial Sequence: Synthetic peptide
CITKNLA

SEQ ID NO: 35275 - protein, 7 aa, Artificial Sequence
  Description of Artificial Sequence: Synthetic peptide
GALNSRG

SEQ ID NO: 35276 - protein, 7 aa, Artificial Sequence
  Description of Artificial Sequence: Synthetic peptide
YQVPLAK

SEQ ID NO: 35277 - protein, 7 aa, Artificial Sequence
  Description of Artificial Sequence: Synthetic peptide
TPTLSHT

SEQ ID NO: 35278 - protein, 7 aa, Artificial Sequence
  Description of Artificial Sequence: Synthetic peptide
NGCGQNQ

SEQ ID NO: 35279 - protein, 7 aa, Artificial Sequence
  Description of Artificial Sequence: Synthetic peptide
HITSNHA

SEQ ID NO: 35280 - protein, 7 aa, Artificial Sequence
  Description of Artificial Sequence: Synthetic peptide
RGKEERD

SEQ ID NO: 35281 - protein, 7 aa, Artificial Sequence
  Description of Artificial Sequence: Synthetic peptide
NGSGENQ

SEQ ID NO: 35282 - protein, 7 aa, Artificial Sequence
  Description of Artificial Sequence: Synthetic peptide
PAAMSSV

SEQ ID NO: 35283 - protein, 7 aa, Artificial Sequence
  Description of Artificial Sequence: Synthetic peptide
SVGTSGL

SEQ ID NO: 35284 - protein, 7 aa, Artificial Sequence
  Description of Artificial Sequence: Synthetic peptide
TQRSQTA

SEQ ID NO: 35285 - protein, 7 aa, Artificial Sequence
  Description of Artificial Sequence: Synthetic peptide
NLGQNLS

SEQ ID NO: 35286 - protein, 7 aa, Artificial Sequence
  Description of Artificial Sequence: Synthetic peptide
CPSTKSC

SEQ ID NO: 35287 - protein, 7 aa, Artificial Sequence
  Description of Artificial Sequence: Synthetic peptide
SPTSPMN

SEQ ID NO: 35288 - protein, 7 aa, Artificial Sequence
  Description of Artificial Sequence: Synthetic peptide
NKTMSST

SEQ ID NO: 35289 - protein, 7 aa, Artificial Sequence
  Description of Artificial Sequence: Synthetic peptide
SYSSKET

SEQ ID NO: 35290 - protein, 7 aa, Artificial Sequence
  Description of Artificial Sequence: Synthetic peptide
PVQHSSN

SEQ ID NO: 35291 - protein, 7 aa, Artificial Sequence
  Description of Artificial Sequence: Synthetic peptide
LGIAKIG

SEQ ID NO: 35292 - protein, 7 aa, Artificial Sequence
  Description of Artificial Sequence: Synthetic peptide
NRSKESA

SEQ ID NO: 35293 - protein, 7 aa, Artificial Sequence
  Description of Artificial Sequence: Synthetic peptide
PPHDGQR

SEQ ID NO: 35294 - protein, 7 aa, Artificial Sequence
  Description of Artificial Sequence: Synthetic peptide
HGVNKTE

SEQ ID NO: 35295 - protein, 7 aa, Artificial Sequence
  Description of Artificial Sequence: Synthetic peptide
DQVSHKL

SEQ ID NO: 35296 - protein, 7 aa, Artificial Sequence
  Description of Artificial Sequence: Synthetic peptide
NSANKTP

SEQ ID NO: 35297 - protein, 7 aa, Artificial Sequence
  Description of Artificial Sequence: Synthetic peptide
MPHPSSK

SEQ ID NO: 35298 - protein, 7 aa, Artificial Sequence
  Description of Artificial Sequence: Synthetic peptide
SHGPQIT

SEQ ID NO: 35299 - protein, 7 aa, Artificial Sequence
  Description of Artificial Sequence: Synthetic peptide
EGGTRNC

SEQ ID NO: 35300 - protein, 7 aa, Artificial Sequence
  Description of Artificial Sequence: Synthetic peptide
ETRPAIC

SEQ ID NO: 35301 - protein, 7 aa, Artificial Sequence
  Description of Artificial Sequence: Synthetic peptide
RPHDNDN

SEQ ID NO: 35302 - protein, 7 aa, Artificial Sequence
  Description of Artificial Sequence: Synthetic peptide
RTSEHDR

SEQ ID NO: 35303 - protein, 7 aa, Artificial Sequence
  Description of Artificial Sequence: Synthetic peptide
TGSSSSQ

SEQ ID NO: 35304 - protein, 7 aa, Artificial Sequence
  Description of Artificial Sequence: Synthetic peptide
FASRPVQ

SEQ ID NO: 35305 - protein, 7 aa, Artificial Sequence
  Description of Artificial Sequence: Synthetic peptide
GALHTRD

SEQ ID NO: 35306 - protein, 7 aa, Artificial Sequence
  Description of Artificial Sequence: Synthetic peptide
MPSQRDG

SEQ ID NO: 35307 - protein, 7 aa, Artificial Sequence
  Description of Artificial Sequence: Synthetic peptide
AMGSSLS

SEQ ID NO: 35308 - protein, 7 aa, Artificial Sequence
  Description of Artificial Sequence: Synthetic peptide
AMSASRN

SEQ ID NO: 35309 - protein, 7 aa, Artificial Sequence
  Description of Artificial Sequence: Synthetic peptide
VSTTPAL

SEQ ID NO: 35310 - protein, 7 aa, Artificial Sequence
  Description of Artificial Sequence: Synthetic peptide
GNTGSYQ

SEQ ID NO: 35311 - protein, 7 aa, Artificial Sequence
  Description of Artificial Sequence: Synthetic peptide
NRKHTST

SEQ ID NO: 35312 - protein, 7 aa, Artificial Sequence
  Description of Artificial Sequence: Synthetic peptide
GNISTSS

SEQ ID NO: 35313 - protein, 7 aa, Artificial Sequence
  Description of Artificial Sequence: Synthetic peptide
SIQSAAA

SEQ ID NO: 35314 - protein, 7 aa, Artificial Sequence
  Description of Artificial Sequence: Synthetic peptide
NDSGQNQ

SEQ ID NO: 35315 - protein, 7 aa, Artificial Sequence
  Description of Artificial Sequence: Synthetic peptide
NTSTNGI

SEQ ID NO: 35316 - protein, 7 aa, Artificial Sequence
  Description of Artificial Sequence: Synthetic peptide
MSTHSSG

SEQ ID NO: 35317 - protein, 7 aa, Artificial Sequence
  Description of Artificial Sequence: Synthetic peptide
NGSGQKQ

SEQ ID NO: 35318 - protein, 7 aa, Artificial Sequence
  Description of Artificial Sequence: Synthetic peptide
SFTGNTV

SEQ ID NO: 35319 - protein, 7 aa, Artificial Sequence
  Description of Artificial Sequence: Synthetic peptide
ELAAPSK

SEQ ID NO: 35320 - protein, 7 aa, Artificial Sequence
  Description of Artificial Sequence: Synthetic peptide
FSNNGSH

SEQ ID NO: 35321 - protein, 7 aa, Artificial Sequence
  Description of Artificial Sequence: Synthetic peptide
LTAVSPK

SEQ ID NO: 35322 - protein, 7 aa, Artificial Sequence
  Description of Artificial Sequence: Synthetic peptide
NASTANM

SEQ ID NO: 35323 - protein, 7 aa, Artificial Sequence
  Description of Artificial Sequence: Synthetic peptide
HTDTSAV

SEQ ID NO: 35324 - protein, 7 aa, Artificial Sequence
  Description of Artificial Sequence: Synthetic peptide
SGTQTWS

SEQ ID NO: 35325 - protein, 7 aa, Artificial Sequence
  Description of Artificial Sequence: Synthetic peptide
NGSGQNE

SEQ ID NO: 35326 - protein, 7 aa, Artificial Sequence
  Description of Artificial Sequence: Synthetic peptide
SYPQQSA

SEQ ID NO: 35327 - protein, 7 aa, Artificial Sequence
  Description of Artificial Sequence: Synthetic peptide
PMGTGRG

SEQ ID NO: 35328 - protein, 7 aa, Artificial Sequence
  Description of Artificial Sequence: Synthetic peptide
GGVPSRL

SEQ ID NO: 35329 - protein, 7 aa, Artificial Sequence
  Description of Artificial Sequence: Synthetic peptide
GVNTGTQ

SEQ ID NO: 35330 - protein, 7 aa, Artificial Sequence
  Description of Artificial Sequence: Synthetic peptide
LNQHSSL

SEQ ID NO: 35331 - protein, 7 aa, Artificial Sequence
  Description of Artificial Sequence: Synthetic peptide
SRESSPL

SEQ ID NO: 35332 - protein, 7 aa, Artificial Sequence
  Description of Artificial Sequence: Synthetic peptide
NGSGQNP

SEQ ID NO: 35333 - protein, 7 aa, Artificial Sequence
  Description of Artificial Sequence: Synthetic peptide
SDVRLSG

SEQ ID NO: 35334 - protein, 7 aa, Artificial Sequence
  Description of Artificial Sequence: Synthetic peptide
QGSSKTT

SEQ ID NO: 35335 - protein, 7 aa, Artificial Sequence
  Description of Artificial Sequence: Synthetic peptide
NGSGQNK

SEQ ID NO: 35336 - protein, 7 aa, Artificial Sequence
  Description of Artificial Sequence: Synthetic peptide
TSSTTSL

SEQ ID NO: 35337 - protein, 7 aa, Artificial Sequence
  Description of Artificial Sequence: Synthetic peptide
GTQKQTS

SEQ ID NO: 35338 - protein, 7 aa, Artificial Sequence
  Description of Artificial Sequence: Synthetic peptide
NGSVQNQ

SEQ ID NO: 35339 - protein, 7 aa, Artificial Sequence
  Description of Artificial Sequence: Synthetic peptide
TSRQSFV

SEQ ID NO: 35340 - protein, 7 aa, Artificial Sequence
  Description of Artificial Sequence: Synthetic peptide
NWSGQNQ

SEQ ID NO: 35341 - protein, 7 aa, Artificial Sequence
  Description of Artificial Sequence: Synthetic peptide
NGSGQSQ

SEQ ID NO: 35342 - protein, 7 aa, Artificial Sequence
  Description of Artificial Sequence: Synthetic peptide
MTTQLNS

SEQ ID NO: 35343 - protein, 7 aa, Artificial Sequence
  Description of Artificial Sequence: Synthetic peptide
PIHPSSG

SEQ ID NO: 35344 - protein, 7 aa, Artificial Sequence
  Description of Artificial Sequence: Synthetic peptide
ESPNLHS

SEQ ID NO: 35345 - protein, 7 aa, Artificial Sequence
  Description of Artificial Sequence: Synthetic peptide
FSQHSSN

SEQ ID NO: 35346 - protein, 7 aa, Artificial Sequence
  Description of Artificial Sequence: Synthetic peptide
VHYSTTN

SEQ ID NO: 35347 - protein, 7 aa, Artificial Sequence
  Description of Artificial Sequence: Synthetic peptide
CATSSRK

SEQ ID NO: 35348 - protein, 7 aa, Artificial Sequence
  Description of Artificial Sequence: Synthetic peptide
PVREGSI

SEQ ID NO: 35349 - protein, 7 aa, Artificial Sequence
  Description of Artificial Sequence: Synthetic peptide
NGSGPNQ

SEQ ID NO: 35350 - protein, 7 aa, Artificial Sequence
  Description of Artificial Sequence: Synthetic peptide
SSPANMA

SEQ ID NO: 35351 - protein, 7 aa, Artificial Sequence
  Description of Artificial Sequence: Synthetic peptide
EGLNTSR

SEQ ID NO: 35352 - protein, 7 aa, Artificial Sequence
  Description of Artificial Sequence: Synthetic peptide
QVTVRPV

SEQ ID NO: 35353 - protein, 7 aa, Artificial Sequence
  Description of Artificial Sequence: Synthetic peptide
YGSESNK

SEQ ID NO: 35354 - protein, 7 aa, Artificial Sequence
  Description of Artificial Sequence: Synthetic peptide
NSEARLS

SEQ ID NO: 35355 - protein, 7 aa, Artificial Sequence
  Description of Artificial Sequence: Synthetic peptide
GPSQHVI

SEQ ID NO: 35356 - protein, 7 aa, Artificial Sequence
  Description of Artificial Sequence: Synthetic peptide
YGSGQNQ

SEQ ID NO: 35357 - protein, 7 aa, Artificial Sequence
  Description of Artificial Sequence: Synthetic peptide
TQGASNL

SEQ ID NO: 35358 - protein, 7 aa, Artificial Sequence
  Description of Artificial Sequence: Synthetic peptide
MTLSGQT

SEQ ID NO: 35359 - protein, 7 aa, Artificial Sequence
  Description of Artificial Sequence: Synthetic peptide
DRHNTTS

SEQ ID NO: 35360 - protein, 7 aa, Artificial Sequence
  Description of Artificial Sequence: Synthetic peptide
IIGSRHT

SEQ ID NO: 35361 - protein, 7 aa, Artificial Sequence
  Description of Artificial Sequence: Synthetic peptide
RDRSVAS

SEQ ID NO: 35362 - protein, 7 aa, Artificial Sequence
  Description of Artificial Sequence: Synthetic peptide
AGNMPHS

SEQ ID NO: 35363 - protein, 7 aa, Artificial Sequence
  Description of Artificial Sequence: Synthetic peptide
GGSATAV

SEQ ID NO: 35364 - protein, 7 aa, Artificial Sequence
  Description of Artificial Sequence: Synthetic peptide
TSSGGLT

SEQ ID NO: 35365 - protein, 7 aa, Artificial Sequence
  Description of Artificial Sequence: Synthetic peptide
GTSPSTM

SEQ ID NO: 35366 - protein, 7 aa, Artificial Sequence
  Description of Artificial Sequence: Synthetic peptide
ANGTKSS

SEQ ID NO: 35367 - protein, 7 aa, Artificial Sequence
  Description of Artificial Sequence: Synthetic peptide
SSLKPTL

SEQ ID NO: 35368 - protein, 7 aa, Artificial Sequence
  Description of Artificial Sequence: Synthetic peptide
VGSDSST

SEQ ID NO: 35369 - protein, 7 aa, Artificial Sequence
  Description of Artificial Sequence: Synthetic peptide
NGYGQNQ

SEQ ID NO: 35370 - protein, 7 aa, Artificial Sequence
  Description of Artificial Sequence: Synthetic peptide
RDATSIG

SEQ ID NO: 35371 - protein, 7 aa, Artificial Sequence
  Description of Artificial Sequence: Synthetic peptide
TGSGQNQ

SEQ ID NO: 35372 - protein, 7 aa, Artificial Sequence
  Description of Artificial Sequence: Synthetic peptide
NGFGQNQ

SEQ ID NO: 35373 - protein, 7 aa, Artificial Sequence
  Description of Artificial Sequence: Synthetic peptide
TQSSTRS

SEQ ID NO: 35374 - protein, 7 aa, Artificial Sequence
  Description of Artificial Sequence: Synthetic peptide
NTTGHAG

SEQ ID NO: 35375 - protein, 7 aa, Artificial Sequence
  Description of Artificial Sequence: Synthetic peptide
LGTSTIL

SEQ ID NO: 35376 - protein, 7 aa, Artificial Sequence
  Description of Artificial Sequence: Synthetic peptide
PSTPTIK

SEQ ID NO: 35377 - protein, 7 aa, Artificial Sequence
  Description of Artificial Sequence: Synthetic peptide
HLAYDNN

SEQ ID NO: 35378 - protein, 7 aa, Artificial Sequence
  Description of Artificial Sequence: Synthetic peptide
ENDHNVR

SEQ ID NO: 35379 - protein, 7 aa, Artificial Sequence
  Description of Artificial Sequence: Synthetic peptide
ATGSPSK

SEQ ID NO: 35380 - protein, 7 aa, Artificial Sequence
  Description of Artificial Sequence: Synthetic peptide
NSSHNSP

SEQ ID NO: 35381 - protein, 7 aa, Artificial Sequence
  Description of Artificial Sequence: Synthetic peptide
GWNHENV

SEQ ID NO: 35382 - protein, 7 aa, Artificial Sequence
  Description of Artificial Sequence: Synthetic peptide
VSSPRMS

SEQ ID NO: 35383 - protein, 7 aa, Artificial Sequence
  Description of Artificial Sequence: Synthetic peptide
NGAGQNQ

SEQ ID NO: 35384 - protein, 7 aa, Artificial Sequence
  Description of Artificial Sequence: Synthetic peptide
PSHNPTN

SEQ ID NO: 35385 - protein, 7 aa, Artificial Sequence
  Description of Artificial Sequence: Synthetic peptide
GSHHPSG

SEQ ID NO: 35386 - protein, 7 aa, Artificial Sequence
  Description of Artificial Sequence: Synthetic peptide
NGRGSDV

SEQ ID NO: 35387 - protein, 7 aa, Artificial Sequence
  Description of Artificial Sequence: Synthetic peptide
AGSNSQG

SEQ ID NO: 35388 - protein, 7 aa, Artificial Sequence
  Description of Artificial Sequence: Synthetic peptide
NGSGQIQ

SEQ ID NO: 35389 - protein, 7 aa, Artificial Sequence
  Description of Artificial Sequence: Synthetic peptide
GGLDHHA

SEQ ID NO: 35390 - protein, 7 aa, Artificial Sequence
  Description of Artificial Sequence: Synthetic peptide
FSSKTSP

SEQ ID NO: 35391 - protein, 7 aa, Artificial Sequence
  Description of Artificial Sequence: Synthetic peptide
NGSRQNQ

SEQ ID NO: 35392 - protein, 7 aa, Artificial Sequence
  Description of Artificial Sequence: Synthetic peptide
TIKSVTN

SEQ ID NO: 35393 - protein, 7 aa, Artificial Sequence
  Description of Artificial Sequence: Synthetic peptide
HSTPSTM

SEQ ID NO: 35394 - protein, 7 aa, Artificial Sequence
  Description of Artificial Sequence: Synthetic peptide
NSSGQNQ

SEQ ID NO: 35395 - protein, 7 aa, Artificial Sequence
  Description of Artificial Sequence: Synthetic peptide
NGSGTNQ

SEQ ID NO: 35396 - protein, 7 aa, Artificial Sequence
  Description of Artificial Sequence: Synthetic peptide
KNHTAVQ

SEQ ID NO: 35397 - protein, 7 aa, Artificial Sequence
  Description of Artificial Sequence: Synthetic peptide
HHDASPN

SEQ ID NO: 35398 - protein, 7 aa, Artificial Sequence
  Description of Artificial Sequence: Synthetic peptide
GGSNSRL

SEQ ID NO: 35399 - protein, 7 aa, Artificial Sequence
  Description of Artificial Sequence: Synthetic peptide
HREARLL

SEQ ID NO: 35400 - protein, 7 aa, Artificial Sequence
  Description of Artificial Sequence: Synthetic peptide
SASGNRC

SEQ ID NO: 35401 - protein, 7 aa, Artificial Sequence
  Description of Artificial Sequence: Synthetic peptide
GPNQSGR

SEQ ID NO: 35402 - protein, 7 aa, Artificial Sequence
  Description of Artificial Sequence: Synthetic peptide
DATKNHS

SEQ ID NO: 35403 - protein, 7 aa, Artificial Sequence
  Description of Artificial Sequence: Synthetic peptide
DSTLGQS

SEQ ID NO: 35404 - protein, 7 aa, Artificial Sequence
  Description of Artificial Sequence: Synthetic peptide
GTGTPRT

SEQ ID NO: 35405 - protein, 7 aa, Artificial Sequence
  Description of Artificial Sequence: Synthetic peptide
NGSGHNQ

SEQ ID NO: 35406 - protein, 7 aa, Artificial Sequence
  Description of Artificial Sequence: Synthetic peptide
NGSGQNR

SEQ ID NO: 35407 - protein, 7 aa, Artificial Sequence
  Description of Artificial Sequence: Synthetic peptide
NSSSSNH

SEQ ID NO: 35408 - protein, 7 aa, Artificial Sequence
  Description of Artificial Sequence: Synthetic peptide
NGSGQYQ

SEQ ID NO: 35409 - protein, 7 aa, Artificial Sequence
  Description of Artificial Sequence: Synthetic peptide
ERSTRMQ

SEQ ID NO: 35410 - protein, 7 aa, Artificial Sequence
  Description of Artificial Sequence: Synthetic peptide
QLPALQG

SEQ ID NO: 35411 - protein, 7 aa, Artificial Sequence
  Description of Artificial Sequence: Synthetic peptide
MAHDGYR

SEQ ID NO: 35412 - protein, 7 aa, Artificial Sequence
  Description of Artificial Sequence: Synthetic peptide
YSKQNLT

SEQ ID NO: 35413 - protein, 7 aa, Artificial Sequence
  Description of Artificial Sequence: Synthetic peptide
SASNVSR

SEQ ID NO: 35414 - protein, 7 aa, Artificial Sequence
  Description of Artificial Sequence: Synthetic peptide
NGSEQNQ

SEQ ID NO: 35415 - protein, 7 aa, Artificial Sequence
  Description of Artificial Sequence: Synthetic peptide
ATVGHMT

SEQ ID NO: 35416 - protein, 7 aa, Artificial Sequence
  Description of Artificial Sequence: Synthetic peptide
STSSSAS

SEQ ID NO: 35417 - protein, 7 aa, Artificial Sequence
  Description of Artificial Sequence: Synthetic peptide
ASRDSSV

SEQ ID NO: 35418 - protein, 7 aa, Artificial Sequence
  Description of Artificial Sequence: Synthetic peptide
SEHQPLS

SEQ ID NO: 35419 - protein, 7 aa, Artificial Sequence
  Description of Artificial Sequence: Synthetic peptide
IQQGSRT

SEQ ID NO: 35420 - protein, 7 aa, Artificial Sequence
  Description of Artificial Sequence: Synthetic peptide
MLPSVSG

SEQ ID NO: 35421 - protein, 7 aa, Artificial Sequence
  Description of Artificial Sequence: Synthetic peptide
SSTSSPY

SEQ ID NO: 35422 - protein, 7 aa, Artificial Sequence
  Description of Artificial Sequence: Synthetic peptide
MRQDTSK

SEQ ID NO: 35423 - protein, 7 aa, Artificial Sequence
  Description of Artificial Sequence: Synthetic peptide
SNVSKPQ

SEQ ID NO: 35424 - protein, 7 aa, Artificial Sequence
  Description of Artificial Sequence: Synthetic peptide
TRGSPLM

SEQ ID NO: 35425 - protein, 7 aa, Artificial Sequence
  Description of Artificial Sequence: Synthetic peptide
HPTSPAM

SEQ ID NO: 35426 - protein, 7 aa, Artificial Sequence
  Description of Artificial Sequence: Synthetic peptide
NGSGLNQ

SEQ ID NO: 35427 - protein, 7 aa, Artificial Sequence
  Description of Artificial Sequence: Synthetic peptide
KRDAHTA

SEQ ID NO: 35428 - protein, 7 aa, Artificial Sequence
  Description of Artificial Sequence: Synthetic peptide
LLGDTKP

SEQ ID NO: 35429 - protein, 7 aa, Artificial Sequence
  Description of Artificial Sequence: Synthetic peptide
YSRVQSE

SEQ ID NO: 35430 - protein, 7 aa, Artificial Sequence
  Description of Artificial Sequence: Synthetic peptide
DVLSKRQ

SEQ ID NO: 35431 - protein, 7 aa, Artificial Sequence
  Description of Artificial Sequence: Synthetic peptide
RDGTPPT

SEQ ID NO: 35432 - protein, 7 aa, Artificial Sequence
  Description of Artificial Sequence: Synthetic peptide
SHPSSFG

SEQ ID NO: 35433 - protein, 7 aa, Artificial Sequence
  Description of Artificial Sequence: Synthetic peptide
SGASSNS

SEQ ID NO: 35434 - protein, 7 aa, Artificial Sequence
  Description of Artificial Sequence: Synthetic peptide
SASRSAY

SEQ ID NO: 35435 - protein, 7 aa, Artificial Sequence
  Description of Artificial Sequence: Synthetic peptide
STSNGTL

SEQ ID NO: 35436 - protein, 7 aa, Artificial Sequence
  Description of Artificial Sequence: Synthetic peptide
SHTPKLV

SEQ ID NO: 35437 - protein, 7 aa, Artificial Sequence
  Description of Artificial Sequence: Synthetic peptide
GQVSQMK

SEQ ID NO: 35438 - protein, 7 aa, Artificial Sequence
  Description of Artificial Sequence: Synthetic peptide
SSHSDTR

SEQ ID NO: 35439 - protein, 7 aa, Artificial Sequence
  Description of Artificial Sequence: Synthetic peptide
QSVKTPE

SEQ ID NO: 35440 - protein, 7 aa, Artificial Sequence
  Description of Artificial Sequence: Synthetic peptide
DRNHAAE

SEQ ID NO: 35441 - protein, 7 aa, Artificial Sequence
  Description of Artificial Sequence: Synthetic peptide
PLNTHQS

SEQ ID NO: 35442 - protein, 7 aa, Artificial Sequence
  Description of Artificial Sequence: Synthetic peptide
SSSAHRL

SEQ ID NO: 35443 - protein, 7 aa, Artificial Sequence
  Description of Artificial Sequence: Synthetic peptide
NDRGQNG

SEQ ID NO: 35444 - protein, 7 aa, Artificial Sequence
  Description of Artificial Sequence: Synthetic peptide
GQTMSTM

SEQ ID NO: 35445 - protein, 7 aa, Artificial Sequence
  Description of Artificial Sequence: Synthetic peptide
TRHMQLS

SEQ ID NO: 35446 - protein, 7 aa, Artificial Sequence
  Description of Artificial Sequence: Synthetic peptide
TGSEQNQ

SEQ ID NO: 35447 - protein, 7 aa, Artificial Sequence
  Description of Artificial Sequence: Synthetic peptide
NGSGHKQ

SEQ ID NO: 35448 - protein, 7 aa, Artificial Sequence
  Description of Artificial Sequence: Synthetic peptide
ILGNKSS

SEQ ID NO: 35449 - protein, 7 aa, Artificial Sequence
  Description of Artificial Sequence: Synthetic peptide
TGAQSTM

SEQ ID NO: 35450 - protein, 7 aa, Artificial Sequence
  Description of Artificial Sequence: Synthetic peptide
VPVTGLS

SEQ ID NO: 35451 - protein, 7 aa, Artificial Sequence
  Description of Artificial Sequence: Synthetic peptide
VQGSLPS

SEQ ID NO: 35452 - protein, 7 aa, Artificial Sequence
  Description of Artificial Sequence: Synthetic peptide
SDSRSGM

SEQ ID NO: 35453 - protein, 7 aa, Artificial Sequence
  Description of Artificial Sequence: Synthetic peptide
HERGQNG

SEQ ID NO: 35454 - protein, 7 aa, Artificial Sequence
  Description of Artificial Sequence: Synthetic peptide
LNGSATA

SEQ ID NO: 35455 - protein, 7 aa, Artificial Sequence
  Description of Artificial Sequence: Synthetic peptide
RMARPAV

SEQ ID NO: 35456 - protein, 7 aa, Artificial Sequence
  Description of Artificial Sequence: Synthetic peptide
RSISSAV

SEQ ID NO: 35457 - protein, 7 aa, Artificial Sequence
  Description of Artificial Sequence: Synthetic peptide
NEQAKLT

SEQ ID NO: 35458 - protein, 7 aa, Artificial Sequence
  Description of Artificial Sequence: Synthetic peptide
SSGGNMS

SEQ ID NO: 35459 - protein, 7 aa, Artificial Sequence
  Description of Artificial Sequence: Synthetic peptide
NATSPRK

SEQ ID NO: 35460 - protein, 7 aa, Artificial Sequence
  Description of Artificial Sequence: Synthetic peptide
SGAGSAG

SEQ ID NO: 35461 - protein, 7 aa, Artificial Sequence
  Description of Artificial Sequence: Synthetic peptide
IGSGQNQ

SEQ ID NO: 35462 - protein, 7 aa, Artificial Sequence
  Description of Artificial Sequence: Synthetic peptide
NNGASVV

SEQ ID NO: 35463 - protein, 7 aa, Artificial Sequence
  Description of Artificial Sequence: Synthetic peptide
SGSGIMM

SEQ ID NO: 35464 - protein, 7 aa, Artificial Sequence
  Description of Artificial Sequence: Synthetic peptide
PTHSSRD

SEQ ID NO: 35465 - protein, 7 aa, Artificial Sequence
  Description of Artificial Sequence: Synthetic peptide
NRSGQNQ

SEQ ID NO: 35466 - protein, 7 aa, Artificial Sequence
  Description of Artificial Sequence: Synthetic peptide
SNSDRAN

SEQ ID NO: 35467 - protein, 7 aa, Artificial Sequence
  Description of Artificial Sequence: Synthetic peptide
VNENRVS

SEQ ID NO: 35468 - protein, 7 aa, Artificial Sequence
  Description of Artificial Sequence: Synthetic peptide
GRESNLS

SEQ ID NO: 35469 - protein, 7 aa, Artificial Sequence
  Description of Artificial Sequence: Synthetic peptide
QGPKNAD

SEQ ID NO: 35470 - protein, 7 aa, Artificial Sequence
  Description of Artificial Sequence: Synthetic peptide
SNNGTQK

SEQ ID NO: 35471 - protein, 7 aa, Artificial Sequence
  Description of Artificial Sequence: Synthetic peptide
DARTMAA

SEQ ID NO: 35472 - DNA, 21 bp, Artificial Sequence
  Description of Artificial Sequence: Synthetic oligonucleotide
gctgctcagccttcgttgaag

SEQ ID NO: 35473 - DNA, 21 bp, Artificial Sequence
  Description of Artificial Sequence: Synthetic oligonucleotide
ggtgcgcgtccggtgcttcag

SEQ ID NO: 35474 - DNA, 21 bp, Artificial Sequence
  Description of Artificial Sequence: Synthetic oligonucleotide
cacatgaacagaaaactcgaa

SEQ ID NO: 35475 - DNA, 21 bp, Artificial Sequence
  Description of Artificial Sequence: Synthetic oligonucleotide
ggcctcagccccgtcctcaaa

SEQ ID NO: 35476 - DNA, 21 bp, Artificial Sequence
  Description of Artificial Sequence: Synthetic oligonucleotide
agcggcgccggcagcgccggc

SEQ ID NO: 35477 - DNA, 21 bp, Artificial Sequence
  Description of Artificial Sequence: Synthetic oligonucleotide
aataatactcagaagaattct

SEQ ID NO: 35478 - DNA, 21 bp, Artificial Sequence
  Description of Artificial Sequence: Synthetic oligonucleotide
atcagaaccagcaaaatgaac

SEQ ID NO: 35479 - DNA, 21 bp, Artificial Sequence
  Description of Artificial Sequence: Synthetic oligonucleotide
cccagcggcgaaaccagcaaa

SEQ ID NO: 35480 - DNA, 21 bp, Artificial Sequence
  Description of Artificial Sequence: Synthetic oligonucleotide
atgaagaatacgactgtggtt

SEQ ID NO: 35481 - DNA, 21 bp, Artificial Sequence
  Description of Artificial Sequence: Synthetic oligonucleotide
tcttctacgagtagtccgtat

SEQ ID NO: 35482 - DNA, 21 bp, Artificial Sequence
  Description of Artificial Sequence: Synthetic oligonucleotide
accggccacagcctcgtcagc

SEQ ID NO: 35483 - DNA, 21 bp, Artificial Sequence
  Description of Artificial Sequence: Synthetic oligonucleotide
tattcggataataagactact

SEQ ID NO: 35484 - DNA, 21 bp, Artificial Sequence
  Description of Artificial Sequence: Synthetic oligonucleotide
gtttcggatggtattagtaag

SEQ ID NO: 35485 - DNA, 21 bp, Artificial Sequence
  Description of Artificial Sequence: Synthetic oligonucleotide
ccggggtctgggagtaataat

SEQ ID NO: 35486 - DNA, 21 bp, Artificial Sequence
  Description of Artificial Sequence: Synthetic oligonucleotide
aataatagtaagagtcagatt

SEQ ID NO: 35487 - DNA, 21 bp, Artificial Sequence
  Description of Artificial Sequence: Synthetic oligonucleotide
caattccccggcaccctcaga

SEQ ID NO: 35488 - DNA, 21 bp, Artificial Sequence
  Description of Artificial Sequence: Synthetic oligonucleotide
ttccccagcaacggcagaacc

SEQ ID NO: 35489 - DNA, 21 bp, Artificial Sequence
  Description of Artificial Sequence: Synthetic oligonucleotide
ggcgccaaagaaagccaaagc

SEQ ID NO: 35490 - DNA, 21 bp, Artificial Sequence
  Description of Artificial Sequence: Synthetic oligonucleotide
agactcagcaacgcctacgcc

SEQ ID NO: 35491 - DNA, 21 bp, Artificial Sequence
  Description of Artificial Sequence: Synthetic oligonucleotide
tctggttcgaataattttttg

SEQ ID NO: 35492 - DNA, 21 bp, Artificial Sequence
  Description of Artificial Sequence: Synthetic oligonucleotide
cacggcggccccggcgccgtc

SEQ ID NO: 35493 - DNA, 21 bp, Artificial Sequence
  Description of Artificial Sequence: Synthetic oligonucleotide
agcaacagcagccaacaaaaa

SEQ ID NO: 35494 - DNA, 21 bp, Artificial Sequence
  Description of Artificial Sequence: Synthetic oligonucleotide
ctcatcagcaccgcccaaaga

SEQ ID NO: 35495 - DNA, 21 bp, Artificial Sequence
  Description of Artificial Sequence: Synthetic oligonucleotide
atggatgggaggtcgactact

SEQ ID NO: 35496 - DNA, 21 bp, Artificial Sequence
  Description of Artificial Sequence: Synthetic oligonucleotide
accaccaacaccgtcagcaga

SEQ ID NO: 35497 - DNA, 21 bp, Artificial Sequence
  Description of Artificial Sequence: Synthetic oligonucleotide
gtgccgcatggggctacttct

SEQ ID NO: 35498 - DNA, 21 bp, Artificial Sequence
  Description of Artificial Sequence: Synthetic oligonucleotide
cctttttctgagatgcagaag

SEQ ID NO: 35499 - DNA, 21 bp, Artificial Sequence
  Description of Artificial Sequence: Synthetic oligonucleotide
ggcggcgacaacaaactcacc

SEQ ID NO: 35500 - DNA, 21 bp, Artificial Sequence
  Description of Artificial Sequence: Synthetic oligonucleotide
aacagccaccaaaaacccagc

SEQ ID NO: 35501 - DNA, 21 bp, Artificial Sequence
  Description of Artificial Sequence: Synthetic oligonucleotide
atgcttagtgggagtcggaat

SEQ ID NO: 35502 - DNA, 21 bp, Artificial Sequence
  Description of Artificial Sequence: Synthetic oligonucleotide
tcttctgggggtaatatgagt

SEQ ID NO: 35503 - DNA, 21 bp, Artificial Sequence
  Description of Artificial Sequence: Synthetic oligonucleotide
aagattgcttcgaagtcggag

SEQ ID NO: 35504 - DNA, 21 bp, Artificial Sequence
  Description of Artificial Sequence: Synthetic oligonucleotide
accgccagcggcaacctcagc

SEQ ID NO: 35505 - DNA, 21 bp, Artificial Sequence
  Description of Artificial Sequence: Synthetic oligonucleotide
accggccaacaacccgccacc

SEQ ID NO: 35506 - DNA, 21 bp, Artificial Sequence
  Description of Artificial Sequence: Synthetic oligonucleotide
acggcttcggggtctaatgct

SEQ ID NO: 35507 - DNA, 21 bp, Artificial Sequence
  Description of Artificial Sequence: Synthetic oligonucleotide
catgggcagacggggatgatt

SEQ ID NO: 35508 - DNA, 21 bp, Artificial Sequence
  Description of Artificial Sequence: Synthetic oligonucleotide
tctgcgagtccgagtattaag

SEQ ID NO: 35509 - DNA, 21 bp, Artificial Sequence
  Description of Artificial Sequence: Synthetic oligonucleotide
gtgtcgactgggtcgtttact

SEQ ID NO: 35510 - DNA, 21 bp, Artificial Sequence
  Description of Artificial Sequence: Synthetic oligonucleotide
ggcagctacagcaaccccacc

SEQ ID NO: 35511 - DNA, 21 bp, Artificial Sequence
  Description of Artificial Sequence: Synthetic oligonucleotide
actacttatggtgggaatcgg

SEQ ID NO: 35512 - DNA, 21 bp, Artificial Sequence
  Description of Artificial Sequence: Synthetic oligonucleotide
cttaatggtactcctcagtct

SEQ ID NO: 35513 - DNA, 21 bp, Artificial Sequence
  Description of Artificial Sequence: Synthetic oligonucleotide
accaacgtcgacaaacccttc

SEQ ID NO: 35514 - DNA, 21 bp, Artificial Sequence
  Description of Artificial Sequence: Synthetic oligonucleotide
atgagttctgagcgtccgggt

SEQ ID NO: 35515 - DNA, 21 bp, Artificial Sequence
  Description of Artificial Sequence: Synthetic oligonucleotide
aacggcatcaccaaaagcagc

SEQ ID NO: 35516 - DNA, 21 bp, Artificial Sequence
  Description of Artificial Sequence: Synthetic oligonucleotide
aacggcagcggccaaaacaaa

SEQ ID NO: 35517 - DNA, 21 bp, Artificial Sequence
  Description of Artificial Sequence: Synthetic oligonucleotide
agagaagacaccaaaatgcac

SEQ ID NO: 35518 - DNA, 21 bp, Artificial Sequence
  Description of Artificial Sequence: Synthetic oligonucleotide
gtgagggatgagcggccttcg

SEQ ID NO: 35519 - DNA, 21 bp, Artificial Sequence
  Description of Artificial Sequence: Synthetic oligonucleotide
gccaaaacccaaagcgtcaac

SEQ ID NO: 35520 - DNA, 21 bp, Artificial Sequence
  Description of Artificial Sequence: Synthetic oligonucleotide
ttgaatctgaagcctattaat

SEQ ID NO: 35521 - DNA, 21 bp, Artificial Sequence
  Description of Artificial Sequence: Synthetic oligonucleotide
gatcctcgtaattctacgtct

SEQ ID NO: 35522 - DNA, 21 bp, Artificial Sequence
  Description of Artificial Sequence: Synthetic oligonucleotide
actactggtggtcatgctctt

SEQ ID NO: 35523 - DNA, 21 bp, Artificial Sequence
  Description of Artificial Sequence: Synthetic oligonucleotide
aataatcctaagaatgttgtt

SEQ ID NO: 35524 - DNA, 21 bp, Artificial Sequence
  Description of Artificial Sequence: Synthetic oligonucleotide
gaacccctcagcaaacaaagc

SEQ ID NO: 35525 - DNA, 21 bp, Artificial Sequence
  Description of Artificial Sequence: Synthetic oligonucleotide
aattataatcaggctggtttg

SEQ ID NO: 35526 - DNA, 21 bp, Artificial Sequence
  Description of Artificial Sequence: Synthetic oligonucleotide
tctccggcttatgatacgagg

SEQ ID NO: 35527 - DNA, 21 bp, Artificial Sequence
  Description of Artificial Sequence: Synthetic oligonucleotide
agccccaccagccccatgaac

SEQ ID NO: 35528 - DNA, 21 bp, Artificial Sequence
  Description of Artificial Sequence: Synthetic oligonucleotide
aacaacagaagcggcatgggc

SEQ ID NO: 35529 - DNA, 21 bp, Artificial Sequence
  Description of Artificial Sequence: Synthetic oligonucleotide
ggtgttaagacgaatcctctt

SEQ ID NO: 35530 - DNA, 21 bp, Artificial Sequence
  Description of Artificial Sequence: Synthetic oligonucleotide
agcggcaccaccaccttcggc

SEQ ID NO: 35531 - DNA, 21 bp, Artificial Sequence
  Description of Artificial Sequence: Synthetic oligonucleotide
aacggttctagacagaatcaa

SEQ ID NO: 35532 - DNA, 21 bp, Artificial Sequence
  Description of Artificial Sequence: Synthetic oligonucleotide
accccccacgacggccaaaga

SEQ ID NO: 35533 - DNA, 21 bp, Artificial Sequence
  Description of Artificial Sequence: Synthetic oligonucleotide
tctattactgggaataggact

SEQ ID NO: 35534 - DNA, 21 bp, Artificial Sequence
  Description of Artificial Sequence: Synthetic oligonucleotide
aattcggcgagtctgaatcat

SEQ ID NO: 35535 - DNA, 21 bp, Artificial Sequence
  Description of Artificial Sequence: Synthetic oligonucleotide
gatattcctgcgaagactgcg

SEQ ID NO: 35536 - DNA, 21 bp, Artificial Sequence
  Description of Artificial Sequence: Synthetic oligonucleotide
cgtacgggtcattatcaggat

SEQ ID NO: 35537 - DNA, 21 bp, Artificial Sequence
  Description of Artificial Sequence: Synthetic oligonucleotide
aatgctaatcagaatcagatg

SEQ ID NO: 35538 - DNA, 21 bp, Artificial Sequence
  Description of Artificial Sequence: Synthetic oligonucleotide
gaaagcgccacccccatcaga

SEQ ID NO: 35539 - DNA, 21 bp, Artificial Sequence
  Description of Artificial Sequence: Synthetic oligonucleotide
atgcctgcgaggaatgtttct

SEQ ID NO: 35540 - DNA, 21 bp, Artificial Sequence
  Description of Artificial Sequence: Synthetic oligonucleotide
cccagcaacaaaaccaacagc

SEQ ID NO: 35541 - DNA, 21 bp, Artificial Sequence
  Description of Artificial Sequence: Synthetic oligonucleotide
agtgcttctaatactagtgtt

SEQ ID NO: 35542 - DNA, 21 bp, Artificial Sequence
  Description of Artificial Sequence: Synthetic oligonucleotide
aacagcagccacaacagcccc

SEQ ID NO: 35543 - DNA, 21 bp, Artificial Sequence
  Description of Artificial Sequence: Synthetic oligonucleotide
agtacggctacgaatgtttat

SEQ ID NO: 35544 - DNA, 21 bp, Artificial Sequence
  Description of Artificial Sequence: Synthetic oligonucleotide
ctcaacatcgccaacagcaaa

SEQ ID NO: 35545 - DNA, 21 bp, Artificial Sequence
  Description of Artificial Sequence: Synthetic oligonucleotide
catggttctaagccgtatatt

SEQ ID NO: 35546 - DNA, 21 bp, Artificial Sequence
  Description of Artificial Sequence: Synthetic oligonucleotide
gacaaaacccaaaaacaactc

SEQ ID NO: 35547 - DNA, 21 bp, Artificial Sequence
  Description of Artificial Sequence: Synthetic oligonucleotide
cagaagactcagacgacttcg

SEQ ID NO: 35548 - DNA, 21 bp, Artificial Sequence
  Description of Artificial Sequence: Synthetic oligonucleotide
acgaatgctaagcaggcgatt

SEQ ID NO: 35549 - DNA, 21 bp, Artificial Sequence
  Description of Artificial Sequence: Synthetic oligonucleotide
ttgcatgatggtcagactcgt

SEQ ID NO: 35550 - DNA, 21 bp, Artificial Sequence
  Description of Artificial Sequence: Synthetic oligonucleotide
aacacccaaagctacaccagc

SEQ ID NO: 35551 - DNA, 21 bp, Artificial Sequence
  Description of Artificial Sequence: Synthetic oligonucleotide
cagtcgcattcggggatttct

SEQ ID NO: 35552 - DNA, 21 bp, Artificial Sequence
  Description of Artificial Sequence: Synthetic oligonucleotide
ggtttggggcatagtgctttt

SEQ ID NO: 35553 - DNA, 21 bp, Artificial Sequence
  Description of Artificial Sequence: Synthetic oligonucleotide
tctttttcgaagggttctagt

SEQ ID NO: 35554 - DNA, 21 bp, Artificial Sequence
  Description of Artificial Sequence: Synthetic oligonucleotide
gggacttttagtactcagagt

SEQ ID NO: 35555 - DNA, 21 bp, Artificial Sequence
  Description of Artificial Sequence: Synthetic oligonucleotide
tctgattctcgtaatacgaat

SEQ ID NO: 35556 - DNA, 21 bp, Artificial Sequence
  Description of Artificial Sequence: Synthetic oligonucleotide
acttctaatagtaatattgcg

SEQ ID NO: 35557 - DNA, 21 bp, Artificial Sequence
  Description of Artificial Sequence: Synthetic oligonucleotide
atgggcatcgccaacatcggc

SEQ ID NO: 35558 - DNA, 21 bp, Artificial Sequence
  Description of Artificial Sequence: Synthetic oligonucleotide
agcagcctcggccacaacgac

SEQ ID NO: 35559 - DNA, 21 bp, Artificial Sequence
  Description of Artificial Sequence: Synthetic oligonucleotide
agagccctcagcaaaggcggc

SEQ ID NO: 35560 - DNA, 21 bp, Artificial Sequence
  Description of Artificial Sequence: Synthetic oligonucleotide
aaaaccggcgaccaaatgggc

SEQ ID NO: 35561 - DNA, 21 bp, Artificial Sequence
  Description of Artificial Sequence: Synthetic oligonucleotide
aacatggacggcgccaccaga

SEQ ID NO: 35562 - DNA, 21 bp, Artificial Sequence
  Description of Artificial Sequence: Synthetic oligonucleotide
gcgaatggtactaagtctagt

SEQ ID NO: 35563 - DNA, 21 bp, Artificial Sequence
  Description of Artificial Sequence: Synthetic oligonucleotide
ctcatcctccccggcaacaac

SEQ ID NO: 35564 - DNA, 21 bp, Artificial Sequence
  Description of Artificial Sequence: Synthetic oligonucleotide
catgttattgctcctcagcag

SEQ ID NO: 35565 - DNA, 21 bp, Artificial Sequence
  Description of Artificial Sequence: Synthetic oligonucleotide
aacggttctggacagaatcta

SEQ ID NO: 35566 - DNA, 21 bp, Artificial Sequence
  Description of Artificial Sequence: Synthetic oligonucleotide
attaggtcgaaggagtctgcg

SEQ ID NO: 35567 - DNA, 21 bp, Artificial Sequence
  Description of Artificial Sequence: Synthetic oligonucleotide
caacaatacgccaaacaagcc

SEQ ID NO: 35568 - DNA, 21 bp, Artificial Sequence
  Description of Artificial Sequence: Synthetic oligonucleotide
cttggtactagtccgatgaag

SEQ ID NO: 35569 - DNA, 21 bp, Artificial Sequence
  Description of Artificial Sequence: Synthetic oligonucleotide
aatttgtcggggtcgaggtat

SEQ ID NO: 35570 - DNA, 21 bp, Artificial Sequence
  Description of Artificial Sequence: Synthetic oligonucleotide
aatagtgaggcgaggcttagt

SEQ ID NO: 35571 - DNA, 21 bp, Artificial Sequence
  Description of Artificial Sequence: Synthetic oligonucleotide
cccaccggcgaaaaaagactc

SEQ ID NO: 35572 - DNA, 21 bp, Artificial Sequence
  Description of Artificial Sequence: Synthetic oligonucleotide
gatatgacgcatctgagtaat

SEQ ID NO: 35573 - DNA, 21 bp, Artificial Sequence
  Description of Artificial Sequence: Synthetic oligonucleotide
ccgagtactagtggtgcgatg

SEQ ID NO: 35574 - DNA, 21 bp, Artificial Sequence
  Description of Artificial Sequence: Synthetic oligonucleotide
caaaacgtcggcggcatcaga

SEQ ID NO: 35575 - DNA, 21 bp, Artificial Sequence
  Description of Artificial Sequence: Synthetic oligonucleotide
tctatttctaagactcaggct

SEQ ID NO: 35576 - DNA, 21 bp, Artificial Sequence
  Description of Artificial Sequence: Synthetic oligonucleotide
agcagcagccccaacgtcaaa

SEQ ID NO: 35577 - DNA, 21 bp, Artificial Sequence
  Description of Artificial Sequence: Synthetic oligonucleotide
cttgctaagaatcctgtgatt

SEQ ID NO: 35578 - DNA, 21 bp, Artificial Sequence
  Description of Artificial Sequence: Synthetic oligonucleotide
ggccaaggcgtcaccgccaaa

SEQ ID NO: 35579 - DNA, 21 bp, Artificial Sequence
  Description of Artificial Sequence: Synthetic oligonucleotide
agcgccagcagaagcgcctac

SEQ ID NO: 35580 - DNA, 21 bp, Artificial Sequence
  Description of Artificial Sequence: Synthetic oligonucleotide
agctacggcggccaaagcaga

SEQ ID NO: 35581 - DNA, 21 bp, Artificial Sequence
  Description of Artificial Sequence: Synthetic oligonucleotide
ggtcagtcgaatgttactttg

SEQ ID NO: 35582 - DNA, 21 bp, Artificial Sequence
  Description of Artificial Sequence: Synthetic oligonucleotide
accaccagccacatgctcaaa

SEQ ID NO: 35583 - DNA, 21 bp, Artificial Sequence
  Description of Artificial Sequence: Synthetic oligonucleotide
gtgcaggggacgggtaatacg

SEQ ID NO: 35584 - DNA, 21 bp, Artificial Sequence
  Description of Artificial Sequence: Synthetic oligonucleotide
tgggatagtaagactccgcgt

SEQ ID NO: 35585 - DNA, 21 bp, Artificial Sequence
  Description of Artificial Sequence: Synthetic oligonucleotide
ttgaatcagcattcgagtatt

SEQ ID NO: 35586 - DNA, 21 bp, Artificial Sequence
  Description of Artificial Sequence: Synthetic oligonucleotide
ggtgtgctgggttctaagaat

SEQ ID NO: 35587 - DNA, 21 bp, Artificial Sequence
  Description of Artificial Sequence: Synthetic oligonucleotide
gagcagggttcgggtaatcat

SEQ ID NO: 35588 - DNA, 21 bp, Artificial Sequence
  Description of Artificial Sequence: Synthetic oligonucleotide
tgcgtcagcaacgtcaccaac

SEQ ID NO: 35589 - DNA, 21 bp, Artificial Sequence
  Description of Artificial Sequence: Synthetic oligonucleotide
tctaagccggctaataatgtt

SEQ ID NO: 35590 - DNA, 21 bp, Artificial Sequence
  Description of Artificial Sequence: Synthetic oligonucleotide
ggtcatgggaataatggggcg

SEQ ID NO: 35591 - DNA, 21 bp, Artificial Sequence
  Description of Artificial Sequence: Synthetic oligonucleotide
ccggctcatcagaagcttagt

SEQ ID NO: 35592 - DNA, 21 bp, Artificial Sequence
  Description of Artificial Sequence: Synthetic oligonucleotide
aatgctaatagtcgtcctgtt

SEQ ID NO: 35593 - DNA, 21 bp, Artificial Sequence
  Description of Artificial Sequence: Synthetic oligonucleotide
accgccacccaaaaaggccaa

SEQ ID NO: 35594 - DNA, 21 bp, Artificial Sequence
  Description of Artificial Sequence: Synthetic oligonucleotide
gacatcatgagccccctcaaa

SEQ ID NO: 35595 - DNA, 21 bp, Artificial Sequence
  Description of Artificial Sequence: Synthetic oligonucleotide
tttcttaagggtactggttcg

SEQ ID NO: 35596 - DNA, 21 bp, Artificial Sequence
  Description of Artificial Sequence: Synthetic oligonucleotide
cacgccaacagccccgccacc

SEQ ID NO: 35597 - DNA, 21 bp, Artificial Sequence
  Description of Artificial Sequence: Synthetic oligonucleotide
ggggattctaagtctacgtgg

SEQ ID NO: 35598 - DNA, 21 bp, Artificial Sequence
  Description of Artificial Sequence: Synthetic oligonucleotide
cgtgttgtgacgaataatctg

SEQ ID NO: 35599 - DNA, 21 bp, Artificial Sequence
  Description of Artificial Sequence: Synthetic oligonucleotide
gctacgaataatggttcgaag

SEQ ID NO: 35600 - DNA, 21 bp, Artificial Sequence
  Description of Artificial Sequence: Synthetic oligonucleotide
cataataattctaagagtgcg

SEQ ID NO: 35601 - DNA, 21 bp, Artificial Sequence
  Description of Artificial Sequence: Synthetic oligonucleotide
actcagcagaatgggaggaat

SEQ ID NO: 35602 - DNA, 21 bp, Artificial Sequence
  Description of Artificial Sequence: Synthetic oligonucleotide
gaaaccaccacccccagaaaa

SEQ ID NO: 35603 - DNA, 21 bp, Artificial Sequence
  Description of Artificial Sequence: Synthetic oligonucleotide
aatgctggtcctaattatgat

SEQ ID NO: 35604 - DNA, 21 bp, Artificial Sequence
  Description of Artificial Sequence: Synthetic oligonucleotide
gaccccctcagaaacagcaac

SEQ ID NO: 35605 - DNA, 21 bp, Artificial Sequence
  Description of Artificial Sequence: Synthetic oligonucleotide
gatcagaatcgtgttccttat

SEQ ID NO: 35606 - DNA, 21 bp, Artificial Sequence
  Description of Artificial Sequence: Synthetic oligonucleotide
tcttatgggaaggagagtagt

SEQ ID NO: 35607 - DNA, 21 bp, Artificial Sequence
  Description of Artificial Sequence: Synthetic oligonucleotide
ctcgacagaagcacctacggc

SEQ ID NO: 35608 - DNA, 21 bp, Artificial Sequence
  Description of Artificial Sequence: Synthetic oligonucleotide
agtcgtaagaataatacgttg

SEQ ID NO: 35609 - DNA, 21 bp, Artificial Sequence
  Description of Artificial Sequence: Synthetic oligonucleotide
gccatcagccccacctacatg

SEQ ID NO: 35610 - DNA, 21 bp, Artificial Sequence
  Description of Artificial Sequence: Synthetic oligonucleotide
tacgccatggaaagagtcggc

SEQ ID NO: 35611 - DNA, 21 bp, Artificial Sequence
  Description of Artificial Sequence: Synthetic oligonucleotide
gaactcatgaacaaaagcaaa

SEQ ID NO: 35612 - DNA, 21 bp, Artificial Sequence
  Description of Artificial Sequence: Synthetic oligonucleotide
cacgacagcaaagtcatcagc

SEQ ID NO: 35613 - DNA, 21 bp, Artificial Sequence
  Description of Artificial Sequence: Synthetic oligonucleotide
gcgcgggctagttctaattcg

SEQ ID NO: 35614 - DNA, 21 bp, Artificial Sequence
  Description of Artificial Sequence: Synthetic oligonucleotide
gccagcagaagcaccaacccc

SEQ ID NO: 35615 - DNA, 21 bp, Artificial Sequence
  Description of Artificial Sequence: Synthetic oligonucleotide
agcagcctcgaaaaaagcaac

SEQ ID NO: 35616 - DNA, 21 bp, Artificial Sequence
  Description of Artificial Sequence: Synthetic oligonucleotide
agcgaccaagtcagaagcgcc

SEQ ID NO: 35617 - DNA, 21 bp, Artificial Sequence
  Description of Artificial Sequence: Synthetic oligonucleotide
ttgattaatcctgctggttct

SEQ ID NO: 35618 - DNA, 21 bp, Artificial Sequence
  Description of Artificial Sequence: Synthetic oligonucleotide
tatgggaatcctaggcaggct

SEQ ID NO: 35619 - DNA, 21 bp, Artificial Sequence
  Description of Artificial Sequence: Synthetic oligonucleotide
gatattaatcgtcagaggact

SEQ ID NO: 35620 - DNA, 21 bp, Artificial Sequence
  Description of Artificial Sequence: Synthetic oligonucleotide
ctggcgagtacttattctggt

SEQ ID NO: 35621 - DNA, 21 bp, Artificial Sequence
  Description of Artificial Sequence: Synthetic oligonucleotide
gtccccagccaaaacagagcc

SEQ ID NO: 35622 - DNA, 21 bp, Artificial Sequence
  Description of Artificial Sequence: Synthetic oligonucleotide
cccagagaaacccacaaacaa

SEQ ID NO: 35623 - DNA, 21 bp, Artificial Sequence
  Description of Artificial Sequence: Synthetic oligonucleotide
gatgggggtaatcagaggagt

SEQ ID NO: 35624 - DNA, 21 bp, Artificial Sequence
  Description of Artificial Sequence: Synthetic oligonucleotide
atggggggtgttacgtcttct

SEQ ID NO: 35625 - DNA, 21 bp, Artificial Sequence
  Description of Artificial Sequence: Synthetic oligonucleotide
aacaacctcgccggcagcaaa

SEQ ID NO: 35626 - DNA, 21 bp, Artificial Sequence
  Description of Artificial Sequence: Synthetic oligonucleotide
cagccgaattctgctagtcat

SEQ ID NO: 35627 - DNA, 21 bp, Artificial Sequence
  Description of Artificial Sequence: Synthetic oligonucleotide
ccgaatggggcgcatgttacg

SEQ ID NO: 35628 - DNA, 21 bp, Artificial Sequence
  Description of Artificial Sequence: Synthetic oligonucleotide
agtagtgataatcgtgggttg

SEQ ID NO: 35629 - DNA, 21 bp, Artificial Sequence
  Description of Artificial Sequence: Synthetic oligonucleotide
gagaatacgaagacttatagt

SEQ ID NO: 35630 - DNA, 21 bp, Artificial Sequence
  Description of Artificial Sequence: Synthetic oligonucleotide
aacggttctggacagtatcaa

SEQ ID NO: 35631 - DNA, 21 bp, Artificial Sequence
  Description of Artificial Sequence: Synthetic oligonucleotide
gaccccggcaccagaaaaagc

SEQ ID NO: 35632 - DNA, 21 bp, Artificial Sequence
  Description of Artificial Sequence: Synthetic oligonucleotide
tttcgtacgcagtctacgaag

SEQ ID NO: 35633 - DNA, 21 bp, Artificial Sequence
  Description of Artificial Sequence: Synthetic oligonucleotide
ggtgtgattaataatgagcgg

SEQ ID NO: 35634 - DNA, 21 bp, Artificial Sequence
  Description of Artificial Sequence: Synthetic oligonucleotide
gccgccgccgtcaaaggcggc

SEQ ID NO: 35635 - DNA, 21 bp, Artificial Sequence
  Description of Artificial Sequence: Synthetic oligonucleotide
agcggcaacgacaaaaacaac

SEQ ID NO: 35636 - DNA, 21 bp, Artificial Sequence
  Description of Artificial Sequence: Synthetic oligonucleotide
aaagacaacacccccggcaga

SEQ ID NO: 35637 - DNA, 21 bp, Artificial Sequence
  Description of Artificial Sequence: Synthetic oligonucleotide
ctcatgcaaacccacggcagc

SEQ ID NO: 35638 - DNA, 21 bp, Artificial Sequence
  Description of Artificial Sequence: Synthetic oligonucleotide
caagtccccgccaccaacaga

SEQ ID NO: 35639 - DNA, 21 bp, Artificial Sequence
  Description of Artificial Sequence: Synthetic oligonucleotide
gctacgagggattctcattct

SEQ ID NO: 35640 - DNA, 21 bp, Artificial Sequence
  Description of Artificial Sequence: Synthetic oligonucleotide
atgggtgttggtatgaatggt

SEQ ID NO: 35641 - DNA, 21 bp, Artificial Sequence
  Description of Artificial Sequence: Synthetic oligonucleotide
ggtttgtcttcgggtaagacg

SEQ ID NO: 35642 - DNA, 21 bp, Artificial Sequence
  Description of Artificial Sequence: Synthetic oligonucleotide
agacccagcggcagcgaaccc

SEQ ID NO: 35643 - DNA, 21 bp, Artificial Sequence
  Description of Artificial Sequence: Synthetic oligonucleotide
ggcgacaccagactcaacgcc

SEQ ID NO: 35644 - DNA, 21 bp, Artificial Sequence
  Description of Artificial Sequence: Synthetic oligonucleotide
gattctggttcttcgacgaag

SEQ ID NO: 35645 - DNA, 21 bp, Artificial Sequence
  Description of Artificial Sequence: Synthetic oligonucleotide
cctacgttgggtacgactaag

SEQ ID NO: 35646 - DNA, 21 bp, Artificial Sequence
  Description of Artificial Sequence: Synthetic oligonucleotide
gacggcaaaaacaacaacgtc

SEQ ID NO: 35647 - DNA, 21 bp, Artificial Sequence
  Description of Artificial Sequence: Synthetic oligonucleotide
cccagcgtcgccaacgtcatg

SEQ ID NO: 35648 - DNA, 21 bp, Artificial Sequence
  Description of Artificial Sequence: Synthetic oligonucleotide
ctcggccccggcaaaaacacc

SEQ ID NO: 35649 - DNA, 21 bp, Artificial Sequence
  Description of Artificial Sequence: Synthetic oligonucleotide
cgtaatcagttggtttctggt

SEQ ID NO: 35650 - DNA, 21 bp, Artificial Sequence
  Description of Artificial Sequence: Synthetic oligonucleotide
agggatgtggatgtgcgtaat

SEQ ID NO: 35651 - DNA, 21 bp, Artificial Sequence
  Description of Artificial Sequence: Synthetic oligonucleotide
gacagaaccaacacccaaaga

SEQ ID NO: 35652 - DNA, 21 bp, Artificial Sequence
  Description of Artificial Sequence: Synthetic oligonucleotide
cctcagaataatcaggcgcat

SEQ ID NO: 35653 - DNA, 21 bp, Artificial Sequence
  Description of Artificial Sequence: Synthetic oligonucleotide
ttgccttcgggtaatactagt

SEQ ID NO: 35654 - DNA, 21 bp, Artificial Sequence
  Description of Artificial Sequence: Synthetic oligonucleotide
tctcgtgcgaattcggttccg

SEQ ID NO: 35655 - DNA, 21 bp, Artificial Sequence
  Description of Artificial Sequence: Synthetic oligonucleotide
gccagcagcagagaaagcctc

SEQ ID NO: 35656 - DNA, 21 bp, Artificial Sequence
  Description of Artificial Sequence: Synthetic oligonucleotide
cgtgttacggatgatcatctt

SEQ ID NO: 35657 - DNA, 21 bp, Artificial Sequence
  Description of Artificial Sequence: Synthetic oligonucleotide
gccgtcaacgaactccacgac

SEQ ID NO: 35658 - DNA, 21 bp, Artificial Sequence
  Description of Artificial Sequence: Synthetic oligonucleotide
agtgggtctctttcttctgct

SEQ ID NO: 35659 - DNA, 21 bp, Artificial Sequence
  Description of Artificial Sequence: Synthetic oligonucleotide
aacggcaccagacaaaaccaa

SEQ ID NO: 35660 - DNA, 21 bp, Artificial Sequence
  Description of Artificial Sequence: Synthetic oligonucleotide
gctgctactaattcgcttact

SEQ ID NO: 35661 - DNA, 21 bp, Artificial Sequence
  Description of Artificial Sequence: Synthetic oligonucleotide
agcacccaccaccccgccagc

SEQ ID NO: 35662 - DNA, 21 bp, Artificial Sequence
  Description of Artificial Sequence: Synthetic oligonucleotide
gcccccctccaaagcaacctc

SEQ ID NO: 35663 - DNA, 21 bp, Artificial Sequence
  Description of Artificial Sequence: Synthetic oligonucleotide
agcggcggcaaaagcgccctc

SEQ ID NO: 35664 - DNA, 21 bp, Artificial Sequence
  Description of Artificial Sequence: Synthetic oligonucleotide
aaactcgtcaacagcaacggc

SEQ ID NO: 35665 - DNA, 21 bp, Artificial Sequence
  Description of Artificial Sequence: Synthetic oligonucleotide
agcatcaccgacagacacagc

SEQ ID NO: 35666 - DNA, 21 bp, Artificial Sequence
  Description of Artificial Sequence: Synthetic oligonucleotide
gggtgtattactaattgtagt

SEQ ID NO: 35667 - DNA, 21 bp, Artificial Sequence
  Description of Artificial Sequence: Synthetic oligonucleotide
actcctggggcttctttgtcg

SEQ ID NO: 35668 - DNA, 21 bp, Artificial Sequence
  Description of Artificial Sequence: Synthetic oligonucleotide
agtagtatttctcgtacttcg

SEQ ID NO: 35669 - DNA, 21 bp, Artificial Sequence
  Description of Artificial Sequence: Synthetic oligonucleotide
aacagcgtcgtcagcgtcagc

SEQ ID NO: 35670 - DNA, 21 bp, Artificial Sequence
  Description of Artificial Sequence: Synthetic oligonucleotide
aacggcagcaccagcagcggc

SEQ ID NO: 35671 - DNA, 21 bp, Artificial Sequence
  Description of Artificial Sequence: Synthetic oligonucleotide
gacatggtcagccccagaaac

SEQ ID NO: 35672 - DNA, 21 bp, Artificial Sequence
  Description of Artificial Sequence: Synthetic oligonucleotide
agagtcagagccgacgacgac

SEQ ID NO: 35673 - DNA, 21 bp, Artificial Sequence
  Description of Artificial Sequence: Synthetic oligonucleotide
gctcagattaatacgcctact

SEQ ID NO: 35674 - DNA, 21 bp, Artificial Sequence
  Description of Artificial Sequence: Synthetic oligonucleotide
gccggcagcaacagccaaggc

SEQ ID NO: 35675 - DNA, 21 bp, Artificial Sequence
  Description of Artificial Sequence: Synthetic oligonucleotide
gattctattggtagttctaag

SEQ ID NO: 35676 - DNA, 21 bp, Artificial Sequence
  Description of Artificial Sequence: Synthetic oligonucleotide
aatccggctcatggtcttaat

SEQ ID NO: 35677 - DNA, 21 bp, Artificial Sequence
  Description of Artificial Sequence: Synthetic oligonucleotide
aacggcgtccaacaacccaaa

SEQ ID NO: 35678 - DNA, 21 bp, Artificial Sequence
  Description of Artificial Sequence: Synthetic oligonucleotide
agaatcaccagcagcaaccaa

SEQ ID NO: 35679 - DNA, 21 bp, Artificial Sequence
  Description of Artificial Sequence: Synthetic oligonucleotide
atcggcaacaaacaaagccaa

SEQ ID NO: 35680 - DNA, 21 bp, Artificial Sequence
  Description of Artificial Sequence: Synthetic oligonucleotide
cctactactcttaagcatgat

SEQ ID NO: 35681 - DNA, 21 bp, Artificial Sequence
  Description of Artificial Sequence: Synthetic oligonucleotide
catactactggtatgcttggg

SEQ ID NO: 35682 - DNA, 21 bp, Artificial Sequence
  Description of Artificial Sequence: Synthetic oligonucleotide
gggtcggggcatggtacgaat

SEQ ID NO: 35683 - DNA, 21 bp, Artificial Sequence
  Description of Artificial Sequence: Synthetic oligonucleotide
gttacgaatagttcgctggtg

SEQ ID NO: 35684 - DNA, 21 bp, Artificial Sequence
  Description of Artificial Sequence: Synthetic oligonucleotide
ggcaccagcaacagatacacc

SEQ ID NO: 35685 - DNA, 21 bp, Artificial Sequence
  Description of Artificial Sequence: Synthetic oligonucleotide
actccgattactcctatgact

SEQ ID NO: 35686 - DNA, 21 bp, Artificial Sequence
  Description of Artificial Sequence: Synthetic oligonucleotide
agtgctaatacgagggttcag

SEQ ID NO: 35687 - DNA, 21 bp, Artificial Sequence
  Description of Artificial Sequence: Synthetic oligonucleotide
cccatgaccaacctcggcacc

SEQ ID NO: 35688 - DNA, 21 bp, Artificial Sequence
  Description of Artificial Sequence: Synthetic oligonucleotide
aatgcgcagggtactgctaag

SEQ ID NO: 35689 - DNA, 21 bp, Artificial Sequence
  Description of Artificial Sequence: Synthetic oligonucleotide
gctactactaaggagggtatt

SEQ ID NO: 35690 - DNA, 21 bp, Artificial Sequence
  Description of Artificial Sequence: Synthetic oligonucleotide
aatgggattagtaagtctaat

SEQ ID NO: 35691 - DNA, 21 bp, Artificial Sequence
  Description of Artificial Sequence: Synthetic oligonucleotide
agtactcataagaatagtcct

SEQ ID NO: 35692 - DNA, 21 bp, Artificial Sequence
  Description of Artificial Sequence: Synthetic oligonucleotide
aacgccttcaccaccaccgtc

SEQ ID NO: 35693 - DNA, 21 bp, Artificial Sequence
  Description of Artificial Sequence: Synthetic oligonucleotide
tatctttcggagcggaattgt

SEQ ID NO: 35694 - DNA, 21 bp, Artificial Sequence
  Description of Artificial Sequence: Synthetic oligonucleotide
ccggttaatcttcagaatggg

SEQ ID NO: 35695 - DNA, 21 bp, Artificial Sequence
  Description of Artificial Sequence: Synthetic oligonucleotide
gcctacggcaaaggcagcagc

SEQ ID NO: 35696 - DNA, 21 bp, Artificial Sequence
  Description of Artificial Sequence: Synthetic oligonucleotide
agactcacccaaagcagccaa

SEQ ID NO: 35697 - DNA, 21 bp, Artificial Sequence
  Description of Artificial Sequence: Synthetic oligonucleotide
gccaccggcagaagccccaac

SEQ ID NO: 35698 - DNA, 21 bp, Artificial Sequence
  Description of Artificial Sequence: Synthetic oligonucleotide
ggcagacaagtcacccccacc

SEQ ID NO: 35699 - DNA, 21 bp, Artificial Sequence
  Description of Artificial Sequence: Synthetic oligonucleotide
agccccggcagaacccaaagc

SEQ ID NO: 35700 - DNA, 21 bp, Artificial Sequence
  Description of Artificial Sequence: Synthetic oligonucleotide
gacggcagcagcagagtcggc

SEQ ID NO: 35701 - DNA, 21 bp, Artificial Sequence
  Description of Artificial Sequence: Synthetic oligonucleotide
atgagtactggtgtttctcct

SEQ ID NO: 35702 - DNA, 21 bp, Artificial Sequence
  Description of Artificial Sequence: Synthetic oligonucleotide
cgtcaggtgtcgactcctctt

SEQ ID NO: 35703 - DNA, 21 bp, Artificial Sequence
  Description of Artificial Sequence: Synthetic oligonucleotide
agaaccaacaaaagcgtcacc

SEQ ID NO: 35704 - DNA, 21 bp, Artificial Sequence
  Description of Artificial Sequence: Synthetic oligonucleotide
tatgggtcggataagtcgatt

SEQ ID NO: 35705 - DNA, 21 bp, Artificial Sequence
  Description of Artificial Sequence: Synthetic oligonucleotide
atcaccaccagaagcagcatg

SEQ ID NO: 35706 - DNA, 21 bp, Artificial Sequence
  Description of Artificial Sequence: Synthetic oligonucleotide
gatacgattacttcgaggggt

SEQ ID NO: 35707 - DNA, 21 bp, Artificial Sequence
  Description of Artificial Sequence: Synthetic oligonucleotide
gattctaggaataatatgacg

SEQ ID NO: 35708 - DNA, 21 bp, Artificial Sequence
  Description of Artificial Sequence: Synthetic oligonucleotide
tatccgaggcagaggacggag

SEQ ID NO: 35709 - DNA, 21 bp, Artificial Sequence
  Description of Artificial Sequence: Synthetic oligonucleotide
tatgtgcctcgttcgagtctg

SEQ ID NO: 35710 - DNA, 21 bp, Artificial Sequence
  Description of Artificial Sequence: Synthetic oligonucleotide
cctttgaatactcatcagtcg

SEQ ID NO: 35711 - DNA, 21 bp, Artificial Sequence
  Description of Artificial Sequence: Synthetic oligonucleotide
gtccccggcaacctccccagc

SEQ ID NO: 35712 - DNA, 21 bp, Artificial Sequence
  Description of Artificial Sequence: Synthetic oligonucleotide
gctcttactggtaagctgtcg

SEQ ID NO: 35713 - DNA, 21 bp, Artificial Sequence
  Description of Artificial Sequence: Synthetic oligonucleotide
cccgtcctcaacaaagccacc

SEQ ID NO: 35714 - DNA, 21 bp, Artificial Sequence
  Description of Artificial Sequence: Synthetic oligonucleotide
catcttgcttatgataataac

SEQ ID NO: 35715 - DNA, 21 bp, Artificial Sequence
  Description of Artificial Sequence: Synthetic oligonucleotide
gacagcagcgaaagaatcaga

SEQ ID NO: 35716 - DNA, 21 bp, Artificial Sequence
  Description of Artificial Sequence: Synthetic oligonucleotide
tcttttagtggggctaataag

SEQ ID NO: 35717 - DNA, 21 bp, Artificial Sequence
  Description of Artificial Sequence: Synthetic oligonucleotide
ttgaaggctaatgctacgggt

SEQ ID NO: 35718 - DNA, 21 bp, Artificial Sequence
  Description of Artificial Sequence: Synthetic oligonucleotide
atgccccaccccagcagcaaa

SEQ ID NO: 35719 - DNA, 21 bp, Artificial Sequence
  Description of Artificial Sequence: Synthetic oligonucleotide
caggataagggtaatgcgggt

SEQ ID NO: 35720 - DNA, 21 bp, Artificial Sequence
  Description of Artificial Sequence: Synthetic oligonucleotide
attaattttagtggtactagg

SEQ ID NO: 35721 - DNA, 21 bp, Artificial Sequence
  Description of Artificial Sequence: Synthetic oligonucleotide
cagacttcgtctcatgcgtat

SEQ ID NO: 35722 - DNA, 21 bp, Artificial Sequence
  Description of Artificial Sequence: Synthetic oligonucleotide
tctcattctgttactcctggg

SEQ ID NO: 35723 - DNA, 21 bp, Artificial Sequence
  Description of Artificial Sequence: Synthetic oligonucleotide
attggtattactaatcatagt

SEQ ID NO: 35724 - DNA, 21 bp, Artificial Sequence
  Description of Artificial Sequence: Synthetic oligonucleotide
cattatacggggaagcagaat

SEQ ID NO: 35725 - DNA, 21 bp, Artificial Sequence
  Description of Artificial Sequence: Synthetic oligonucleotide
cagcgggtgtcgagtactttg

SEQ ID NO: 35726 - DNA, 21 bp, Artificial Sequence
  Description of Artificial Sequence: Synthetic oligonucleotide
gggcttgctggtagtttgcag

SEQ ID NO: 35727 - DNA, 21 bp, Artificial Sequence
  Description of Artificial Sequence: Synthetic oligonucleotide
gatttgtcgatgcagacgcgg

SEQ ID NO: 35728 - DNA, 21 bp, Artificial Sequence
  Description of Artificial Sequence: Synthetic oligonucleotide
actcctgcggggccgaataag

SEQ ID NO: 35729 - DNA, 21 bp, Artificial Sequence
  Description of Artificial Sequence: Synthetic oligonucleotide
gttaggatttcgactcaggcg

SEQ ID NO: 35730 - DNA, 21 bp, Artificial Sequence
  Description of Artificial Sequence: Synthetic oligonucleotide
gtcctcgccggcagcaacacc

SEQ ID NO: 35731 - DNA, 21 bp, Artificial Sequence
  Description of Artificial Sequence: Synthetic oligonucleotide
gctagttctaagggtttgact

SEQ ID NO: 35732 - DNA, 21 bp, Artificial Sequence
  Description of Artificial Sequence: Synthetic oligonucleotide
aggactcttaatcttaatact

SEQ ID NO: 35733 - DNA, 21 bp, Artificial Sequence
  Description of Artificial Sequence: Synthetic oligonucleotide
aacagagaacaactcagagac

SEQ ID NO: 35734 - DNA, 21 bp, Artificial Sequence
  Description of Artificial Sequence: Synthetic oligonucleotide
ccgggtgaggttcatcggtct

SEQ ID NO: 35735 - DNA, 21 bp, Artificial Sequence
  Description of Artificial Sequence: Synthetic oligonucleotide
tctattcattcggatcggacg

SEQ ID NO: 35736 - DNA, 21 bp, Artificial Sequence
  Description of Artificial Sequence: Synthetic oligonucleotide
tatgcgacggatggtcttaag

SEQ ID NO: 35737 - DNA, 21 bp, Artificial Sequence
  Description of Artificial Sequence: Synthetic oligonucleotide
gacaccaacaaaaccagctac

SEQ ID NO: 35738 - DNA, 21 bp, Artificial Sequence
  Description of Artificial Sequence: Synthetic oligonucleotide
tatggttcgcgtccgccttct

SEQ ID NO: 35739 - DNA, 21 bp, Artificial Sequence
  Description of Artificial Sequence: Synthetic oligonucleotide
ccgttgattaatcgtactatg

SEQ ID NO: 35740 - DNA, 21 bp, Artificial Sequence
  Description of Artificial Sequence: Synthetic oligonucleotide
agtaagagtgtggctcagtct

SEQ ID NO: 35741 - DNA, 21 bp, Artificial Sequence
  Description of Artificial Sequence: Synthetic oligonucleotide
agagaccccacccccgtcaga

SEQ ID NO: 35742 - DNA, 21 bp, Artificial Sequence
  Description of Artificial Sequence: Synthetic oligonucleotide
tatgggagtgagtcgaataag

SEQ ID NO: 35743 - DNA, 21 bp, Artificial Sequence
  Description of Artificial Sequence: Synthetic oligonucleotide
gacagagtcctcagccaaggc

SEQ ID NO: 35744 - DNA, 21 bp, Artificial Sequence
  Description of Artificial Sequence: Synthetic oligonucleotide
ttggttgcgtcggggcagaag

SEQ ID NO: 35745 - DNA, 21 bp, Artificial Sequence
  Description of Artificial Sequence: Synthetic oligonucleotide
aattcgagtgattcgttgact

SEQ ID NO: 35746 - DNA, 21 bp, Artificial Sequence
  Description of Artificial Sequence: Synthetic oligonucleotide
ggtgcttcgggtaagattggg

SEQ ID NO: 35747 - DNA, 21 bp, Artificial Sequence
  Description of Artificial Sequence: Synthetic oligonucleotide
aatacgacgggtcatgctggg

SEQ ID NO: 35748 - DNA, 21 bp, Artificial Sequence
  Description of Artificial Sequence: Synthetic oligonucleotide
tacagagtcggcagcatcagc

SEQ ID NO: 35749 - DNA, 21 bp, Artificial Sequence
  Description of Artificial Sequence: Synthetic oligonucleotide
gtcaccctcccccccaacgcc

SEQ ID NO: 35750 - DNA, 21 bp, Artificial Sequence
  Description of Artificial Sequence: Synthetic oligonucleotide
tgcgccaccagagccagctac

SEQ ID NO: 35751 - DNA, 21 bp, Artificial Sequence
  Description of Artificial Sequence: Synthetic oligonucleotide
agcatcagccacagcagcagc

SEQ ID NO: 35752 - DNA, 21 bp, Artificial Sequence
  Description of Artificial Sequence: Synthetic oligonucleotide
tgtaataatgctcgtgtttcg

SEQ ID NO: 35753 - DNA, 21 bp, Artificial Sequence
  Description of Artificial Sequence: Synthetic oligonucleotide
actgtgcctggtcgttcgacg

SEQ ID NO: 35754 - DNA, 21 bp, Artificial Sequence
  Description of Artificial Sequence: Synthetic oligonucleotide
aacgccctccccaacagaggc

SEQ ID NO: 35755 - DNA, 21 bp, Artificial Sequence
  Description of Artificial Sequence: Synthetic oligonucleotide
aaccccagcgaaaaaatgctc

SEQ ID NO: 35756 - DNA, 21 bp, Artificial Sequence
  Description of Artificial Sequence: Synthetic oligonucleotide
cccggcaccggcagcaaccac

SEQ ID NO: 35757 - DNA, 21 bp, Artificial Sequence
  Description of Artificial Sequence: Synthetic oligonucleotide
cacatcacccccgccaccagc

SEQ ID NO: 35758 - DNA, 21 bp, Artificial Sequence
  Description of Artificial Sequence: Synthetic oligonucleotide
agcagaaaccccaacatgatc

SEQ ID NO: 35759 - DNA, 21 bp, Artificial Sequence
  Description of Artificial Sequence: Synthetic oligonucleotide
ggcgaaaacagcgccaaaaga

SEQ ID NO: 35760 - DNA, 21 bp, Artificial Sequence
  Description of Artificial Sequence: Synthetic oligonucleotide
agtcttagttcgaagcagatg

SEQ ID NO: 35761 - DNA, 21 bp, Artificial Sequence
  Description of Artificial Sequence: Synthetic oligonucleotide
tgcaacagcgtcaacgacaga

SEQ ID NO: 35762 - DNA, 21 bp, Artificial Sequence
  Description of Artificial Sequence: Synthetic oligonucleotide
gagtctaagaattcggttgtg

SEQ ID NO: 35763 - DNA, 21 bp, Artificial Sequence
  Description of Artificial Sequence: Synthetic oligonucleotide
gactaccacaacagcaaactc

SEQ ID NO: 35764 - DNA, 21 bp, Artificial Sequence
  Description of Artificial Sequence: Synthetic oligonucleotide
gggcagaatactgtttctcgt

SEQ ID NO: 35765 - DNA, 21 bp, Artificial Sequence
  Description of Artificial Sequence: Synthetic oligonucleotide
gatagtgttgctggttttacg

SEQ ID NO: 35766 - DNA, 21 bp, Artificial Sequence
  Description of Artificial Sequence: Synthetic oligonucleotide
ccctacaaaaacaaacccagc

SEQ ID NO: 35767 - DNA, 21 bp, Artificial Sequence
  Description of Artificial Sequence: Synthetic oligonucleotide
gttgcggataagggttctatg

SEQ ID NO: 35768 - DNA, 21 bp, Artificial Sequence
  Description of Artificial Sequence: Synthetic oligonucleotide
ggccaaaacagaaacaacacc

SEQ ID NO: 35769 - DNA, 21 bp, Artificial Sequence
  Description of Artificial Sequence: Synthetic oligonucleotide
agaagctacgaaggcatgcaa

SEQ ID NO: 35770 - DNA, 21 bp, Artificial Sequence
  Description of Artificial Sequence: Synthetic oligonucleotide
aaacaaagaagcgcccccaac

SEQ ID NO: 35771 - DNA, 21 bp, Artificial Sequence
  Description of Artificial Sequence: Synthetic oligonucleotide
actgcgcgtgggggtcctact

SEQ ID NO: 35772 - DNA, 21 bp, Artificial Sequence
  Description of Artificial Sequence: Synthetic oligonucleotide
tcgatggggaagttgtctagt

SEQ ID NO: 35773 - DNA, 21 bp, Artificial Sequence
  Description of Artificial Sequence: Synthetic oligonucleotide
gtcgtcctcgacaccaacaga

SEQ ID NO: 35774 - DNA, 21 bp, Artificial Sequence
  Description of Artificial Sequence: Synthetic oligonucleotide
aatggggctacgaagaatagt

SEQ ID NO: 35775 - DNA, 21 bp, Artificial Sequence
  Description of Artificial Sequence: Synthetic oligonucleotide
agcagccccctcgaacacagc

SEQ ID NO: 35776 - DNA, 21 bp, Artificial Sequence
  Description of Artificial Sequence: Synthetic oligonucleotide
gctaagactaatttgagttct

SEQ ID NO: 35777 - DNA, 21 bp, Artificial Sequence
  Description of Artificial Sequence: Synthetic oligonucleotide
agtcttcctaatactaatggg

SEQ ID NO: 35778 - DNA, 21 bp, Artificial Sequence
  Description of Artificial Sequence: Synthetic oligonucleotide
ctcggcctcagagacaacacc

SEQ ID NO: 35779 - DNA, 21 bp, Artificial Sequence
  Description of Artificial Sequence: Synthetic oligonucleotide
tcgaatgagactaagtcttcg

SEQ ID NO: 35780 - DNA, 21 bp, Artificial Sequence
  Description of Artificial Sequence: Synthetic oligonucleotide
agcgtcaacagccaccacggc

SEQ ID NO: 35781 - DNA, 21 bp, Artificial Sequence
  Description of Artificial Sequence: Synthetic oligonucleotide
accaaaggcggcagccaactc

SEQ ID NO: 35782 - DNA, 21 bp, Artificial Sequence
  Description of Artificial Sequence: Synthetic oligonucleotide
cgtaatggtgctatgtctaat

SEQ ID NO: 35783 - DNA, 21 bp, Artificial Sequence
  Description of Artificial Sequence: Synthetic oligonucleotide
actggggtttcgcctctggct

SEQ ID NO: 35784 - DNA, 21 bp, Artificial Sequence
  Description of Artificial Sequence: Synthetic oligonucleotide
gccatgaccggcagccacacc

SEQ ID NO: 35785 - DNA, 21 bp, Artificial Sequence
  Description of Artificial Sequence: Synthetic oligonucleotide
ggcacccccaacaccaaagtc

SEQ ID NO: 35786 - DNA, 21 bp, Artificial Sequence
  Description of Artificial Sequence: Synthetic oligonucleotide
catggtattggtaattcggcg

SEQ ID NO: 35787 - DNA, 21 bp, Artificial Sequence
  Description of Artificial Sequence: Synthetic oligonucleotide
gagggttctgggaggcttact

SEQ ID NO: 35788 - DNA, 21 bp, Artificial Sequence
  Description of Artificial Sequence: Synthetic oligonucleotide
tcgggggcttcgagtaattct

SEQ ID NO: 35789 - DNA, 21 bp, Artificial Sequence
  Description of Artificial Sequence: Synthetic oligonucleotide
cagaatcgtaatactgttggt

SEQ ID NO: 35790 - DNA, 21 bp, Artificial Sequence
  Description of Artificial Sequence: Synthetic oligonucleotide
ggcacccaaaaacaaaccagc

SEQ ID NO: 35791 - DNA, 21 bp, Artificial Sequence
  Description of Artificial Sequence: Synthetic oligonucleotide
tataatagtactactgcgact

SEQ ID NO: 35792 - DNA, 21 bp, Artificial Sequence
  Description of Artificial Sequence: Synthetic oligonucleotide
atgggtaatgcgggtgtgcgg

SEQ ID NO: 35793 - DNA, 21 bp, Artificial Sequence
  Description of Artificial Sequence: Synthetic oligonucleotide
ttttcgcttaagggtgggaat

SEQ ID NO: 35794 - DNA, 21 bp, Artificial Sequence
  Description of Artificial Sequence: Synthetic oligonucleotide
aacggcagcggccaaacccaa

SEQ ID NO: 35795 - DNA, 21 bp, Artificial Sequence
  Description of Artificial Sequence: Synthetic oligonucleotide
cttaataagtctacgcttccg

SEQ ID NO: 35796 - DNA, 21 bp, Artificial Sequence
  Description of Artificial Sequence: Synthetic oligonucleotide
cctagtaattcgggtaataat

SEQ ID NO: 35797 - DNA, 21 bp, Artificial Sequence
  Description of Artificial Sequence: Synthetic oligonucleotide
cagcctacgacgagtgctctg

SEQ ID NO: 35798 - DNA, 21 bp, Artificial Sequence
  Description of Artificial Sequence: Synthetic oligonucleotide
gtcgccagcagcgcccacgtc

SEQ ID NO: 35799 - DNA, 21 bp, Artificial Sequence
  Description of Artificial Sequence: Synthetic oligonucleotide
gggattgctactactaatagg

SEQ ID NO: 35800 - DNA, 21 bp, Artificial Sequence
  Description of Artificial Sequence: Synthetic oligonucleotide
cgtctgcataatatgtcggct

SEQ ID NO: 35801 - DNA, 21 bp, Artificial Sequence
  Description of Artificial Sequence: Synthetic oligonucleotide
tctcagcagtctgctgcgctt

SEQ ID NO: 35802 - DNA, 21 bp, Artificial Sequence
  Description of Artificial Sequence: Synthetic oligonucleotide
atgctgaatacttctcattat

SEQ ID NO: 35803 - DNA, 21 bp, Artificial Sequence
  Description of Artificial Sequence: Synthetic oligonucleotide
cagggtctgtctaagagtggg

SEQ ID NO: 35804 - DNA, 21 bp, Artificial Sequence
  Description of Artificial Sequence: Synthetic oligonucleotide
agacccatcgccagcagcggc

SEQ ID NO: 35805 - DNA, 21 bp, Artificial Sequence
  Description of Artificial Sequence: Synthetic oligonucleotide
gatgtgcataggagtagtggg

SEQ ID NO: 35806 - DNA, 21 bp, Artificial Sequence
  Description of Artificial Sequence: Synthetic oligonucleotide
tttaatagtgggagtggtcgt

SEQ ID NO: 35807 - DNA, 21 bp, Artificial Sequence
  Description of Artificial Sequence: Synthetic oligonucleotide
attggtagtaatgcgcggcag

SEQ ID NO: 35808 - DNA, 21 bp, Artificial Sequence
  Description of Artificial Sequence: Synthetic oligonucleotide
ccccacgtcgccagacaaatg

SEQ ID NO: 35809 - DNA, 21 bp, Artificial Sequence
  Description of Artificial Sequence: Synthetic oligonucleotide
ttgactgcggttagtccgaag

SEQ ID NO: 35810 - DNA, 21 bp, Artificial Sequence
  Description of Artificial Sequence: Synthetic oligonucleotide
tatcctagtccgacggttact

SEQ ID NO: 35811 - DNA, 21 bp, Artificial Sequence
  Description of Artificial Sequence: Synthetic oligonucleotide
atccaacaaggcagcagaacc

SEQ ID NO: 35812 - DNA, 21 bp, Artificial Sequence
  Description of Artificial Sequence: Synthetic oligonucleotide
aacgtcagcggccaaaaccaa

SEQ ID NO: 35813 - DNA, 21 bp, Artificial Sequence
  Description of Artificial Sequence: Synthetic oligonucleotide
gggtctgggtctcggttgatt

SEQ ID NO: 35814 - DNA, 21 bp, Artificial Sequence
  Description of Artificial Sequence: Synthetic oligonucleotide
aatcagcagaatgggagtaat

SEQ ID NO: 35815 - DNA, 21 bp, Artificial Sequence
  Description of Artificial Sequence: Synthetic oligonucleotide
atggtttcgggtaagagttat

SEQ ID NO: 35816 - DNA, 21 bp, Artificial Sequence
  Description of Artificial Sequence: Synthetic oligonucleotide
ctgggtggtcggagtagtaat

SEQ ID NO: 35817 - DNA, 21 bp, Artificial Sequence
  Description of Artificial Sequence: Synthetic oligonucleotide
aacggttctgcacagaatcaa

SEQ ID NO: 35818 - DNA, 21 bp, Artificial Sequence
  Description of Artificial Sequence: Synthetic oligonucleotide
accggccaacaaaccgccacc

SEQ ID NO: 35819 - DNA, 21 bp, Artificial Sequence
  Description of Artificial Sequence: Synthetic oligonucleotide
gccagcaccgccatcaaccaa

SEQ ID NO: 35820 - DNA, 21 bp, Artificial Sequence
  Description of Artificial Sequence: Synthetic oligonucleotide
ggtcagcctaattctgcgcgg

SEQ ID NO: 35821 - DNA, 21 bp, Artificial Sequence
  Description of Artificial Sequence: Synthetic oligonucleotide
aacagcatcagcagagtcacc

SEQ ID NO: 35822 - DNA, 21 bp, Artificial Sequence
  Description of Artificial Sequence: Synthetic oligonucleotide
gtgaatacgtctcatacgaat

SEQ ID NO: 35823 - DNA, 21 bp, Artificial Sequence
  Description of Artificial Sequence: Synthetic oligonucleotide
tctactaatggtaatggtttg

SEQ ID NO: 35824 - DNA, 21 bp, Artificial Sequence
  Description of Artificial Sequence: Synthetic oligonucleotide
aatagtggggcgaggcttagt

SEQ ID NO: 35825 - DNA, 21 bp, Artificial Sequence
  Description of Artificial Sequence: Synthetic oligonucleotide
tcttcgacgtctcctgggagg

SEQ ID NO: 35826 - DNA, 21 bp, Artificial Sequence
  Description of Artificial Sequence: Synthetic oligonucleotide
aaaagcgacgcccacaccgcc

SEQ ID NO: 35827 - DNA, 21 bp, Artificial Sequence
  Description of Artificial Sequence: Synthetic oligonucleotide
gtgcatcaggctggggctaat

SEQ ID NO: 35828 - DNA, 21 bp, Artificial Sequence
  Description of Artificial Sequence: Synthetic oligonucleotide
tccgatactaagccttttacg

SEQ ID NO: 35829 - DNA, 21 bp, Artificial Sequence
  Description of Artificial Sequence: Synthetic oligonucleotide
actgctttttctactaatcgg

SEQ ID NO: 35830 - DNA, 21 bp, Artificial Sequence
  Description of Artificial Sequence: Synthetic oligonucleotide
cttagtatgaatacttcgaag

SEQ ID NO: 35831 - DNA, 21 bp, Artificial Sequence
  Description of Artificial Sequence: Synthetic oligonucleotide
atgaccgaaagcagcagaacc

SEQ ID NO: 35832 - DNA, 21 bp, Artificial Sequence
  Description of Artificial Sequence: Synthetic oligonucleotide
gagcgtgctaaggggtctagt

SEQ ID NO: 35833 - DNA, 21 bp, Artificial Sequence
  Description of Artificial Sequence: Synthetic oligonucleotide
agactcaccggcatcagcacc

SEQ ID NO: 35834 - DNA, 21 bp, Artificial Sequence
  Description of Artificial Sequence: Synthetic oligonucleotide
atgaagtcgcagaagtatgct

SEQ ID NO: 35835 - DNA, 21 bp, Artificial Sequence
  Description of Artificial Sequence: Synthetic oligonucleotide
tctcctggtaataagagtact

SEQ ID NO: 35836 - DNA, 21 bp, Artificial Sequence
  Description of Artificial Sequence: Synthetic oligonucleotide
tttagtagtgcttcttttacg

SEQ ID NO: 35837 - DNA, 21 bp, Artificial Sequence
  Description of Artificial Sequence: Synthetic oligonucleotide
agaggcatcgacaacaaaggc

SEQ ID NO: 35838 - DNA, 21 bp, Artificial Sequence
  Description of Artificial Sequence: Synthetic oligonucleotide
atcgtcagccccgtcagcaaa

SEQ ID NO: 35839 - DNA, 21 bp, Artificial Sequence
  Description of Artificial Sequence: Synthetic oligonucleotide
actactcataatattcagggg

SEQ ID NO: 35840 - DNA, 21 bp, Artificial Sequence
  Description of Artificial Sequence: Synthetic oligonucleotide
ggtgatgctggtagttttagt

SEQ ID NO: 35841 - DNA, 21 bp, Artificial Sequence
  Description of Artificial Sequence: Synthetic oligonucleotide
ctcggcgtcaaaacccccacc

SEQ ID NO: 35842 - DNA, 21 bp, Artificial Sequence
  Description of Artificial Sequence: Synthetic oligonucleotide
actaatcgtgtgggttatggt

SEQ ID NO: 35843 - DNA, 21 bp, Artificial Sequence
  Description of Artificial Sequence: Synthetic oligonucleotide
tcggcgcgggatagggcgtcg

SEQ ID NO: 35844 - DNA, 21 bp, Artificial Sequence
  Description of Artificial Sequence: Synthetic oligonucleotide
aaagacttcggccaaatgaga

SEQ ID NO: 35845 - DNA, 21 bp, Artificial Sequence
  Description of Artificial Sequence: Synthetic oligonucleotide
gatattagtgttcggccgggt

SEQ ID NO: 35846 - DNA, 21 bp, Artificial Sequence
  Description of Artificial Sequence: Synthetic oligonucleotide
cccagccaagaaggccaacaa

SEQ ID NO: 35847 - DNA, 21 bp, Artificial Sequence
  Description of Artificial Sequence: Synthetic oligonucleotide
ccgattactcatcctttgcgt

SEQ ID NO: 35848 - DNA, 21 bp, Artificial Sequence
  Description of Artificial Sequence: Synthetic oligonucleotide
ccgggtcatgctacgcagagt

SEQ ID NO: 35849 - DNA, 21 bp, Artificial Sequence
  Description of Artificial Sequence: Synthetic oligonucleotide
aggccggtggggggtctggcg

SEQ ID NO: 35850 - DNA, 21 bp, Artificial Sequence
  Description of Artificial Sequence: Synthetic oligonucleotide
atgtctacggctcgttctgct

SEQ ID NO: 35851 - DNA, 21 bp, Artificial Sequence
  Description of Artificial Sequence: Synthetic oligonucleotide
agcaaccccagcggcttcagc

SEQ ID NO: 35852 - DNA, 21 bp, Artificial Sequence
  Description of Artificial Sequence: Synthetic oligonucleotide
ggcatgcaaaaaatgagcagc

SEQ ID NO: 35853 - DNA, 21 bp, Artificial Sequence
  Description of Artificial Sequence: Synthetic oligonucleotide
ccgcttgataagtctatgatg

SEQ ID NO: 35854 - DNA, 21 bp, Artificial Sequence
  Description of Artificial Sequence: Synthetic oligonucleotide
gtccaaagaagcagcaaccaa

SEQ ID NO: 35855 - DNA, 21 bp, Artificial Sequence
  Description of Artificial Sequence: Synthetic oligonucleotide
agcggcggcaaaggccccacc

SEQ ID NO: 35856 - DNA, 21 bp, Artificial Sequence
  Description of Artificial Sequence: Synthetic oligonucleotide
gaccaagtcagccacaaactc

SEQ ID NO: 35857 - DNA, 21 bp, Artificial Sequence
  Description of Artificial Sequence: Synthetic oligonucleotide
tcgcatgatagtcgtgtggct

SEQ ID NO: 35858 - DNA, 21 bp, Artificial Sequence
  Description of Artificial Sequence: Synthetic oligonucleotide
ggcaccgccggcagattcaac

SEQ ID NO: 35859 - DNA, 21 bp, Artificial Sequence
  Description of Artificial Sequence: Synthetic oligonucleotide
cgtgatcggactaatgctgct

SEQ ID NO: 35860 - DNA, 21 bp, Artificial Sequence
  Description of Artificial Sequence: Synthetic oligonucleotide
cccgtcagcggcgccaccatc

SEQ ID NO: 35861 - DNA, 21 bp, Artificial Sequence
  Description of Artificial Sequence: Synthetic oligonucleotide
gtcctcaacgccaaaagcagc

SEQ ID NO: 35862 - DNA, 21 bp, Artificial Sequence
  Description of Artificial Sequence: Synthetic oligonucleotide
cacgtcaccaaaagcaccgcc

SEQ ID NO: 35863 - DNA, 21 bp, Artificial Sequence
  Description of Artificial Sequence: Synthetic oligonucleotide
agcatcaaaagcgtcaccaac

SEQ ID NO: 35864 - DNA, 21 bp, Artificial Sequence
  Description of Artificial Sequence: Synthetic oligonucleotide
agtgcgggtggtgcggtgtct

SEQ ID NO: 35865 - DNA, 21 bp, Artificial Sequence
  Description of Artificial Sequence: Synthetic oligonucleotide
atgggtcagggtactcttcgt

SEQ ID NO: 35866 - DNA, 21 bp, Artificial Sequence
  Description of Artificial Sequence: Synthetic oligonucleotide
ggcagactcaccagcagcatc

SEQ ID NO: 35867 - DNA, 21 bp, Artificial Sequence
  Description of Artificial Sequence: Synthetic oligonucleotide
acccaaagccacaacctcgcc

SEQ ID NO: 35868 - DNA, 21 bp, Artificial Sequence
  Description of Artificial Sequence: Synthetic oligonucleotide
catatttctactcggtctgct

SEQ ID NO: 35869 - DNA, 21 bp, Artificial Sequence
  Description of Artificial Sequence: Synthetic oligonucleotide
gatcagggtaatggttatggg

SEQ ID NO: 35870 - DNA, 21 bp, Artificial Sequence
  Description of Artificial Sequence: Synthetic oligonucleotide
accccccaaaacagcgtcaaa

SEQ ID NO: 35871 - DNA, 21 bp, Artificial Sequence
  Description of Artificial Sequence: Synthetic oligonucleotide
aaaagcgcccaaggcggcaac

SEQ ID NO: 35872 - DNA, 21 bp, Artificial Sequence
  Description of Artificial Sequence: Synthetic oligonucleotide
gagtcttcttcttctatgggt

SEQ ID NO: 35873 - DNA, 21 bp, Artificial Sequence
  Description of Artificial Sequence: Synthetic oligonucleotide
cggaataataatacgcctggg

SEQ ID NO: 35874 - DNA, 21 bp, Artificial Sequence
  Description of Artificial Sequence: Synthetic oligonucleotide
taccaaaacgtcagcagcaaa

SEQ ID NO: 35875 - DNA, 21 bp, Artificial Sequence
  Description of Artificial Sequence: Synthetic oligonucleotide
tataataatggtggtactcgt

SEQ ID NO: 35876 - DNA, 21 bp, Artificial Sequence
  Description of Artificial Sequence: Synthetic oligonucleotide
aacggcagcggcaccaaccaa

SEQ ID NO: 35877 - DNA, 21 bp, Artificial Sequence
  Description of Artificial Sequence: Synthetic oligonucleotide
atccccctcagcagccaaaga

SEQ ID NO: 35878 - DNA, 21 bp, Artificial Sequence
  Description of Artificial Sequence: Synthetic oligonucleotide
ggtttgcatcctacgtattct

SEQ ID NO: 35879 - DNA, 21 bp, Artificial Sequence
  Description of Artificial Sequence: Synthetic oligonucleotide
gatgctcagcgtaggggtgtg

SEQ ID NO: 35880 - DNA, 21 bp, Artificial Sequence
  Description of Artificial Sequence: Synthetic oligonucleotide
aatgttagtactggggctact

SEQ ID NO: 35881 - DNA, 21 bp, Artificial Sequence
  Description of Artificial Sequence: Synthetic oligonucleotide
cccacccaaaacggcagaagc

SEQ ID NO: 35882 - DNA, 21 bp, Artificial Sequence
  Description of Artificial Sequence: Synthetic oligonucleotide
agcagcgtcagcagaagccac

SEQ ID NO: 35883 - DNA, 21 bp, Artificial Sequence
  Description of Artificial Sequence: Synthetic oligonucleotide
ccggatgttaaggtgactagg

SEQ ID NO: 35884 - DNA, 21 bp, Artificial Sequence
  Description of Artificial Sequence: Synthetic oligonucleotide
aatgtttcgagtgcgattaag

SEQ ID NO: 35885 - DNA, 21 bp, Artificial Sequence
  Description of Artificial Sequence: Synthetic oligonucleotide
atgagtagtaggtcgagtgtg

SEQ ID NO: 35886 - DNA, 21 bp, Artificial Sequence
  Description of Artificial Sequence: Synthetic oligonucleotide
ggcagactcaacaccaacggc

SEQ ID NO: 35887 - DNA, 21 bp, Artificial Sequence
  Description of Artificial Sequence: Synthetic oligonucleotide
gatatttcgaggtctcatggt

SEQ ID NO: 35888 - DNA, 21 bp, Artificial Sequence
  Description of Artificial Sequence: Synthetic oligonucleotide
gaagccaccagcagcaccaaa

SEQ ID NO: 35889 - DNA, 21 bp, Artificial Sequence
  Description of Artificial Sequence: Synthetic oligonucleotide
ggtatttcgccggggacggct

SEQ ID NO: 35890 - DNA, 21 bp, Artificial Sequence
  Description of Artificial Sequence: Synthetic oligonucleotide
cccctcaccaccagacccagc

SEQ ID NO: 35891 - DNA, 21 bp, Artificial Sequence
  Description of Artificial Sequence: Synthetic oligonucleotide
gctatgaatcgggaggtgtct

SEQ ID NO: 35892 - DNA, 21 bp, Artificial Sequence
  Description of Artificial Sequence: Synthetic oligonucleotide
cccagccaaaccaaacccagc

SEQ ID NO: 35893 - DNA, 21 bp, Artificial Sequence
  Description of Artificial Sequence: Synthetic oligonucleotide
tcttcgaatgagaaggatagg

SEQ ID NO: 35894 - DNA, 21 bp, Artificial Sequence
  Description of Artificial Sequence: Synthetic oligonucleotide
catcatagtactcttcagact

SEQ ID NO: 35895 - DNA, 21 bp, Artificial Sequence
  Description of Artificial Sequence: Synthetic oligonucleotide
aacgccagcggccaaaaccaa

SEQ ID NO: 35896 - DNA, 21 bp, Artificial Sequence
  Description of Artificial Sequence: Synthetic oligonucleotide
agcatgggcaacagcatcagc

SEQ ID NO: 35897 - DNA, 21 bp, Artificial Sequence
  Description of Artificial Sequence: Synthetic oligonucleotide
agcgccgtcggcaaagccagc

SEQ ID NO: 35898 - DNA, 21 bp, Artificial Sequence
  Description of Artificial Sequence: Synthetic oligonucleotide
cccagccacaaccccaccaac

SEQ ID NO: 35899 - DNA, 21 bp, Artificial Sequence
  Description of Artificial Sequence: Synthetic oligonucleotide
tcggataagggtaatactcgg

SEQ ID NO: 35900 - DNA, 21 bp, Artificial Sequence
  Description of Artificial Sequence: Synthetic oligonucleotide
agcagactcgaaaaaagcaac

SEQ ID NO: 35901 - DNA, 21 bp, Artificial Sequence
  Description of Artificial Sequence: Synthetic oligonucleotide
cggccttcgatgcctcatagt

SEQ ID NO: 35902 - DNA, 21 bp, Artificial Sequence
  Description of Artificial Sequence: Synthetic oligonucleotide
ctcagagacaccaacatgaac

SEQ ID NO: 35903 - DNA, 21 bp, Artificial Sequence
  Description of Artificial Sequence: Synthetic oligonucleotide
agagtcaacctcaacgaactc

SEQ ID NO: 35904 - DNA, 21 bp, Artificial Sequence
  Description of Artificial Sequence: Synthetic oligonucleotide
gggacgactaattcgcgtaat

SEQ ID NO: 35905 - DNA, 21 bp, Artificial Sequence
  Description of Artificial Sequence: Synthetic oligonucleotide
aatagtaatgggtttaataat

SEQ ID NO: 35906 - DNA, 21 bp, Artificial Sequence
  Description of Artificial Sequence: Synthetic oligonucleotide
aatcagggtggttatcatggt

SEQ ID NO: 35907 - DNA, 21 bp, Artificial Sequence
  Description of Artificial Sequence: Synthetic oligonucleotide
atcagccccgtccccctcacc

SEQ ID NO: 35908 - DNA, 21 bp, Artificial Sequence
  Description of Artificial Sequence: Synthetic oligonucleotide
catgtgccgtcgaagcttgct

SEQ ID NO: 35909 - DNA, 21 bp, Artificial Sequence
  Description of Artificial Sequence: Synthetic oligonucleotide
tcgattccgtcgactagtcag

SEQ ID NO: 35910 - DNA, 21 bp, Artificial Sequence
  Description of Artificial Sequence: Synthetic oligonucleotide
aacagagtcgaacacacccaa

SEQ ID NO: 35911 - DNA, 21 bp, Artificial Sequence
  Description of Artificial Sequence: Synthetic oligonucleotide
agaatgagcagcacccacggc

SEQ ID NO: 35912 - DNA, 21 bp, Artificial Sequence
  Description of Artificial Sequence: Synthetic oligonucleotide
ggtatgaagggtagtgttaat

SEQ ID NO: 35913 - DNA, 21 bp, Artificial Sequence
  Description of Artificial Sequence: Synthetic oligonucleotide
agtgttgcgggtactagtagg

SEQ ID NO: 35914 - DNA, 21 bp, Artificial Sequence
  Description of Artificial Sequence: Synthetic oligonucleotide
aacaaaagcaacaccttcctc

SEQ ID NO: 35915 - DNA, 21 bp, Artificial Sequence
  Description of Artificial Sequence: Synthetic oligonucleotide
gacccccacagcggcggcaaa

SEQ ID NO: 35916 - DNA, 21 bp, Artificial Sequence
  Description of Artificial Sequence: Synthetic oligonucleotide
ggcaccagcaccagcctcaga

SEQ ID NO: 35917 - DNA, 21 bp, Artificial Sequence
  Description of Artificial Sequence: Synthetic oligonucleotide
ctcgccaccaacagaagcaac

SEQ ID NO: 35918 - DNA, 21 bp, Artificial Sequence
  Description of Artificial Sequence: Synthetic oligonucleotide
aacagacaagtccccggcctc

SEQ ID NO: 35919 - DNA, 21 bp, Artificial Sequence
  Description of Artificial Sequence: Synthetic oligonucleotide
tctactgggtcggtgagtaag

SEQ ID NO: 35920 - DNA, 21 bp, Artificial Sequence
  Description of Artificial Sequence: Synthetic oligonucleotide
ggtctgccgcttaggtcggtt

SEQ ID NO: 35921 - DNA, 21 bp, Artificial Sequence
  Description of Artificial Sequence: Synthetic oligonucleotide
caagtcaccagcatcggcgcc

SEQ ID NO: 35922 - DNA, 21 bp, Artificial Sequence
  Description of Artificial Sequence: Synthetic oligonucleotide
cctcagtcgaggaagggggag

SEQ ID NO: 35923 - DNA, 21 bp, Artificial Sequence
  Description of Artificial Sequence: Synthetic oligonucleotide
agctacgccgacaaacaaggc

SEQ ID NO: 35924 - DNA, 21 bp, Artificial Sequence
  Description of Artificial Sequence: Synthetic oligonucleotide
cctcttcagcagaatcggtct

SEQ ID NO: 35925 - DNA, 21 bp, Artificial Sequence
  Description of Artificial Sequence: Synthetic oligonucleotide
cacagcgaaaacggcaacaga

SEQ ID NO: 35926 - DNA, 21 bp, Artificial Sequence
  Description of Artificial Sequence: Synthetic oligonucleotide
cgtgcttcgcagtctgtgggt

SEQ ID NO: 35927 - DNA, 21 bp, Artificial Sequence
  Description of Artificial Sequence: Synthetic oligonucleotide
tttaattcttcttctggtagt

SEQ ID NO: 35928 - DNA, 21 bp, Artificial Sequence
  Description of Artificial Sequence: Synthetic oligonucleotide
aacggttctggacagagtcaa

SEQ ID NO: 35929 - DNA, 21 bp, Artificial Sequence
  Description of Artificial Sequence: Synthetic oligonucleotide
aacaccaccgccaaaagcagc

SEQ ID NO: 35930 - DNA, 21 bp, Artificial Sequence
  Description of Artificial Sequence: Synthetic oligonucleotide
tctgtgagttctcctagggat

SEQ ID NO: 35931 - DNA, 21 bp, Artificial Sequence
  Description of Artificial Sequence: Synthetic oligonucleotide
agccacggcccccaaatcacc

SEQ ID NO: 35932 - DNA, 21 bp, Artificial Sequence
  Description of Artificial Sequence: Synthetic oligonucleotide
aaactccccgacagcagattc

SEQ ID NO: 35933 - DNA, 21 bp, Artificial Sequence
  Description of Artificial Sequence: Synthetic oligonucleotide
gcgggtggtattaataagctt

SEQ ID NO: 35934 - DNA, 21 bp, Artificial Sequence
  Description of Artificial Sequence: Synthetic oligonucleotide
ggtgctgagcggattttgcgt

SEQ ID NO: 35935 - DNA, 21 bp, Artificial Sequence
  Description of Artificial Sequence: Synthetic oligonucleotide
ccgagtgcggggagggagaag

SEQ ID NO: 35936 - DNA, 21 bp, Artificial Sequence
  Description of Artificial Sequence: Synthetic oligonucleotide
gttagtacgactcctgctttg

SEQ ID NO: 35937 - DNA, 21 bp, Artificial Sequence
  Description of Artificial Sequence: Synthetic oligonucleotide
catagtacgtctttgtctaag

SEQ ID NO: 35938 - DNA, 21 bp, Artificial Sequence
  Description of Artificial Sequence: Synthetic oligonucleotide
ggcagcagcatcccctggcaa

SEQ ID NO: 35939 - DNA, 21 bp, Artificial Sequence
  Description of Artificial Sequence: Synthetic oligonucleotide
tggtcgacgagtaagcaggtt

SEQ ID NO: 35940 - DNA, 21 bp, Artificial Sequence
  Description of Artificial Sequence: Synthetic oligonucleotide
ggtagtgcgggtaatatgctt

SEQ ID NO: 35941 - DNA, 21 bp, Artificial Sequence
  Description of Artificial Sequence: Synthetic oligonucleotide
aacggtcctggacagaatcaa

SEQ ID NO: 35942 - DNA, 21 bp, Artificial Sequence
  Description of Artificial Sequence: Synthetic oligonucleotide
actacttcgggtgctgggcgt

SEQ ID NO: 35943 - DNA, 21 bp, Artificial Sequence
  Description of Artificial Sequence: Synthetic oligonucleotide
tcgcggaatacgcagtcgatg

SEQ ID NO: 35944 - DNA, 21 bp, Artificial Sequence
  Description of Artificial Sequence: Synthetic oligonucleotide
accaccatgagcaaagtcggc

SEQ ID NO: 35945 - DNA, 21 bp, Artificial Sequence
  Description of Artificial Sequence: Synthetic oligonucleotide
agtgggggtactcctgggcgt

SEQ ID NO: 35946 - DNA, 21 bp, Artificial Sequence
  Description of Artificial Sequence: Synthetic oligonucleotide
attagggcgaaggagtctgcg

SEQ ID NO: 35947 - DNA, 21 bp, Artificial Sequence
  Description of Artificial Sequence: Synthetic oligonucleotide
gggaatcgtgggtctgttatt

SEQ ID NO: 35948 - DNA, 21 bp, Artificial Sequence
  Description of Artificial Sequence: Synthetic oligonucleotide
gacgactaccaacacaaaggc

SEQ ID NO: 35949 - DNA, 21 bp, Artificial Sequence
  Description of Artificial Sequence: Synthetic oligonucleotide
aacagagtcggcagcatcagc

SEQ ID NO: 35950 - DNA, 21 bp, Artificial Sequence
  Description of Artificial Sequence: Synthetic oligonucleotide
gatcttactcgggcgacgtct

SEQ ID NO: 35951 - DNA, 21 bp, Artificial Sequence
  Description of Artificial Sequence: Synthetic oligonucleotide
catgcgacgtctggtacgcgt

SEQ ID NO: 35952 - DNA, 21 bp, Artificial Sequence
  Description of Artificial Sequence: Synthetic oligonucleotide
aaaaactacgacaacgccgtc

SEQ ID NO: 35953 - DNA, 21 bp, Artificial Sequence
  Description of Artificial Sequence: Synthetic oligonucleotide
agcttcgccaaaagcgccagc

SEQ ID NO: 35954 - DNA, 21 bp, Artificial Sequence
  Description of Artificial Sequence: Synthetic oligonucleotide
caccacgacgccagccccaac

SEQ ID NO: 35955 - DNA, 21 bp, Artificial Sequence
  Description of Artificial Sequence: Synthetic oligonucleotide
gacgtcctcagcaaaagccaa

SEQ ID NO: 35956 - DNA, 21 bp, Artificial Sequence
  Description of Artificial Sequence: Synthetic oligonucleotide
caccccgaaaccgccttcaaa

SEQ ID NO: 35957 - DNA, 21 bp, Artificial Sequence
  Description of Artificial Sequence: Synthetic oligonucleotide
agagccggcggcaacgccgtc

SEQ ID NO: 35958 - DNA, 21 bp, Artificial Sequence
  Description of Artificial Sequence: Synthetic oligonucleotide
gtgggtggtggtcgtgataat

SEQ ID NO: 35959 - DNA, 21 bp, Artificial Sequence
  Description of Artificial Sequence: Synthetic oligonucleotide
tgtactacgcggcagggtaat

SEQ ID NO: 35960 - DNA, 21 bp, Artificial Sequence
  Description of Artificial Sequence: Synthetic oligonucleotide
tatggttcgaatacgccgact

SEQ ID NO: 35961 - DNA, 21 bp, Artificial Sequence
  Description of Artificial Sequence: Synthetic oligonucleotide
ggccccatgagacccttccaa

SEQ ID NO: 35962 - DNA, 21 bp, Artificial Sequence
  Description of Artificial Sequence: Synthetic oligonucleotide
gataggcataatacgacttct

SEQ ID NO: 35963 - DNA, 21 bp, Artificial Sequence
  Description of Artificial Sequence: Synthetic oligonucleotide
ttgcctcatcatacttctgcg

SEQ ID NO: 35964 - DNA, 21 bp, Artificial Sequence
  Description of Artificial Sequence: Synthetic oligonucleotide
agaaccgtcgacagcagcgac

SEQ ID NO: 35965 - DNA, 21 bp, Artificial Sequence
  Description of Artificial Sequence: Synthetic oligonucleotide
agtgttcattcgaatgcgatt

SEQ ID NO: 35966 - DNA, 21 bp, Artificial Sequence
  Description of Artificial Sequence: Synthetic oligonucleotide
gagggtcctagtagtcctcat

SEQ ID NO: 35967 - DNA, 21 bp, Artificial Sequence
  Description of Artificial Sequence: Synthetic oligonucleotide
acgttttctaagggtactaat

SEQ ID NO: 35968 - DNA, 21 bp, Artificial Sequence
  Description of Artificial Sequence: Synthetic oligonucleotide
tcgtcgcctgttaggaatact

SEQ ID NO: 35969 - DNA, 21 bp, Artificial Sequence
  Description of Artificial Sequence: Synthetic oligonucleotide
aattcgagttcgtctaatcat

SEQ ID NO: 35970 - DNA, 21 bp, Artificial Sequence
  Description of Artificial Sequence: Synthetic oligonucleotide
gacagaagcgccaccgtcaaa

SEQ ID NO: 35971 - DNA, 21 bp, Artificial Sequence
  Description of Artificial Sequence: Synthetic oligonucleotide
agtgttcctggggtgtctcgg

SEQ ID NO: 35972 - DNA, 21 bp, Artificial Sequence
  Description of Artificial Sequence: Synthetic oligonucleotide
cgtgagggtggtcagatggtg

SEQ ID NO: 35973 - DNA, 21 bp, Artificial Sequence
  Description of Artificial Sequence: Synthetic oligonucleotide
ctgtcgacggttaatcagaat

SEQ ID NO: 35974 - DNA, 21 bp, Artificial Sequence
  Description of Artificial Sequence: Synthetic oligonucleotide
agaaacaccagcgacctcgcc

SEQ ID NO: 35975 - DNA, 21 bp, Artificial Sequence
  Description of Artificial Sequence: Synthetic oligonucleotide
aacggttctggactgaatcaa

SEQ ID NO: 35976 - DNA, 21 bp, Artificial Sequence
  Description of Artificial Sequence: Synthetic oligonucleotide
cctggtttgcgtgatacggct

SEQ ID NO: 35977 - DNA, 21 bp, Artificial Sequence
  Description of Artificial Sequence: Synthetic oligonucleotide
atgagtacgcatagttcgggt

SEQ ID NO: 35978 - DNA, 21 bp, Artificial Sequence
  Description of Artificial Sequence: Synthetic oligonucleotide
gtttcgactgggaagagtgtc

SEQ ID NO: 35979 - DNA, 21 bp, Artificial Sequence
  Description of Artificial Sequence: Synthetic oligonucleotide
aaccccagcatggccatgaaa

SEQ ID NO: 35980 - DNA, 21 bp, Artificial Sequence
  Description of Artificial Sequence: Synthetic oligonucleotide
agactccccgaaaacgtcaga

SEQ ID NO: 35981 - DNA, 21 bp, Artificial Sequence
  Description of Artificial Sequence: Synthetic oligonucleotide
cggccggatcgtactactctg

SEQ ID NO: 35982 - DNA, 21 bp, Artificial Sequence
  Description of Artificial Sequence: Synthetic oligonucleotide
agcagagaaaccgtccccacc

SEQ ID NO: 35983 - DNA, 21 bp, Artificial Sequence
  Description of Artificial Sequence: Synthetic oligonucleotide
gacccccacaacaccagcaga

SEQ ID NO: 35984 - DNA, 21 bp, Artificial Sequence
  Description of Artificial Sequence: Synthetic oligonucleotide
agggatggtgggcaggatcgg

SEQ ID NO: 35985 - DNA, 21 bp, Artificial Sequence
  Description of Artificial Sequence: Synthetic oligonucleotide
tcttttgattcgaagccgcct

SEQ ID NO: 35986 - DNA, 21 bp, Artificial Sequence
  Description of Artificial Sequence: Synthetic oligonucleotide
tctaatgcgactaggtctagt

SEQ ID NO: 35987 - DNA, 21 bp, Artificial Sequence
  Description of Artificial Sequence: Synthetic oligonucleotide
cctcagaatctggctcatgtt

SEQ ID NO: 35988 - DNA, 21 bp, Artificial Sequence
  Description of Artificial Sequence: Synthetic oligonucleotide
aatacgggtagtggtagtcgg

SEQ ID NO: 35989 - DNA, 21 bp, Artificial Sequence
  Description of Artificial Sequence: Synthetic oligonucleotide
atgaattcggggccgaaggtt

SEQ ID NO: 35990 - DNA, 21 bp, Artificial Sequence
  Description of Artificial Sequence: Synthetic oligonucleotide
cagagtgggccgggggttact

SEQ ID NO: 35991 - DNA, 21 bp, Artificial Sequence
  Description of Artificial Sequence: Synthetic oligonucleotide
aagcagggtgggcctactggg

SEQ ID NO: 35992 - DNA, 21 bp, Artificial Sequence
  Description of Artificial Sequence: Synthetic oligonucleotide
acggggtctgggagtaatcat

SEQ ID NO: 35993 - DNA, 21 bp, Artificial Sequence
  Description of Artificial Sequence: Synthetic oligonucleotide
cccgccaaccacaaaaccatg

SEQ ID NO: 35994 - DNA, 21 bp, Artificial Sequence
  Description of Artificial Sequence: Synthetic oligonucleotide
gctcctagtgctggtaattct

SEQ ID NO: 35995 - DNA, 21 bp, Artificial Sequence
  Description of Artificial Sequence: Synthetic oligonucleotide
ctttcgcttaataagtctcag

SEQ ID NO: 35996 - DNA, 21 bp, Artificial Sequence
  Description of Artificial Sequence: Synthetic oligonucleotide
cctggtgctagtggtaaggtt

SEQ ID NO: 35997 - DNA, 21 bp, Artificial Sequence
  Description of Artificial Sequence: Synthetic oligonucleotide
ctcagaagcgcccccagcatc

SEQ ID NO: 35998 - DNA, 21 bp, Artificial Sequence
  Description of Artificial Sequence: Synthetic oligonucleotide
tcgatggcttcggcgtataag

SEQ ID NO: 35999 - DNA, 21 bp, Artificial Sequence
  Description of Artificial Sequence: Synthetic oligonucleotide
ccctacgccggcaccagcccc

SEQ ID NO: 36000 - DNA, 21 bp, Artificial Sequence
  Description of Artificial Sequence: Synthetic oligonucleotide
gtcaacaaaatcaacggcagc

SEQ ID NO: 36001 - DNA, 21 bp, Artificial Sequence
  Description of Artificial Sequence: Synthetic oligonucleotide
ctccccaccgtcaccagaagc

SEQ ID NO: 36002 - DNA, 21 bp, Artificial Sequence
  Description of Artificial Sequence: Synthetic oligonucleotide
aatcctggttcgggttatggt

SEQ ID NO: 36003 - DNA, 21 bp, Artificial Sequence
  Description of Artificial Sequence: Synthetic oligonucleotide
caacccaacagcggcaccacc

SEQ ID NO: 36004 - DNA, 21 bp, Artificial Sequence
  Description of Artificial Sequence: Synthetic oligonucleotide
ctcggcaacgcccaccaactc

SEQ ID NO: 36005 - DNA, 21 bp, Artificial Sequence
  Description of Artificial Sequence: Synthetic oligonucleotide
agaacccaaagcctcaccgcc

SEQ ID NO: 36006 - DNA, 21 bp, Artificial Sequence
  Description of Artificial Sequence: Synthetic oligonucleotide
tctggtgctcctggttcttcg

SEQ ID NO: 36007 - DNA, 21 bp, Artificial Sequence
  Description of Artificial Sequence: Synthetic oligonucleotide
aatcttacttcttcgagttct

SEQ ID NO: 36008 - DNA, 21 bp, Artificial Sequence
  Description of Artificial Sequence: Synthetic oligonucleotide
cctttttctcattcggttgct

SEQ ID NO: 36009 - DNA, 21 bp, Artificial Sequence
  Description of Artificial Sequence: Synthetic oligonucleotide
ttgctgaagaatgatgcttct

SEQ ID NO: 36010 - DNA, 21 bp, Artificial Sequence
  Description of Artificial Sequence: Synthetic oligonucleotide
gtcagagaaagcagaagcagc

SEQ ID NO: 36011 - DNA, 21 bp, Artificial Sequence
  Description of Artificial Sequence: Synthetic oligonucleotide
agggagccgatgaagggtagt

SEQ ID NO: 36012 - DNA, 21 bp, Artificial Sequence
  Description of Artificial Sequence: Synthetic oligonucleotide
gtccaacaaagcaaagcctac

SEQ ID NO: 36013 - DNA, 21 bp, Artificial Sequence
  Description of Artificial Sequence: Synthetic oligonucleotide
aaaagcgccgaccaaggcaga

SEQ ID NO: 36014 - DNA, 21 bp, Artificial Sequence
  Description of Artificial Sequence: Synthetic oligonucleotide
ggtacggggactcctaggact

SEQ ID NO: 36015 - DNA, 21 bp, Artificial Sequence
  Description of Artificial Sequence: Synthetic oligonucleotide
caaaacacccccaaaagcacc

SEQ ID NO: 36016 - DNA, 21 bp, Artificial Sequence
  Description of Artificial Sequence: Synthetic oligonucleotide
tcgagggattctagtattcat

SEQ ID NO: 36017 - DNA, 21 bp, Artificial Sequence
  Description of Artificial Sequence: Synthetic oligonucleotide
cacaccgccaacagccaaagc

SEQ ID NO: 36018 - DNA, 21 bp, Artificial Sequence
  Description of Artificial Sequence: Synthetic oligonucleotide
acccaacaacacggcagcaac

SEQ ID NO: 36019 - DNA, 21 bp, Artificial Sequence
  Description of Artificial Sequence: Synthetic oligonucleotide
agcaccagcaaagactacacc

SEQ ID NO: 36020 - DNA, 21 bp, Artificial Sequence
  Description of Artificial Sequence: Synthetic oligonucleotide
cttcctggggttcgtgttgcg

SEQ ID NO: 36021 - DNA, 21 bp, Artificial Sequence
  Description of Artificial Sequence: Synthetic oligonucleotide
tctttgcctggggagtctaag

SEQ ID NO: 36022 - DNA, 21 bp, Artificial Sequence
  Description of Artificial Sequence: Synthetic oligonucleotide
catacgtctccggggaagaat

SEQ ID NO: 36023 - DNA, 21 bp, Artificial Sequence
  Description of Artificial Sequence: Synthetic oligonucleotide
cccgtcgtcggcaaaatgagc

SEQ ID NO: 36024 - DNA, 21 bp, Artificial Sequence
  Description of Artificial Sequence: Synthetic oligonucleotide
cccagcctcgaaagaggcagc

SEQ ID NO: 36025 - DNA, 21 bp, Artificial Sequence
  Description of Artificial Sequence: Synthetic oligonucleotide
tatattaatagtccttcgaat

SEQ ID NO: 36026 - DNA, 21 bp, Artificial Sequence
  Description of Artificial Sequence: Synthetic oligonucleotide
tcgtctcaggcgcagccgact

SEQ ID NO: 36027 - DNA, 21 bp, Artificial Sequence
  Description of Artificial Sequence: Synthetic oligonucleotide
gaccccgtcagaaaaaccagc

SEQ ID NO: 36028 - DNA, 21 bp, Artificial Sequence
  Description of Artificial Sequence: Synthetic oligonucleotide
aattctcataatggtgcttct

SEQ ID NO: 36029 - DNA, 21 bp, Artificial Sequence
  Description of Artificial Sequence: Synthetic oligonucleotide
cctgggcctgaggttggtcgg

SEQ ID NO: 36030 - DNA, 21 bp, Artificial Sequence
  Description of Artificial Sequence: Synthetic oligonucleotide
ctccccatcaccgccagaaac

SEQ ID NO: 36031 - DNA, 21 bp, Artificial Sequence
  Description of Artificial Sequence: Synthetic oligonucleotide
gtcgccagccaacccgtcaga

SEQ ID NO: 36032 - DNA, 21 bp, Artificial Sequence
  Description of Artificial Sequence: Synthetic oligonucleotide
aatctgagtagttcgggtggt

SEQ ID NO: 36033 - DNA, 21 bp, Artificial Sequence
  Description of Artificial Sequence: Synthetic oligonucleotide
gagcggaatgggaattttacg

SEQ ID NO: 36034 - DNA, 21 bp, Artificial Sequence
  Description of Artificial Sequence: Synthetic oligonucleotide
cccggcagcagcaacagaaac

SEQ ID NO: 36035 - DNA, 21 bp, Artificial Sequence
  Description of Artificial Sequence: Synthetic oligonucleotide
aaaagaatggacaaaagcagc

SEQ ID NO: 36036 - DNA, 21 bp, Artificial Sequence
  Description of Artificial Sequence: Synthetic oligonucleotide
gtgaagtgtagtggttgtagt

SEQ ID NO: 36037 - DNA, 21 bp, Artificial Sequence
  Description of Artificial Sequence: Synthetic oligonucleotide
tgtgttctgccttcggggaat

SEQ ID NO: 36038 - DNA, 21 bp, Artificial Sequence
  Description of Artificial Sequence: Synthetic oligonucleotide
ttcaccagcaacaaagccagc

SEQ ID NO: 36039 - DNA, 21 bp, Artificial Sequence
  Description of Artificial Sequence: Synthetic oligonucleotide
ttgagttcggataagaatgtt

SEQ ID NO: 36040 - DNA, 21 bp, Artificial Sequence
  Description of Artificial Sequence: Synthetic oligonucleotide
agcagcagcacccacgccgtc

SEQ ID NO: 36041 - DNA, 21 bp, Artificial Sequence
  Description of Artificial Sequence: Synthetic oligonucleotide
actaatccgaagtcgtcttct

SEQ ID NO: 36042 - DNA, 21 bp, Artificial Sequence
  Description of Artificial Sequence: Synthetic oligonucleotide
agcagcgaacaaaccaccaga

SEQ ID NO: 36043 - DNA, 21 bp, Artificial Sequence
  Description of Artificial Sequence: Synthetic oligonucleotide
gaacccctccaaggcagcaga

SEQ ID NO: 36044 - DNA, 21 bp, Artificial Sequence
  Description of Artificial Sequence: Synthetic oligonucleotide
agtaagactgggactagtttg

SEQ ID NO: 36045 - DNA, 21 bp, Artificial Sequence
  Description of Artificial Sequence: Synthetic oligonucleotide
agggtggtgaatcggggggat

SEQ ID NO: 36046 - DNA, 21 bp, Artificial Sequence
  Description of Artificial Sequence: Synthetic oligonucleotide
cctatgtcgggtactcgtctg

SEQ ID NO: 36047 - DNA, 21 bp, Artificial Sequence
  Description of Artificial Sequence: Synthetic oligonucleotide
acgtcgaatactaagcagggt

SEQ ID NO: 36048 - DNA, 21 bp, Artificial Sequence
  Description of Artificial Sequence: Synthetic oligonucleotide
ggccccaaccaaagcggcaga

SEQ ID NO: 36049 - DNA, 21 bp, Artificial Sequence
  Description of Artificial Sequence: Synthetic oligonucleotide
accaaccccaacccccacaga

SEQ ID NO: 36050 - DNA, 21 bp, Artificial Sequence
  Description of Artificial Sequence: Synthetic oligonucleotide
cccggcagagaaaaaaccgtc

SEQ ID NO: 36051 - DNA, 21 bp, Artificial Sequence
  Description of Artificial Sequence: Synthetic oligonucleotide
ttcgccaacaccgccaacaga

SEQ ID NO: 36052 - DNA, 21 bp, Artificial Sequence
  Description of Artificial Sequence: Synthetic oligonucleotide
actgttctgggtgctaggggg

SEQ ID NO: 36053 - DNA, 21 bp, Artificial Sequence
  Description of Artificial Sequence: Synthetic oligonucleotide
aacgtcaccacccccctcatc

SEQ ID NO: 36054 - DNA, 21 bp, Artificial Sequence
  Description of Artificial Sequence: Synthetic oligonucleotide
tatagggcttctggtatttcg

SEQ ID NO: 36055 - DNA, 21 bp, Artificial Sequence
  Description of Artificial Sequence: Synthetic oligonucleotide
ggtagtaataggaatcctctt

SEQ ID NO: 36056 - DNA, 21 bp, Artificial Sequence
  Description of Artificial Sequence: Synthetic oligonucleotide
agtcggggtcagcctcctttg

SEQ ID NO: 36057 - DNA, 21 bp, Artificial Sequence
  Description of Artificial Sequence: Synthetic oligonucleotide
ggggtgactggtactcatgtg

SEQ ID NO: 36058 - DNA, 21 bp, Artificial Sequence
  Description of Artificial Sequence: Synthetic oligonucleotide
aatcttaagacgaagggggag

SEQ ID NO: 36059 - DNA, 21 bp, Artificial Sequence
  Description of Artificial Sequence: Synthetic oligonucleotide
agaagccccggcagcaacacc

SEQ ID NO: 36060 - DNA, 21 bp, Artificial Sequence
  Description of Artificial Sequence: Synthetic oligonucleotide
tggggtacgggtattggttct

SEQ ID NO: 36061 - DNA, 21 bp, Artificial Sequence
  Description of Artificial Sequence: Synthetic oligonucleotide
gggtctatttcgacggctcat

SEQ ID NO: 36062 - DNA, 21 bp, Artificial Sequence
  Description of Artificial Sequence: Synthetic oligonucleotide
cttcctggtcagggtgttggt

SEQ ID NO: 36063 - DNA, 21 bp, Artificial Sequence
  Description of Artificial Sequence: Synthetic oligonucleotide
aatagtgggaagccgaatgcg

SEQ ID NO: 36064 - DNA, 21 bp, Artificial Sequence
  Description of Artificial Sequence: Synthetic oligonucleotide
ttcgccagcagacccgtccaa

SEQ ID NO: 36065 - DNA, 21 bp, Artificial Sequence
  Description of Artificial Sequence: Synthetic oligonucleotide
ggccaagtcaaagccatcggc

SEQ ID NO: 36066 - DNA, 21 bp, Artificial Sequence
  Description of Artificial Sequence: Synthetic oligonucleotide
cagtcgagtcgtacggttact

SEQ ID NO: 36067 - DNA, 21 bp, Artificial Sequence
  Description of Artificial Sequence: Synthetic oligonucleotide
acttcgtctcctcagccgtcg

SEQ ID NO: 36068 - DNA, 21 bp, Artificial Sequence
  Description of Artificial Sequence: Synthetic oligonucleotide
ttgggggctagtactattttg

SEQ ID NO: 36069 - DNA, 21 bp, Artificial Sequence
  Description of Artificial Sequence: Synthetic oligonucleotide
aacgaccaagccaaactcacc

SEQ ID NO: 36070 - DNA, 21 bp, Artificial Sequence
  Description of Artificial Sequence: Synthetic oligonucleotide
actcggagtaaggagagtcct

SEQ ID NO: 36071 - DNA, 21 bp, Artificial Sequence
  Description of Artificial Sequence: Synthetic oligonucleotide
caggggtctgggagtaatcat

SEQ ID NO: 36072 - DNA, 21 bp, Artificial Sequence
  Description of Artificial Sequence: Synthetic oligonucleotide
aatagtgcgaataagactccg

SEQ ID NO: 36073 - DNA, 21 bp, Artificial Sequence
  Description of Artificial Sequence: Synthetic oligonucleotide
gccacccacaacagcagccaa

SEQ ID NO: 36074 - DNA, 21 bp, Artificial Sequence
  Description of Artificial Sequence: Synthetic oligonucleotide
tttccggttaatgggctgagt

SEQ ID NO: 36075 - DNA, 21 bp, Artificial Sequence
  Description of Artificial Sequence: Synthetic oligonucleotide
tctgtggggtctggtgctttg

SEQ ID NO: 36076 - DNA, 21 bp, Artificial Sequence
  Description of Artificial Sequence: Synthetic oligonucleotide
cagggtagttcgttgcgtact

SEQ ID NO: 36077 - DNA, 21 bp, Artificial Sequence
  Description of Artificial Sequence: Synthetic oligonucleotide
agcagagtcgaccaatacaaa

SEQ ID NO: 36078 - DNA, 21 bp, Artificial Sequence
  Description of Artificial Sequence: Synthetic oligonucleotide
cctttggctgcgggtggtacg

SEQ ID NO: 36079 - DNA, 21 bp, Artificial Sequence
  Description of Artificial Sequence: Synthetic oligonucleotide
attaagcagtcttcttcggct

SEQ ID NO: 36080 - DNA, 21 bp, Artificial Sequence
  Description of Artificial Sequence: Synthetic oligonucleotide
acccccagcatgagaaacacc

SEQ ID NO: 36081 - DNA, 21 bp, Artificial Sequence
  Description of Artificial Sequence: Synthetic oligonucleotide
accagaatgaacaaacaaacc

SEQ ID NO: 36082 - DNA, 21 bp, Artificial Sequence
  Description of Artificial Sequence: Synthetic oligonucleotide
gacttcagcgaaaaaagactc

SEQ ID NO: 36083 - DNA, 21 bp, Artificial Sequence
  Description of Artificial Sequence: Synthetic oligonucleotide
tcggcttatgagaggacttcg

SEQ ID NO: 36084 - DNA, 21 bp, Artificial Sequence
  Description of Artificial Sequence: Synthetic oligonucleotide
tctacttcgggtacgagtagt

SEQ ID NO: 36085 - DNA, 21 bp, Artificial Sequence
  Description of Artificial Sequence: Synthetic oligonucleotide
ggtactacttctagtcgggat

SEQ ID NO: 36086 - DNA, 21 bp, Artificial Sequence
  Description of Artificial Sequence: Synthetic oligonucleotide
cagtcgacgccgcgtatgggt

SEQ ID NO: 36087 - DNA, 21 bp, Artificial Sequence
  Description of Artificial Sequence: Synthetic oligonucleotide
gggcaggtgaaggctcttggg

SEQ ID NO: 36088 - DNA, 21 bp, Artificial Sequence
  Description of Artificial Sequence: Synthetic oligonucleotide
gttggtactaaggctgctacg

SEQ ID NO: 36089 - DNA, 21 bp, Artificial Sequence
  Description of Artificial Sequence: Synthetic oligonucleotide
tcggatatgtctggtcagcgt

SEQ ID NO: 36090 - DNA, 21 bp, Artificial Sequence
  Description of Artificial Sequence: Synthetic oligonucleotide
cctatttcgcatacgactggt

SEQ ID NO: 36091 - DNA, 21 bp, Artificial Sequence
  Description of Artificial Sequence: Synthetic oligonucleotide
ggcagcagccccagcctcaga

SEQ ID NO: 36092 - DNA, 21 bp, Artificial Sequence
  Description of Artificial Sequence: Synthetic oligonucleotide
ttgtcttcgaatcggcataat

SEQ ID NO: 36093 - DNA, 21 bp, Artificial Sequence
  Description of Artificial Sequence: Synthetic oligonucleotide
catacgcatgatgtgggtaag

SEQ ID NO: 36094 - DNA, 21 bp, Artificial Sequence
  Description of Artificial Sequence: Synthetic oligonucleotide
ggcctcaaaaacgaacccgcc

SEQ ID NO: 36095 - DNA, 21 bp, Artificial Sequence
  Description of Artificial Sequence: Synthetic oligonucleotide
tctcggattggtatgagtacg

SEQ ID NO: 36096 - DNA, 21 bp, Artificial Sequence
  Description of Artificial Sequence: Synthetic oligonucleotide
actgctaattcgcctgcgacg

SEQ ID NO: 36097 - DNA, 21 bp, Artificial Sequence
  Description of Artificial Sequence: Synthetic oligonucleotide
agcgtcgaaaaagcccaaagc

SEQ ID NO: 36098 - DNA, 21 bp, Artificial Sequence
  Description of Artificial Sequence: Synthetic oligonucleotide
gtcagcggcatgagcggcagc

SEQ ID NO: 36099 - DNA, 21 bp, Artificial Sequence
  Description of Artificial Sequence: Synthetic oligonucleotide
catacttcgagtaattctctt

SEQ ID NO: 36100 - DNA, 21 bp, Artificial Sequence
  Description of Artificial Sequence: Synthetic oligonucleotide
gggtctccgaatcatagtagt

SEQ ID NO: 36101 - DNA, 21 bp, Artificial Sequence
  Description of Artificial Sequence: Synthetic oligonucleotide
ggccaagccatgcccttcaaa

SEQ ID NO: 36102 - DNA, 21 bp, Artificial Sequence
  Description of Artificial Sequence: Synthetic oligonucleotide
cgtatgaagagtctggataat

SEQ ID NO: 36103 - DNA, 21 bp, Artificial Sequence
  Description of Artificial Sequence: Synthetic oligonucleotide
tacagaagcgccgccaacagc

SEQ ID NO: 36104 - DNA, 21 bp, Artificial Sequence
  Description of Artificial Sequence: Synthetic oligonucleotide
cttgggacgtctcatcagcag

SEQ ID NO: 36105 - DNA, 21 bp, Artificial Sequence
  Description of Artificial Sequence: Synthetic oligonucleotide
aatatttcgactaggcagagt

SEQ ID NO: 36106 - DNA, 21 bp, Artificial Sequence
  Description of Artificial Sequence: Synthetic oligonucleotide
cccggcatcaacaccaacagc

SEQ ID NO: 36107 - DNA, 21 bp, Artificial Sequence
  Description of Artificial Sequence: Synthetic oligonucleotide
atggagattaagcctaatcgg

SEQ ID NO: 36108 - DNA, 21 bp, Artificial Sequence
  Description of Artificial Sequence: Synthetic oligonucleotide
cttccgcaggatagggttggt

SEQ ID NO: 36109 - DNA, 21 bp, Artificial Sequence
  Description of Artificial Sequence: Synthetic oligonucleotide
gaaggcctcaacaccagcaga

SEQ ID NO: 36110 - DNA, 21 bp, Artificial Sequence
  Description of Artificial Sequence: Synthetic oligonucleotide
ttccacgtcggcgccagcagc

SEQ ID NO: 36111 - DNA, 21 bp, Artificial Sequence
  Description of Artificial Sequence: Synthetic oligonucleotide
ggccccagcagccccagactc

SEQ ID NO: 36112 - DNA, 21 bp, Artificial Sequence
  Description of Artificial Sequence: Synthetic oligonucleotide
gacagcacccacagagccacc

SEQ ID NO: 36113 - DNA, 21 bp, Artificial Sequence
  Description of Artificial Sequence: Synthetic oligonucleotide
cctccgactgattcgggtctg

SEQ ID NO: 36114 - DNA, 21 bp, Artificial Sequence
  Description of Artificial Sequence: Synthetic oligonucleotide
accgccaccaccctcagcagc

SEQ ID NO: 36115 - DNA, 21 bp, Artificial Sequence
  Description of Artificial Sequence: Synthetic oligonucleotide
ctcaaaagcgtcagcggccaa

SEQ ID NO: 36116 - DNA, 21 bp, Artificial Sequence
  Description of Artificial Sequence: Synthetic oligonucleotide
cccctccaaaccagcagaacc

SEQ ID NO: 36117 - DNA, 21 bp, Artificial Sequence
  Description of Artificial Sequence: Synthetic oligonucleotide
gccaccggcaacggcagaggc

SEQ ID NO: 36118 - DNA, 21 bp, Artificial Sequence
  Description of Artificial Sequence: Synthetic oligonucleotide
gatttgcatgtgcagaaggct

SEQ ID NO: 36119 - DNA, 21 bp, Artificial Sequence
  Description of Artificial Sequence: Synthetic oligonucleotide
cccggcaccaaacaaagcagc

SEQ ID NO: 36120 - DNA, 21 bp, Artificial Sequence
  Description of Artificial Sequence: Synthetic oligonucleotide
gcttcgagggatagggctggt

SEQ ID NO: 36121 - DNA, 21 bp, Artificial Sequence
  Description of Artificial Sequence: Synthetic oligonucleotide
tttaatagttcgtcttcgaag

SEQ ID NO: 36122 - DNA, 21 bp, Artificial Sequence
  Description of Artificial Sequence: Synthetic oligonucleotide
tcttcgtcggcgaagtctatt

SEQ ID NO: 36123 - DNA, 21 bp, Artificial Sequence
  Description of Artificial Sequence: Synthetic oligonucleotide
ggcagagcccaactcgccagc

SEQ ID NO: 36124 - DNA, 21 bp, Artificial Sequence
  Description of Artificial Sequence: Synthetic oligonucleotide
tttgtgaatactagtgcgcag

SEQ ID NO: 36125 - DNA, 21 bp, Artificial Sequence
  Description of Artificial Sequence: Synthetic oligonucleotide
agaaaccaaggcgccctccaa

SEQ ID NO: 36126 - DNA, 21 bp, Artificial Sequence
  Description of Artificial Sequence: Synthetic oligonucleotide
gacctcccccaccacaccaga

SEQ ID NO: 36127 - DNA, 21 bp, Artificial Sequence
  Description of Artificial Sequence: Synthetic oligonucleotide
tacctcaaaaccggcgacaac

SEQ ID NO: 36128 - DNA, 21 bp, Artificial Sequence
  Description of Artificial Sequence: Synthetic oligonucleotide
agacccagcagcacccacgcc

SEQ ID NO: 36129 - DNA, 21 bp, Artificial Sequence
  Description of Artificial Sequence: Synthetic oligonucleotide
atcctcggcaacaaaagcagc

SEQ ID NO: 36130 - DNA, 21 bp, Artificial Sequence
  Description of Artificial Sequence: Synthetic oligonucleotide
ggcctcgccggcagactcagc

SEQ ID NO: 36131 - DNA, 21 bp, Artificial Sequence
  Description of Artificial Sequence: Synthetic oligonucleotide
accaacggcggcagagtcacc

SEQ ID NO: 36132 - DNA, 21 bp, Artificial Sequence
  Description of Artificial Sequence: Synthetic oligonucleotide
accggcatgagcaacaacaga

SEQ ID NO: 36133 - DNA, 21 bp, Artificial Sequence
  Description of Artificial Sequence: Synthetic oligonucleotide
cctaagttgtcgcatacgggg

SEQ ID NO: 36134 - DNA, 21 bp, Artificial Sequence
  Description of Artificial Sequence: Synthetic oligonucleotide
agcatcggcaaaggctacaac

SEQ ID NO: 36135 - DNA, 21 bp, Artificial Sequence
  Description of Artificial Sequence: Synthetic oligonucleotide
accaccatgagcaaacccagc

SEQ ID NO: 36136 - DNA, 21 bp, Artificial Sequence
  Description of Artificial Sequence: Synthetic oligonucleotide
accgaaagaaccaaagccacc

SEQ ID NO: 36137 - DNA, 21 bp, Artificial Sequence
  Description of Artificial Sequence: Synthetic oligonucleotide
gttagttcgaatgctagtatg

SEQ ID NO: 36138 - DNA, 21 bp, Artificial Sequence
  Description of Artificial Sequence: Synthetic oligonucleotide
cccaacctccaaagcagcaaa

SEQ ID NO: 36139 - DNA, 21 bp, Artificial Sequence
  Description of Artificial Sequence: Synthetic oligonucleotide
agccccggcaacgtcagaaaa

SEQ ID NO: 36140 - DNA, 21 bp, Artificial Sequence
  Description of Artificial Sequence: Synthetic oligonucleotide
caaggcagcagcaaaaccacc

SEQ ID NO: 36141 - DNA, 21 bp, Artificial Sequence
  Description of Artificial Sequence: Synthetic oligonucleotide
aatgcggttcgttctgagaat

SEQ ID NO: 36142 - DNA, 21 bp, Artificial Sequence
  Description of Artificial Sequence: Synthetic oligonucleotide
actgaggctcggtcggcgaat

SEQ ID NO: 36143 - DNA, 21 bp, Artificial Sequence
  Description of Artificial Sequence: Synthetic oligonucleotide
ctcaccacccacggcatgaaa

SEQ ID NO: 36144 - DNA, 21 bp, Artificial Sequence
  Description of Artificial Sequence: Synthetic oligonucleotide
cgtcagaatggtggtgtgaag

SEQ ID NO: 36145 - DNA, 21 bp, Artificial Sequence
  Description of Artificial Sequence: Synthetic oligonucleotide
agagtcagcgacagacacatc

SEQ ID NO: 36146 - DNA, 21 bp, Artificial Sequence
  Description of Artificial Sequence: Synthetic oligonucleotide
gaaggcagcagcggcagaaga

SEQ ID NO: 36147 - DNA, 21 bp, Artificial Sequence
  Description of Artificial Sequence: Synthetic oligonucleotide
cggggggatactaagaatttg

SEQ ID NO: 36148 - DNA, 21 bp, Artificial Sequence
  Description of Artificial Sequence: Synthetic oligonucleotide
aatattaattcgcgtttggcg

SEQ ID NO: 36149 - DNA, 21 bp, Artificial Sequence
  Description of Artificial Sequence: Synthetic oligonucleotide
acgtctaggggtaatttgtct

SEQ ID NO: 36150 - DNA, 21 bp, Artificial Sequence
  Description of Artificial Sequence: Synthetic oligonucleotide
aacggcagcgccagaatgacc

SEQ ID NO: 36151 - DNA, 21 bp, Artificial Sequence
  Description of Artificial Sequence: Synthetic oligonucleotide
gggagttctcctaagcttact

SEQ ID NO: 36152 - DNA, 21 bp, Artificial Sequence
  Description of Artificial Sequence: Synthetic oligonucleotide
tatcagaataagtctctgacg

SEQ ID NO: 36153 - DNA, 21 bp, Artificial Sequence
  Description of Artificial Sequence: Synthetic oligonucleotide
agccccctcctcgactacaaa

SEQ ID NO: 36154 - DNA, 21 bp, Artificial Sequence
  Description of Artificial Sequence: Synthetic oligonucleotide
cccagcaacaccggcaccatc

SEQ ID NO: 36155 - DNA, 21 bp, Artificial Sequence
  Description of Artificial Sequence: Synthetic oligonucleotide
tctgctacgaagagtagttgt

SEQ ID NO: 36156 - DNA, 21 bp, Artificial Sequence
  Description of Artificial Sequence: Synthetic oligonucleotide
cagaatctgaattctttttcg

SEQ ID NO: 36157 - DNA, 21 bp, Artificial Sequence
  Description of Artificial Sequence: Synthetic oligonucleotide
ggcagcgccagcatcgaaaaa

SEQ ID NO: 36158 - DNA, 21 bp, Artificial Sequence
  Description of Artificial Sequence: Synthetic oligonucleotide
tatcgtccggtgtcggtgcag

SEQ ID NO: 36159 - DNA, 21 bp, Artificial Sequence
  Description of Artificial Sequence: Synthetic oligonucleotide
ttcagaaccaccgccagcacc

SEQ ID NO: 36160 - DNA, 21 bp, Artificial Sequence
  Description of Artificial Sequence: Synthetic oligonucleotide
aataatgctgctactcattcg

SEQ ID NO: 36161 - DNA, 21 bp, Artificial Sequence
  Description of Artificial Sequence: Synthetic oligonucleotide
actcagcggtcgcaggctgct

SEQ ID NO: 36162 - DNA, 21 bp, Artificial Sequence
  Description of Artificial Sequence: Synthetic oligonucleotide
cccggcagcgccatgctcaac

SEQ ID NO: 36163 - DNA, 21 bp, Artificial Sequence
  Description of Artificial Sequence: Synthetic oligonucleotide
ccttataagggtaatgggctt

SEQ ID NO: 36164 - DNA, 21 bp, Artificial Sequence
  Description of Artificial Sequence: Synthetic oligonucleotide
attagttctggtacgcatggg

SEQ ID NO: 36165 - DNA, 21 bp, Artificial Sequence
  Description of Artificial Sequence: Synthetic oligonucleotide
caaaacctccccaaagccagc

SEQ ID NO: 36166 - DNA, 21 bp, Artificial Sequence
  Description of Artificial Sequence: Synthetic oligonucleotide
aatccttcgcatacttctgtg

SEQ ID NO: 36167 - DNA, 21 bp, Artificial Sequence
  Description of Artificial Sequence: Synthetic oligonucleotide
tatcagatgacgactcctcag

SEQ ID NO: 36168 - DNA, 21 bp, Artificial Sequence
  Description of Artificial Sequence: Synthetic oligonucleotide
gacagcagcaccagaggccaa

SEQ ID NO: 36169 - DNA, 21 bp, Artificial Sequence
  Description of Artificial Sequence: Synthetic oligonucleotide
cagggtcatagttcgtttctg

SEQ ID NO: 36170 - DNA, 21 bp, Artificial Sequence
  Description of Artificial Sequence: Synthetic oligonucleotide
accagcagcggcaacctcagc

SEQ ID NO: 36171 - DNA, 21 bp, Artificial Sequence
  Description of Artificial Sequence: Synthetic oligonucleotide
agcctcaccagcaccggcaaa

SEQ ID NO: 36172 - DNA, 21 bp, Artificial Sequence
  Description of Artificial Sequence: Synthetic oligonucleotide
ggcaccgacagcaaaagacac

SEQ ID NO: 36173 - DNA, 21 bp, Artificial Sequence
  Description of Artificial Sequence: Synthetic oligonucleotide
gagggtaatcgttctaatatg

SEQ ID NO: 36174 - DNA, 21 bp, Artificial Sequence
  Description of Artificial Sequence: Synthetic oligonucleotide
tacaacagaaccagcatcgtc

SEQ ID NO: 36175 - DNA, 21 bp, Artificial Sequence
  Description of Artificial Sequence: Synthetic oligonucleotide
tcgttgaatgcgccgaatagg

SEQ ID NO: 36176 - DNA, 21 bp, Artificial Sequence
  Description of Artificial Sequence: Synthetic oligonucleotide
gtgctttcgtcttcgcctaag

SEQ ID NO: 36177 - DNA, 21 bp, Artificial Sequence
  Description of Artificial Sequence: Synthetic oligonucleotide
ccggggcagaagcagggtatt

SEQ ID NO: 36178 - DNA, 21 bp, Artificial Sequence
  Description of Artificial Sequence: Synthetic oligonucleotide
gaaaccagaaaacaaggcgtc

SEQ ID NO: 36179 - DNA, 21 bp, Artificial Sequence
  Description of Artificial Sequence: Synthetic oligonucleotide
accccccaaaacgtcagaaac

SEQ ID NO: 36180 - DNA, 21 bp, Artificial Sequence
  Description of Artificial Sequence: Synthetic oligonucleotide
caggatgctactcctcgtagt

SEQ ID NO: 36181 - DNA, 21 bp, Artificial Sequence
  Description of Artificial Sequence: Synthetic oligonucleotide
agccccaacgccaacagcgtc

SEQ ID NO: 36182 - DNA, 21 bp, Artificial Sequence
  Description of Artificial Sequence: Synthetic oligonucleotide
caagacatgagactcagcggc

SEQ ID NO: 36183 - DNA, 21 bp, Artificial Sequence
  Description of Artificial Sequence: Synthetic oligonucleotide
aatcgtgttaagccgatggtg

SEQ ID NO: 36184 - DNA, 21 bp, Artificial Sequence
  Description of Artificial Sequence: Synthetic oligonucleotide
cctggtgagagtggtaaggtt

SEQ ID NO: 36185 - DNA, 21 bp, Artificial Sequence
  Description of Artificial Sequence: Synthetic oligonucleotide
tatcggaatgtgaatgcgatg

SEQ ID NO: 36186 - DNA, 21 bp, Artificial Sequence
  Description of Artificial Sequence: Synthetic oligonucleotide
ttccccagcgtcagcaccacc

SEQ ID NO: 36187 - DNA, 21 bp, Artificial Sequence
  Description of Artificial Sequence: Synthetic oligonucleotide
agcaccgtcgccaccagcttc

SEQ ID NO: 36188 - DNA, 21 bp, Artificial Sequence
  Description of Artificial Sequence: Synthetic oligonucleotide
cctagtgctaggatgtctggt

SEQ ID NO: 36189 - DNA, 21 bp, Artificial Sequence
  Description of Artificial Sequence: Synthetic oligonucleotide
catcttagggggtctaatact

SEQ ID NO: 36190 - DNA, 21 bp, Artificial Sequence
  Description of Artificial Sequence: Synthetic oligonucleotide
gtgggggcggcgactattcgt

SEQ ID NO: 36191 - DNA, 21 bp, Artificial Sequence
  Description of Artificial Sequence: Synthetic oligonucleotide
gggtcgagggataagtcgact

SEQ ID NO: 36192 - DNA, 21 bp, Artificial Sequence
  Description of Artificial Sequence: Synthetic oligonucleotide
agactcgtccccgccagcggc

SEQ ID NO: 36193 - DNA, 21 bp, Artificial Sequence
  Description of Artificial Sequence: Synthetic oligonucleotide
atcagccaaagcaccaccaga

SEQ ID NO: 36194 - DNA, 21 bp, Artificial Sequence
  Description of Artificial Sequence: Synthetic oligonucleotide
agtagttcggcgcctcgtctt

SEQ ID NO: 36195 - DNA, 21 bp, Artificial Sequence
  Description of Artificial Sequence: Synthetic oligonucleotide
tggatgtctggtaagaatagt

SEQ ID NO: 36196 - DNA, 21 bp, Artificial Sequence
  Description of Artificial Sequence: Synthetic oligonucleotide
cagcatactacgactaatcag

SEQ ID NO: 36197 - DNA, 21 bp, Artificial Sequence
  Description of Artificial Sequence: Synthetic oligonucleotide
tatagtggtggtactcagcag

SEQ ID NO: 36198 - DNA, 21 bp, Artificial Sequence
  Description of Artificial Sequence: Synthetic oligonucleotide
cttcttagtgctaaggggggg

SEQ ID NO: 36199 - DNA, 21 bp, Artificial Sequence
  Description of Artificial Sequence: Synthetic oligonucleotide
caagaaggcgtcagaagcagc

SEQ ID NO: 36200 - DNA, 21 bp, Artificial Sequence
  Description of Artificial Sequence: Synthetic oligonucleotide
gctagtagggcgcctcctggg

SEQ ID NO: 36201 - DNA, 21 bp, Artificial Sequence
  Description of Artificial Sequence: Synthetic oligonucleotide
caaagaaccgtcggcaccgcc

SEQ ID NO: 36202 - DNA, 21 bp, Artificial Sequence
  Description of Artificial Sequence: Synthetic oligonucleotide
tcttcgtctacgtcgcctagg

SEQ ID NO: 36203 - DNA, 21 bp, Artificial Sequence
  Description of Artificial Sequence: Synthetic oligonucleotide
caaacccaaggccaactcaaa

SEQ ID NO: 36204 - DNA, 21 bp, Artificial Sequence
  Description of Artificial Sequence: Synthetic oligonucleotide
ggccccaccgaccacaaactc

SEQ ID NO: 36205 - DNA, 21 bp, Artificial Sequence
  Description of Artificial Sequence: Synthetic oligonucleotide
ggtgttaataataatattaat

SEQ ID NO: 36206 - DNA, 21 bp, Artificial Sequence
  Description of Artificial Sequence: Synthetic oligonucleotide
gctgggcgggcgtctaatact

SEQ ID NO: 36207 - DNA, 21 bp, Artificial Sequence
  Description of Artificial Sequence: Synthetic oligonucleotide
agttctgctaagagttcgctt

SEQ ID NO: 36208 - DNA, 21 bp, Artificial Sequence
  Description of Artificial Sequence: Synthetic oligonucleotide
accagcaaaaacgccgccatg

SEQ ID NO: 36209 - DNA, 21 bp, Artificial Sequence
  Description of Artificial Sequence: Synthetic oligonucleotide
gccgcccaacccagcctcaaa

SEQ ID NO: 36210 - DNA, 21 bp, Artificial Sequence
  Description of Artificial Sequence: Synthetic oligonucleotide
cacagagaaatcgtcatgaaa

SEQ ID NO: 36211 - DNA, 21 bp, Artificial Sequence
  Description of Artificial Sequence: Synthetic oligonucleotide
aataatactcagaagaattct

SEQ ID NO: 36212 - DNA, 21 bp, Artificial Sequence
  Description of Artificial Sequence: Synthetic oligonucleotide
ggtgcgcgtccggtgcttcag

SEQ ID NO: 36213 - DNA, 21 bp, Artificial Sequence
  Description of Artificial Sequence: Synthetic oligonucleotide
gggggtgataataagcttacg

SEQ ID NO: 36214 - DNA, 21 bp, Artificial Sequence
  Description of Artificial Sequence: Synthetic oligonucleotide
aactgttctggacagaatcaa

SEQ ID NO: 36215 - DNA, 21 bp, Artificial Sequence
  Description of Artificial Sequence: Synthetic oligonucleotide
aatgggagtccgggtttttat

SEQ ID NO: 36216 - DNA, 21 bp, Artificial Sequence
  Description of Artificial Sequence: Synthetic oligonucleotide
agaagacaagacacccaagaa

SEQ ID NO: 36217 - DNA, 21 bp, Artificial Sequence
  Description of Artificial Sequence: Synthetic oligonucleotide
attagtgggcttgatggtaat

SEQ ID NO: 36218 - DNA, 21 bp, Artificial Sequence
  Description of Artificial Sequence: Synthetic oligonucleotide
aataggaatgggtttaataat

SEQ ID NO: 36219 - DNA, 21 bp, Artificial Sequence
  Description of Artificial Sequence: Synthetic oligonucleotide
aacagttctggacagaatcaa

SEQ ID NO: 36220 - DNA, 21 bp, Artificial Sequence
  Description of Artificial Sequence: Synthetic oligonucleotide
aataataattctggtagtggt

SEQ ID NO: 36221 - DNA, 21 bp, Artificial Sequence
  Description of Artificial Sequence: Synthetic oligonucleotide
gggcttagtcctgttcttaag

SEQ ID NO: 36222 - DNA, 21 bp, Artificial Sequence
  Description of Artificial Sequence: Synthetic oligonucleotide
aacggtgctggacagaatcaa

SEQ ID NO: 36223 - DNA, 21 bp, Artificial Sequence
  Description of Artificial Sequence: Synthetic oligonucleotide
aacggttctggacagagtcaa

SEQ ID NO: 36224 - DNA, 21 bp, Artificial Sequence
  Description of Artificial Sequence: Synthetic oligonucleotide
gatttttctgagaagcgtctt

SEQ ID NO: 36225 - DNA, 21 bp, Artificial Sequence
  Description of Artificial Sequence: Synthetic oligonucleotide
ggcaccgacaacaacaccaga

SEQ ID NO: 36226 - DNA, 21 bp, Artificial Sequence
  Description of Artificial Sequence: Synthetic oligonucleotide
gaggttttttcttctcagaag

SEQ ID NO: 36227 - DNA, 21 bp, Artificial Sequence
  Description of Artificial Sequence: Synthetic oligonucleotide
cccagcaacaccggcaccatc

SEQ ID NO: 36228 - DNA, 21 bp, Artificial Sequence
  Description of Artificial Sequence: Synthetic oligonucleotide
atgggcgccggcgccctcacc

SEQ ID NO: 36229 - DNA, 21 bp, Artificial Sequence
  Description of Artificial Sequence: Synthetic oligonucleotide
ttcagaagcaaagaaagcgcc

SEQ ID NO: 36230 - DNA, 21 bp, Artificial Sequence
  Description of Artificial Sequence: Synthetic oligonucleotide
caacaaggcgtcggcaacaac

SEQ ID NO: 36231 - DNA, 21 bp, Artificial Sequence
  Description of Artificial Sequence: Synthetic oligonucleotide
gattctaggaataatatgacg

SEQ ID NO: 36232 - DNA, 21 bp, Artificial Sequence
  Description of Artificial Sequence: Synthetic oligonucleotide
atgagcagaagcgaccccccc

SEQ ID NO: 36233 - DNA, 21 bp, Artificial Sequence
  Description of Artificial Sequence: Synthetic oligonucleotide
caatacgacagcagcagcggc

SEQ ID NO: 36234 - DNA, 21 bp, Artificial Sequence
  Description of Artificial Sequence: Synthetic oligonucleotide
tttaattcttcttctggtagt

SEQ ID NO: 36235 - DNA, 21 bp, Artificial Sequence
  Description of Artificial Sequence: Synthetic oligonucleotide
taccccagcagcgtccaacaa

SEQ ID NO: 36236 - DNA, 21 bp, Artificial Sequence
  Description of Artificial Sequence: Synthetic oligonucleotide
aacgccaccagccccagaaaa

SEQ ID NO: 36237 - DNA, 21 bp, Artificial Sequence
  Description of Artificial Sequence: Synthetic oligonucleotide
aacggcagcggccaaatccaa

SEQ ID NO: 36238 - DNA, 21 bp, Artificial Sequence
  Description of Artificial Sequence: Synthetic oligonucleotide
agacccgaaagcagctacagc

SEQ ID NO: 36239 - DNA, 21 bp, Artificial Sequence
  Description of Artificial Sequence: Synthetic oligonucleotide
aatgcggttcgttctgagaat

SEQ ID NO: 36240 - DNA, 21 bp, Artificial Sequence
  Description of Artificial Sequence: Synthetic oligonucleotide
tctgtggggtctggtgctttg

SEQ ID NO: 36241 - DNA, 21 bp, Artificial Sequence
  Description of Artificial Sequence: Synthetic oligonucleotide
accacccaaaccccctacaaa

SEQ ID NO: 36242 - DNA, 21 bp, Artificial Sequence
  Description of Artificial Sequence: Synthetic oligonucleotide
aacggttgtggacagaatcaa

SEQ ID NO: 36243 - DNA, 21 bp, Artificial Sequence
  Description of Artificial Sequence: Synthetic oligonucleotide
tattcggataataagactact

SEQ ID NO: 36244 - DNA, 21 bp, Artificial Sequence
  Description of Artificial Sequence: Synthetic oligonucleotide
atgaggcaggatacgagtaag

SEQ ID NO: 36245 - DNA, 21 bp, Artificial Sequence
  Description of Artificial Sequence: Synthetic oligonucleotide
ctcaacagcggcaacggcagc

SEQ ID NO: 36246 - DNA, 21 bp, Artificial Sequence
  Description of Artificial Sequence: Synthetic oligonucleotide
agcagcaacgaaaaagacaga

SEQ ID NO: 36247 - DNA, 21 bp, Artificial Sequence
  Description of Artificial Sequence: Synthetic oligonucleotide
ctccccagcggcaacaccagc

SEQ ID NO: 36248 - DNA, 21 bp, Artificial Sequence
  Description of Artificial Sequence: Synthetic oligonucleotide
aatcctgggcataagttgact

SEQ ID NO: 36249 - DNA, 21 bp, Artificial Sequence
  Description of Artificial Sequence: Synthetic oligonucleotide
caaaccagcagccacgcctac

SEQ ID NO: 36250 - DNA, 21 bp, Artificial Sequence
  Description of Artificial Sequence: Synthetic oligonucleotide
agcaacaacggcacccaaaaa

SEQ ID NO: 36251 - DNA, 21 bp, Artificial Sequence
  Description of Artificial Sequence: Synthetic oligonucleotide
ggggatcataataggattaat

SEQ ID NO: 36252 - DNA, 21 bp, Artificial Sequence
  Description of Artificial Sequence: Synthetic oligonucleotide
gtcagcggcaccaaaatcgaa

SEQ ID NO: 36253 - DNA, 21 bp, Artificial Sequence
  Description of Artificial Sequence: Synthetic oligonucleotide
gtcggcgaagccggcaaagcc

SEQ ID NO: 36254 - DNA, 21 bp, Artificial Sequence
  Description of Artificial Sequence: Synthetic oligonucleotide
attgctggtaggggtcttggt

SEQ ID NO: 36255 - DNA, 21 bp, Artificial Sequence
  Description of Artificial Sequence: Synthetic oligonucleotide
aatgttttgggtcgggagggg

SEQ ID NO: 36256 - DNA, 21 bp, Artificial Sequence
  Description of Artificial Sequence: Synthetic oligonucleotide
agtggtcagcattctttgaat

SEQ ID NO: 36257 - DNA, 21 bp, Artificial Sequence
  Description of Artificial Sequence: Synthetic oligonucleotide
aacggttctggacagactcaa

SEQ ID NO: 36258 - DNA, 21 bp, Artificial Sequence
  Description of Artificial Sequence: Synthetic oligonucleotide
gatatggtgagtccgcggaat

SEQ ID NO: 36259 - DNA, 21 bp, Artificial Sequence
  Description of Artificial Sequence: Synthetic oligonucleotide
atgactactcagttgaatagt

SEQ ID NO: 36260 - DNA, 21 bp, Artificial Sequence
  Description of Artificial Sequence: Synthetic oligonucleotide
caaacccccgtcagcgccccc

SEQ ID NO: 36261 - DNA, 21 bp, Artificial Sequence
  Description of Artificial Sequence: Synthetic oligonucleotide
aacgtcgccaccctcagcgcc

SEQ ID NO: 36262 - DNA, 21 bp, Artificial Sequence
  Description of Artificial Sequence: Synthetic oligonucleotide
tcggcggatcatattcggaat

SEQ ID NO: 36263 - DNA, 21 bp, Artificial Sequence
  Description of Artificial Sequence: Synthetic oligonucleotide
agtgttagtacgaatttttcg

SEQ ID NO: 36264 - DNA, 21 bp, Artificial Sequence
  Description of Artificial Sequence: Synthetic oligonucleotide
aacgattctggacagaatcaa

SEQ ID NO: 36265 - DNA, 21 bp, Artificial Sequence
  Description of Artificial Sequence: Synthetic oligonucleotide
gcgactggttctcctagtaag

SEQ ID NO: 36266 - DNA, 21 bp, Artificial Sequence
  Description of Artificial Sequence: Synthetic oligonucleotide
acccaacaacacggcagcaac

SEQ ID NO: 36267 - DNA, 21 bp, Artificial Sequence
  Description of Artificial Sequence: Synthetic oligonucleotide
gagaatcggacttctgttcag

SEQ ID NO: 36268 - DNA, 21 bp, Artificial Sequence
  Description of Artificial Sequence: Synthetic oligonucleotide
accagccaagtcagccacggc

SEQ ID NO: 36269 - DNA, 21 bp, Artificial Sequence
  Description of Artificial Sequence: Synthetic oligonucleotide
gacagagtcctcagccaaggc

SEQ ID NO: 36270 - DNA, 21 bp, Artificial Sequence
  Description of Artificial Sequence: Synthetic oligonucleotide
gacagcggcagcagcaccaaa

SEQ ID NO: 36271 - DNA, 21 bp, Artificial Sequence
  Description of Artificial Sequence: Synthetic oligonucleotide
ccgactcatgcttcgagtctt

SEQ ID NO: 36272 - DNA, 21 bp, Artificial Sequence
  Description of Artificial Sequence: Synthetic oligonucleotide
aacggcagcggccaaaacccc

SEQ ID NO: 36273 - DNA, 21 bp, Artificial Sequence
  Description of Artificial Sequence: Synthetic oligonucleotide
cccaacggcgcccacgtcacc

SEQ ID NO: 36274 - DNA, 21 bp, Artificial Sequence
  Description of Artificial Sequence: Synthetic oligonucleotide
ggtgctaaggagagtcagagt

SEQ ID NO: 36275 - DNA, 21 bp, Artificial Sequence
  Description of Artificial Sequence: Synthetic oligonucleotide
ggccacgacggccaaagcaga

SEQ ID NO: 36276 - DNA, 21 bp, Artificial Sequence
  Description of Artificial Sequence: Synthetic oligonucleotide
cggtcttatgagggtatgcag

SEQ ID NO: 36277 - DNA, 21 bp, Artificial Sequence
  Description of Artificial Sequence: Synthetic oligonucleotide
acgactgtgggtagtggttat

SEQ ID NO: 36278 - DNA, 21 bp, Artificial Sequence
  Description of Artificial Sequence: Synthetic oligonucleotide
ggcatcgccaccaccaacaga

SEQ ID NO: 36279 - DNA, 21 bp, Artificial Sequence
  Description of Artificial Sequence: Synthetic oligonucleotide
agctacagcggcaccctcggc

SEQ ID NO: 36280 - DNA, 21 bp, Artificial Sequence
  Description of Artificial Sequence: Synthetic oligonucleotide
ttttctactcatgaggtttct

SEQ ID NO: 36281 - DNA, 21 bp, Artificial Sequence
  Description of Artificial Sequence: Synthetic oligonucleotide
atcaccggcaaccaaggcgtc

SEQ ID NO: 36282 - DNA, 21 bp, Artificial Sequence
  Description of Artificial Sequence: Synthetic oligonucleotide
tctacggtgggtcatatgaat

SEQ ID NO: 36283 - DNA, 21 bp, Artificial Sequence
  Description of Artificial Sequence: Synthetic oligonucleotide
tctggtgttaaggctttttct

SEQ ID NO: 36284 - DNA, 21 bp, Artificial Sequence
  Description of Artificial Sequence: Synthetic oligonucleotide
cacaaagtccccggcagcggc

SEQ ID NO: 36285 - DNA, 21 bp, Artificial Sequence
  Description of Artificial Sequence: Synthetic oligonucleotide
agcaacgacagcaacaaaaaa

SEQ ID NO: 36286 - DNA, 21 bp, Artificial Sequence
  Description of Artificial Sequence: Synthetic oligonucleotide
aataatggggcttcggttgtg

SEQ ID NO: 36287 - DNA, 21 bp, Artificial Sequence
  Description of Artificial Sequence: Synthetic oligonucleotide
actgcttcgccgaataatcgt

SEQ ID NO: 36288 - DNA, 21 bp, Artificial Sequence
  Description of Artificial Sequence: Synthetic oligonucleotide
accaaccccaaaagcagcagc

SEQ ID NO: 36289 - DNA, 21 bp, Artificial Sequence
  Description of Artificial Sequence: Synthetic oligonucleotide
ttcaaccaacacagcagcctc

SEQ ID NO: 36290 - DNA, 21 bp, Artificial Sequence
  Description of Artificial Sequence: Synthetic oligonucleotide
actccgcagaattctgtgaag

SEQ ID NO: 36291 - DNA, 21 bp, Artificial Sequence
  Description of Artificial Sequence: Synthetic oligonucleotide
ggcggcctcagccccaaagtc

SEQ ID NO: 36292 - DNA, 21 bp, Artificial Sequence
  Description of Artificial Sequence: Synthetic oligonucleotide
tctactgggtcggtgagtaag

SEQ ID NO: 36293 - DNA, 21 bp, Artificial Sequence
  Description of Artificial Sequence: Synthetic oligonucleotide
actctgccttctaattatatg

SEQ ID NO: 36294 - DNA, 21 bp, Artificial Sequence
  Description of Artificial Sequence: Synthetic oligonucleotide
atggccgccaaacccaacgac

SEQ ID NO: 36295 - DNA, 21 bp, Artificial Sequence
  Description of Artificial Sequence: Synthetic oligonucleotide
cccggcaccggcagcaaccac

SEQ ID NO: 36296 - DNA, 21 bp, Artificial Sequence
  Description of Artificial Sequence: Synthetic oligonucleotide
ggcagcgccggcaacatgctc

SEQ ID NO: 36297 - DNA, 21 bp, Artificial Sequence
  Description of Artificial Sequence: Synthetic oligonucleotide
gacgccaacagcacccacgcc

SEQ ID NO: 36298 - DNA, 21 bp, Artificial Sequence
  Description of Artificial Sequence: Synthetic oligonucleotide
caactcagaagcgaccaaacc

SEQ ID NO: 36299 - DNA, 21 bp, Artificial Sequence
  Description of Artificial Sequence: Synthetic oligonucleotide
aatcttaagacgaagggggag

SEQ ID NO: 36300 - DNA, 21 bp, Artificial Sequence
  Description of Artificial Sequence: Synthetic oligonucleotide
agtattagtgataagcttggt

SEQ ID NO: 36301 - DNA, 21 bp, Artificial Sequence
  Description of Artificial Sequence: Synthetic oligonucleotide
gaaagacccggcggcaccccc

SEQ ID NO: 36302 - DNA, 21 bp, Artificial Sequence
  Description of Artificial Sequence: Synthetic oligonucleotide
agcaacagcagacaagccgac

SEQ ID NO: 36303 - DNA, 21 bp, Artificial Sequence
  Description of Artificial Sequence: Synthetic oligonucleotide
gaaagcgtcagcaacagcctc

SEQ ID NO: 36304 - DNA, 21 bp, Artificial Sequence
  Description of Artificial Sequence: Synthetic oligonucleotide
aacgccagcggccaaaaccaa

SEQ ID NO: 36305 - DNA, 21 bp, Artificial Sequence
  Description of Artificial Sequence: Synthetic oligonucleotide
ctcctcagccaacacagcgac

SEQ ID NO: 36306 - DNA, 21 bp, Artificial Sequence
  Description of Artificial Sequence: Synthetic oligonucleotide
tctgttactagtcctaataag

SEQ ID NO: 36307 - DNA, 21 bp, Artificial Sequence
  Description of Artificial Sequence: Synthetic oligonucleotide
gctactgggaatgggcggggg

SEQ ID NO: 36308 - DNA, 21 bp, Artificial Sequence
  Description of Artificial Sequence: Synthetic oligonucleotide
attaggtcgaaggagtctgag

SEQ ID NO: 36309 - DNA, 21 bp, Artificial Sequence
  Description of Artificial Sequence: Synthetic oligonucleotide
tcgggtacgaatatgtggcag

SEQ ID NO: 36310 - DNA, 21 bp, Artificial Sequence
  Description of Artificial Sequence: Synthetic oligonucleotide
ccgactactaggatggtgaat

SEQ ID NO: 36311 - DNA, 21 bp, Artificial Sequence
  Description of Artificial Sequence: Synthetic oligonucleotide
ggggataagaatcatggtagt

SEQ ID NO: 36312 - DNA, 21 bp, Artificial Sequence
  Description of Artificial Sequence: Synthetic oligonucleotide
cagagtcatggtattacgaat

SEQ ID NO: 36313 - DNA, 21 bp, Artificial Sequence
  Description of Artificial Sequence: Synthetic oligonucleotide
aatagtactccgtcgactagg

SEQ ID NO: 36314 - DNA, 21 bp, Artificial Sequence
  Description of Artificial Sequence: Synthetic oligonucleotide
ctggttcagggtggtgttaat

SEQ ID NO: 36315 - DNA, 21 bp, Artificial Sequence
  Description of Artificial Sequence: Synthetic oligonucleotide
attccgactgctcgtgctgcg

SEQ ID NO: 36316 - DNA, 21 bp, Artificial Sequence
  Description of Artificial Sequence: Synthetic oligonucleotide
tacaaccacggcagcgtcgac

SEQ ID NO: 36317 - DNA, 21 bp, Artificial Sequence
  Description of Artificial Sequence: Synthetic oligonucleotide
tggtctttggggcataatgat

SEQ ID NO: 36318 - DNA, 21 bp, Artificial Sequence
  Description of Artificial Sequence: Synthetic oligonucleotide
actcagtcgcataatcttgct

SEQ ID NO: 36319 - DNA, 21 bp, Artificial Sequence
  Description of Artificial Sequence: Synthetic oligonucleotide
aatcctggttcgggttatggt

SEQ ID NO: 36320 - DNA, 21 bp, Artificial Sequence
  Description of Artificial Sequence: Synthetic oligonucleotide
aaccccagccacaccagcgtc

SEQ ID NO: 36321 - DNA, 21 bp, Artificial Sequence
  Description of Artificial Sequence: Synthetic oligonucleotide
caaagcaacaccagccccacc

SEQ ID NO: 36322 - DNA, 21 bp, Artificial Sequence
  Description of Artificial Sequence: Synthetic oligonucleotide
ccggggtctgggagtaatcat

SEQ ID NO: 36323 - DNA, 21 bp, Artificial Sequence
  Description of Artificial Sequence: Synthetic oligonucleotide
gccagaggcgccagcaccaac

SEQ ID NO: 36324 - DNA, 21 bp, Artificial Sequence
  Description of Artificial Sequence: Synthetic oligonucleotide
gacaacatgagcacccccaaa

SEQ ID NO: 36325 - DNA, 21 bp, Artificial Sequence
  Description of Artificial Sequence: Synthetic oligonucleotide
accgccacccaaaaaggccaa

SEQ ID NO: 36326 - DNA, 21 bp, Artificial Sequence
  Description of Artificial Sequence: Synthetic oligonucleotide
atgccgacttcgtctttgaat

SEQ ID NO: 36327 - DNA, 21 bp, Artificial Sequence
  Description of Artificial Sequence: Synthetic oligonucleotide
tcttctcataaggattatttg

SEQ ID NO: 36328 - DNA, 21 bp, Artificial Sequence
  Description of Artificial Sequence: Synthetic oligonucleotide
gccggcgccagcagcaacacc

SEQ ID NO: 36329 - DNA, 21 bp, Artificial Sequence
  Description of Artificial Sequence: Synthetic oligonucleotide
agcgtccacagcaacgccatc

SEQ ID NO: 36330 - DNA, 21 bp, Artificial Sequence
  Description of Artificial Sequence: Synthetic oligonucleotide
gtcctcgccggcagcaacacc

SEQ ID NO: 36331 - DNA, 21 bp, Artificial Sequence
  Description of Artificial Sequence: Synthetic oligonucleotide
cagacgggtactagttctact

SEQ ID NO: 36332 - DNA, 21 bp, Artificial Sequence
  Description of Artificial Sequence: Synthetic oligonucleotide
gcttctactccgaataatact

SEQ ID NO: 36333 - DNA, 21 bp, Artificial Sequence
  Description of Artificial Sequence: Synthetic oligonucleotide
accaacatccaagccagcaaa

SEQ ID NO: 36334 - DNA, 21 bp, Artificial Sequence
  Description of Artificial Sequence: Synthetic oligonucleotide
gctccgagtcatgcttctctt

SEQ ID NO: 36335 - DNA, 21 bp, Artificial Sequence
  Description of Artificial Sequence: Synthetic oligonucleotide
ggtcagattaagaatttgggt

SEQ ID NO: 36336 - DNA, 21 bp, Artificial Sequence
  Description of Artificial Sequence: Synthetic oligonucleotide
ggcctcgaccacctcagaacc

SEQ ID NO: 36337 - DNA, 21 bp, Artificial Sequence
  Description of Artificial Sequence: Synthetic oligonucleotide
tctctgtctcgtgagcatatg

SEQ ID NO: 36338 - DNA, 21 bp, Artificial Sequence
  Description of Artificial Sequence: Synthetic oligonucleotide
acccccaccctcgcccacggc

SEQ ID NO: 36339 - DNA, 21 bp, Artificial Sequence
  Description of Artificial Sequence: Synthetic oligonucleotide
tctgttcatcagaatcgggcg

SEQ ID NO: 36340 - DNA, 21 bp, Artificial Sequence
  Description of Artificial Sequence: Synthetic oligonucleotide
agcagagacagcggcggcgcc

SEQ ID NO: 36341 - DNA, 21 bp, Artificial Sequence
  Description of Artificial Sequence: Synthetic oligonucleotide
agcagcgaagccagactcatg

SEQ ID NO: 36342 - DNA, 21 bp, Artificial Sequence
  Description of Artificial Sequence: Synthetic oligonucleotide
tctacgtctcgtgatgctact

SEQ ID NO: 36343 - DNA, 21 bp, Artificial Sequence
  Description of Artificial Sequence: Synthetic oligonucleotide
tgcaaccaaagccccaacaga

SEQ ID NO: 36344 - DNA, 21 bp, Artificial Sequence
  Description of Artificial Sequence: Synthetic oligonucleotide
ggccaaaccagagaaagcagc

SEQ ID NO: 36345 - DNA, 21 bp, Artificial Sequence
  Description of Artificial Sequence: Synthetic oligonucleotide
agcagcaccaaaagcagcctc

SEQ ID NO: 36346 - DNA, 21 bp, Artificial Sequence
  Description of Artificial Sequence: Synthetic oligonucleotide
cctcttgcttcgcctatggtg

SEQ ID NO: 36347 - DNA, 21 bp, Artificial Sequence
  Description of Artificial Sequence: Synthetic oligonucleotide
ggcaccagccccagcaccatg

SEQ ID NO: 36348 - DNA, 21 bp, Artificial Sequence
  Description of Artificial Sequence: Synthetic oligonucleotide
atcagcaaagccagcacccac

SEQ ID NO: 36349 - DNA, 21 bp, Artificial Sequence
  Description of Artificial Sequence: Synthetic oligonucleotide
aatggtaatatttctattggg

SEQ ID NO: 36350 - DNA, 21 bp, Artificial Sequence
  Description of Artificial Sequence: Synthetic oligonucleotide
accgccgtcaccgccaaccaa

SEQ ID NO: 36351 - DNA, 21 bp, Artificial Sequence
  Description of Artificial Sequence: Synthetic oligonucleotide
gatgggggtaatcagaggagt

SEQ ID NO: 36352 - DNA, 21 bp, Artificial Sequence
  Description of Artificial Sequence: Synthetic oligonucleotide
gacgacagaagcaacctcagc

SEQ ID NO: 36353 - DNA, 21 bp, Artificial Sequence
  Description of Artificial Sequence: Synthetic oligonucleotide
cctgttccgtatcgtgctgat

SEQ ID NO: 36354 - DNA, 21 bp, Artificial Sequence
  Description of Artificial Sequence: Synthetic oligonucleotide
aattctcgtgagaagggtgcg

SEQ ID NO: 36355 - DNA, 21 bp, Artificial Sequence
  Description of Artificial Sequence: Synthetic oligonucleotide
agactccccgcccaccaagcc

SEQ ID NO: 36356 - DNA, 21 bp, Artificial Sequence
  Description of Artificial Sequence: Synthetic oligonucleotide
aacgccaaccaaaaccaaatg

SEQ ID NO: 36357 - DNA, 21 bp, Artificial Sequence
  Description of Artificial Sequence: Synthetic oligonucleotide
tataatgtgaatcgtaatacg

SEQ ID NO: 36358 - DNA, 21 bp, Artificial Sequence
  Description of Artificial Sequence: Synthetic oligonucleotide
tattctgggggtaatatgagt

SEQ ID NO: 36359 - DNA, 21 bp, Artificial Sequence
  Description of Artificial Sequence: Synthetic oligonucleotide
gccaccaacaacggcagcaaa

SEQ ID NO: 36360 - DNA, 21 bp, Artificial Sequence
  Description of Artificial Sequence: Synthetic oligonucleotide
gacagcatcggcagcagcaaa

SEQ ID NO: 36361 - DNA, 21 bp, Artificial Sequence
  Description of Artificial Sequence: Synthetic oligonucleotide
gacggcatcaaaagctacgcc

SEQ ID NO: 36362 - DNA, 21 bp, Artificial Sequence
  Description of Artificial Sequence: Synthetic oligonucleotide
agcagacccagcaacatggcc

SEQ ID NO: 36363 - DNA, 21 bp, Artificial Sequence
  Description of Artificial Sequence: Synthetic oligonucleotide
ggtctgccgactgagaagatg

SEQ ID NO: 36364 - DNA, 21 bp, Artificial Sequence
  Description of Artificial Sequence: Synthetic oligonucleotide
aacggttctgcacagaatcaa

SEQ ID NO: 36365 - DNA, 21 bp, Artificial Sequence
  Description of Artificial Sequence: Synthetic oligonucleotide
accagcagagtcggccaagtc

SEQ ID NO: 36366 - DNA, 21 bp, Artificial Sequence
  Description of Artificial Sequence: Synthetic oligonucleotide
agtactagtaatattgcttcg

SEQ ID NO: 36367 - DNA, 21 bp, Artificial Sequence
  Description of Artificial Sequence: Synthetic oligonucleotide
aatgcgaatccgtctttgagg

SEQ ID NO: 36368 - DNA, 21 bp, Artificial Sequence
  Description of Artificial Sequence: Synthetic oligonucleotide
gagagtaattcgagtcggggg

SEQ ID NO: 36369 - DNA, 21 bp, Artificial Sequence
  Description of Artificial Sequence: Synthetic oligonucleotide
tcgggtggtcaggctatgggg

SEQ ID NO: 36370 - DNA, 21 bp, Artificial Sequence
  Description of Artificial Sequence: Synthetic oligonucleotide
tttgtgaatactagtgcgcag

SEQ ID NO: 36371 - DNA, 21 bp, Artificial Sequence
  Description of Artificial Sequence: Synthetic oligonucleotide
atgatgggcggcgtcaaaaac

SEQ ID NO: 36372 - DNA, 21 bp, Artificial Sequence
  Description of Artificial Sequence: Synthetic oligonucleotide
catacgcctgatgtgggtaag

SEQ ID NO: 36373 - DNA, 21 bp, Artificial Sequence
  Description of Artificial Sequence: Synthetic oligonucleotide
agaagcagcagcgccatgacc

SEQ ID NO: 36374 - DNA, 21 bp, Artificial Sequence
  Description of Artificial Sequence: Synthetic oligonucleotide
agtcagattccgccgtctact

SEQ ID NO: 36375 - DNA, 21 bp, Artificial Sequence
  Description of Artificial Sequence: Synthetic oligonucleotide
agcggcagcaacaacttcctc

SEQ ID NO: 36376 - DNA, 21 bp, Artificial Sequence
  Description of Artificial Sequence: Synthetic oligonucleotide
atgcgtgctgagtctggtcag

SEQ ID NO: 36377 - DNA, 21 bp, Artificial Sequence
  Description of Artificial Sequence: Synthetic oligonucleotide
tcgatttctcattcgtctagt

SEQ ID NO: 36378 - DNA, 21 bp, Artificial Sequence
  Description of Artificial Sequence: Synthetic oligonucleotide
tacagagccagcggcatcagc

SEQ ID NO: 36379 - DNA, 21 bp, Artificial Sequence
  Description of Artificial Sequence: Synthetic oligonucleotide
tctggtacgacgacgtttggt

SEQ ID NO: 36380 - DNA, 21 bp, Artificial Sequence
  Description of Artificial Sequence: Synthetic oligonucleotide
gccctcagcagccaaaaaggc

SEQ ID NO: 36381 - DNA, 21 bp, Artificial Sequence
  Description of Artificial Sequence: Synthetic oligonucleotide
ctcggcgtcaaaacccccacc

SEQ ID NO: 36382 - DNA, 21 bp, Artificial Sequence
  Description of Artificial Sequence: Synthetic oligonucleotide
aatgatcgtggtcagaatggg

SEQ ID NO: 36383 - DNA, 21 bp, Artificial Sequence
  Description of Artificial Sequence: Synthetic oligonucleotide
ttccacgccaacagcaccgtc

SEQ ID NO: 36384 - DNA, 21 bp, Artificial Sequence
  Description of Artificial Sequence: Synthetic oligonucleotide
aaaagcgtcaaccccctcctc

SEQ ID NO: 36385 - DNA, 21 bp, Artificial Sequence
  Description of Artificial Sequence: Synthetic oligonucleotide
cacagcagcagacccctcgaa

SEQ ID NO: 36386 - DNA, 21 bp, Artificial Sequence
  Description of Artificial Sequence: Synthetic oligonucleotide
agtgataataagggttcggtg

SEQ ID NO: 36387 - DNA, 21 bp, Artificial Sequence
  Description of Artificial Sequence: Synthetic oligonucleotide
agaatgggcaacaaagaagcc

SEQ ID NO: 36388 - DNA, 21 bp, Artificial Sequence
  Description of Artificial Sequence: Synthetic oligonucleotide
ggcctcgccgaccccagaacc

SEQ ID NO: 36389 - DNA, 21 bp, Artificial Sequence
  Description of Artificial Sequence: Synthetic oligonucleotide
atcaccagcaccggcagcagc

SEQ ID NO: 36390 - DNA, 21 bp, Artificial Sequence
  Description of Artificial Sequence: Synthetic oligonucleotide
gcgggttcgtctcctcctacg

SEQ ID NO: 36391 - DNA, 21 bp, Artificial Sequence
  Description of Artificial Sequence: Synthetic oligonucleotide
ccgttgcctaagaatagtagt

SEQ ID NO: 36392 - DNA, 21 bp, Artificial Sequence
  Description of Artificial Sequence: Synthetic oligonucleotide
agcagagtcgaccaatacaaa

SEQ ID NO: 36393 - DNA, 21 bp, Artificial Sequence
  Description of Artificial Sequence: Synthetic oligonucleotide
ggcatgacccaaggcggcaaa

SEQ ID NO: 36394 - DNA, 21 bp, Artificial Sequence
  Description of Artificial Sequence: Synthetic oligonucleotide
caattccccggcaccctcaga

SEQ ID NO: 36395 - DNA, 21 bp, Artificial Sequence
  Description of Artificial Sequence: Synthetic oligonucleotide
ggtgctaatacgaatccgggg

SEQ ID NO: 36396 - DNA, 21 bp, Artificial Sequence
  Description of Artificial Sequence: Synthetic oligonucleotide
gatcgggctgatgcgaattct

SEQ ID NO: 36397 - DNA, 21 bp, Artificial Sequence
  Description of Artificial Sequence: Synthetic oligonucleotide
actactcataatattaagggg

SEQ ID NO: 36398 - DNA, 21 bp, Artificial Sequence
  Description of Artificial Sequence: Synthetic oligonucleotide
gtcggcagccaaaccaacagc

SEQ ID NO: 36399 - DNA, 21 bp, Artificial Sequence
  Description of Artificial Sequence: Synthetic oligonucleotide
catacggcgactcctcttctg

SEQ ID NO: 36400 - DNA, 21 bp, Artificial Sequence
  Description of Artificial Sequence: Synthetic oligonucleotide
gctgttggtaagtcgacggag

SEQ ID NO: 36401 - DNA, 21 bp, Artificial Sequence
  Description of Artificial Sequence: Synthetic oligonucleotide
ggggcggctgtgcaggcgaat

SEQ ID NO: 36402 - DNA, 21 bp, Artificial Sequence
  Description of Artificial Sequence: Synthetic oligonucleotide
gaccccctcggcaaacaaggc

SEQ ID NO: 36403 - DNA, 21 bp, Artificial Sequence
  Description of Artificial Sequence: Synthetic oligonucleotide
agcatcaaaagcgccgccgcc

SEQ ID NO: 36404 - DNA, 21 bp, Artificial Sequence
  Description of Artificial Sequence: Synthetic oligonucleotide
tcgaatcagcgtggtgagggt

SEQ ID NO: 36405 - DNA, 21 bp, Artificial Sequence
  Description of Artificial Sequence: Synthetic oligonucleotide
cacggcatcagcaaccaaagc

SEQ ID NO: 36406 - DNA, 21 bp, Artificial Sequence
  Description of Artificial Sequence: Synthetic oligonucleotide
ggcaccggcgtccccggcaaa

SEQ ID NO: 36407 - DNA, 21 bp, Artificial Sequence
  Description of Artificial Sequence: Synthetic oligonucleotide
accggcagcggccaaaaccaa

SEQ ID NO: 36408 - DNA, 21 bp, Artificial Sequence
  Description of Artificial Sequence: Synthetic oligonucleotide
cctaatctgagtaagagtttg

SEQ ID NO: 36409 - DNA, 21 bp, Artificial Sequence
  Description of Artificial Sequence: Synthetic oligonucleotide
gattatcataatagtaagctg

SEQ ID NO: 36410 - DNA, 21 bp, Artificial Sequence
  Description of Artificial Sequence: Synthetic oligonucleotide
tctgttaattctcggagtgag

SEQ ID NO: 36411 - DNA, 21 bp, Artificial Sequence
  Description of Artificial Sequence: Synthetic oligonucleotide
caacccaacagagccgacaac

SEQ ID NO: 36412 - DNA, 21 bp, Artificial Sequence
  Description of Artificial Sequence: Synthetic oligonucleotide
gccgccaccatgagaaacagc

SEQ ID NO: 36413 - DNA, 21 bp, Artificial Sequence
  Description of Artificial Sequence: Synthetic oligonucleotide
agccaacaaagccccagcatg

SEQ ID NO: 36414 - DNA, 21 bp, Artificial Sequence
  Description of Artificial Sequence: Synthetic oligonucleotide
catcgtgatcaggtttcgctt

SEQ ID NO: 36415 - DNA, 21 bp, Artificial Sequence
  Description of Artificial Sequence: Synthetic oligonucleotide
agcaacgaaaccaaaagcagc

SEQ ID NO: 36416 - DNA, 21 bp, Artificial Sequence
  Description of Artificial Sequence: Synthetic oligonucleotide
agcggcagcggccaaaaccaa

SEQ ID NO: 36417 - DNA, 21 bp, Artificial Sequence
  Description of Artificial Sequence: Synthetic oligonucleotide
tcgtctgaggcggctactagg

SEQ ID NO: 36418 - DNA, 21 bp, Artificial Sequence
  Description of Artificial Sequence: Synthetic oligonucleotide
tctggtagtgataagtttagt

SEQ ID NO: 36419 - DNA, 21 bp, Artificial Sequence
  Description of Artificial Sequence: Synthetic oligonucleotide
cctaataatcagtctacgagg

SEQ ID NO: 36420 - DNA, 21 bp, Artificial Sequence
  Description of Artificial Sequence: Synthetic oligonucleotide
tcgcataattcgaaggattct

SEQ ID NO: 36421 - DNA, 21 bp, Artificial Sequence
  Description of Artificial Sequence: Synthetic oligonucleotide
tgcaccaccagacaaggcaac

SEQ ID NO: 36422 - DNA, 21 bp, Artificial Sequence
  Description of Artificial Sequence: Synthetic oligonucleotide
gtcttcaaccacgccagcaaa

SEQ ID NO: 36423 - DNA, 21 bp, Artificial Sequence
  Description of Artificial Sequence: Synthetic oligonucleotide
gaactccacagcaaaaacgcc

SEQ ID NO: 36424 - DNA, 21 bp, Artificial Sequence
  Description of Artificial Sequence: Synthetic oligonucleotide
ggccccggcagaaacctcatc

SEQ ID NO: 36425 - DNA, 21 bp, Artificial Sequence
  Description of Artificial Sequence: Synthetic oligonucleotide
agcctcggcagagaccacgcc

SEQ ID NO: 36426 - DNA, 21 bp, Artificial Sequence
  Description of Artificial Sequence: Synthetic oligonucleotide
tacggccaaaccaaaacccaa

SEQ ID NO: 36427 - DNA, 21 bp, Artificial Sequence
  Description of Artificial Sequence: Synthetic oligonucleotide
gccaccaaccacagcccccaa

SEQ ID NO: 36428 - DNA, 21 bp, Artificial Sequence
  Description of Artificial Sequence: Synthetic oligonucleotide
aatgtgactacgccgcttatt

SEQ ID NO: 36429 - DNA, 21 bp, Artificial Sequence
  Description of Artificial Sequence: Synthetic oligonucleotide
cccaccaaaggcgccaacgcc

SEQ ID NO: 36430 - DNA, 21 bp, Artificial Sequence
  Description of Artificial Sequence: Synthetic oligonucleotide
ggttcttcgcatcttactacg

SEQ ID NO: 36431 - DNA, 21 bp, Artificial Sequence
  Description of Artificial Sequence: Synthetic oligonucleotide
tctctgacgacgaaggctaat

SEQ ID NO: 36432 - DNA, 21 bp, Artificial Sequence
  Description of Artificial Sequence: Synthetic oligonucleotide
accggcagcagcaaagtcggc

SEQ ID NO: 36433 - DNA, 21 bp, Artificial Sequence
  Description of Artificial Sequence: Synthetic oligonucleotide
agccaaagccccaacagaggc

SEQ ID NO: 36434 - DNA, 21 bp, Artificial Sequence
  Description of Artificial Sequence: Synthetic oligonucleotide
ggtttgaaggggtcttttccg

SEQ ID NO: 36435 - DNA, 21 bp, Artificial Sequence
  Description of Artificial Sequence: Synthetic oligonucleotide
tcgatggggaattcgattagt

SEQ ID NO: 36436 - DNA, 21 bp, Artificial Sequence
  Description of Artificial Sequence: Synthetic oligonucleotide
gagacgaattctcgtttgggt

SEQ ID NO: 36437 - DNA, 21 bp, Artificial Sequence
  Description of Artificial Sequence: Synthetic oligonucleotide
gcgcctaatgggactctgtcg

SEQ ID NO: 36438 - DNA, 21 bp, Artificial Sequence
  Description of Artificial Sequence: Synthetic oligonucleotide
ctgagtacggcgaataagtct

SEQ ID NO: 36439 - DNA, 21 bp, Artificial Sequence
  Description of Artificial Sequence: Synthetic oligonucleotide
atgcagactagtcagtcgact

SEQ ID NO: 36440 - DNA, 21 bp, Artificial Sequence
  Description of Artificial Sequence: Synthetic oligonucleotide
aatagtgcgaataagactccg

SEQ ID NO: 36441 - DNA, 21 bp, Artificial Sequence
  Description of Artificial Sequence: Synthetic oligonucleotide
atcggcaccagcatcaacagc

SEQ ID NO: 36442 - DNA, 21 bp, Artificial Sequence
  Description of Artificial Sequence: Synthetic oligonucleotide
tttaggacgactgcttcgact

SEQ ID NO: 36443 - DNA, 21 bp, Artificial Sequence
  Description of Artificial Sequence: Synthetic oligonucleotide
tcggcttatgagaggacttcg

SEQ ID NO: 36444 - DNA, 21 bp, Artificial Sequence
  Description of Artificial Sequence: Synthetic oligonucleotide
agcatcaccggcaacagaacc

SEQ ID NO: 36445 - DNA, 21 bp, Artificial Sequence
  Description of Artificial Sequence: Synthetic oligonucleotide
gccttcggcggcgaaaccaaa

SEQ ID NO: 36446 - DNA, 21 bp, Artificial Sequence
  Description of Artificial Sequence: Synthetic oligonucleotide
ggcaccgccagaggcgtcgcc

SEQ ID NO: 36447 - DNA, 21 bp, Artificial Sequence
  Description of Artificial Sequence: Synthetic oligonucleotide
tctcatggtcctcagattact

SEQ ID NO: 36448 - DNA, 21 bp, Artificial Sequence
  Description of Artificial Sequence: Synthetic oligonucleotide
ctggtttcgtctaagagtagt

SEQ ID NO: 36449 - DNA, 21 bp, Artificial Sequence
  Description of Artificial Sequence: Synthetic oligonucleotide
gcccaagtcgacaaaagaagc

SEQ ID NO: 36450 - DNA, 21 bp, Artificial Sequence
  Description of Artificial Sequence: Synthetic oligonucleotide
gagaatacgaagacttatagt

SEQ ID NO: 36451 - DNA, 21 bp, Artificial Sequence
  Description of Artificial Sequence: Synthetic oligonucleotide
agcaacatgcccggcatggtc

SEQ ID NO: 36452 - DNA, 21 bp, Artificial Sequence
  Description of Artificial Sequence: Synthetic oligonucleotide
gccgaacaccaaagcggcaaa

SEQ ID NO: 36453 - DNA, 21 bp, Artificial Sequence
  Description of Artificial Sequence: Synthetic oligonucleotide
ggcaaaaccggccccaacagc

SEQ ID NO: 36454 - DNA, 21 bp, Artificial Sequence
  Description of Artificial Sequence: Synthetic oligonucleotide
gggaatatttcgacttcgtct

SEQ ID NO: 36455 - DNA, 21 bp, Artificial Sequence
  Description of Artificial Sequence: Synthetic oligonucleotide
acggtggctcatcctagtcat

SEQ ID NO: 36456 - DNA, 21 bp, Artificial Sequence
  Description of Artificial Sequence: Synthetic oligonucleotide
cccaccatgcaaggcgtccac

SEQ ID NO: 36457 - DNA, 21 bp, Artificial Sequence
  Description of Artificial Sequence: Synthetic oligonucleotide
agaatgaacggcggcggcccc

SEQ ID NO: 36458 - DNA, 21 bp, Artificial Sequence
  Description of Artificial Sequence: Synthetic oligonucleotide
aatcagtcgtcttctgctcgg

SEQ ID NO: 36459 - DNA, 21 bp, Artificial Sequence
  Description of Artificial Sequence: Synthetic oligonucleotide
atcggcagcggccaaaaccaa

SEQ ID NO: 36460 - DNA, 21 bp, Artificial Sequence
  Description of Artificial Sequence: Synthetic oligonucleotide
atggagattaagcctaatcgg

SEQ ID NO: 36461 - DNA, 21 bp, Artificial Sequence
  Description of Artificial Sequence: Synthetic oligonucleotide
aatgcggtgggggttgggtat

SEQ ID NO: 36462 - DNA, 21 bp, Artificial Sequence
  Description of Artificial Sequence: Synthetic oligonucleotide
caccaaggcaacgtcatcagc

SEQ ID NO: 36463 - DNA, 21 bp, Artificial Sequence
  Description of Artificial Sequence: Synthetic oligonucleotide
cataatgttggtgggggggat

SEQ ID NO: 36464 - DNA, 21 bp, Artificial Sequence
  Description of Artificial Sequence: Synthetic oligonucleotide
acgccgacgctgtctcatact

SEQ ID NO: 36465 - DNA, 21 bp, Artificial Sequence
  Description of Artificial Sequence: Synthetic oligonucleotide
aacaacaccagcacccacctc

SEQ ID NO: 36466 - DNA, 21 bp, Artificial Sequence
  Description of Artificial Sequence: Synthetic oligonucleotide
aatattgctagtaaggggccg

SEQ ID NO: 36467 - DNA, 21 bp, Artificial Sequence
  Description of Artificial Sequence: Synthetic oligonucleotide
aacggttctgaacagaatcaa

SEQ ID NO: 36468 - DNA, 21 bp, Artificial Sequence
  Description of Artificial Sequence: Synthetic oligonucleotide
ggtagtaggtcttctacgact

SEQ ID NO: 36469 - DNA, 21 bp, Artificial Sequence
  Description of Artificial Sequence: Synthetic oligonucleotide
tttaatacttctaagcttagt

SEQ ID NO: 36470 - DNA, 21 bp, Artificial Sequence
  Description of Artificial Sequence: Synthetic oligonucleotide
agacccacccaagtcggcgcc

SEQ ID NO: 36471 - DNA, 21 bp, Artificial Sequence
  Description of Artificial Sequence: Synthetic oligonucleotide
cagtctactgagcggttggcg

SEQ ID NO: 36472 - DNA, 21 bp, Artificial Sequence
  Description of Artificial Sequence: Synthetic oligonucleotide
atgagtacgcatagttcgggt

SEQ ID NO: 36473 - DNA, 21 bp, Artificial Sequence
  Description of Artificial Sequence: Synthetic oligonucleotide
caacaagccagcctcagcagc

SEQ ID NO: 36474 - DNA, 21 bp, Artificial Sequence
  Description of Artificial Sequence: Synthetic oligonucleotide
attgatggtcatcggaatggt

SEQ ID NO: 36475 - DNA, 21 bp, Artificial Sequence
  Description of Artificial Sequence: Synthetic oligonucleotide
tgttctccgccgactaggggg

SEQ ID NO: 36476 - DNA, 21 bp, Artificial Sequence
  Description of Artificial Sequence: Synthetic oligonucleotide
tcgggtgcggggtcggctggg

SEQ ID NO: 36477 - DNA, 21 bp, Artificial Sequence
  Description of Artificial Sequence: Synthetic oligonucleotide
agagaaagcagccccagcctc

SEQ ID NO: 36478 - DNA, 21 bp, Artificial Sequence
  Description of Artificial Sequence: Synthetic oligonucleotide
gtgaatacgtctcatacgaat

SEQ ID NO: 36479 - DNA, 21 bp, Artificial Sequence
  Description of Artificial Sequence: Synthetic oligonucleotide
gcctaccccaaaaacagcaac

SEQ ID NO: 36480 - DNA, 21 bp, Artificial Sequence
  Description of Artificial Sequence: Synthetic oligonucleotide
ttcgccaacaccgccaacaga

SEQ ID NO: 36481 - DNA, 21 bp, Artificial Sequence
  Description of Artificial Sequence: Synthetic oligonucleotide
aattcggcgagtctgaatcat

SEQ ID NO: 36482 - DNA, 21 bp, Artificial Sequence
  Description of Artificial Sequence: Synthetic oligonucleotide
ggtgatgctggtagttttagt

SEQ ID NO: 36483 - DNA, 21 bp, Artificial Sequence
  Description of Artificial Sequence: Synthetic oligonucleotide
ttcaacgaacaaagagtcagc

SEQ ID NO: 36484 - DNA, 21 bp, Artificial Sequence
  Description of Artificial Sequence: Synthetic oligonucleotide
ctcagaagcaaagaaagcgcc

SEQ ID NO: 36485 - DNA, 21 bp, Artificial Sequence
  Description of Artificial Sequence: Synthetic oligonucleotide
tttcgtacgcagtctacgaag

SEQ ID NO: 36486 - DNA, 21 bp, Artificial Sequence
  Description of Artificial Sequence: Synthetic oligonucleotide
cccaccggcgaaaaaagactc

SEQ ID NO: 36487 - DNA, 21 bp, Artificial Sequence
  Description of Artificial Sequence: Synthetic oligonucleotide
gggcgggagagtaatctgagt

SEQ ID NO: 36488 - DNA, 21 bp, Artificial Sequence
  Description of Artificial Sequence: Synthetic oligonucleotide
cagggtcctaagaatgctgat

SEQ ID NO: 36489 - DNA, 21 bp, Artificial Sequence
  Description of Artificial Sequence: Synthetic oligonucleotide
catgcgacgtctggtacgcgt

SEQ ID NO: 36490 - DNA, 21 bp, Artificial Sequence
  Description of Artificial Sequence: Synthetic oligonucleotide
ggcggcagcaacctcagaacc

SEQ ID NO: 36491 - DNA, 21 bp, Artificial Sequence
  Description of Artificial Sequence: Synthetic oligonucleotide
aacgccagcaccgccaacatg

SEQ ID NO: 36492 - DNA, 21 bp, Artificial Sequence
  Description of Artificial Sequence: Synthetic oligonucleotide
gctttggctaatccgcagact

SEQ ID NO: 36493 - DNA, 21 bp, Artificial Sequence
  Description of Artificial Sequence: Synthetic oligonucleotide
agaagcggcaacgccaccatc

SEQ ID NO: 36494 - DNA, 21 bp, Artificial Sequence
  Description of Artificial Sequence: Synthetic oligonucleotide
caaagcgaaatcgtcaacaaa

SEQ ID NO: 36495 - DNA, 21 bp, Artificial Sequence
  Description of Artificial Sequence: Synthetic oligonucleotide
aacggttatggacagaatcaa

SEQ ID NO: 36496 - DNA, 21 bp, Artificial Sequence
  Description of Artificial Sequence: Synthetic oligonucleotide
agaagcagccccgccagcctc

SEQ ID NO: 36497 - DNA, 21 bp, Artificial Sequence
  Description of Artificial Sequence: Synthetic oligonucleotide
gcggtgacgggtgcgagtggt

SEQ ID NO: 36498 - DNA, 21 bp, Artificial Sequence
  Description of Artificial Sequence: Synthetic oligonucleotide
agcggcagcgaacacctcaga

SEQ ID NO: 36499 - DNA, 21 bp, Artificial Sequence
  Description of Artificial Sequence: Synthetic oligonucleotide
catatgaatcgtaagcttgag

SEQ ID NO: 36500 - DNA, 21 bp, Artificial Sequence
  Description of Artificial Sequence: Synthetic oligonucleotide
gataatactggtcgtaatgct

SEQ ID NO: 36501 - DNA, 21 bp, Artificial Sequence
  Description of Artificial Sequence: Synthetic oligonucleotide
cccggcgccgccctcagcatc

SEQ ID NO: 36502 - DNA, 21 bp, Artificial Sequence
  Description of Artificial Sequence: Synthetic oligonucleotide
agaaccgaccacggcggcgtc

SEQ ID NO: 36503 - DNA, 21 bp, Artificial Sequence
  Description of Artificial Sequence: Synthetic oligonucleotide
ctcaacagcaccgccggcaaa

SEQ ID NO: 36504 - DNA, 21 bp, Artificial Sequence
  Description of Artificial Sequence: Synthetic oligonucleotide
tcgcatcttgatcgtttgaat

SEQ ID NO: 36505 - DNA, 21 bp, Artificial Sequence
  Description of Artificial Sequence: Synthetic oligonucleotide
agctacgccgacaaacaaggc

SEQ ID NO: 36506 - DNA, 21 bp, Artificial Sequence
  Description of Artificial Sequence: Synthetic oligonucleotide
actgcgacgacgctttcgagt

SEQ ID NO: 36507 - DNA, 21 bp, Artificial Sequence
  Description of Artificial Sequence: Synthetic oligonucleotide
cctcggactggtacgttgatg

SEQ ID NO: 36508 - DNA, 21 bp, Artificial Sequence
  Description of Artificial Sequence: Synthetic oligonucleotide
gctagtactaatagtatgcag

SEQ ID NO: 36509 - DNA, 21 bp, Artificial Sequence
  Description of Artificial Sequence: Synthetic oligonucleotide
ggtaattctatggctgggact

SEQ ID NO: 36510 - DNA, 21 bp, Artificial Sequence
  Description of Artificial Sequence: Synthetic oligonucleotide
gctgtgtcgagtaaggtgggg

SEQ ID NO: 36511 - DNA, 21 bp, Artificial Sequence
  Description of Artificial Sequence: Synthetic oligonucleotide
tctgcgagtccgagtattaag

SEQ ID NO: 36512 - DNA, 21 bp, Artificial Sequence
  Description of Artificial Sequence: Synthetic oligonucleotide
cttagtatgaatacttcgaag

SEQ ID NO: 36513 - DNA, 21 bp, Artificial Sequence
  Description of Artificial Sequence: Synthetic oligonucleotide
cccaacggcagccccctcagc

SEQ ID NO: 36514 - DNA, 21 bp, Artificial Sequence
  Description of Artificial Sequence: Synthetic oligonucleotide
aacggttctggacagaataaa

SEQ ID NO: 36515 - DNA, 21 bp, Artificial Sequence
  Description of Artificial Sequence: Synthetic oligonucleotide
gtcaaaaccgccaaagtcaac

SEQ ID NO: 36516 - DNA, 21 bp, Artificial Sequence
  Description of Artificial Sequence: Synthetic oligonucleotide
cacagagtcgacaaccaaggc

SEQ ID NO: 36517 - DNA, 21 bp, Artificial Sequence
  Description of Artificial Sequence: Synthetic oligonucleotide
cctcttgtgcctaggggtacg

SEQ ID NO: 36518 - DNA, 21 bp, Artificial Sequence
  Description of Artificial Sequence: Synthetic oligonucleotide
agcagccaagcccaacccacc

SEQ ID NO: 36519 - DNA, 21 bp, Artificial Sequence
  Description of Artificial Sequence: Synthetic oligonucleotide
gctggtaatacgggttcgcat

SEQ ID NO: 36520 - DNA, 21 bp, Artificial Sequence
  Description of Artificial Sequence: Synthetic oligonucleotide
agcatccccagcaccagccaa

SEQ ID NO: 36521 - DNA, 21 bp, Artificial Sequence
  Description of Artificial Sequence: Synthetic oligonucleotide
atgagtcatactaagtcgaat

SEQ ID NO: 36522 - DNA, 21 bp, Artificial Sequence
  Description of Artificial Sequence: Synthetic oligonucleotide
cagggtgcgggggtttcgtct

SEQ ID NO: 36523 - DNA, 21 bp, Artificial Sequence
  Description of Artificial Sequence: Synthetic oligonucleotide
caagaaaccagaggcaacagc

SEQ ID NO: 36524 - DNA, 21 bp, Artificial Sequence
  Description of Artificial Sequence: Synthetic oligonucleotide
gtcagcggcagcaacagcctc

SEQ ID NO: 36525 - DNA, 21 bp, Artificial Sequence
  Description of Artificial Sequence: Synthetic oligonucleotide
agtgcggggacttcggttggt

SEQ ID NO: 36526 - DNA, 21 bp, Artificial Sequence
  Description of Artificial Sequence: Synthetic oligonucleotide
aacagcgccggcaccagagtc

SEQ ID NO: 36527 - DNA, 21 bp, Artificial Sequence
  Description of Artificial Sequence: Synthetic oligonucleotide
cgtctggaggggagtatggcg

SEQ ID NO: 36528 - DNA, 21 bp, Artificial Sequence
  Description of Artificial Sequence: Synthetic oligonucleotide
cccgccgaccacggcaaactc

SEQ ID NO: 36529 - DNA, 21 bp, Artificial Sequence
  Description of Artificial Sequence: Synthetic oligonucleotide
atggatgggaggtcgactact

SEQ ID NO: 36530 - DNA, 21 bp, Artificial Sequence
  Description of Artificial Sequence: Synthetic oligonucleotide
actgggactgattcgcggtcg

SEQ ID NO: 36531 - DNA, 21 bp, Artificial Sequence
  Description of Artificial Sequence: Synthetic oligonucleotide
attaggacgaaggagtctgcg

SEQ ID NO: 36532 - DNA, 21 bp, Artificial Sequence
  Description of Artificial Sequence: Synthetic oligonucleotide
agagacgtcgacgtcagaaac

SEQ ID NO: 36533 - DNA, 21 bp, Artificial Sequence
  Description of Artificial Sequence: Synthetic oligonucleotide
tacgtcagcagcggcaaagcc

SEQ ID NO: 36534 - DNA, 21 bp, Artificial Sequence
  Description of Artificial Sequence: Synthetic oligonucleotide
agttttcctcctggtaatgtt

SEQ ID NO: 36535 - DNA, 21 bp, Artificial Sequence
  Description of Artificial Sequence: Synthetic oligonucleotide
caactccccaccatgaccgtc

SEQ ID NO: 36536 - DNA, 21 bp, Artificial Sequence
  Description of Artificial Sequence: Synthetic oligonucleotide
cccaccaccctcaaacacgac

SEQ ID NO: 36537 - DNA, 21 bp, Artificial Sequence
  Description of Artificial Sequence: Synthetic oligonucleotide
ggtcctagtacgcattcgggt

SEQ ID NO: 36538 - DNA, 21 bp, Artificial Sequence
  Description of Artificial Sequence: Synthetic oligonucleotide
cacagaagccccagcacccaa

SEQ ID NO: 36539 - DNA, 21 bp, Artificial Sequence
  Description of Artificial Sequence: Synthetic oligonucleotide
caaagagtcaacaccgccagc

SEQ ID NO: 36540 - DNA, 21 bp, Artificial Sequence
  Description of Artificial Sequence: Synthetic oligonucleotide
cacaacagcggcaacggcagc

SEQ ID NO: 36541 - DNA, 21 bp, Artificial Sequence
  Description of Artificial Sequence: Synthetic oligonucleotide
acggctcagggtccgtctgct

SEQ ID NO: 36542 - DNA, 21 bp, Artificial Sequence
  Description of Artificial Sequence: Synthetic oligonucleotide
ccggttacgcgttctaaggat

SEQ ID NO: 36543 - DNA, 21 bp, Artificial Sequence
  Description of Artificial Sequence: Synthetic oligonucleotide
gccgccaccaacagcctcacc

SEQ ID NO: 36544 - DNA, 21 bp, Artificial Sequence
  Description of Artificial Sequence: Synthetic oligonucleotide
tctggtgctcctggttcttcg

SEQ ID NO: 36545 - DNA, 21 bp, Artificial Sequence
  Description of Artificial Sequence: Synthetic oligonucleotide
accagcaacaccaaacaaggc

SEQ ID NO: 36546 - DNA, 21 bp, Artificial Sequence
  Description of Artificial Sequence: Synthetic oligonucleotide
agaacccccaccgccagcggc

SEQ ID NO: 36547 - DNA, 21 bp, Artificial Sequence
  Description of Artificial Sequence: Synthetic oligonucleotide
ggggcttcgactcctaggctt

SEQ ID NO: 36548 - DNA, 21 bp, Artificial Sequence
  Description of Artificial Sequence: Synthetic oligonucleotide
atgctcaacaacgccagcgcc

SEQ ID NO: 36549 - DNA, 21 bp, Artificial Sequence
  Description of Artificial Sequence: Synthetic oligonucleotide
gattatgggaaggggagttct

SEQ ID NO: 36550 - DNA, 21 bp, Artificial Sequence
  Description of Artificial Sequence: Synthetic oligonucleotide
ggtaatatgcgtaatttggct

SEQ ID NO: 36551 - DNA, 21 bp, Artificial Sequence
  Description of Artificial Sequence: Synthetic oligonucleotide
catgctaattcgcctgcgacg

SEQ ID NO: 36552 - DNA, 21 bp, Artificial Sequence
  Description of Artificial Sequence: Synthetic oligonucleotide
gcgtctcggagtgtgaatgct

SEQ ID NO: 36553 - DNA, 21 bp, Artificial Sequence
  Description of Artificial Sequence: Synthetic oligonucleotide
gagaatcgggtgaaggttaat

SEQ ID NO: 36554 - DNA, 21 bp, Artificial Sequence
  Description of Artificial Sequence: Synthetic oligonucleotide
aacgtttctggacagaatcaa

SEQ ID NO: 36555 - DNA, 21 bp, Artificial Sequence
  Description of Artificial Sequence: Synthetic oligonucleotide
ttcatgggcagacccaacgtc

SEQ ID NO: 36556 - DNA, 21 bp, Artificial Sequence
  Description of Artificial Sequence: Synthetic oligonucleotide
gattctcgttctattaagggg

SEQ ID NO: 36557 - DNA, 21 bp, Artificial Sequence
  Description of Artificial Sequence: Synthetic oligonucleotide
ctccaaaaacccagcctcgtc

SEQ ID NO: 36558 - DNA, 21 bp, Artificial Sequence
  Description of Artificial Sequence: Synthetic oligonucleotide
tcgaaggataggagtactgtt

SEQ ID NO: 36559 - DNA, 21 bp, Artificial Sequence
  Description of Artificial Sequence: Synthetic oligonucleotide
acccaaaacaccaaaagcatc

SEQ ID NO: 36560 - DNA, 21 bp, Artificial Sequence
  Description of Artificial Sequence: Synthetic oligonucleotide
aatcctgttgctctgagggat

SEQ ID NO: 36561 - DNA, 21 bp, Artificial Sequence
  Description of Artificial Sequence: Synthetic oligonucleotide
ggccaaagcaacgtcaccctc

SEQ ID NO: 36562 - DNA, 21 bp, Artificial Sequence
  Description of Artificial Sequence: Synthetic oligonucleotide
agcagcagcggcggcgtcaaa

SEQ ID NO: 36563 - DNA, 21 bp, Artificial Sequence
  Description of Artificial Sequence: Synthetic oligonucleotide
agcgacatcaacagaagcacc

SEQ ID NO: 36564 - DNA, 21 bp, Artificial Sequence
  Description of Artificial Sequence: Synthetic oligonucleotide
aacagagtcgaacacacccaa

SEQ ID NO: 36565 - DNA, 21 bp, Artificial Sequence
  Description of Artificial Sequence: Synthetic oligonucleotide
gatcagggtaatggttatggg

SEQ ID NO: 36566 - DNA, 21 bp, Artificial Sequence
  Description of Artificial Sequence: Synthetic oligonucleotide
cgtttggagactaagtcgggt

SEQ ID NO: 36567 - DNA, 21 bp, Artificial Sequence
  Description of Artificial Sequence: Synthetic oligonucleotide
tctactcctattcgttcggtt

SEQ ID NO: 36568 - DNA, 21 bp, Artificial Sequence
  Description of Artificial Sequence: Synthetic oligonucleotide
acgtcttctgcgcgtgttacg

SEQ ID NO: 36569 - DNA, 21 bp, Artificial Sequence
  Description of Artificial Sequence: Synthetic oligonucleotide
gaggctgttactatgcatggt

SEQ ID NO: 36570 - DNA, 21 bp, Artificial Sequence
  Description of Artificial Sequence: Synthetic oligonucleotide
actaagggtggttcgcagttg

SEQ ID NO: 36571 - DNA, 21 bp, Artificial Sequence
  Description of Artificial Sequence: Synthetic oligonucleotide
ggcaccggcaacagcaacctc

SEQ ID NO: 36572 - DNA, 21 bp, Artificial Sequence
  Description of Artificial Sequence: Synthetic oligonucleotide
ggcaccagcaccagcctcaga

SEQ ID NO: 36573 - DNA, 21 bp, Artificial Sequence
  Description of Artificial Sequence: Synthetic oligonucleotide
cttggtcctcatcctacgcat

SEQ ID NO: 36574 - DNA, 21 bp, Artificial Sequence
  Description of Artificial Sequence: Synthetic oligonucleotide
gcgtcggtgagtcagcggtcg

SEQ ID NO: 36575 - DNA, 21 bp, Artificial Sequence
  Description of Artificial Sequence: Synthetic oligonucleotide
cccagcacccccaccatcaaa

SEQ ID NO: 36576 - DNA, 21 bp, Artificial Sequence
  Description of Artificial Sequence: Synthetic oligonucleotide
aggtcttctgggggtttgact

SEQ ID NO: 36577 - DNA, 21 bp, Artificial Sequence
  Description of Artificial Sequence: Synthetic oligonucleotide
tctaggtctcatgcgatgact

SEQ ID NO: 36578 - DNA, 21 bp, Artificial Sequence
  Description of Artificial Sequence: Synthetic oligonucleotide
ttcctcaaaggcaccggcagc

SEQ ID NO: 36579 - DNA, 21 bp, Artificial Sequence
  Description of Artificial Sequence: Synthetic oligonucleotide
ccttctacgtcttctgcgggg

SEQ ID NO: 36580 - DNA, 21 bp, Artificial Sequence
  Description of Artificial Sequence: Synthetic oligonucleotide
gaccccctcagaagcatgcac

SEQ ID NO: 36581 - DNA, 21 bp, Artificial Sequence
  Description of Artificial Sequence: Synthetic oligonucleotide
tatcaggtgggtgatactagg

SEQ ID NO: 36582 - DNA, 21 bp, Artificial Sequence
  Description of Artificial Sequence: Synthetic oligonucleotide
gagggttctgggaggcttact

SEQ ID NO: 36583 - DNA, 21 bp, Artificial Sequence
  Description of Artificial Sequence: Synthetic oligonucleotide
agcgacagcagaagcagaagc

SEQ ID NO: 36584 - DNA, 21 bp, Artificial Sequence
  Description of Artificial Sequence: Synthetic oligonucleotide
tcgctggagaggcttaagact

SEQ ID NO: 36585 - DNA, 21 bp, Artificial Sequence
  Description of Artificial Sequence: Synthetic oligonucleotide
accaccaacaacatccaaggc

SEQ ID NO: 36586 - DNA, 21 bp, Artificial Sequence
  Description of Artificial Sequence: Synthetic oligonucleotide
agtaatggtcagaggaaggag

SEQ ID NO: 36587 - DNA, 21 bp, Artificial Sequence
  Description of Artificial Sequence: Synthetic oligonucleotide
aaggataatactcctgggagg

SEQ ID NO: 36588 - DNA, 21 bp, Artificial Sequence
  Description of Artificial Sequence: Synthetic oligonucleotide
cagacttcgcattctgctaag

SEQ ID NO: 36589 - DNA, 21 bp, Artificial Sequence
  Description of Artificial Sequence: Synthetic oligonucleotide
ggcatgggcggcctcaaaaac

SEQ ID NO: 36590 - DNA, 21 bp, Artificial Sequence
  Description of Artificial Sequence: Synthetic oligonucleotide
catgagcgtggtcagaatggg

SEQ ID NO: 36591 - DNA, 21 bp, Artificial Sequence
  Description of Artificial Sequence: Synthetic oligonucleotide
agcaccagcaccgtccacagc

SEQ ID NO: 36592 - DNA, 21 bp, Artificial Sequence
  Description of Artificial Sequence: Synthetic oligonucleotide
ggcggccacccccccaccagc

SEQ ID NO: 36593 - DNA, 21 bp, Artificial Sequence
  Description of Artificial Sequence: Synthetic oligonucleotide
gggtctatttcgacggctcat

SEQ ID NO: 36594 - DNA, 21 bp, Artificial Sequence
  Description of Artificial Sequence: Synthetic oligonucleotide
tcgagtccgtctaagatggcg

SEQ ID NO: 36595 - DNA, 21 bp, Artificial Sequence
  Description of Artificial Sequence: Synthetic oligonucleotide
tggggtacgggtattggttct

SEQ ID NO: 36596 - DNA, 21 bp, Artificial Sequence
  Description of Artificial Sequence: Synthetic oligonucleotide
cgggctcctggtagtaatact

SEQ ID NO: 36597 - DNA, 21 bp, Artificial Sequence
  Description of Artificial Sequence: Synthetic oligonucleotide
gttgtgcctgagaggtctaag

SEQ ID NO: 36598 - DNA, 21 bp, Artificial Sequence
  Description of Artificial Sequence: Synthetic oligonucleotide
ctcggcatgagagacaacacc

SEQ ID NO: 36599 - DNA, 21 bp, Artificial Sequence
  Description of Artificial Sequence: Synthetic oligonucleotide
ggccccagcagcatcaacaga

SEQ ID NO: 36600 - DNA, 21 bp, Artificial Sequence
  Description of Artificial Sequence: Synthetic oligonucleotide
aacttcagcaaccccaccgtc

SEQ ID NO: 36601 - DNA, 21 bp, Artificial Sequence
  Description of Artificial Sequence: Synthetic oligonucleotide
actgggcgggggacggatgtg

SEQ ID NO: 36602 - DNA, 21 bp, Artificial Sequence
  Description of Artificial Sequence: Synthetic oligonucleotide
tacagagtcacccaaagcagc

SEQ ID NO: 36603 - DNA, 21 bp, Artificial Sequence
  Description of Artificial Sequence: Synthetic oligonucleotide
acgtcgaatactaagtctgtt

SEQ ID NO: 36604 - DNA, 21 bp, Artificial Sequence
  Description of Artificial Sequence: Synthetic oligonucleotide
agactcacccaaagcagccaa

SEQ ID NO: 36605 - DNA, 21 bp, Artificial Sequence
  Description of Artificial Sequence: Synthetic oligonucleotide
cccgccaacagccccgccacc

SEQ ID NO: 36606 - DNA, 21 bp, Artificial Sequence
  Description of Artificial Sequence: Synthetic oligonucleotide
cccagaagccaacccgtcccc

SEQ ID NO: 36607 - DNA, 21 bp, Artificial Sequence
  Description of Artificial Sequence: Synthetic oligonucleotide
cccgacaccctcaccagacaa

SEQ ID NO: 36608 - DNA, 21 bp, Artificial Sequence
  Description of Artificial Sequence: Synthetic oligonucleotide
aatgggcgggggtcggatgtg

SEQ ID NO: 36609 - DNA, 21 bp, Artificial Sequence
  Description of Artificial Sequence: Synthetic oligonucleotide
gcgaatggtactaagtctagt

SEQ ID NO: 36610 - DNA, 21 bp, Artificial Sequence
  Description of Artificial Sequence: Synthetic oligonucleotide
ccggggggtactacgaagggt

SEQ ID NO: 36611 - DNA, 21 bp, Artificial Sequence
  Description of Artificial Sequence: Synthetic oligonucleotide
cccacccacagcagcagagac

SEQ ID NO: 36612 - DNA, 21 bp, Artificial Sequence
  Description of Artificial Sequence: Synthetic oligonucleotide
agtggtatggcttcggttacg

SEQ ID NO: 36613 - DNA, 21 bp, Artificial Sequence
  Description of Artificial Sequence: Synthetic oligonucleotide
gggcctgttaatgctcattct

SEQ ID NO: 36614 - DNA, 21 bp, Artificial Sequence
  Description of Artificial Sequence: Synthetic oligonucleotide
ggcaacaccggcagctaccaa

SEQ ID NO: 36615 - DNA, 21 bp, Artificial Sequence
  Description of Artificial Sequence: Synthetic oligonucleotide
gccctcagcagccccgccaac

SEQ ID NO: 36616 - DNA, 21 bp, Artificial Sequence
  Description of Artificial Sequence: Synthetic oligonucleotide
cagcagtctcctcggaatggg

SEQ ID NO: 36617 - DNA, 21 bp, Artificial Sequence
  Description of Artificial Sequence: Synthetic oligonucleotide
ccttctcagactaagccgagt

SEQ ID NO: 36618 - DNA, 21 bp, Artificial Sequence
  Description of Artificial Sequence: Synthetic oligonucleotide
caaaccagcagcagagaaatg

SEQ ID NO: 36619 - DNA, 21 bp, Artificial Sequence
  Description of Artificial Sequence: Synthetic oligonucleotide
aacaccaccgccaaaagcagc

SEQ ID NO: 36620 - DNA, 21 bp, Artificial Sequence
  Description of Artificial Sequence: Synthetic oligonucleotide
gagcgggttggttcgatttct

SEQ ID NO: 36621 - DNA, 21 bp, Artificial Sequence
  Description of Artificial Sequence: Synthetic oligonucleotide
caaaccagaaccgacgtcacc

SEQ ID NO: 36622 - DNA, 21 bp, Artificial Sequence
  Description of Artificial Sequence: Synthetic oligonucleotide
ggtaatcgtccgacgacgttg

SEQ ID NO: 36623 - DNA, 21 bp, Artificial Sequence
  Description of Artificial Sequence: Synthetic oligonucleotide
gttggtactaatcatacttcg

SEQ ID NO: 36624 - DNA, 21 bp, Artificial Sequence
  Description of Artificial Sequence: Synthetic oligonucleotide
gatcatcgtaatatttcttcg

SEQ ID NO: 36625 - DNA, 21 bp, Artificial Sequence
  Description of Artificial Sequence: Synthetic oligonucleotide
aacaccagcaacaacatccaa

SEQ ID NO: 36626 - DNA, 21 bp, Artificial Sequence
  Description of Artificial Sequence: Synthetic oligonucleotide
gggacgactaattcgcgtaat

SEQ ID NO: 36627 - DNA, 21 bp, Artificial Sequence
  Description of Artificial Sequence: Synthetic oligonucleotide
tcttatgggaaggagagtagt

SEQ ID NO: 36628 - DNA, 21 bp, Artificial Sequence
  Description of Artificial Sequence: Synthetic oligonucleotide
cggagtgatacgaatcgtggg

SEQ ID NO: 36629 - DNA, 21 bp, Artificial Sequence
  Description of Artificial Sequence: Synthetic oligonucleotide
cccctcaacgccagaggcagc

SEQ ID NO: 36630 - DNA, 21 bp, Artificial Sequence
  Description of Artificial Sequence: Synthetic oligonucleotide
gatttgcatgtgcagaaggct

SEQ ID NO: 36631 - DNA, 21 bp, Artificial Sequence
  Description of Artificial Sequence: Synthetic oligonucleotide
agcggcggcacccacatcgcc

SEQ ID NO: 36632 - DNA, 21 bp, Artificial Sequence
  Description of Artificial Sequence: Synthetic oligonucleotide
agcgccagcaccagcaccctc

SEQ ID NO: 36633 - DNA, 21 bp, Artificial Sequence
  Description of Artificial Sequence: Synthetic oligonucleotide
gctgctactaggcagcctgat

SEQ ID NO: 36634 - DNA, 21 bp, Artificial Sequence
  Description of Artificial Sequence: Synthetic oligonucleotide
gtcggcagcagcagcgtcatg

SEQ ID NO: 36635 - DNA, 21 bp, Artificial Sequence
  Description of Artificial Sequence: Synthetic oligonucleotide
tcgtcgagtcctaatgttaag

SEQ ID NO: 36636 - DNA, 21 bp, Artificial Sequence
  Description of Artificial Sequence: Synthetic oligonucleotide
aacaacgcccacagcagcagc

SEQ ID NO: 36637 - DNA, 21 bp, Artificial Sequence
  Description of Artificial Sequence: Synthetic oligonucleotide
agagacagcaccaaactcgtc

SEQ ID NO: 36638 - DNA, 21 bp, Artificial Sequence
  Description of Artificial Sequence: Synthetic oligonucleotide
accctcagcagcaccggcggc

SEQ ID NO: 36639 - DNA, 21 bp, Artificial Sequence
  Description of Artificial Sequence: Synthetic oligonucleotide
agaatcggccaaggcagcagc

SEQ ID NO: 36640 - DNA, 21 bp, Artificial Sequence
  Description of Artificial Sequence: Synthetic oligonucleotide
tctatttcgcatgctcgtgag

SEQ ID NO: 36641 - DNA, 21 bp, Artificial Sequence
  Description of Artificial Sequence: Synthetic oligonucleotide
gaccccagaaacagcaccagc

SEQ ID NO: 36642 - DNA, 21 bp, Artificial Sequence
  Description of Artificial Sequence: Synthetic oligonucleotide
gatagtcatcctcgttctatt

SEQ ID NO: 36643 - DNA, 21 bp, Artificial Sequence
  Description of Artificial Sequence: Synthetic oligonucleotide
ttgccgggtcatcctcgggcg

SEQ ID NO: 36644 - DNA, 21 bp, Artificial Sequence
  Description of Artificial Sequence: Synthetic oligonucleotide
tacggttctggacagaatcaa

SEQ ID NO: 36645 - DNA, 21 bp, Artificial Sequence
  Description of Artificial Sequence: Synthetic oligonucleotide
agcgccaacagacccagcgcc

SEQ ID NO: 36646 - DNA, 21 bp, Artificial Sequence
  Description of Artificial Sequence: Synthetic oligonucleotide
acccccggcgccagcctcagc

SEQ ID NO: 36647 - DNA, 21 bp, Artificial Sequence
  Description of Artificial Sequence: Synthetic oligonucleotide
gaaggcatgggcgtccacggc

SEQ ID NO: 36648 - DNA, 21 bp, Artificial Sequence
  Description of Artificial Sequence: Synthetic oligonucleotide
acgacggcgcctgggcttcgg

SEQ ID NO: 36649 - DNA, 21 bp, Artificial Sequence
  Description of Artificial Sequence: Synthetic oligonucleotide
cccctcagcggcagcaaagcc

SEQ ID NO: 36650 - DNA, 21 bp, Artificial Sequence
  Description of Artificial Sequence: Synthetic oligonucleotide
caccaaatcagcagcctcaaa

SEQ ID NO: 36651 - DNA, 21 bp, Artificial Sequence
  Description of Artificial Sequence: Synthetic oligonucleotide
ccttctaagggtacgtatcct

SEQ ID NO: 36652 - DNA, 21 bp, Artificial Sequence
  Description of Artificial Sequence: Synthetic oligonucleotide
agcgacatgagcggccaaaga

SEQ ID NO: 36653 - DNA, 21 bp, Artificial Sequence
  Description of Artificial Sequence: Synthetic oligonucleotide
gtcgccgacaaaggcagcatg

SEQ ID NO: 36654 - DNA, 21 bp, Artificial Sequence
  Description of Artificial Sequence: Synthetic oligonucleotide
ggttatgaggctaataggggg

SEQ ID NO: 36655 - DNA, 21 bp, Artificial Sequence
  Description of Artificial Sequence: Synthetic oligonucleotide
gatgagagtggtaagtcgaag

SEQ ID NO: 36656 - DNA, 21 bp, Artificial Sequence
  Description of Artificial Sequence: Synthetic oligonucleotide
ggggttaggacggctatgtct

SEQ ID NO: 36657 - DNA, 21 bp, Artificial Sequence
  Description of Artificial Sequence: Synthetic oligonucleotide
agcggcagcaccaaaggccaa

SEQ ID NO: 36658 - DNA, 21 bp, Artificial Sequence
  Description of Artificial Sequence: Synthetic oligonucleotide
ttggggtctaatcgttattct

SEQ ID NO: 36659 - DNA, 21 bp, Artificial Sequence
  Description of Artificial Sequence: Synthetic oligonucleotide
ggcggcggcaccagcttcggc

SEQ ID NO: 36660 - DNA, 21 bp, Artificial Sequence
  Description of Artificial Sequence: Synthetic oligonucleotide
gtcaacctcagaagcaacacc

SEQ ID NO: 36661 - DNA, 21 bp, Artificial Sequence
  Description of Artificial Sequence: Synthetic oligonucleotide
ccctacgccggcaccagcccc

SEQ ID NO: 36662 - DNA, 21 bp, Artificial Sequence
  Description of Artificial Sequence: Synthetic oligonucleotide
catacgcatgatgtgggtaag

SEQ ID NO: 36663 - DNA, 21 bp, Artificial Sequence
  Description of Artificial Sequence: Synthetic oligonucleotide
accggcaccaaaagcgacaac

SEQ ID NO: 36664 - DNA, 21 bp, Artificial Sequence
  Description of Artificial Sequence: Synthetic oligonucleotide
agtaagtctacgcatcaggcg

SEQ ID NO: 36665 - DNA, 21 bp, Artificial Sequence
  Description of Artificial Sequence: Synthetic oligonucleotide
gacagcagacaaaccagcctc

SEQ ID NO: 36666 - DNA, 21 bp, Artificial Sequence
  Description of Artificial Sequence: Synthetic oligonucleotide
cttgcgccggggcatggtaat

SEQ ID NO: 36667 - DNA, 21 bp, Artificial Sequence
  Description of Artificial Sequence: Synthetic oligonucleotide
agtgtgcatggtaatcagctg

SEQ ID NO: 36668 - DNA, 21 bp, Artificial Sequence
  Description of Artificial Sequence: Synthetic oligonucleotide
tcttcgacgtctcctgggagg

SEQ ID NO: 36669 - DNA, 21 bp, Artificial Sequence
  Description of Artificial Sequence: Synthetic oligonucleotide
actaatcctactggttatcgt

SEQ ID NO: 36670 - DNA, 21 bp, Artificial Sequence
  Description of Artificial Sequence: Synthetic oligonucleotide
catgtgccgtcgaagcttgct

SEQ ID NO: 36671 - DNA, 21 bp, Artificial Sequence
  Description of Artificial Sequence: Synthetic oligonucleotide
caggtgacgggtgcgagtcat

SEQ ID NO: 36672 - DNA, 21 bp, Artificial Sequence
  Description of Artificial Sequence: Synthetic oligonucleotide
agacccggcggcaaagacggc

SEQ ID NO: 36673 - DNA, 21 bp, Artificial Sequence
  Description of Artificial Sequence: Synthetic oligonucleotide
cacaccagcaacaccagagtc

SEQ ID NO: 36674 - DNA, 21 bp, Artificial Sequence
  Description of Artificial Sequence: Synthetic oligonucleotide
agaagcaccagcagcgccccc

SEQ ID NO: 36675 - DNA, 21 bp, Artificial Sequence
  Description of Artificial Sequence: Synthetic oligonucleotide
atgggcaaccccagacacgtc

SEQ ID NO: 36676 - DNA, 21 bp, Artificial Sequence
  Description of Artificial Sequence: Synthetic oligonucleotide
actcctgcggggccgaataag

SEQ ID NO: 36677 - DNA, 21 bp, Artificial Sequence
  Description of Artificial Sequence: Synthetic oligonucleotide
agcggcggcggcaccagaacc

SEQ ID NO: 36678 - DNA, 21 bp, Artificial Sequence
  Description of Artificial Sequence: Synthetic oligonucleotide
gctgggtcgtcttcgcctgct

SEQ ID NO: 36679 - DNA, 21 bp, Artificial Sequence
  Description of Artificial Sequence: Synthetic oligonucleotide
gttagttttaagcctaatgag

SEQ ID NO: 36680 - DNA, 21 bp, Artificial Sequence
  Description of Artificial Sequence: Synthetic oligonucleotide
tcgtatcctagtcagttgaat

SEQ ID NO: 36681 - DNA, 21 bp, Artificial Sequence
  Description of Artificial Sequence: Synthetic oligonucleotide
ccttctcatatggcttcggcg

SEQ ID NO: 36682 - DNA, 21 bp, Artificial Sequence
  Description of Artificial Sequence: Synthetic oligonucleotide
cggactctttctaataatggt

SEQ ID NO: 36683 - DNA, 21 bp, Artificial Sequence
  Description of Artificial Sequence: Synthetic oligonucleotide
aacggtcctggacagaatcaa

SEQ ID NO: 36684 - DNA, 21 bp, Artificial Sequence
  Description of Artificial Sequence: Synthetic oligonucleotide
gacctcccccaccacaccaga

SEQ ID NO: 36685 - DNA, 21 bp, Artificial Sequence
  Description of Artificial Sequence: Synthetic oligonucleotide
aacggttctggacagaatcga

SEQ ID NO: 36686 - DNA, 21 bp, Artificial Sequence
  Description of Artificial Sequence: Synthetic oligonucleotide
cacggttctggacagaatcaa

SEQ ID NO: 36687 - DNA, 21 bp, Artificial Sequence
  Description of Artificial Sequence: Synthetic oligonucleotide
tctcagacggttaagactggt

SEQ ID NO: 36688 - DNA, 21 bp, Artificial Sequence
  Description of Artificial Sequence: Synthetic oligonucleotide
agcagcgcccccagcctcagc

SEQ ID NO: 36689 - DNA, 21 bp, Artificial Sequence
  Description of Artificial Sequence: Synthetic oligonucleotide
aggactttgagtgcttcgtcg

SEQ ID NO: 36690 - DNA, 21 bp, Artificial Sequence
  Description of Artificial Sequence: Synthetic oligonucleotide
catccgacttctccggcgatg

SEQ ID NO: 36691 - DNA, 21 bp, Artificial Sequence
  Description of Artificial Sequence: Synthetic oligonucleotide
gaacccagcagaagcagcacc

SEQ ID NO: 36692 - DNA, 21 bp, Artificial Sequence
  Description of Artificial Sequence: Synthetic oligonucleotide
cacaacaccgcccacgccagc

SEQ ID NO: 36693 - DNA, 21 bp, Artificial Sequence
  Description of Artificial Sequence: Synthetic oligonucleotide
caggtgacgtctattggtgct

SEQ ID NO: 36694 - DNA, 21 bp, Artificial Sequence
  Description of Artificial Sequence: Synthetic oligonucleotide
cccggcagcgtcaccggcagc

SEQ ID NO: 36695 - DNA, 21 bp, Artificial Sequence
  Description of Artificial Sequence: Synthetic oligonucleotide
cagtcgagtcgtacggttact

SEQ ID NO: 36696 - DNA, 21 bp, Artificial Sequence
  Description of Artificial Sequence: Synthetic oligonucleotide
gggcgtctgaatactaatggt

SEQ ID NO: 36697 - DNA, 21 bp, Artificial Sequence
  Description of Artificial Sequence: Synthetic oligonucleotide
accagaagccaaggcatcctc

SEQ ID NO: 36698 - DNA, 21 bp, Artificial Sequence
  Description of Artificial Sequence: Synthetic oligonucleotide
cgggatgttggttctgctgct

SEQ ID NO: 36699 - DNA, 21 bp, Artificial Sequence
  Description of Artificial Sequence: Synthetic oligonucleotide
aacggttctggacagtatcaa

SEQ ID NO: 36700 - DNA, 21 bp, Artificial Sequence
  Description of Artificial Sequence: Synthetic oligonucleotide
gctggtgcgcctaagacggat

SEQ ID NO: 36701 - DNA, 21 bp, Artificial Sequence
  Description of Artificial Sequence: Synthetic oligonucleotide
ggcaccgtcgacaaagccagc

SEQ ID NO: 36702 - DNA, 21 bp, Artificial Sequence
  Description of Artificial Sequence: Synthetic oligonucleotide
aacaaaatgaccagcgtcagc

SEQ ID NO: 36703 - DNA, 21 bp, Artificial Sequence
  Description of Artificial Sequence: Synthetic oligonucleotide
gagtttactaaggttggtgct

SEQ ID NO: 36704 - DNA, 21 bp, Artificial Sequence
  Description of Artificial Sequence: Synthetic oligonucleotide
gcgacgagtcctcggttgtct

SEQ ID NO: 36705 - DNA, 21 bp, Artificial Sequence
  Description of Artificial Sequence: Synthetic oligonucleotide
gtcacccaaagcagcagcaaa

SEQ ID NO: 36706 - DNA, 21 bp, Artificial Sequence
  Description of Artificial Sequence: Synthetic oligonucleotide
cctaagggtgttcattcgatg

SEQ ID NO: 36707 - DNA, 21 bp, Artificial Sequence
  Description of Artificial Sequence: Synthetic oligonucleotide
cgtggggtttcgactccgact

SEQ ID NO: 36708 - DNA, 21 bp, Artificial Sequence
  Description of Artificial Sequence: Synthetic oligonucleotide
gacatccccgccaaaaccgcc

SEQ ID NO: 36709 - DNA, 21 bp, Artificial Sequence
  Description of Artificial Sequence: Synthetic oligonucleotide
agtacgtctgggattcgttct

SEQ ID NO: 36710 - DNA, 21 bp, Artificial Sequence
  Description of Artificial Sequence: Synthetic oligonucleotide
tcgagggattctagtattcat

SEQ ID NO: 36711 - DNA, 21 bp, Artificial Sequence
  Description of Artificial Sequence: Synthetic oligonucleotide
aatagtacgagtacttctcag

SEQ ID NO: 36712 - DNA, 21 bp, Artificial Sequence
  Description of Artificial Sequence: Synthetic oligonucleotide
aacggtactggacagaatcaa

SEQ ID NO: 36713 - DNA, 21 bp, Artificial Sequence
  Description of Artificial Sequence: Synthetic oligonucleotide
gtcaaaagcaacaacctcccc

SEQ ID NO: 36714 - DNA, 21 bp, Artificial Sequence
  Description of Artificial Sequence: Synthetic oligonucleotide
ggccaaaccggcgacatgaga

SEQ ID NO: 36715 - DNA, 21 bp, Artificial Sequence
  Description of Artificial Sequence: Synthetic oligonucleotide
gtccaacccagaaccagcacc

SEQ ID NO: 36716 - DNA, 21 bp, Artificial Sequence
  Description of Artificial Sequence: Synthetic oligonucleotide
cagggtagttcgttgcgtact

SEQ ID NO: 36717 - DNA, 21 bp, Artificial Sequence
  Description of Artificial Sequence: Synthetic oligonucleotide
atgagaagcaaccccaccagc

SEQ ID NO: 36718 - DNA, 21 bp, Artificial Sequence
  Description of Artificial Sequence: Synthetic oligonucleotide
gagaatattagtaggtctcat

SEQ ID NO: 36719 - DNA, 21 bp, Artificial Sequence
  Description of Artificial Sequence: Synthetic oligonucleotide
gggctggcgggtcgtcttagt

SEQ ID NO: 36720 - DNA, 21 bp, Artificial Sequence
  Description of Artificial Sequence: Synthetic oligonucleotide
acgcctttgagtgcttcttgt

SEQ ID NO: 36721 - DNA, 21 bp, Artificial Sequence
  Description of Artificial Sequence: Synthetic oligonucleotide
ggccccaccgaccacaaactc

SEQ ID NO: 36722 - DNA, 21 bp, Artificial Sequence
  Description of Artificial Sequence: Synthetic oligonucleotide
gagaggtttactagttcttcg

SEQ ID NO: 36723 - DNA, 21 bp, Artificial Sequence
  Description of Artificial Sequence: Synthetic oligonucleotide
acggctgggcaggcgtcggtt

SEQ ID NO: 36724 - DNA, 21 bp, Artificial Sequence
  Description of Artificial Sequence: Synthetic oligonucleotide
agagtcatcacccccagcacc

SEQ ID NO: 36725 - DNA, 21 bp, Artificial Sequence
  Description of Artificial Sequence: Synthetic oligonucleotide
ggtacttttcagagtgggacg

SEQ ID NO: 36726 - DNA, 21 bp, Artificial Sequence
  Description of Artificial Sequence: Synthetic oligonucleotide
accgtcagcgcccccagcgcc

SEQ ID NO: 36727 - DNA, 21 bp, Artificial Sequence
  Description of Artificial Sequence: Synthetic oligonucleotide
cggccgtcgagtactcatgcg

SEQ ID NO: 36728 - DNA, 21 bp, Artificial Sequence
  Description of Artificial Sequence: Synthetic oligonucleotide
agcggcgccagcagcaacagc

SEQ ID NO: 36729 - DNA, 21 bp, Artificial Sequence
  Description of Artificial Sequence: Synthetic oligonucleotide
cctcctgtgacgactcgtcct

SEQ ID NO: 36730 - DNA, 21 bp, Artificial Sequence
  Description of Artificial Sequence: Synthetic oligonucleotide
gctttttctcattcttcgggt

SEQ ID NO: 36731 - DNA, 21 bp, Artificial Sequence
  Description of Artificial Sequence: Synthetic oligonucleotide
aacggttctggacagcatcaa

SEQ ID NO: 36732 - DNA, 21 bp, Artificial Sequence
  Description of Artificial Sequence: Synthetic oligonucleotide
aacggcagcggcctcaaccaa

SEQ ID NO: 36733 - DNA, 21 bp, Artificial Sequence
  Description of Artificial Sequence: Synthetic oligonucleotide
ctcgtcaacagcgccgtccaa

SEQ ID NO: 36734 - DNA, 21 bp, Artificial Sequence
  Description of Artificial Sequence: Synthetic oligonucleotide
cagtcgagtaatgctcggaat

SEQ ID NO: 36735 - DNA, 21 bp, Artificial Sequence
  Description of Artificial Sequence: Synthetic oligonucleotide
ggcgtcctcggcagcaaaaac

SEQ ID NO: 36736 - DNA, 21 bp, Artificial Sequence
  Description of Artificial Sequence: Synthetic oligonucleotide
agtccgaattctcatccttct

SEQ ID NO: 36737 - DNA, 21 bp, Artificial Sequence
  Description of Artificial Sequence: Synthetic oligonucleotide
acgtcttcggctaatactgtg

SEQ ID NO: 36738 - DNA, 21 bp, Artificial Sequence
  Description of Artificial Sequence: Synthetic oligonucleotide
ggttcgactaagccttctcct

SEQ ID NO: 36739 - DNA, 21 bp, Artificial Sequence
  Description of Artificial Sequence: Synthetic oligonucleotide
tacgccagcagcagagacggc

SEQ ID NO: 36740 - DNA, 21 bp, Artificial Sequence
  Description of Artificial Sequence: Synthetic oligonucleotide
aacaacgtccccctcatcaaa

SEQ ID NO: 36741 - DNA, 21 bp, Artificial Sequence
  Description of Artificial Sequence: Synthetic oligonucleotide
agtagtgcttctacttataag

SEQ ID NO: 36742 - DNA, 21 bp, Artificial Sequence
  Description of Artificial Sequence: Synthetic oligonucleotide
cggtcgggtaatggttctttg

SEQ ID NO: 36743 - DNA, 21 bp, Artificial Sequence
  Description of Artificial Sequence: Synthetic oligonucleotide
gctggtgtgacgactgttaat

SEQ ID NO: 36744 - DNA, 21 bp, Artificial Sequence
  Description of Artificial Sequence: Synthetic oligonucleotide
cctcgtactaatgttatgcct

SEQ ID NO: 36745 - DNA, 21 bp, Artificial Sequence
  Description of Artificial Sequence: Synthetic oligonucleotide
tatgcggatggtgcgcgtaat

SEQ ID NO: 36746 - DNA, 21 bp, Artificial Sequence
  Description of Artificial Sequence: Synthetic oligonucleotide
agcagcagcagaggccaaaac

SEQ ID NO: 36747 - DNA, 21 bp, Artificial Sequence
  Description of Artificial Sequence: Synthetic oligonucleotide
gtgtcgactaagagtgctcct

SEQ ID NO: 36748 - DNA, 21 bp, Artificial Sequence
  Description of Artificial Sequence: Synthetic oligonucleotide
atgggccaaggcaccctcaga

SEQ ID NO: 36749 - DNA, 21 bp, Artificial Sequence
  Description of Artificial Sequence: Synthetic oligonucleotide
aggggtacgggtattggttct

SEQ ID NO: 36750 - DNA, 21 bp, Artificial Sequence
  Description of Artificial Sequence: Synthetic oligonucleotide
tcggcgtcgcatggtgctctg

SEQ ID NO: 36751 - DNA, 21 bp, Artificial Sequence
  Description of Artificial Sequence: Synthetic oligonucleotide
tctcatcctagttcttttggg

SEQ ID NO: 36752 - DNA, 21 bp, Artificial Sequence
  Description of Artificial Sequence: Synthetic oligonucleotide
cctactcctgtttcgaatcgt

SEQ ID NO: 36753 - DNA, 21 bp, Artificial Sequence
  Description of Artificial Sequence: Synthetic oligonucleotide
tcggctgcgtctaatgggcgt

SEQ ID NO: 36754 - DNA, 21 bp, Artificial Sequence
  Description of Artificial Sequence: Synthetic oligonucleotide
gtcctccacaacgccagcagc

SEQ ID NO: 36755 - DNA, 21 bp, Artificial Sequence
  Description of Artificial Sequence: Synthetic oligonucleotide
gggcatctttcgccttctagt

SEQ ID NO: 36756 - DNA, 21 bp, Artificial Sequence
  Description of Artificial Sequence: Synthetic oligonucleotide
gctggtgcgggtatgtatgct

SEQ ID NO: 36757 - DNA, 21 bp, Artificial Sequence
  Description of Artificial Sequence: Synthetic oligonucleotide
ggtacgaatactgggattgtt

SEQ ID NO: 36758 - DNA, 21 bp, Artificial Sequence
  Description of Artificial Sequence: Synthetic oligonucleotide
agcatggacatcaaacccaga

SEQ ID NO: 36759 - DNA, 21 bp, Artificial Sequence
  Description of Artificial Sequence: Synthetic oligonucleotide
cccgccaacagccacgccacc

SEQ ID NO: 36760 - DNA, 21 bp, Artificial Sequence
  Description of Artificial Sequence: Synthetic oligonucleotide
ggtgttggtactccgcgttcg

SEQ ID NO: 36761 - DNA, 21 bp, Artificial Sequence
  Description of Artificial Sequence: Synthetic oligonucleotide
agccaacccgccggcagaagc

SEQ ID NO: 36762 - DNA, 21 bp, Artificial Sequence
  Description of Artificial Sequence: Synthetic oligonucleotide
cccggcatgaaagtcagcccc

SEQ ID NO: 36763 - DNA, 21 bp, Artificial Sequence
  Description of Artificial Sequence: Synthetic oligonucleotide
gccggcgccggcaaagtctac

SEQ ID NO: 36764 - DNA, 21 bp, Artificial Sequence
  Description of Artificial Sequence: Synthetic oligonucleotide
ggcagcctcacccccaaagcc

SEQ ID NO: 36765 - DNA, 21 bp, Artificial Sequence
  Description of Artificial Sequence: Synthetic oligonucleotide
ccccccaccctcaacaccaga

SEQ ID NO: 36766 - DNA, 21 bp, Artificial Sequence
  Description of Artificial Sequence: Synthetic oligonucleotide
gctttgccggcgaagtctgct

SEQ ID NO: 36767 - DNA, 21 bp, Artificial Sequence
  Description of Artificial Sequence: Synthetic oligonucleotide
ctcatgcccagcagcagcagc

SEQ ID NO: 36768 - DNA, 21 bp, Artificial Sequence
  Description of Artificial Sequence: Synthetic oligonucleotide
tgcctcgcccaacccagagtc

SEQ ID NO: 36769 - DNA, 21 bp, Artificial Sequence
  Description of Artificial Sequence: Synthetic oligonucleotide
cagggtacgactgctaggtcg

SEQ ID NO: 36770 - DNA, 21 bp, Artificial Sequence
  Description of Artificial Sequence: Synthetic oligonucleotide
agcgccagcaacgtcagcaga

SEQ ID NO: 36771 - DNA, 21 bp, Artificial Sequence
  Description of Artificial Sequence: Synthetic oligonucleotide
tctacggtgggtcatatgact

SEQ ID NO: 36772 - DNA, 21 bp, Artificial Sequence
  Description of Artificial Sequence: Synthetic oligonucleotide
atgggcgccgtcagcgtcagc

SEQ ID NO: 36773 - DNA, 21 bp, Artificial Sequence
  Description of Artificial Sequence: Synthetic oligonucleotide
ggcaccagcctcaaaatgagc

SEQ ID NO: 36774 - DNA, 21 bp, Artificial Sequence
  Description of Artificial Sequence: Synthetic oligonucleotide
agcagcgccggcacctacacc

SEQ ID NO: 36775 - DNA, 21 bp, Artificial Sequence
  Description of Artificial Sequence: Synthetic oligonucleotide
ggcacccccaacaccaaagtc

SEQ ID NO: 36776 - DNA, 21 bp, Artificial Sequence
  Description of Artificial Sequence: Synthetic oligonucleotide
caaaaaacccaaaccaccagc

SEQ ID NO: 36777 - DNA, 21 bp, Artificial Sequence
  Description of Artificial Sequence: Synthetic oligonucleotide
gctagtactgcgattaatcag

SEQ ID NO: 36778 - DNA, 21 bp, Artificial Sequence
  Description of Artificial Sequence: Synthetic oligonucleotide
ggtttgcatccgcctcgtact

SEQ ID NO: 36779 - DNA, 21 bp, Artificial Sequence
  Description of Artificial Sequence: Synthetic oligonucleotide
ccttctcttgagcgtgggtct

SEQ ID NO: 36780 - DNA, 21 bp, Artificial Sequence
  Description of Artificial Sequence: Synthetic oligonucleotide
atggctctgcagccgaatagg

SEQ ID NO: 36781 - DNA, 21 bp, Artificial Sequence
  Description of Artificial Sequence: Synthetic oligonucleotide
ccgaggagtactacgggtggg

SEQ ID NO: 36782 - DNA, 21 bp, Artificial Sequence
  Description of Artificial Sequence: Synthetic oligonucleotide
aacggttctagacagaatcaa

SEQ ID NO: 36783 - DNA, 21 bp, Artificial Sequence
  Description of Artificial Sequence: Synthetic oligonucleotide
gccaacgccaccccccaccac

SEQ ID NO: 36784 - DNA, 21 bp, Artificial Sequence
  Description of Artificial Sequence: Synthetic oligonucleotide
ccgaggatgcaggaggcgaat

SEQ ID NO: 36785 - DNA, 21 bp, Artificial Sequence
  Description of Artificial Sequence: Synthetic oligonucleotide
tctactacgactgcttcttct

SEQ ID NO: 36786 - DNA, 21 bp, Artificial Sequence
  Description of Artificial Sequence: Synthetic oligonucleotide
catggtgttaataagactgag

SEQ ID NO: 36787 - DNA, 21 bp, Artificial Sequence
  Description of Artificial Sequence: Synthetic oligonucleotide
accaccagcaacaaagacagc

SEQ ID NO: 36788 - DNA, 21 bp, Artificial Sequence
  Description of Artificial Sequence: Synthetic oligonucleotide
ggcaacaacaacggcagaacc

SEQ ID NO: 36789 - DNA, 21 bp, Artificial Sequence
  Description of Artificial Sequence: Synthetic oligonucleotide
agtggtgtggtgaagtctagt

SEQ ID NO: 36790 - DNA, 21 bp, Artificial Sequence
  Description of Artificial Sequence: Synthetic oligonucleotide
agcagcctcaccaccccccac

SEQ ID NO: 36791 - DNA, 21 bp, Artificial Sequence
  Description of Artificial Sequence: Synthetic oligonucleotide
tacacccaaagcaccagcaga

SEQ ID NO: 36792 - DNA, 21 bp, Artificial Sequence
  Description of Artificial Sequence: Synthetic oligonucleotide
catgtgactaagtctacggct

SEQ ID NO: 36793 - DNA, 21 bp, Artificial Sequence
  Description of Artificial Sequence: Synthetic oligonucleotide
agcagcagcaacaaacacgtc

SEQ ID NO: 36794 - DNA, 21 bp, Artificial Sequence
  Description of Artificial Sequence: Synthetic oligonucleotide
agcgaccaaagaaccgccaac

SEQ ID NO: 36795 - DNA, 21 bp, Artificial Sequence
  Description of Artificial Sequence: Synthetic oligonucleotide
aaaggttctggacagaatcaa

SEQ ID NO: 36796 - DNA, 21 bp, Artificial Sequence
  Description of Artificial Sequence: Synthetic oligonucleotide
gattctgggtttaagtctcct

SEQ ID NO: 36797 - DNA, 21 bp, Artificial Sequence
  Description of Artificial Sequence: Synthetic oligonucleotide
agcaccccccaccacaccacc

SEQ ID NO: 36798 - DNA, 21 bp, Artificial Sequence
  Description of Artificial Sequence: Synthetic oligonucleotide
aacggttctggagagaatcaa

SEQ ID NO: 36799 - DNA, 21 bp, Artificial Sequence
  Description of Artificial Sequence: Synthetic oligonucleotide
tcgtcgcctgttaggaatact

SEQ ID NO: 36800 - DNA, 21 bp, Artificial Sequence
  Description of Artificial Sequence: Synthetic oligonucleotide
tcttcgcgtactcagtctttg

SEQ ID NO: 36801 - DNA, 21 bp, Artificial Sequence
  Description of Artificial Sequence: Synthetic oligonucleotide
ggcaccaacagcaccagaggc

SEQ ID NO: 36802 - DNA, 21 bp, Artificial Sequence
  Description of Artificial Sequence: Synthetic oligonucleotide
ttgaatggtagtgctactgct

SEQ ID NO: 36803 - DNA, 21 bp, Artificial Sequence
  Description of Artificial Sequence: Synthetic oligonucleotide
agcagcccccccgtcggcaga

SEQ ID NO: 36804 - DNA, 21 bp, Artificial Sequence
  Description of Artificial Sequence: Synthetic oligonucleotide
actcatgctgctcattcttct

SEQ ID NO: 36805 - DNA, 21 bp, Artificial Sequence
  Description of Artificial Sequence: Synthetic oligonucleotide
ggttcggctcagtcgcctagg

SEQ ID NO: 36806 - DNA, 21 bp, Artificial Sequence
  Description of Artificial Sequence: Synthetic oligonucleotide
ccgattcatccgtcgagtggg

SEQ ID NO: 36807 - DNA, 21 bp, Artificial Sequence
  Description of Artificial Sequence: Synthetic oligonucleotide
aggaatcagggtgcgttgcag

SEQ ID NO: 36808 - DNA, 21 bp, Artificial Sequence
  Description of Artificial Sequence: Synthetic oligonucleotide
ggccaagtcaaccacaccacc

SEQ ID NO: 36809 - DNA, 21 bp, Artificial Sequence
  Description of Artificial Sequence: Synthetic oligonucleotide
gggtctagtcagcgttcggat

SEQ ID NO: 36810 - DNA, 21 bp, Artificial Sequence
  Description of Artificial Sequence: Synthetic oligonucleotide
acggggagggctccgtcttcg

SEQ ID NO: 36811 - DNA, 21 bp, Artificial Sequence
  Description of Artificial Sequence: Synthetic oligonucleotide
ggcggcacccccacccacaga

SEQ ID NO: 36812 - DNA, 21 bp, Artificial Sequence
  Description of Artificial Sequence: Synthetic oligonucleotide
gtcccccaagtcagcagcgcc

SEQ ID NO: 36813 - DNA, 21 bp, Artificial Sequence
  Description of Artificial Sequence: Synthetic oligonucleotide
accaacggccaagccgccaga

SEQ ID NO: 36814 - DNA, 21 bp, Artificial Sequence
  Description of Artificial Sequence: Synthetic oligonucleotide
gcgctgggtcataaccataat

SEQ ID NO: 36815 - DNA, 21 bp, Artificial Sequence
  Description of Artificial Sequence: Synthetic oligonucleotide
gggtcggggcatggtacgaat

SEQ ID NO: 36816 - DNA, 21 bp, Artificial Sequence
  Description of Artificial Sequence: Synthetic oligonucleotide
cccaccgtcagaagcagcacc

SEQ ID NO: 36817 - DNA, 21 bp, Artificial Sequence
  Description of Artificial Sequence: Synthetic oligonucleotide
agcgtcaacaccaaagccctc

SEQ ID NO: 36818 - DNA, 21 bp, Artificial Sequence
  Description of Artificial Sequence: Synthetic oligonucleotide
gagccgacgcatccgcggggt

SEQ ID NO: 36819 - DNA, 21 bp, Artificial Sequence
  Description of Artificial Sequence: Synthetic oligonucleotide
caacacagccccagaaacggc

SEQ ID NO: 36820 - DNA, 21 bp, Artificial Sequence
  Description of Artificial Sequence: Synthetic oligonucleotide
agcggcagcagcaccttcaga

SEQ ID NO: 36821 - DNA, 21 bp, Artificial Sequence
  Description of Artificial Sequence: Synthetic oligonucleotide
cacggcagcagcagcttcacc

SEQ ID NO: 36822 - DNA, 21 bp, Artificial Sequence
  Description of Artificial Sequence: Synthetic oligonucleotide
gctggttctcataagggtgtg

SEQ ID NO: 36823 - DNA, 21 bp, Artificial Sequence
  Description of Artificial Sequence: Synthetic oligonucleotide
tcttcgccgactcgtggtttg

SEQ ID NO: 36824 - DNA, 21 bp, Artificial Sequence
  Description of Artificial Sequence: Synthetic oligonucleotide
tcgcgtaattcgcctccgcag

SEQ ID NO: 36825 - DNA, 21 bp, Artificial Sequence
  Description of Artificial Sequence: Synthetic oligonucleotide
ccggtgggttcggtgcggggg

SEQ ID NO: 36826 - DNA, 21 bp, Artificial Sequence
  Description of Artificial Sequence: Synthetic oligonucleotide
ggtactggtcatcagaggtct

SEQ ID NO: 36827 - DNA, 21 bp, Artificial Sequence
  Description of Artificial Sequence: Synthetic oligonucleotide
accacccaaagcagaagcctc

SEQ ID NO: 36828 - DNA, 21 bp, Artificial Sequence
  Description of Artificial Sequence: Synthetic oligonucleotide
gcttcgagggatagggctggt

SEQ ID NO: 36829 - DNA, 21 bp, Artificial Sequence
  Description of Artificial Sequence: Synthetic oligonucleotide
actggtatgcagagtttgtcg

SEQ ID NO: 36830 - DNA, 21 bp, Artificial Sequence
  Description of Artificial Sequence: Synthetic oligonucleotide
tcttcgtcttctacgcatggt

SEQ ID NO: 36831 - DNA, 21 bp, Artificial Sequence
  Description of Artificial Sequence: Synthetic oligonucleotide
aatattagtactatgtcgaag

SEQ ID NO: 36832 - DNA, 21 bp, Artificial Sequence
  Description of Artificial Sequence: Synthetic oligonucleotide
ggtagggctcataatgtgatt

SEQ ID NO: 36833 - DNA, 21 bp, Artificial Sequence
  Description of Artificial Sequence: Synthetic oligonucleotide
tcgcctgggaataagctgctt

SEQ ID NO: 36834 - DNA, 21 bp, Artificial Sequence
  Description of Artificial Sequence: Synthetic oligonucleotide
gttcagccggtgaagatgagt

SEQ ID NO: 36835 - DNA, 21 bp, Artificial Sequence
  Description of Artificial Sequence: Synthetic oligonucleotide
cagggttcgagtaagacgact

SEQ ID NO: 36836 - DNA, 21 bp, Artificial Sequence
  Description of Artificial Sequence: Synthetic oligonucleotide
gttactaagtcgggtaatggg

SEQ ID NO: 36837 - DNA, 21 bp, Artificial Sequence
  Description of Artificial Sequence: Synthetic oligonucleotide
ggtacgtatggtgagatgagg

SEQ ID NO: 36838 - DNA, 21 bp, Artificial Sequence
  Description of Artificial Sequence: Synthetic oligonucleotide
gtcaacaccaacagagccgcc

SEQ ID NO: 36839 - DNA, 21 bp, Artificial Sequence
  Description of Artificial Sequence: Synthetic oligonucleotide
aacggttctggacagaatgaa

SEQ ID NO: 36840 - DNA, 21 bp, Artificial Sequence
  Description of Artificial Sequence: Synthetic oligonucleotide
gatgctggttctcgttcttct

SEQ ID NO: 36841 - DNA, 21 bp, Artificial Sequence
  Description of Artificial Sequence: Synthetic oligonucleotide
cccctccccgcccacagcccc

SEQ ID NO: 36842 - DNA, 21 bp, Artificial Sequence
  Description of Artificial Sequence: Synthetic oligonucleotide
actagtggtactaaggctcat

SEQ ID NO: 36843 - DNA, 21 bp, Artificial Sequence
  Description of Artificial Sequence: Synthetic oligonucleotide
ttgcagcagcataatacgaag

SEQ ID NO: 36844 - DNA, 21 bp, Artificial Sequence
  Description of Artificial Sequence: Synthetic oligonucleotide
caccaaagcagcagcagcagc

SEQ ID NO: 36845 - DNA, 21 bp, Artificial Sequence
  Description of Artificial Sequence: Synthetic oligonucleotide
ttcagagcccaagccaacgtc

SEQ ID NO: 36846 - DNA, 21 bp, Artificial Sequence
  Description of Artificial Sequence: Synthetic oligonucleotide
ccctacaacagcaaagccagc

SEQ ID NO: 36847 - DNA, 21 bp, Artificial Sequence
  Description of Artificial Sequence: Synthetic oligonucleotide
gcgcatagtaataattcgtat

SEQ ID NO: 36848 - DNA, 21 bp, Artificial Sequence
  Description of Artificial Sequence: Synthetic oligonucleotide
accaccgccagcagacccagc

SEQ ID NO: 36849 - DNA, 21 bp, Artificial Sequence
  Description of Artificial Sequence: Synthetic oligonucleotide
gtcagcaccggcaaaagcgtc

SEQ ID NO: 36850 - DNA, 21 bp, Artificial Sequence
  Description of Artificial Sequence: Synthetic oligonucleotide
ggcgccagcgtcaaccaaggc

SEQ ID NO: 36851 - DNA, 21 bp, Artificial Sequence
  Description of Artificial Sequence: Synthetic oligonucleotide
aacggttctggacagaatcta

SEQ ID NO: 36852 - DNA, 21 bp, Artificial Sequence
  Description of Artificial Sequence: Synthetic oligonucleotide
cagctgggttctacgactagg

SEQ ID NO: 36853 - DNA, 21 bp, Artificial Sequence
  Description of Artificial Sequence: Synthetic oligonucleotide
agcggcagagacaaaatcagc

SEQ ID NO: 36854 - DNA, 21 bp, Artificial Sequence
  Description of Artificial Sequence: Synthetic oligonucleotide
aacggttctgtacagaatcaa

SEQ ID NO: 36855 - DNA, 21 bp, Artificial Sequence
  Description of Artificial Sequence: Synthetic oligonucleotide
atgccgagtcagagggatggt

SEQ ID NO: 36856 - DNA, 21 bp, Artificial Sequence
  Description of Artificial Sequence: Synthetic oligonucleotide
gtcaccaccagcaccggcaga

SEQ ID NO: 36857 - DNA, 21 bp, Artificial Sequence
  Description of Artificial Sequence: Synthetic oligonucleotide
aacggttctggacataatcaa

SEQ ID NO: 36858 - DNA, 21 bp, Artificial Sequence
  Description of Artificial Sequence: Synthetic oligonucleotide
accggcatcggcagccacctc

SEQ ID NO: 36859 - DNA, 21 bp, Artificial Sequence
  Description of Artificial Sequence: Synthetic oligonucleotide
aacggttctggacggaatcaa

SEQ ID NO: 36860 - DNA, 21 bp, Artificial Sequence
  Description of Artificial Sequence: Synthetic oligonucleotide
gttcgtgagtctcgttcttct

SEQ ID NO: 36861 - DNA, 21 bp, Artificial Sequence
  Description of Artificial Sequence: Synthetic oligonucleotide
ccccaaaacctcgcccacgtc

SEQ ID NO: 36862 - DNA, 21 bp, Artificial Sequence
  Description of Artificial Sequence: Synthetic oligonucleotide
aaaaaccccagcagcgccccc

SEQ ID NO: 36863 - DNA, 21 bp, Artificial Sequence
  Description of Artificial Sequence: Synthetic oligonucleotide
aacagcggcaaacccaacgcc

SEQ ID NO: 36864 - DNA, 21 bp, Artificial Sequence
  Description of Artificial Sequence: Synthetic oligonucleotide
aacggttctggacagaagcaa

SEQ ID NO: 36865 - DNA, 21 bp, Artificial Sequence
  Description of Artificial Sequence: Synthetic oligonucleotide
aacggcgtcccccaacccaaa

SEQ ID NO: 36866 - DNA, 21 bp, Artificial Sequence
  Description of Artificial Sequence: Synthetic oligonucleotide
aacggttctggaaagaatcaa

SEQ ID NO: 36867 - DNA, 21 bp, Artificial Sequence
  Description of Artificial Sequence: Synthetic oligonucleotide
aacggttctggacaggatcaa

SEQ ID NO: 36868 - DNA, 21 bp, Artificial Sequence
  Description of Artificial Sequence: Synthetic oligonucleotide
ggcttcagcagacccaacacc

SEQ ID NO: 36869 - DNA, 21 bp, Artificial Sequence
  Description of Artificial Sequence: Synthetic oligonucleotide
tctaggcaggctacgtcgtct

SEQ ID NO: 36870 - DNA, 21 bp, Artificial Sequence
  Description of Artificial Sequence: Synthetic oligonucleotide
tacgccaacaacctcaacaga

SEQ ID NO: 36871 - DNA, 21 bp, Artificial Sequence
  Description of Artificial Sequence: Synthetic oligonucleotide
gaagtcaccaacgcccccaaa

SEQ ID NO: 36872 - DNA, 21 bp, Artificial Sequence
  Description of Artificial Sequence: Synthetic oligonucleotide
agcggcacccaaacctggagc

SEQ ID NO: 36873 - DNA, 21 bp, Artificial Sequence
  Description of Artificial Sequence: Synthetic oligonucleotide
gccgtccccgccaaaggcgcc

SEQ ID NO: 36874 - DNA, 21 bp, Artificial Sequence
  Description of Artificial Sequence: Synthetic oligonucleotide
cgtaattatacgggtgatagt

SEQ ID NO: 36875 - DNA, 21 bp, Artificial Sequence
  Description of Artificial Sequence: Synthetic oligonucleotide
aacggttttggacagaatcaa

SEQ ID NO: 36876 - DNA, 21 bp, Artificial Sequence
  Description of Artificial Sequence: Synthetic oligonucleotide
ctcagagccaccagcggcaac

SEQ ID NO: 36877 - DNA, 21 bp, Artificial Sequence
  Description of Artificial Sequence: Synthetic oligonucleotide
gccgcccaacccagcctcaaa

SEQ ID NO: 36878 - DNA, 21 bp, Artificial Sequence
  Description of Artificial Sequence: Synthetic oligonucleotide
cacatgaacagaaaactcgaa

SEQ ID NO: 36879 - DNA, 21 bp, Artificial Sequence
  Description of Artificial Sequence: Synthetic oligonucleotide
ggcgccagacccgtcctccaa

SEQ ID NO: 36880 - DNA, 21 bp, Artificial Sequence
  Description of Artificial Sequence: Synthetic oligonucleotide
cgtcatacgatgacgcatgtg

SEQ ID NO: 36881 - DNA, 21 bp, Artificial Sequence
  Description of Artificial Sequence: Synthetic oligonucleotide
ggcctcagccccgtcctcaaa

SEQ ID NO: 36882 - DNA, 21 bp, Artificial Sequence
  Description of Artificial Sequence: Synthetic oligonucleotide
caattccccggcaccctcaga

SEQ ID NO: 36883 - DNA, 21 bp, Artificial Sequence
  Description of Artificial Sequence: Synthetic oligonucleotide
cacaacctccacatgcccggc

SEQ ID NO: 36884 - DNA, 21 bp, Artificial Sequence
  Description of Artificial Sequence: Synthetic oligonucleotide
ccgaaggcgaggcagcataat

SEQ ID NO: 36885 - DNA, 21 bp, Artificial Sequence
  Description of Artificial Sequence: Synthetic oligonucleotide
cgtcctcctgtggatgctgtg

SEQ ID NO: 36886 - DNA, 21 bp, Artificial Sequence
  Description of Artificial Sequence: Synthetic oligonucleotide
aaacccaccagaagcaccgcc

SEQ ID NO: 36887 - DNA, 21 bp, Artificial Sequence
  Description of Artificial Sequence: Synthetic oligonucleotide
aattatgtgggtcagaggtct

SEQ ID NO: 36888 - DNA, 21 bp, Artificial Sequence
  Description of Artificial Sequence: Synthetic oligonucleotide
agccaagccaaaaaaaccggc

SEQ ID NO: 36889 - DNA, 21 bp, Artificial Sequence
  Description of Artificial Sequence: Synthetic oligonucleotide
tatggtaattctggtcggtat

SEQ ID NO: 36890 - DNA, 21 bp, Artificial Sequence
  Description of Artificial Sequence: Synthetic oligonucleotide
agaggccccggccacaacacc

SEQ ID NO: 36891 - DNA, 21 bp, Artificial Sequence
  Description of Artificial Sequence: Synthetic oligonucleotide
tgtgctgtttcgaagagtcgg

SEQ ID NO: 36892 - DNA, 21 bp, Artificial Sequence
  Description of Artificial Sequence: Synthetic oligonucleotide
aagcttaataagtctcaggcg

SEQ ID NO: 36893 - DNA, 21 bp, Artificial Sequence
  Description of Artificial Sequence: Synthetic oligonucleotide
gatcagaagactgttaatcgt

SEQ ID NO: 36894 - DNA, 21 bp, Artificial Sequence
  Description of Artificial Sequence: Synthetic oligonucleotide
ccggcggctcttaatgagttg

SEQ ID NO: 36895 - DNA, 21 bp, Artificial Sequence
  Description of Artificial Sequence: Synthetic oligonucleotide
aaccccggccacaaactcacc

SEQ ID NO: 36896 - DNA, 21 bp, Artificial Sequence
  Description of Artificial Sequence: Synthetic oligonucleotide
aatactcagagttatacgagg

SEQ ID NO: 36897 - DNA, 21 bp, Artificial Sequence
  Description of Artificial Sequence: Synthetic oligonucleotide
caagtcgtccccgccaccaac

SEQ ID NO: 36898 - DNA, 21 bp, Artificial Sequence
  Description of Artificial Sequence: Synthetic oligonucleotide
acggcgagttataagccttct

SEQ ID NO: 36899 - DNA, 21 bp, Artificial Sequence
  Description of Artificial Sequence: Synthetic oligonucleotide
gaaatgagagtcgaaagaccc

SEQ ID NO: 36900 - DNA, 21 bp, Artificial Sequence
  Description of Artificial Sequence: Synthetic oligonucleotide
atgaagtcgcagaagtatgct

SEQ ID NO: 36901 - DNA, 21 bp, Artificial Sequence
  Description of Artificial Sequence: Synthetic oligonucleotide
aaggattttggtcagatgcgg

SEQ ID NO: 36902 - DNA, 21 bp, Artificial Sequence
  Description of Artificial Sequence: Synthetic oligonucleotide
gagcatattggtcataatcat

SEQ ID NO: 36903 - DNA, 21 bp, Artificial Sequence
  Description of Artificial Sequence: Synthetic oligonucleotide
aataatactcagaagaattct

SEQ ID NO: 36904 - DNA, 21 bp, Artificial Sequence
  Description of Artificial Sequence: Synthetic oligonucleotide
tcttcgagtgggggtgtgaag

SEQ ID NO: 36905 - DNA, 21 bp, Artificial Sequence
  Description of Artificial Sequence: Synthetic oligonucleotide
gttagtgggactaagattgag

SEQ ID NO: 36906 - DNA, 21 bp, Artificial Sequence
  Description of Artificial Sequence: Synthetic oligonucleotide
tacggcatgagactcgtcaac

SEQ ID NO: 36907 - DNA, 21 bp, Artificial Sequence
  Description of Artificial Sequence: Synthetic oligonucleotide
cccaaactcagccacaccggc

SEQ ID NO: 36908 - DNA, 21 bp, Artificial Sequence
  Description of Artificial Sequence: Synthetic oligonucleotide
gagcggaaggttcagaattgt

SEQ ID NO: 36909 - DNA, 21 bp, Artificial Sequence
  Description of Artificial Sequence: Synthetic oligonucleotide
cctggtacgtctgatagtgtt

SEQ ID NO: 36910 - DNA, 21 bp, Artificial Sequence
  Description of Artificial Sequence: Synthetic oligonucleotide
tgtgtgtattctggtactagg

SEQ ID NO: 36911 - DNA, 21 bp, Artificial Sequence
  Description of Artificial Sequence: Synthetic oligonucleotide
agctacgtcaccaccgccggc

SEQ ID NO: 36912 - DNA, 21 bp, Artificial Sequence
  Description of Artificial Sequence: Synthetic oligonucleotide
aaaagcaacggccacagaatc

SEQ ID NO: 36913 - DNA, 21 bp, Artificial Sequence
  Description of Artificial Sequence: Synthetic oligonucleotide
ggtaatgagctggtgcatttg

SEQ ID NO: 36914 - DNA, 21 bp, Artificial Sequence
  Description of Artificial Sequence: Synthetic oligonucleotide
tctatggctcctgctggtctg

SEQ ID NO: 36915 - DNA, 21 bp, Artificial Sequence
  Description of Artificial Sequence: Synthetic oligonucleotide
caacaagaaatgagcaaaaaa

SEQ ID NO: 36916 - DNA, 21 bp, Artificial Sequence
  Description of Artificial Sequence: Synthetic oligonucleotide
aagaatcagagtcttatgtcg

SEQ ID NO: 36917 - DNA, 21 bp, Artificial Sequence
  Description of Artificial Sequence: Synthetic oligonucleotide
catgttgagcggacgggggtg

SEQ ID NO: 36918 - DNA, 21 bp, Artificial Sequence
  Description of Artificial Sequence: Synthetic oligonucleotide
ttgaaggctaatgctacgggt

SEQ ID NO: 36919 - DNA, 21 bp, Artificial Sequence
  Description of Artificial Sequence: Synthetic oligonucleotide
aacagcacccaaatcaccccc

SEQ ID NO: 36920 - DNA, 21 bp, Artificial Sequence
  Description of Artificial Sequence: Synthetic oligonucleotide
agtaagactagtaaggtgcat

SEQ ID NO: 36921 - DNA, 21 bp, Artificial Sequence
  Description of Artificial Sequence: Synthetic oligonucleotide
cgtcattatacgggtgatagt

SEQ ID NO: 36922 - DNA, 21 bp, Artificial Sequence
  Description of Artificial Sequence: Synthetic oligonucleotide
aatggtcggcctcagtttcgg

SEQ ID NO: 36923 - DNA, 21 bp, Artificial Sequence
  Description of Artificial Sequence: Synthetic oligonucleotide
aattcggttggtcatagtagg

SEQ ID NO: 36924 - DNA, 21 bp, Artificial Sequence
  Description of Artificial Sequence: Synthetic oligonucleotide
ggtccgacgccttattcgcgg

SEQ ID NO: 36925 - DNA, 21 bp, Artificial Sequence
  Description of Artificial Sequence: Synthetic oligonucleotide
tctcctggtaatgttcgtaag

SEQ ID NO: 36926 - DNA, 21 bp, Artificial Sequence
  Description of Artificial Sequence: Synthetic oligonucleotide
caaagcagcgaaaaaagacaa

SEQ ID NO: 36927 - DNA, 21 bp, Artificial Sequence
  Description of Artificial Sequence: Synthetic oligonucleotide
atcgacggccacagaaacggc

SEQ ID NO: 36928 - DNA, 21 bp, Artificial Sequence
  Description of Artificial Sequence: Synthetic oligonucleotide
ggttctcagattcctcgtatt

SEQ ID NO: 36929 - DNA, 21 bp, Artificial Sequence
  Description of Artificial Sequence: Synthetic oligonucleotide
gacagaggcagacccgccggc

SEQ ID NO: 36930 - DNA, 21 bp, Artificial Sequence
  Description of Artificial Sequence: Synthetic oligonucleotide
tctgattctcgtaatacgaat

SEQ ID NO: 36931 - DNA, 21 bp, Artificial Sequence
  Description of Artificial Sequence: Synthetic oligonucleotide
tcgcgtacgcagtcttattgt

SEQ ID NO: 36932 - DNA, 21 bp, Artificial Sequence
  Description of Artificial Sequence: Synthetic oligonucleotide
aataatcctaagaatgctgtt

SEQ ID NO: 36933 - DNA, 21 bp, Artificial Sequence
  Description of Artificial Sequence: Synthetic oligonucleotide
cccagcagcggccacagcaga

SEQ ID NO: 36934 - DNA, 21 bp, Artificial Sequence
  Description of Artificial Sequence: Synthetic oligonucleotide
ctcctcagcaacagcttcaaa

SEQ ID NO: 36935 - DNA, 21 bp, Artificial Sequence
  Description of Artificial Sequence: Synthetic oligonucleotide
ccgttgggtgctacgtttgcg

SEQ ID NO: 36936 - DNA, 21 bp, Artificial Sequence
  Description of Artificial Sequence: Synthetic oligonucleotide
cgtgttcctctttcgactatt

SEQ ID NO: 36937 - DNA, 21 bp, Artificial Sequence
  Description of Artificial Sequence: Synthetic oligonucleotide
aatctgaagaatcaggttgct

SEQ ID NO: 36938 - DNA, 21 bp, Artificial Sequence
  Description of Artificial Sequence: Synthetic oligonucleotide
gggttgcagagtcagtctcgt

SEQ ID NO: 36939 - DNA, 21 bp, Artificial Sequence
  Description of Artificial Sequence: Synthetic oligonucleotide
gccagcagagccccccccggc

SEQ ID NO: 36940 - DNA, 21 bp, Artificial Sequence
  Description of Artificial Sequence: Synthetic oligonucleotide
ggcaccgacagaaccctccac

SEQ ID NO: 36941 - DNA, 21 bp, Artificial Sequence
  Description of Artificial Sequence: Synthetic oligonucleotide
aatagtttttctcggaatagt

SEQ ID NO: 36942 - DNA, 21 bp, Artificial Sequence
  Description of Artificial Sequence: Synthetic oligonucleotide
tatattaagtctgttactaat

SEQ ID NO: 36943 - DNA, 21 bp, Artificial Sequence
  Description of Artificial Sequence: Synthetic oligonucleotide
gtgctgcgtaatatttctaag

SEQ ID NO: 36944 - DNA, 21 bp, Artificial Sequence
  Description of Artificial Sequence: Synthetic oligonucleotide
gccggccacagcggcagagac

SEQ ID NO: 36945 - DNA, 21 bp, Artificial Sequence
  Description of Artificial Sequence: Synthetic oligonucleotide
cgggagctgaagaattcttcg

SEQ ID NO: 36946 - DNA, 21 bp, Artificial Sequence
  Description of Artificial Sequence: Synthetic oligonucleotide
gctaggactaatatggtgaag

SEQ ID NO: 36947 - DNA, 21 bp, Artificial Sequence
  Description of Artificial Sequence: Synthetic oligonucleotide
atccccgccaacagcttcaaa

SEQ ID NO: 36948 - DNA, 21 bp, Artificial Sequence
  Description of Artificial Sequence: Synthetic oligonucleotide
cagactggttctaataataag

SEQ ID NO: 36949 - DNA, 21 bp, Artificial Sequence
  Description of Artificial Sequence: Synthetic oligonucleotide
cggcagccgaagaaggattcg

SEQ ID NO: 36950 - DNA, 21 bp, Artificial Sequence
  Description of Artificial Sequence: Synthetic oligonucleotide
aattcggggaggaattctgtt

SEQ ID NO: 36951 - DNA, 21 bp, Artificial Sequence
  Description of Artificial Sequence: Synthetic oligonucleotide
agcttccccgtcggcgtcggc

SEQ ID NO: 36952 - DNA, 21 bp, Artificial Sequence
  Description of Artificial Sequence: Synthetic oligonucleotide
gtcatggacgtccaacacaga

SEQ ID NO: 36953 - DNA, 21 bp, Artificial Sequence
  Description of Artificial Sequence: Synthetic oligonucleotide
tctattacgtctgttactaat

SEQ ID NO: 36954 - DNA, 21 bp, Artificial Sequence
  Description of Artificial Sequence: Synthetic oligonucleotide
aaagccggccaagaaagaacc

SEQ ID NO: 36955 - DNA, 21 bp, Artificial Sequence
  Description of Artificial Sequence: Synthetic oligonucleotide
aaccccggcagacaacaattc

SEQ ID NO: 36956 - DNA, 21 bp, Artificial Sequence
  Description of Artificial Sequence: Synthetic oligonucleotide
aagcttcctgattctaggttt

SEQ ID NO: 36957 - DNA, 21 bp, Artificial Sequence
  Description of Artificial Sequence: Synthetic oligonucleotide
cataatctgtctctggtgaag

SEQ ID NO: 36958 - DNA, 21 bp, Artificial Sequence
  Description of Artificial Sequence: Synthetic oligonucleotide
aatagtaatgggtttaataat

SEQ ID NO: 36959 - DNA, 21 bp, Artificial Sequence
  Description of Artificial Sequence: Synthetic oligonucleotide
ccgatgggtactgggaggggc

SEQ ID NO: 36960 - DNA, 21 bp, Artificial Sequence
  Description of Artificial Sequence: Synthetic oligonucleotide
gctcagacgaagggtactcag

SEQ ID NO: 36961 - DNA, 21 bp, Artificial Sequence
  Description of Artificial Sequence: Synthetic oligonucleotide
accgccacccaaaaaggccaa

SEQ ID NO: 36962 - DNA, 21 bp, Artificial Sequence
  Description of Artificial Sequence: Synthetic oligonucleotide
attcagacgcatactagtaat

SEQ ID NO: 36963 - DNA, 21 bp, Artificial Sequence
  Description of Artificial Sequence: Synthetic oligonucleotide
aatttggggattcctaagggt

SEQ ID NO: 36964 - DNA, 21 bp, Artificial Sequence
  Description of Artificial Sequence: Synthetic oligonucleotide
tctcctgctattcagaggagg

SEQ ID NO: 36965 - DNA, 21 bp, Artificial Sequence
  Description of Artificial Sequence: Synthetic oligonucleotide
ggtagtaatgctattagtggt

SEQ ID NO: 36966 - DNA, 21 bp, Artificial Sequence
  Description of Artificial Sequence: Synthetic oligonucleotide
tgtcttcattctaatgagggt

SEQ ID NO: 36967 - DNA, 21 bp, Artificial Sequence
  Description of Artificial Sequence: Synthetic oligonucleotide
aggcgtgatgataaggatagg

SEQ ID NO: 36968 - DNA, 21 bp, Artificial Sequence
  Description of Artificial Sequence: Synthetic oligonucleotide
cgtgttgttggtcagactact

SEQ ID NO: 36969 - DNA, 21 bp, Artificial Sequence
  Description of Artificial Sequence: Synthetic oligonucleotide
caagacggcagcaaaggcaaa

SEQ ID NO: 36970 - DNA, 21 bp, Artificial Sequence
  Description of Artificial Sequence: Synthetic oligonucleotide
actaggatgaataagcagact

SEQ ID NO: 36971 - DNA, 21 bp, Artificial Sequence
  Description of Artificial Sequence: Synthetic oligonucleotide
atttctggtcagcagacgact

SEQ ID NO: 36972 - DNA, 21 bp, Artificial Sequence
  Description of Artificial Sequence: Synthetic oligonucleotide
cacgtcgtcgaacaattcaaa

SEQ ID NO: 36973 - DNA, 21 bp, Artificial Sequence
  Description of Artificial Sequence: Synthetic oligonucleotide
attccttcgcggaatctgtct

SEQ ID NO: 36974 - DNA, 21 bp, Artificial Sequence
  Description of Artificial Sequence: Synthetic oligonucleotide
aatcctgttaatacgaagtct

SEQ ID NO: 36975 - DNA, 21 bp, Artificial Sequence
  Description of Artificial Sequence: Synthetic oligonucleotide
cgttattcgagggataatgtt

SEQ ID NO: 36976 - DNA, 21 bp, Artificial Sequence
  Description of Artificial Sequence: Synthetic oligonucleotide
gggcagtatgggcgtacttcg

SEQ ID NO: 36977 - DNA, 21 bp, Artificial Sequence
  Description of Artificial Sequence: Synthetic oligonucleotide
gatcggacgaatactcagagg

SEQ ID NO: 36978 - DNA, 21 bp, Artificial Sequence
  Description of Artificial Sequence: Synthetic oligonucleotide
actaattctccgagtcctggg

SEQ ID NO: 36979 - DNA, 21 bp, Artificial Sequence
  Description of Artificial Sequence: Synthetic oligonucleotide
aatccttcggagaagatgttg

SEQ ID NO: 36980 - DNA, 21 bp, Artificial Sequence
  Description of Artificial Sequence: Synthetic oligonucleotide
gacgaaagcggcaaaagcaaa

SEQ ID NO: 36981 - DNA, 21 bp, Artificial Sequence
  Description of Artificial Sequence: Synthetic oligonucleotide
cctcagcatagtgtttattcg

SEQ ID NO: 36982 - DNA, 21 bp, Artificial Sequence
  Description of Artificial Sequence: Synthetic oligonucleotide
cgtcgtgctgagctgttgact

SEQ ID NO: 36983 - DNA, 21 bp, Artificial Sequence
  Description of Artificial Sequence: Synthetic oligonucleotide
tgcccccaaagcagagaaaaa

SEQ ID NO: 36984 - DNA, 21 bp, Artificial Sequence
  Description of Artificial Sequence: Synthetic oligonucleotide
aatggtcaggcgggtaatagg

SEQ ID NO: 36985 - DNA, 21 bp, Artificial Sequence
  Description of Artificial Sequence: Synthetic oligonucleotide
accccccacgacggccaaaga

SEQ ID NO: 36986 - DNA, 21 bp, Artificial Sequence
  Description of Artificial Sequence: Synthetic oligonucleotide
tctgcgagtccgagtattaag

SEQ ID NO: 36987 - DNA, 21 bp, Artificial Sequence
  Description of Artificial Sequence: Synthetic oligonucleotide
tctgtttctgggaggcatatt

SEQ ID NO: 36988 - DNA, 21 bp, Artificial Sequence
  Description of Artificial Sequence: Synthetic oligonucleotide
aatcatggtgctgcgcagggg

SEQ ID NO: 36989 - DNA, 21 bp, Artificial Sequence
  Description of Artificial Sequence: Synthetic oligonucleotide
tctgctcagaagaatcttatt

SEQ ID NO: 36990 - DNA, 21 bp, Artificial Sequence
  Description of Artificial Sequence: Synthetic oligonucleotide
ggtcatgggggtcagtctagg

SEQ ID NO: 36991 - DNA, 21 bp, Artificial Sequence
  Description of Artificial Sequence: Synthetic oligonucleotide
atgaatatgcggagtactcat

SEQ ID NO: 36992 - DNA, 21 bp, Artificial Sequence
  Description of Artificial Sequence: Synthetic oligonucleotide
caagacaaacacaaccccggc

SEQ ID NO: 36993 - DNA, 21 bp, Artificial Sequence
  Description of Artificial Sequence: Synthetic oligonucleotide
aactgttctggacagaatcaa

SEQ ID NO: 36994 - DNA, 21 bp, Artificial Sequence
  Description of Artificial Sequence: Synthetic oligonucleotide
agtgtgggtagtggttataag

SEQ ID NO: 36995 - DNA, 21 bp, Artificial Sequence
  Description of Artificial Sequence: Synthetic oligonucleotide
ggcagaggcaaagactacaga

SEQ ID NO: 36996 - DNA, 21 bp, Artificial Sequence
  Description of Artificial Sequence: Synthetic oligonucleotide
cctgcgcatcgtaggagtgag

SEQ ID NO: 36997 - DNA, 21 bp, Artificial Sequence
  Description of Artificial Sequence: Synthetic oligonucleotide
aacgacgtcaaacaaggccac

SEQ ID NO: 36998 - DNA, 21 bp, Artificial Sequence
  Description of Artificial Sequence: Synthetic oligonucleotide
ggtatgaagggtagtgttaat

SEQ ID NO: 36999 - DNA, 21 bp, Artificial Sequence
  Description of Artificial Sequence: Synthetic oligonucleotide
cacaccagccccggcaaaaac

SEQ ID NO: 37000 - DNA, 21 bp, Artificial Sequence
  Description of Artificial Sequence: Synthetic oligonucleotide
gggcttgcggcggggtttggg

SEQ ID NO: 37001 - DNA, 21 bp, Artificial Sequence
  Description of Artificial Sequence: Synthetic oligonucleotide
gcgtcgctgcatcgtaataat

SEQ ID NO: 37002 - DNA, 21 bp, Artificial Sequence
  Description of Artificial Sequence: Synthetic oligonucleotide
gatcgtagtcgtgttctgggg

SEQ ID NO: 37003 - DNA, 21 bp, Artificial Sequence
  Description of Artificial Sequence: Synthetic oligonucleotide
cctggtgataggggtaaggtt

SEQ ID NO: 37004 - DNA, 21 bp, Artificial Sequence
  Description of Artificial Sequence: Synthetic oligonucleotide
aagacttctgagactcgttcg

SEQ ID NO: 37005 - DNA, 21 bp, Artificial Sequence
  Description of Artificial Sequence: Synthetic oligonucleotide
gttaaggtgacgcatcagcag

SEQ ID NO: 37006 - DNA, 21 bp, Artificial Sequence
  Description of Artificial Sequence: Synthetic oligonucleotide
catagtactccgtcgactagg

SEQ ID NO: 37007 - DNA, 21 bp, Artificial Sequence
  Description of Artificial Sequence: Synthetic oligonucleotide
gctctgaataatcatcgggcg

SEQ ID NO: 37008 - DNA, 21 bp, Artificial Sequence
  Description of Artificial Sequence: Synthetic oligonucleotide
aattctattactcggagtagt

SEQ ID NO: 37009 - DNA, 21 bp, Artificial Sequence
  Description of Artificial Sequence: Synthetic oligonucleotide
cccaacagaaccagcagctac

SEQ ID NO: 37010 - DNA, 21 bp, Artificial Sequence
  Description of Artificial Sequence: Synthetic oligonucleotide
agacccgaaagcagctacagc

SEQ ID NO: 37011 - DNA, 21 bp, Artificial Sequence
  Description of Artificial Sequence: Synthetic oligonucleotide
gccctcgccaacccccaaacc

SEQ ID NO: 37012 - DNA, 21 bp, Artificial Sequence
  Description of Artificial Sequence: Synthetic oligonucleotide
tgtaataatgctcgtgtttcg

SEQ ID NO: 37013 - DNA, 21 bp, Artificial Sequence
  Description of Artificial Sequence: Synthetic oligonucleotide
catcgtgatcaggtttcgctt

SEQ ID NO: 37014 - DNA, 21 bp, Artificial Sequence
  Description of Artificial Sequence: Synthetic oligonucleotide
aggggtaatgagaatattaat

SEQ ID NO: 37015 - DNA, 21 bp, Artificial Sequence
  Description of Artificial Sequence: Synthetic oligonucleotide
caaatcaaaaccatcagcgcc

SEQ ID NO: 37016 - DNA, 21 bp, Artificial Sequence
  Description of Artificial Sequence: Synthetic oligonucleotide
gatattcggaatctgcagcgg

SEQ ID NO: 37017 - DNA, 21 bp, Artificial Sequence
  Description of Artificial Sequence: Synthetic oligonucleotide
atgcttacggtgccgcagcag

SEQ ID NO: 37018 - DNA, 21 bp, Artificial Sequence
  Description of Artificial Sequence: Synthetic oligonucleotide
ctccaaagcggcggccacaga

SEQ ID NO: 37019 - DNA, 21 bp, Artificial Sequence
  Description of Artificial Sequence: Synthetic oligonucleotide
ggtccgattcggccgattcag

SEQ ID NO: 37020 - DNA, 21 bp, Artificial Sequence
  Description of Artificial Sequence: Synthetic oligonucleotide
gtttcgaatggtcagaatcct

SEQ ID NO: 37021 - DNA, 21 bp, Artificial Sequence
  Description of Artificial Sequence: Synthetic oligonucleotide
tgtcgtgggatttctggtaag

SEQ ID NO: 37022 - DNA, 21 bp, Artificial Sequence
  Description of Artificial Sequence: Synthetic oligonucleotide
tttacttatgcggaggggaat

SEQ ID NO: 37023 - DNA, 21 bp, Artificial Sequence
  Description of Artificial Sequence: Synthetic oligonucleotide
ttgacgacgcatggtatgaag

SEQ ID NO: 37024 - DNA, 21 bp, Artificial Sequence
  Description of Artificial Sequence: Synthetic oligonucleotide
gctcttttgaatattaatact

SEQ ID NO: 37025 - DNA, 21 bp, Artificial Sequence
  Description of Artificial Sequence: Synthetic oligonucleotide
cttacgtttaattcgtctggt

SEQ ID NO: 37026 - DNA, 21 bp, Artificial Sequence
  Description of Artificial Sequence: Synthetic oligonucleotide
actggggattcgcctctggct

SEQ ID NO: 37027 - DNA, 21 bp, Artificial Sequence
  Description of Artificial Sequence: Synthetic oligonucleotide
tttcattctagggatagttct

SEQ ID NO: 37028 - DNA, 21 bp, Artificial Sequence
  Description of Artificial Sequence: Synthetic oligonucleotide
gtcaaaaccgccagagccacc

SEQ ID NO: 37029 - DNA, 21 bp, Artificial Sequence
  Description of Artificial Sequence: Synthetic oligonucleotide
ggcaccgccagaaccaccggc

SEQ ID NO: 37030 - DNA, 21 bp, Artificial Sequence
  Description of Artificial Sequence: Synthetic oligonucleotide
cagcatattcagttgagtagg

SEQ ID NO: 37031 - DNA, 21 bp, Artificial Sequence
  Description of Artificial Sequence: Synthetic oligonucleotide
tctaagttgcgtacgtctact

SEQ ID NO: 37032 - DNA, 21 bp, Artificial Sequence
  Description of Artificial Sequence: Synthetic oligonucleotide
actcggagtaaggagagtcct

SEQ ID NO: 37033 - DNA, 21 bp, Artificial Sequence
  Description of Artificial Sequence: Synthetic oligonucleotide
ttgcctacgggtaagatgttg

SEQ ID NO: 37034 - DNA, 21 bp, Artificial Sequence
  Description of Artificial Sequence: Synthetic oligonucleotide
atgggcacccacagcatcggc

SEQ ID NO: 37035 - DNA, 21 bp, Artificial Sequence
  Description of Artificial Sequence: Synthetic oligonucleotide
aagtctagttctggttggact

SEQ ID NO: 37036 - DNA, 21 bp, Artificial Sequence
  Description of Artificial Sequence: Synthetic oligonucleotide
agcatcaccggcaacagaacc

SEQ ID NO: 37037 - DNA, 21 bp, Artificial Sequence
  Description of Artificial Sequence: Synthetic oligonucleotide
atgaatttgagtactgagcgt

SEQ ID NO: 37038 - DNA, 21 bp, Artificial Sequence
  Description of Artificial Sequence: Synthetic oligonucleotide
ggtcagagtctgtcggttatt

SEQ ID NO: 37039 - DNA, 21 bp, Artificial Sequence
  Description of Artificial Sequence: Synthetic oligonucleotide
aaaaacgccaccggcatcctc

SEQ ID NO: 37040 - DNA, 21 bp, Artificial Sequence
  Description of Artificial Sequence: Synthetic oligonucleotide
cccctcagagaactcaaaccc

SEQ ID NO: 37041 - DNA, 21 bp, Artificial Sequence
  Description of Artificial Sequence: Synthetic oligonucleotide
agtctgtctacgttgacgctt

SEQ ID NO: 37042 - DNA, 21 bp, Artificial Sequence
  Description of Artificial Sequence: Synthetic oligonucleotide
caagccaaaggcagcagagac

SEQ ID NO: 37043 - DNA, 21 bp, Artificial Sequence
  Description of Artificial Sequence: Synthetic oligonucleotide
aagagggttacttatacggat

SEQ ID NO: 37044 - DNA, 21 bp, Artificial Sequence
  Description of Artificial Sequence: Synthetic oligonucleotide
acccacctcaccggcgtccaa

SEQ ID NO: 37045 - DNA, 21 bp, Artificial Sequence
  Description of Artificial Sequence: Synthetic oligonucleotide
gggcatacggctaggttgtat

SEQ ID NO: 37046 - DNA, 21 bp, Artificial Sequence
  Description of Artificial Sequence: Synthetic oligonucleotide
tttgtgaagacgcatagtgcg

SEQ ID NO: 37047 - DNA, 21 bp, Artificial Sequence
  Description of Artificial Sequence: Synthetic oligonucleotide
cctggtagtgtgactgggtct

SEQ ID NO: 37048 - DNA, 21 bp, Artificial Sequence
  Description of Artificial Sequence: Synthetic oligonucleotide
cagacgggtactagttctact

SEQ ID NO: 37049 - DNA, 21 bp, Artificial Sequence
  Description of Artificial Sequence: Synthetic oligonucleotide
agcaacaacggcacccaaaaa

SEQ ID NO: 37050 - DNA, 21 bp, Artificial Sequence
  Description of Artificial Sequence: Synthetic oligonucleotide
cttggtactagtccgatgaag

SEQ ID NO: 37051 - DNA, 21 bp, Artificial Sequence
  Description of Artificial Sequence: Synthetic oligonucleotide
accagaggccaaaaaccccaa

SEQ ID NO: 37052 - DNA, 21 bp, Artificial Sequence
  Description of Artificial Sequence: Synthetic oligonucleotide
ggtcatagttcgaataatgct

SEQ ID NO: 37053 - DNA, 21 bp, Artificial Sequence
  Description of Artificial Sequence: Synthetic oligonucleotide
gctaggggtgcttctactaat

SEQ ID NO: 37054 - DNA, 21 bp, Artificial Sequence
  Description of Artificial Sequence: Synthetic oligonucleotide
atgaggcaggatacgagtaag

SEQ ID NO: 37055 - DNA, 21 bp, Artificial Sequence
  Description of Artificial Sequence: Synthetic oligonucleotide
cgtgcttctggtgttactaat

SEQ ID NO: 37056 - DNA, 21 bp, Artificial Sequence
  Description of Artificial Sequence: Synthetic oligonucleotide
ttgggggctagtactattttg

SEQ ID NO: 37057 - DNA, 21 bp, Artificial Sequence
  Description of Artificial Sequence: Synthetic oligonucleotide
tatggggggttgcataatcct

SEQ ID NO: 37058 - DNA, 21 bp, Artificial Sequence
  Description of Artificial Sequence: Synthetic oligonucleotide
gattctggttcttcgacgaag

SEQ ID NO: 37059 - DNA, 21 bp, Artificial Sequence
  Description of Artificial Sequence: Synthetic oligonucleotide
gaagccagaaaagtcaccagc

SEQ ID NO: 37060 - DNA, 21 bp, Artificial Sequence
  Description of Artificial Sequence: Synthetic oligonucleotide
gagtatcctcagcaggcgaag

SEQ ID NO: 37061 - DNA, 21 bp, Artificial Sequence
  Description of Artificial Sequence: Synthetic oligonucleotide
ggtcagaggggtgatcatctt

SEQ ID NO: 37062 - DNA, 21 bp, Artificial Sequence
  Description of Artificial Sequence: Synthetic oligonucleotide
tcttcgaggactgattcgccg

SEQ ID NO: 37063 - DNA, 21 bp, Artificial Sequence
  Description of Artificial Sequence: Synthetic oligonucleotide
ctcaacgccggcaacaccaga

SEQ ID NO: 37064 - DNA, 21 bp, Artificial Sequence
  Description of Artificial Sequence: Synthetic oligonucleotide
ccggggcagaagcagggtatt

SEQ ID NO: 37065 - DNA, 21 bp, Artificial Sequence
  Description of Artificial Sequence: Synthetic oligonucleotide
tcgcggtattctggtcattct

SEQ ID NO: 37066 - DNA, 21 bp, Artificial Sequence
  Description of Artificial Sequence: Synthetic oligonucleotide
cctgttctgggtacgatttct

SEQ ID NO: 37067 - DNA, 21 bp, Artificial Sequence
  Description of Artificial Sequence: Synthetic oligonucleotide
cagaggccgagtacgggtaat

SEQ ID NO: 37068 - DNA, 21 bp, Artificial Sequence
  Description of Artificial Sequence: Synthetic oligonucleotide
aggattgcgggtccgacggtg

SEQ ID NO: 37069 - DNA, 21 bp, Artificial Sequence
  Description of Artificial Sequence: Synthetic oligonucleotide
caaaccagcagccacgcctac

SEQ ID NO: 37070 - DNA, 21 bp, Artificial Sequence
  Description of Artificial Sequence: Synthetic oligonucleotide
aacggcaccagacaaaaccaa

SEQ ID NO: 37071 - DNA, 21 bp, Artificial Sequence
  Description of Artificial Sequence: Synthetic oligonucleotide
aatgcgaatccgtctttgagg

SEQ ID NO: 37072 - DNA, 21 bp, Artificial Sequence
  Description of Artificial Sequence: Synthetic oligonucleotide
ttcaacgaacaaagagtcagc

SEQ ID NO: 37073 - DNA, 21 bp, Artificial Sequence
  Description of Artificial Sequence: Synthetic oligonucleotide
agggttattactccttctacg

SEQ ID NO: 37074 - DNA, 21 bp, Artificial Sequence
  Description of Artificial Sequence: Synthetic oligonucleotide
gagcctgttacttctaagtct

SEQ ID NO: 37075 - DNA, 21 bp, Artificial Sequence
  Description of Artificial Sequence: Synthetic oligonucleotide
agcaacgtcgccaaaagaacc

SEQ ID NO: 37076 - DNA, 21 bp, Artificial Sequence
  Description of Artificial Sequence: Synthetic oligonucleotide
cagcgtaagtcgggtacgagt

SEQ ID NO: 37077 - DNA, 21 bp, Artificial Sequence
  Description of Artificial Sequence: Synthetic oligonucleotide
aaaggcaaaagcaccgacccc

SEQ ID NO: 37078 - DNA, 21 bp, Artificial Sequence
  Description of Artificial Sequence: Synthetic oligonucleotide
cagtatatgggggctaattct

SEQ ID NO: 37079 - DNA, 21 bp, Artificial Sequence
  Description of Artificial Sequence: Synthetic oligonucleotide
tcgagtgatcagcctaggctt

SEQ ID NO: 37080 - DNA, 21 bp, Artificial Sequence
  Description of Artificial Sequence: Synthetic oligonucleotide
ggtttttcgtcgcagcagcgg

SEQ ID NO: 37081 - DNA, 21 bp, Artificial Sequence
  Description of Artificial Sequence: Synthetic oligonucleotide
tgccacaaaagacccggcgaa

SEQ ID NO: 37082 - DNA, 21 bp, Artificial Sequence
  Description of Artificial Sequence: Synthetic oligonucleotide
gattcgactcttggtcagtct

SEQ ID NO: 37083 - DNA, 21 bp, Artificial Sequence
  Description of Artificial Sequence: Synthetic oligonucleotide
ccggggagggagaagacggtg

SEQ ID NO: 37084 - DNA, 21 bp, Artificial Sequence
  Description of Artificial Sequence: Synthetic oligonucleotide
gcggagtctggtggtagtagg

SEQ ID NO: 37085 - DNA, 21 bp, Artificial Sequence
  Description of Artificial Sequence: Synthetic oligonucleotide
cttagggatacgaatatgaat

SEQ ID NO: 37086 - DNA, 21 bp, Artificial Sequence
  Description of Artificial Sequence: Synthetic oligonucleotide
tgtccgagtacgaagagttgt

SEQ ID NO: 37087 - DNA, 21 bp, Artificial Sequence
  Description of Artificial Sequence: Synthetic oligonucleotide
cacagcagcagcaaaatccac

SEQ ID NO: 37088 - DNA, 21 bp, Artificial Sequence
  Description of Artificial Sequence: Synthetic oligonucleotide
ggcctccaaaccccccccaga

SEQ ID NO: 37089 - DNA, 21 bp, Artificial Sequence
  Description of Artificial Sequence: Synthetic oligonucleotide
gagagtaattcgagtcggggg

SEQ ID NO: 37090 - DNA, 21 bp, Artificial Sequence
  Description of Artificial Sequence: Synthetic oligonucleotide
gttactacggggggttctaag

SEQ ID NO: 37091 - DNA, 21 bp, Artificial Sequence
  Description of Artificial Sequence: Synthetic oligonucleotide
ggcagcctcgacaacagaaaa

SEQ ID NO: 37092 - DNA, 21 bp, Artificial Sequence
  Description of Artificial Sequence: Synthetic oligonucleotide
aacggcgtccaacaacccaaa

SEQ ID NO: 37093 - DNA, 21 bp, Artificial Sequence
  Description of Artificial Sequence: Synthetic oligonucleotide
caacccagccaaggccacagc

SEQ ID NO: 37094 - DNA, 21 bp, Artificial Sequence
  Description of Artificial Sequence: Synthetic oligonucleotide
ggtacggataataatacgagg

SEQ ID NO: 37095 - DNA, 21 bp, Artificial Sequence
  Description of Artificial Sequence: Synthetic oligonucleotide
catcagcctcatcagaatcag

SEQ ID NO: 37096 - DNA, 21 bp, Artificial Sequence
  Description of Artificial Sequence: Synthetic oligonucleotide
tctacggcttctgtgaatcag

SEQ ID NO: 37097 - DNA, 21 bp, Artificial Sequence
  Description of Artificial Sequence: Synthetic oligonucleotide
aatagtgcgaataagactccg

SEQ ID NO: 37098 - DNA, 21 bp, Artificial Sequence
  Description of Artificial Sequence: Synthetic oligonucleotide
aacagaagcaccgacttcaaa

SEQ ID NO: 37099 - DNA, 21 bp, Artificial Sequence
  Description of Artificial Sequence: Synthetic oligonucleotide
cttaatattgctaatagtaag

SEQ ID NO: 37100 - DNA, 21 bp, Artificial Sequence
  Description of Artificial Sequence: Synthetic oligonucleotide
tacaaccaacccgtcggcaaa

SEQ ID NO: 37101 - DNA, 21 bp, Artificial Sequence
  Description of Artificial Sequence: Synthetic oligonucleotide
aatttgggtaattctctgaag

SEQ ID NO: 37102 - DNA, 21 bp, Artificial Sequence
  Description of Artificial Sequence: Synthetic oligonucleotide
gggcctaatccgggtaatcat

SEQ ID NO: 37103 - DNA, 21 bp, Artificial Sequence
  Description of Artificial Sequence: Synthetic oligonucleotide
atgggtgggcatacgcatacg

SEQ ID NO: 37104 - DNA, 21 bp, Artificial Sequence
  Description of Artificial Sequence: Synthetic oligonucleotide
cagtcggggtcgaagcctggg

SEQ ID NO: 37105 - DNA, 21 bp, Artificial Sequence
  Description of Artificial Sequence: Synthetic oligonucleotide
tctaatgattcgaataagaag

SEQ ID NO: 37106 - DNA, 21 bp, Artificial Sequence
  Description of Artificial Sequence: Synthetic oligonucleotide
tcttcgcaggcggtttttcgg

SEQ ID NO: 37107 - DNA, 21 bp, Artificial Sequence
  Description of Artificial Sequence: Synthetic oligonucleotide
agccacgacaacggccaaagc

SEQ ID NO: 37108 - DNA, 21 bp, Artificial Sequence
  Description of Artificial Sequence: Synthetic oligonucleotide
ttcagaagcaaagaaagcgcc

SEQ ID NO: 37109 - DNA, 21 bp, Artificial Sequence
  Description of Artificial Sequence: Synthetic oligonucleotide
caaggcagcagcaaaaccacc

SEQ ID NO: 37110 - DNA, 21 bp, Artificial Sequence
  Description of Artificial Sequence: Synthetic oligonucleotide
actggtcagcagccggctact

SEQ ID NO: 37111 - DNA, 21 bp, Artificial Sequence
  Description of Artificial Sequence: Synthetic oligonucleotide
acgaataggaatacgtatgtt

SEQ ID NO: 37112 - DNA, 21 bp, Artificial Sequence
  Description of Artificial Sequence: Synthetic oligonucleotide
gctctgcagtataaggctagt

SEQ ID NO: 37113 - DNA, 21 bp, Artificial Sequence
  Description of Artificial Sequence: Synthetic oligonucleotide
ggtagtaataggaatcctctt

SEQ ID NO: 37114 - DNA, 21 bp, Artificial Sequence
  Description of Artificial Sequence: Synthetic oligonucleotide
gggactgttcctaagcctcgt

SEQ ID NO: 37115 - DNA, 21 bp, Artificial Sequence
  Description of Artificial Sequence: Synthetic oligonucleotide
ggtactggtaattctaatctt

SEQ ID NO: 37116 - DNA, 21 bp, Artificial Sequence
  Description of Artificial Sequence: Synthetic oligonucleotide
aatcgggagtcgccgcagagg

SEQ ID NO: 37117 - DNA, 21 bp, Artificial Sequence
  Description of Artificial Sequence: Synthetic oligonucleotide
tcgtcgacggtgaagagtggt

SEQ ID NO: 37118 - DNA, 21 bp, Artificial Sequence
  Description of Artificial Sequence: Synthetic oligonucleotide
ttcaacatgcaaagaagccaa

SEQ ID NO: 37119 - DNA, 21 bp, Artificial Sequence
  Description of Artificial Sequence: Synthetic oligonucleotide
cacagcgaaaacggcaacaga

SEQ ID NO: 37120 - DNA, 21 bp, Artificial Sequence
  Description of Artificial Sequence: Synthetic oligonucleotide
tcgaatgagactaagtcttcg

SEQ ID NO: 37121 - DNA, 21 bp, Artificial Sequence
  Description of Artificial Sequence: Synthetic oligonucleotide
cttcagccgtctgttattgct

SEQ ID NO: 37122 - DNA, 21 bp, Artificial Sequence
  Description of Artificial Sequence: Synthetic oligonucleotide
aatgttgcttctaattattcg

SEQ ID NO: 37123 - DNA, 21 bp, Artificial Sequence
  Description of Artificial Sequence: Synthetic oligonucleotide
atggatgggaggtcgactact

SEQ ID NO: 37124 - DNA, 21 bp, Artificial Sequence
  Description of Artificial Sequence: Synthetic oligonucleotide
tctaggaatcctaatatgatt

SEQ ID NO: 37125 - DNA, 21 bp, Artificial Sequence
  Description of Artificial Sequence: Synthetic oligonucleotide
aaattcccccccaacagcggc

SEQ ID NO: 37126 - DNA, 21 bp, Artificial Sequence
  Description of Artificial Sequence: Synthetic oligonucleotide
tgtattagggctggttcttgt

SEQ ID NO: 37127 - DNA, 21 bp, Artificial Sequence
  Description of Artificial Sequence: Synthetic oligonucleotide
gggtctcatattgcttatact

SEQ ID NO: 37128 - DNA, 21 bp, Artificial Sequence
  Description of Artificial Sequence: Synthetic oligonucleotide
tcttcgtcggcgaagtctatt

SEQ ID NO: 37129 - DNA, 21 bp, Artificial Sequence
  Description of Artificial Sequence: Synthetic oligonucleotide
gctgctcattcgactatgaat

SEQ ID NO: 37130 - DNA, 21 bp, Artificial Sequence
  Description of Artificial Sequence: Synthetic oligonucleotide
tctgtggggtctggtgctttg

SEQ ID NO: 37131 - DNA, 21 bp, Artificial Sequence
  Description of Artificial Sequence: Synthetic oligonucleotide
ccgaatggggcgcatgttacg

SEQ ID NO: 37132 - DNA, 21 bp, Artificial Sequence
  Description of Artificial Sequence: Synthetic oligonucleotide
cccgacagaagacccctcgaa

SEQ ID NO: 37133 - DNA, 21 bp, Artificial Sequence
  Description of Artificial Sequence: Synthetic oligonucleotide
tctgatcgtgggcagtctcat

SEQ ID NO: 37134 - DNA, 21 bp, Artificial Sequence
  Description of Artificial Sequence: Synthetic oligonucleotide
tcgccggttaaggggtctgtt

SEQ ID NO: 37135 - DNA, 21 bp, Artificial Sequence
  Description of Artificial Sequence: Synthetic oligonucleotide
gatgcgactaagaatcattcg

SEQ ID NO: 37136 - DNA, 21 bp, Artificial Sequence
  Description of Artificial Sequence: Synthetic oligonucleotide
gagcgtctgactcgttcttct

SEQ ID NO: 37137 - DNA, 21 bp, Artificial Sequence
  Description of Artificial Sequence: Synthetic oligonucleotide
gatagtcgtgcgggtgttcat

SEQ ID NO: 37138 - DNA, 21 bp, Artificial Sequence
  Description of Artificial Sequence: Synthetic oligonucleotide
ggccaaaccggcgacatgaga

SEQ ID NO: 37139 - DNA, 21 bp, Artificial Sequence
  Description of Artificial Sequence: Synthetic oligonucleotide
ggcagactcgaagcccaaaaa

SEQ ID NO: 37140 - DNA, 21 bp, Artificial Sequence
  Description of Artificial Sequence: Synthetic oligonucleotide
tctagtggtttgtcgtcgtct

SEQ ID NO: 37141 - DNA, 21 bp, Artificial Sequence
  Description of Artificial Sequence: Synthetic oligonucleotide
gatcctccgaagggtagtcgg

SEQ ID NO: 37142 - DNA, 21 bp, Artificial Sequence
  Description of Artificial Sequence: Synthetic oligonucleotide
ggcgaccacaacagaatcaac

SEQ ID NO: 37143 - DNA, 21 bp, Artificial Sequence
  Description of Artificial Sequence: Synthetic oligonucleotide
gccagcgccctcagaagccac

SEQ ID NO: 37144 - DNA, 21 bp, Artificial Sequence
  Description of Artificial Sequence: Synthetic oligonucleotide
tacagcacccacctcaacaac

SEQ ID NO: 37145 - DNA, 21 bp, Artificial Sequence
  Description of Artificial Sequence: Synthetic oligonucleotide
acttataatagtagtcaggcg

SEQ ID NO: 37146 - DNA, 21 bp, Artificial Sequence
  Description of Artificial Sequence: Synthetic oligonucleotide
aacggttctagacagaatcaa

SEQ ID NO: 37147 - DNA, 21 bp, Artificial Sequence
  Description of Artificial Sequence: Synthetic oligonucleotide
gttgtgcctgagaggtctaag

SEQ ID NO: 37148 - DNA, 21 bp, Artificial Sequence
  Description of Artificial Sequence: Synthetic oligonucleotide
gttgggctgcagagtccggag

SEQ ID NO: 37149 - DNA, 21 bp, Artificial Sequence
  Description of Artificial Sequence: Synthetic oligonucleotide
actattaagtctgttactaat

SEQ ID NO: 37150 - DNA, 21 bp, Artificial Sequence
  Description of Artificial Sequence: Synthetic oligonucleotide
agaaacgacaaacaaaacagc

SEQ ID NO: 37151 - DNA, 21 bp, Artificial Sequence
  Description of Artificial Sequence: Synthetic oligonucleotide
ggtgataaggggttgcagcgt

SEQ ID NO: 37152 - DNA, 21 bp, Artificial Sequence
  Description of Artificial Sequence: Synthetic oligonucleotide
tgcagcagcgacacccacaga

SEQ ID NO: 37153 - DNA, 21 bp, Artificial Sequence
  Description of Artificial Sequence: Synthetic oligonucleotide
tcggcggatcatattcggaat

SEQ ID NO: 37154 - DNA, 21 bp, Artificial Sequence
  Description of Artificial Sequence: Synthetic oligonucleotide
aatgggattagtaagtctaat

SEQ ID NO: 37155 - DNA, 21 bp, Artificial Sequence
  Description of Artificial Sequence: Synthetic oligonucleotide
agagccacccccctcagcggc

SEQ ID NO: 37156 - DNA, 21 bp, Artificial Sequence
  Description of Artificial Sequence: Synthetic oligonucleotide
gacggcggcaaccaaagaagc

SEQ ID NO: 37157 - DNA, 21 bp, Artificial Sequence
  Description of Artificial Sequence: Synthetic oligonucleotide
gtgagtgataatacttataag

SEQ ID NO: 37158 - DNA, 21 bp, Artificial Sequence
  Description of Artificial Sequence: Synthetic oligonucleotide
aacgtttctggacagaatcaa

SEQ ID NO: 37159 - DNA, 21 bp, Artificial Sequence
  Description of Artificial Sequence: Synthetic oligonucleotide
agtaatcaggttcgtcagatt

SEQ ID NO: 37160 - DNA, 21 bp, Artificial Sequence
  Description of Artificial Sequence: Synthetic oligonucleotide
ccggggggtgataggttgagg

SEQ ID NO: 37161 - DNA, 21 bp, Artificial Sequence
  Description of Artificial Sequence: Synthetic oligonucleotide
tttattaggacggcgtcgatt

SEQ ID NO: 37162 - DNA, 21 bp, Artificial Sequence
  Description of Artificial Sequence: Synthetic oligonucleotide
agcatgcacgccctccaatgc

SEQ ID NO: 37163 - DNA, 21 bp, Artificial Sequence
  Description of Artificial Sequence: Synthetic oligonucleotide
agaaccggcagctacacccaa

SEQ ID NO: 37164 - DNA, 21 bp, Artificial Sequence
  Description of Artificial Sequence: Synthetic oligonucleotide
attattaagaaggatcaggtt

SEQ ID NO: 37165 - DNA, 21 bp, Artificial Sequence
  Description of Artificial Sequence: Synthetic oligonucleotide
aggccggtggggggtctggcg

SEQ ID NO: 37166 - DNA, 21 bp, Artificial Sequence
  Description of Artificial Sequence: Synthetic oligonucleotide
gggatgggtggtttgaagaat

SEQ ID NO: 37167 - DNA, 21 bp, Artificial Sequence
  Description of Artificial Sequence: Synthetic oligonucleotide
ggtgtgattaataatgagcgg

SEQ ID NO: 37168 - DNA, 21 bp, Artificial Sequence
  Description of Artificial Sequence: Synthetic oligonucleotide
atcatcagccaaaaaggcatg

SEQ ID NO: 37169 - DNA, 21 bp, Artificial Sequence
  Description of Artificial Sequence: Synthetic oligonucleotide
ctcctcgaccaacccagaaac

SEQ ID NO: 37170 - DNA, 21 bp, Artificial Sequence
  Description of Artificial Sequence: Synthetic oligonucleotide
ggggtgactgggtctcggggt

SEQ ID NO: 37171 - DNA, 21 bp, Artificial Sequence
  Description of Artificial Sequence: Synthetic oligonucleotide
gaagtcaacaccagaagcaga

SEQ ID NO: 37172 - DNA, 21 bp, Artificial Sequence
  Description of Artificial Sequence: Synthetic oligonucleotide
aataataattctggtagtggt

SEQ ID NO: 37173 - DNA, 21 bp, Artificial Sequence
  Description of Artificial Sequence: Synthetic oligonucleotide
cttgctaagaatcctgtgatt

SEQ ID NO: 37174 - DNA, 21 bp, Artificial Sequence
  Description of Artificial Sequence: Synthetic oligonucleotide
ccggggggtactacgaagggt

SEQ ID NO: 37175 - DNA, 21 bp, Artificial Sequence
  Description of Artificial Sequence: Synthetic oligonucleotide
tggcgtagtcagcataattcg

SEQ ID NO: 37176 - DNA, 21 bp, Artificial Sequence
  Description of Artificial Sequence: Synthetic oligonucleotide
tcgcagagttctcgtagtggt

SEQ ID NO: 37177 - DNA, 21 bp, Artificial Sequence
  Description of Artificial Sequence: Synthetic oligonucleotide
ggtttgcatccgcctcgtact

SEQ ID NO: 37178 - DNA, 21 bp, Artificial Sequence
  Description of Artificial Sequence: Synthetic oligonucleotide
ggccaagaaagaaccaacatg

SEQ ID NO: 37179 - DNA, 21 bp, Artificial Sequence
  Description of Artificial Sequence: Synthetic oligonucleotide
tacctcggcaaagtccaagtc

SEQ ID NO: 37180 - DNA, 21 bp, Artificial Sequence
  Description of Artificial Sequence: Synthetic oligonucleotide
tacgccgacggcgccagaaac

SEQ ID NO: 37181 - DNA, 21 bp, Artificial Sequence
  Description of Artificial Sequence: Synthetic oligonucleotide
agtagggagcagggggttggg

SEQ ID NO: 37182 - DNA, 21 bp, Artificial Sequence
  Description of Artificial Sequence: Synthetic oligonucleotide
agcaccagcatccccggcatg

SEQ ID NO: 37183 - DNA, 21 bp, Artificial Sequence
  Description of Artificial Sequence: Synthetic oligonucleotide
ttgcatcctaaggggcagact

SEQ ID NO: 37184 - DNA, 21 bp, Artificial Sequence
  Description of Artificial Sequence: Synthetic oligonucleotide
cccagaaccgacagaaacacc

SEQ ID NO: 37185 - DNA, 21 bp, Artificial Sequence
  Description of Artificial Sequence: Synthetic oligonucleotide
cccagaagcctcagcaccagc

SEQ ID NO: 37186 - DNA, 21 bp, Artificial Sequence
  Description of Artificial Sequence: Synthetic oligonucleotide
tttccgagtaatgggcggact

SEQ ID NO: 37187 - DNA, 21 bp, Artificial Sequence
  Description of Artificial Sequence: Synthetic oligonucleotide
tcgatggcttcggcgtataag

SEQ ID NO: 37188 - DNA, 21 bp, Artificial Sequence
  Description of Artificial Sequence: Synthetic oligonucleotide
ctcgacgccggcgtcgccaga

SEQ ID NO: 37189 - DNA, 21 bp, Artificial Sequence
  Description of Artificial Sequence: Synthetic oligonucleotide
caccccagcaacaaacccctc

SEQ ID NO: 37190 - DNA, 21 bp, Artificial Sequence
  Description of Artificial Sequence: Synthetic oligonucleotide
gaaaacatcagcagaagccac

SEQ ID NO: 37191 - DNA, 21 bp, Artificial Sequence
  Description of Artificial Sequence: Synthetic oligonucleotide
atggggattgctaatattggg

SEQ ID NO: 37192 - DNA, 21 bp, Artificial Sequence
  Description of Artificial Sequence: Synthetic oligonucleotide
caaagcgaaatcgtcaacaaa

SEQ ID NO: 37193 - DNA, 21 bp, Artificial Sequence
  Description of Artificial Sequence: Synthetic oligonucleotide
ttccaaaaagaaagataccaa

SEQ ID NO: 37194 - DNA, 21 bp, Artificial Sequence
  Description of Artificial Sequence: Synthetic oligonucleotide
cccggcgccggcaacaccaga

SEQ ID NO: 37195 - DNA, 21 bp, Artificial Sequence
  Description of Artificial Sequence: Synthetic oligonucleotide
agtgttcctggggtgtctcgg

SEQ ID NO: 37196 - DNA, 21 bp, Artificial Sequence
  Description of Artificial Sequence: Synthetic oligonucleotide
cgggtgtcttcggggatgtcg

SEQ ID NO: 37197 - DNA, 21 bp, Artificial Sequence
  Description of Artificial Sequence: Synthetic oligonucleotide
cataataattctaagagtgcg

SEQ ID NO: 37198 - DNA, 21 bp, Artificial Sequence
  Description of Artificial Sequence: Synthetic oligonucleotide
gtgggggctcgtactgggggg

SEQ ID NO: 37199 - DNA, 21 bp, Artificial Sequence
  Description of Artificial Sequence: Synthetic oligonucleotide
cgtgagaataatactagttct

SEQ ID NO: 37200 - DNA, 21 bp, Artificial Sequence
  Description of Artificial Sequence: Synthetic oligonucleotide
agtccggggcgtacgcagagt

SEQ ID NO: 37201 - DNA, 21 bp, Artificial Sequence
  Description of Artificial Sequence: Synthetic oligonucleotide
aacgcccccaacagcagcggc

SEQ ID NO: 37202 - DNA, 21 bp, Artificial Sequence
  Description of Artificial Sequence: Synthetic oligonucleotide
ccggggagtgctatgttgaat

SEQ ID NO: 37203 - DNA, 21 bp, Artificial Sequence
  Description of Artificial Sequence: Synthetic oligonucleotide
catgggcagacggggctgatt

SEQ ID NO: 37204 - DNA, 21 bp, Artificial Sequence
  Description of Artificial Sequence: Synthetic oligonucleotide
agtatgatgccgagttcgtcg

SEQ ID NO: 37205 - DNA, 21 bp, Artificial Sequence
  Description of Artificial Sequence: Synthetic oligonucleotide
caaaaaacccaaaccaccagc

SEQ ID NO: 37206 - DNA, 21 bp, Artificial Sequence
  Description of Artificial Sequence: Synthetic oligonucleotide
gtccccggcaacctccccagc

SEQ ID NO: 37207 - DNA, 21 bp, Artificial Sequence
  Description of Artificial Sequence: Synthetic oligonucleotide
agttctggtagtaataggtct

SEQ ID NO: 37208 - DNA, 21 bp, Artificial Sequence
  Description of Artificial Sequence: Synthetic oligonucleotide
tctggtgttaaggctttttct

SEQ ID NO: 37209 - DNA, 21 bp, Artificial Sequence
  Description of Artificial Sequence: Synthetic oligonucleotide
aagggtgatggtagggtgatg

SEQ ID NO: 37210 - DNA, 21 bp, Artificial Sequence
  Description of Artificial Sequence: Synthetic oligonucleotide
ggcgtcgtcatcagcagcaga

SEQ ID NO: 37211 - DNA, 21 bp, Artificial Sequence
  Description of Artificial Sequence: Synthetic oligonucleotide
cggctggttccggcttctggt

SEQ ID NO: 37212 - DNA, 21 bp, Artificial Sequence
  Description of Artificial Sequence: Synthetic oligonucleotide
agggttctttcgaatgagacg

SEQ ID NO: 37213 - DNA, 21 bp, Artificial Sequence
  Description of Artificial Sequence: Synthetic oligonucleotide
atcagaaccagcaaaatgaac

SEQ ID NO: 37214 - DNA, 21 bp, Artificial Sequence
  Description of Artificial Sequence: Synthetic oligonucleotide
tggagcaccagcaaacaagtc

SEQ ID NO: 37215 - DNA, 21 bp, Artificial Sequence
  Description of Artificial Sequence: Synthetic oligonucleotide
cagccgaatgcttcgcctact

SEQ ID NO: 37216 - DNA, 21 bp, Artificial Sequence
  Description of Artificial Sequence: Synthetic oligonucleotide
tctaatgctactagggcgatt

SEQ ID NO: 37217 - DNA, 21 bp, Artificial Sequence
  Description of Artificial Sequence: Synthetic oligonucleotide
agtacgactccggggttgaag

SEQ ID NO: 37218 - DNA, 21 bp, Artificial Sequence
  Description of Artificial Sequence: Synthetic oligonucleotide
attgggactagtattaattct

SEQ ID NO: 37219 - DNA, 21 bp, Artificial Sequence
  Description of Artificial Sequence: Synthetic oligonucleotide
gaaaacagagtcaaagtcaac

SEQ ID NO: 37220 - DNA, 21 bp, Artificial Sequence
  Description of Artificial Sequence: Synthetic oligonucleotide
attggtaagaattctatggct

SEQ ID NO: 37221 - DNA, 21 bp, Artificial Sequence
  Description of Artificial Sequence: Synthetic oligonucleotide
gacaacatgagcacccccaaa

SEQ ID NO: 37222 - DNA, 21 bp, Artificial Sequence
  Description of Artificial Sequence: Synthetic oligonucleotide
tatggtcgtgggcgtgatctt

SEQ ID NO: 37223 - DNA, 21 bp, Artificial Sequence
  Description of Artificial Sequence: Synthetic oligonucleotide
ggttctcggaattcgagtgcg

SEQ ID NO: 37224 - DNA, 21 bp, Artificial Sequence
  Description of Artificial Sequence: Synthetic oligonucleotide
cacgtctaccccaaacaaagc

SEQ ID NO: 37225 - DNA, 21 bp, Artificial Sequence
  Description of Artificial Sequence: Synthetic oligonucleotide
tttaatcggtcgaaggttact

SEQ ID NO: 37226 - DNA, 21 bp, Artificial Sequence
  Description of Artificial Sequence: Synthetic oligonucleotide
ggttcgcggccgccggggact

SEQ ID NO: 37227 - DNA, 21 bp, Artificial Sequence
  Description of Artificial Sequence: Synthetic oligonucleotide
gctaatgctacgccgcatcat

SEQ ID NO: 37228 - DNA, 21 bp, Artificial Sequence
  Description of Artificial Sequence: Synthetic oligonucleotide
gtggctggggctgctcagagg

SEQ ID NO: 37229 - DNA, 21 bp, Artificial Sequence
  Description of Artificial Sequence: Synthetic oligonucleotide
ccgaaggtgagggatgggtat

SEQ ID NO: 37230 - DNA, 21 bp, Artificial Sequence
  Description of Artificial Sequence: Synthetic oligonucleotide
ccccccaacggctaccaaagc

SEQ ID NO: 37231 - DNA, 21 bp, Artificial Sequence
  Description of Artificial Sequence: Synthetic oligonucleotide
aatgtgccttctattagtagg

SEQ ID NO: 37232 - DNA, 21 bp, Artificial Sequence
  Description of Artificial Sequence: Synthetic oligonucleotide
actccgcagaattctgtgaag

SEQ ID NO: 37233 - DNA, 21 bp, Artificial Sequence
  Description of Artificial Sequence: Synthetic oligonucleotide
tctcatacgggtaatatggtt

SEQ ID NO: 37234 - DNA, 21 bp, Artificial Sequence
  Description of Artificial Sequence: Synthetic oligonucleotide
agggatcctacgcctgttcgt

SEQ ID NO: 37235 - DNA, 21 bp, Artificial Sequence
  Description of Artificial Sequence: Synthetic oligonucleotide
tatgttactagttctgggggt

SEQ ID NO: 37236 - DNA, 21 bp, Artificial Sequence
  Description of Artificial Sequence: Synthetic oligonucleotide
ggtactggtcatcagaggtct

SEQ ID NO: 37237 - DNA, 21 bp, Artificial Sequence
  Description of Artificial Sequence: Synthetic oligonucleotide
ggcagcggcatcaaaagagaa

SEQ ID NO: 37238 - DNA, 21 bp, Artificial Sequence
  Description of Artificial Sequence: Synthetic oligonucleotide
gttaagactgcgaaggttaat

SEQ ID NO: 37239 - DNA, 21 bp, Artificial Sequence
  Description of Artificial Sequence: Synthetic oligonucleotide
gtgactggtcagaatcagact

SEQ ID NO: 37240 - DNA, 21 bp, Artificial Sequence
  Description of Artificial Sequence: Synthetic oligonucleotide
tcgggtcggagtgttggtaat

SEQ ID NO: 37241 - DNA, 21 bp, Artificial Sequence
  Description of Artificial Sequence: Synthetic oligonucleotide
cctccttctacgcttaagaat

SEQ ID NO: 37242 - DNA, 21 bp, Artificial Sequence
  Description of Artificial Sequence: Synthetic oligonucleotide
cccaacctccaaagcagcaaa

SEQ ID NO: 37243 - DNA, 21 bp, Artificial Sequence
  Description of Artificial Sequence: Synthetic oligonucleotide
agagaacccagagtccaagaa

SEQ ID NO: 37244 - DNA, 21 bp, Artificial Sequence
  Description of Artificial Sequence: Synthetic oligonucleotide
aacagaagcggccaaaaccaa

SEQ ID NO: 37245 - DNA, 21 bp, Artificial Sequence
  Description of Artificial Sequence: Synthetic oligonucleotide
caagtcagcgccaaaagcgcc

SEQ ID NO: 37246 - DNA, 21 bp, Artificial Sequence
  Description of Artificial Sequence: Synthetic oligonucleotide
agtactcataagaatagtcct

SEQ ID NO: 37247 - DNA, 21 bp, Artificial Sequence
  Description of Artificial Sequence: Synthetic oligonucleotide
acgttttctaagggtactaat

SEQ ID NO: 37248 - DNA, 21 bp, Artificial Sequence
  Description of Artificial Sequence: Synthetic oligonucleotide
ggtcttgagcataatcgggct

SEQ ID NO: 37249 - DNA, 21 bp, Artificial Sequence
  Description of Artificial Sequence: Synthetic oligonucleotide
agaagcaccaaaaccgaaaac

SEQ ID NO: 37250 - DNA, 21 bp, Artificial Sequence
  Description of Artificial Sequence: Synthetic oligonucleotide
caactcggcgacagaaacaga

SEQ ID NO: 37251 - DNA, 21 bp, Artificial Sequence
  Description of Artificial Sequence: Synthetic oligonucleotide
cataatagtaagagtcagatt

SEQ ID NO: 37252 - DNA, 21 bp, Artificial Sequence
  Description of Artificial Sequence: Synthetic oligonucleotide
cccagagaaagagacagaagc

SEQ ID NO: 37253 - DNA, 21 bp, Artificial Sequence
  Description of Artificial Sequence: Synthetic oligonucleotide
caggagggtgtgcgtagttct

SEQ ID NO: 37254 - DNA, 21 bp, Artificial Sequence
  Description of Artificial Sequence: Synthetic oligonucleotide
aatgttaatggtcggactcat

SEQ ID NO: 37255 - DNA, 21 bp, Artificial Sequence
  Description of Artificial Sequence: Synthetic oligonucleotide
gctactaataagacgacgaat

SEQ ID NO: 37256 - DNA, 21 bp, Artificial Sequence
  Description of Artificial Sequence: Synthetic oligonucleotide
caaagcaccggcagagaaaga

SEQ ID NO: 37257 - DNA, 21 bp, Artificial Sequence
  Description of Artificial Sequence: Synthetic oligonucleotide
taccacagcaaaggcaccacc

SEQ ID NO: 37258 - DNA, 21 bp, Artificial Sequence
  Description of Artificial Sequence: Synthetic oligonucleotide
ggcaacagacccaccaccctc

SEQ ID NO: 37259 - DNA, 21 bp, Artificial Sequence
  Description of Artificial Sequence: Synthetic oligonucleotide
caaagaaacgtcagcgtcgtc

SEQ ID NO: 37260 - DNA, 21 bp, Artificial Sequence
  Description of Artificial Sequence: Synthetic oligonucleotide
gataatactggtcgtaatgct

SEQ ID NO: 37261 - DNA, 21 bp, Artificial Sequence
  Description of Artificial Sequence: Synthetic oligonucleotide
cagacgcaggggcagttgaag

SEQ ID NO: 37262 - DNA, 21 bp, Artificial Sequence
  Description of Artificial Sequence: Synthetic oligonucleotide
aacggttctggacagaataaa

SEQ ID NO: 37263 - DNA, 21 bp, Artificial Sequence
  Description of Artificial Sequence: Synthetic oligonucleotide
aatagtgaggcgaggcttagt

SEQ ID NO: 37264 - DNA, 21 bp, Artificial Sequence
  Description of Artificial Sequence: Synthetic oligonucleotide
ttgtgtagggctcagactggc

SEQ ID NO: 37265 - DNA, 21 bp, Artificial Sequence
  Description of Artificial Sequence: Synthetic oligonucleotide
agggatgggacgcctccgact

SEQ ID NO: 37266 - DNA, 21 bp, Artificial Sequence
  Description of Artificial Sequence: Synthetic oligonucleotide
cgtatgaatggtggtgggcct

SEQ ID NO: 37267 - DNA, 21 bp, Artificial Sequence
  Description of Artificial Sequence: Synthetic oligonucleotide
gctggtcgtactcattcgtgt

SEQ ID NO: 37268 - DNA, 21 bp, Artificial Sequence
  Description of Artificial Sequence: Synthetic oligonucleotide
aaaagagacgcccacaccgcc

SEQ ID NO: 37269 - DNA, 21 bp, Artificial Sequence
  Description of Artificial Sequence: Synthetic oligonucleotide
acttctatgaatggtaataag

SEQ ID NO: 37270 - DNA, 21 bp, Artificial Sequence
  Description of Artificial Sequence: Synthetic oligonucleotide
caagaacaccccgacagaaga

SEQ ID NO: 37271 - DNA, 21 bp, Artificial Sequence
  Description of Artificial Sequence: Synthetic oligonucleotide
cagtcgaagattccgcatccg

SEQ ID NO: 37272 - DNA, 21 bp, Artificial Sequence
  Description of Artificial Sequence: Synthetic oligonucleotide
gtctgcagccccgaaggcaaa

SEQ ID NO: 37273 - DNA, 21 bp, Artificial Sequence
  Description of Artificial Sequence: Synthetic oligonucleotide
cagttgaatgaggagcatggg

SEQ ID NO: 37274 - DNA, 21 bp, Artificial Sequence
  Description of Artificial Sequence: Synthetic oligonucleotide
gaaaccaccacccccagaaaa

SEQ ID NO: 37275 - DNA, 21 bp, Artificial Sequence
  Description of Artificial Sequence: Synthetic oligonucleotide
gagatgaaggggcatacggct

SEQ ID NO: 37276 - DNA, 21 bp, Artificial Sequence
  Description of Artificial Sequence: Synthetic oligonucleotide
accaacagaggcggcaccccc

SEQ ID NO: 37277 - DNA, 21 bp, Artificial Sequence
  Description of Artificial Sequence: Synthetic oligonucleotide
tctggttcgaataattttttg

SEQ ID NO: 37278 - DNA, 21 bp, Artificial Sequence
  Description of Artificial Sequence: Synthetic oligonucleotide
agttctgctaagagttcgctt

SEQ ID NO: 37279 - DNA, 21 bp, Artificial Sequence
  Description of Artificial Sequence: Synthetic oligonucleotide
tgggcgggtagtaatccgcgt

SEQ ID NO: 37280 - DNA, 21 bp, Artificial Sequence
  Description of Artificial Sequence: Synthetic oligonucleotide
aacaacaaaagcgccagccaa

SEQ ID NO: 37281 - DNA, 21 bp, Artificial Sequence
  Description of Artificial Sequence: Synthetic oligonucleotide
aaaagcgcccaaggcggcaac

SEQ ID NO: 37282 - DNA, 21 bp, Artificial Sequence
  Description of Artificial Sequence: Synthetic oligonucleotide
tctagtgggccgtcttctggg

SEQ ID NO: 37283 - DNA, 21 bp, Artificial Sequence
  Description of Artificial Sequence: Synthetic oligonucleotide
gaaaccctccccagcctcatc

SEQ ID NO: 37284 - DNA, 21 bp, Artificial Sequence
  Description of Artificial Sequence: Synthetic oligonucleotide
caagccaacaccagcaccgaa

SEQ ID NO: 37285 - DNA, 21 bp, Artificial Sequence
  Description of Artificial Sequence: Synthetic oligonucleotide
gggattaataagaatggtact

SEQ ID NO: 37286 - DNA, 21 bp, Artificial Sequence
  Description of Artificial Sequence: Synthetic oligonucleotide
agacccatgaaaagcaccaac

SEQ ID NO: 37287 - DNA, 21 bp, Artificial Sequence
  Description of Artificial Sequence: Synthetic oligonucleotide
cctgagattggtaagcagcgg

SEQ ID NO: 37288 - DNA, 21 bp, Artificial Sequence
  Description of Artificial Sequence: Synthetic oligonucleotide
aaggtggataagaggactgat

SEQ ID NO: 37289 - DNA, 21 bp, Artificial Sequence
  Description of Artificial Sequence: Synthetic oligonucleotide
attccgcttactctgagtctt

SEQ ID NO: 37290 - DNA, 21 bp, Artificial Sequence
  Description of Artificial Sequence: Synthetic oligonucleotide
tttcctctgaagctggggagg

SEQ ID NO: 37291 - DNA, 21 bp, Artificial Sequence
  Description of Artificial Sequence: Synthetic oligonucleotide
ctgtctcgtagtaagcagggt

SEQ ID NO: 37292 - DNA, 21 bp, Artificial Sequence
  Description of Artificial Sequence: Synthetic oligonucleotide
gataagccggctgggtctctg

SEQ ID NO: 37293 - DNA, 21 bp, Artificial Sequence
  Description of Artificial Sequence: Synthetic oligonucleotide
ctgaatcctaatgttgctcgt

SEQ ID NO: 37294 - DNA, 21 bp, Artificial Sequence
  Description of Artificial Sequence: Synthetic oligonucleotide
caaagcaaagccggcaacagc

SEQ ID NO: 37295 - DNA, 21 bp, Artificial Sequence
  Description of Artificial Sequence: Synthetic oligonucleotide
cccaacagagtccccaaccac

SEQ ID NO: 37296 - DNA, 21 bp, Artificial Sequence
  Description of Artificial Sequence: Synthetic oligonucleotide
actactattccgaagcgtcag

SEQ ID NO: 37297 - DNA, 21 bp, Artificial Sequence
  Description of Artificial Sequence: Synthetic oligonucleotide
tttggggatcatactcgtacg

SEQ ID NO: 37298 - DNA, 21 bp, Artificial Sequence
  Description of Artificial Sequence: Synthetic oligonucleotide
cccagaatcagcggcaacctc

SEQ ID NO: 37299 - DNA, 21 bp, Artificial Sequence
  Description of Artificial Sequence: Synthetic oligonucleotide
cggaataatccgactacggtt

SEQ ID NO: 37300 - DNA, 21 bp, Artificial Sequence
  Description of Artificial Sequence: Synthetic oligonucleotide
gctactactaaggatggtatt

SEQ ID NO: 37301 - DNA, 21 bp, Artificial Sequence
  Description of Artificial Sequence: Synthetic oligonucleotide
agtaagccgagtggttcttct

SEQ ID NO: 37302 - DNA, 21 bp, Artificial Sequence
  Description of Artificial Sequence: Synthetic oligonucleotide
cccagcaccaaaaccagagtc

SEQ ID NO: 37303 - DNA, 21 bp, Artificial Sequence
  Description of Artificial Sequence: Synthetic oligonucleotide
gatccgttggggaagcagggt

SEQ ID NO: 37304 - DNA, 21 bp, Artificial Sequence
  Description of Artificial Sequence: Synthetic oligonucleotide
catactcgtcctaattcgatg

SEQ ID NO: 37305 - DNA, 21 bp, Artificial Sequence
  Description of Artificial Sequence: Synthetic oligonucleotide
acccaaagccacaacctcgcc

SEQ ID NO: 37306 - DNA, 21 bp, Artificial Sequence
  Description of Artificial Sequence: Synthetic oligonucleotide
ctcggcaaaagcgcccacagc

SEQ ID NO: 37307 - DNA, 21 bp, Artificial Sequence
  Description of Artificial Sequence: Synthetic oligonucleotide
cataatgggcgtaatgtgagt

SEQ ID NO: 37308 - DNA, 21 bp, Artificial Sequence
  Description of Artificial Sequence: Synthetic oligonucleotide
tataataatggtggtactcgt

SEQ ID NO: 37309 - DNA, 21 bp, Artificial Sequence
  Description of Artificial Sequence: Synthetic oligonucleotide
tcgactactgctcaggttaag

SEQ ID NO: 37310 - DNA, 21 bp, Artificial Sequence
  Description of Artificial Sequence: Synthetic oligonucleotide
ttcagaaacaacggcagccac

SEQ ID NO: 37311 - DNA, 21 bp, Artificial Sequence
  Description of Artificial Sequence: Synthetic oligonucleotide
ggccaaatcaaaaacctcggc

SEQ ID NO: 37312 - DNA, 21 bp, Artificial Sequence
  Description of Artificial Sequence: Synthetic oligonucleotide
aatccggtggctgcggctacg

SEQ ID NO: 37313 - DNA, 21 bp, Artificial Sequence
  Description of Artificial Sequence: Synthetic oligonucleotide
cccagcgccggcagagaaaaa

SEQ ID NO: 37314 - DNA, 21 bp, Artificial Sequence
  Description of Artificial Sequence: Synthetic oligonucleotide
actggggtttcgcctctggct

SEQ ID NO: 37315 - DNA, 21 bp, Artificial Sequence
  Description of Artificial Sequence: Synthetic oligonucleotide
ttccccgtcaacgccggcgcc

SEQ ID NO: 37316 - DNA, 21 bp, Artificial Sequence
  Description of Artificial Sequence: Synthetic oligonucleotide
tcttttagtggggctaataag

SEQ ID NO: 37317 - DNA, 21 bp, Artificial Sequence
  Description of Artificial Sequence: Synthetic oligonucleotide
aagcagggtgggcctactggg

SEQ ID NO: 37318 - DNA, 21 bp, Artificial Sequence
  Description of Artificial Sequence: Synthetic oligonucleotide
acgaagtctactagtcatgtt

SEQ ID NO: 37319 - DNA, 21 bp, Artificial Sequence
  Description of Artificial Sequence: Synthetic oligonucleotide
gggtctattaaggcgccgcct

SEQ ID NO: 37320 - DNA, 21 bp, Artificial Sequence
  Description of Artificial Sequence: Synthetic oligonucleotide
tatgggctgccgagtagtcgt

SEQ ID NO: 37321 - DNA, 21 bp, Artificial Sequence
  Description of Artificial Sequence: Synthetic oligonucleotide
cgtcaggatagtactcctggg

SEQ ID NO: 37322 - DNA, 21 bp, Artificial Sequence
  Description of Artificial Sequence: Synthetic oligonucleotide
cccaccctcgccagcggcaga

SEQ ID NO: 37323 - DNA, 21 bp, Artificial Sequence
  Description of Artificial Sequence: Synthetic oligonucleotide
aatcctggttcgggttatggt

SEQ ID NO: 37324 - DNA, 21 bp, Artificial Sequence
  Description of Artificial Sequence: Synthetic oligonucleotide
ttggttgcgtcggggcagaag

SEQ ID NO: 37325 - DNA, 21 bp, Artificial Sequence
  Description of Artificial Sequence: Synthetic oligonucleotide
ggcctccccaccgaaaaaatg

SEQ ID NO: 37326 - DNA, 21 bp, Artificial Sequence
  Description of Artificial Sequence: Synthetic oligonucleotide
accgtcggcaccaccaccatc

SEQ ID NO: 37327 - DNA, 21 bp, Artificial Sequence
  Description of Artificial Sequence: Synthetic oligonucleotide
cctagtgtgaataggactcct

SEQ ID NO: 37328 - DNA, 21 bp, Artificial Sequence
  Description of Artificial Sequence: Synthetic oligonucleotide
cttggtactagtcagatgaag

SEQ ID NO: 37329 - DNA, 21 bp, Artificial Sequence
  Description of Artificial Sequence: Synthetic oligonucleotide
cagaagactaataagctttat

SEQ ID NO: 37330 - DNA, 21 bp, Artificial Sequence
  Description of Artificial Sequence: Synthetic oligonucleotide
acgagtaagcctaattctccg

SEQ ID NO: 37331 - DNA, 21 bp, Artificial Sequence
  Description of Artificial Sequence: Synthetic oligonucleotide
acgtctacgcagaagggtcag

SEQ ID NO: 37332 - DNA, 21 bp, Artificial Sequence
  Description of Artificial Sequence: Synthetic oligonucleotide
agtatttcgaatcagcgtagt

SEQ ID NO: 37333 - DNA, 21 bp, Artificial Sequence
  Description of Artificial Sequence: Synthetic oligonucleotide
tatactattacgccgcagaag

SEQ ID NO: 37334 - DNA, 21 bp, Artificial Sequence
  Description of Artificial Sequence: Synthetic oligonucleotide
ttggggattcgtgataatact

SEQ ID NO: 37335 - DNA, 21 bp, Artificial Sequence
  Description of Artificial Sequence: Synthetic oligonucleotide
aaagtcagcgcccaagccctc

SEQ ID NO: 37336 - DNA, 21 bp, Artificial Sequence
  Description of Artificial Sequence: Synthetic oligonucleotide
ccgtctacgtttacggaggtt

SEQ ID NO: 37337 - DNA, 21 bp, Artificial Sequence
  Description of Artificial Sequence: Synthetic oligonucleotide
aacagaagcaaagaaagcgcc

SEQ ID NO: 37338 - DNA, 21 bp, Artificial Sequence
  Description of Artificial Sequence: Synthetic oligonucleotide
tcgcataattcgaaggtttct

SEQ ID NO: 37339 - DNA, 21 bp, Artificial Sequence
  Description of Artificial Sequence: Synthetic oligonucleotide
gaaacccccaacagaagccaa

SEQ ID NO: 37340 - DNA, 21 bp, Artificial Sequence
  Description of Artificial Sequence: Synthetic oligonucleotide
gagactaagcgttctaatatg

SEQ ID NO: 37341 - DNA, 21 bp, Artificial Sequence
  Description of Artificial Sequence: Synthetic oligonucleotide
ctccctagttttaggcctcct

SEQ ID NO: 37342 - DNA, 21 bp, Artificial Sequence
  Description of Artificial Sequence: Synthetic oligonucleotide
ccggggactgggagtaatcat

SEQ ID NO: 37343 - DNA, 21 bp, Artificial Sequence
  Description of Artificial Sequence: Synthetic oligonucleotide
cctggtagtagggctcttact

SEQ ID NO: 37344 - DNA, 21 bp, Artificial Sequence
  Description of Artificial Sequence: Synthetic oligonucleotide
aataatagtcgggttcttggg

SEQ ID NO: 37345 - DNA, 21 bp, Artificial Sequence
  Description of Artificial Sequence: Synthetic oligonucleotide
atgaacagagcccccaccaac

SEQ ID NO: 37346 - DNA, 21 bp, Artificial Sequence
  Description of Artificial Sequence: Synthetic oligonucleotide
ggtccgcatactgcggttggt

SEQ ID NO: 37347 - DNA, 21 bp, Artificial Sequence
  Description of Artificial Sequence: Synthetic oligonucleotide
cagtcgcattcggggatttct

SEQ ID NO: 37348 - DNA, 21 bp, Artificial Sequence
  Description of Artificial Sequence: Synthetic oligonucleotide
catgggggtcctggtgctgtt

SEQ ID NO: 37349 - DNA, 21 bp, Artificial Sequence
  Description of Artificial Sequence: Synthetic oligonucleotide
ctcaacagagcccacaccagc

SEQ ID NO: 37350 - DNA, 21 bp, Artificial Sequence
  Description of Artificial Sequence: Synthetic oligonucleotide
gccggcagcaaaaccaccagc

SEQ ID NO: 37351 - DNA, 21 bp, Artificial Sequence
  Description of Artificial Sequence: Synthetic oligonucleotide
gaactcatgaacaaaagcaaa

SEQ ID NO: 37352 - DNA, 21 bp, Artificial Sequence
  Description of Artificial Sequence: Synthetic oligonucleotide
gagggttctgggaggcttact

SEQ ID NO: 37353 - DNA, 21 bp, Artificial Sequence
  Description of Artificial Sequence: Synthetic oligonucleotide
gccgtcggcaaaagcaccgaa

SEQ ID NO: 37354 - DNA, 21 bp, Artificial Sequence
  Description of Artificial Sequence: Synthetic oligonucleotide
tatcgttcgaaggagattggt

SEQ ID NO: 37355 - DNA, 21 bp, Artificial Sequence
  Description of Artificial Sequence: Synthetic oligonucleotide
agcagaaacagccccccccaa

SEQ ID NO: 37356 - DNA, 21 bp, Artificial Sequence
  Description of Artificial Sequence: Synthetic oligonucleotide
accggttctggacagaatcaa

SEQ ID NO: 37357 - DNA, 21 bp, Artificial Sequence
  Description of Artificial Sequence: Synthetic oligonucleotide
cccaacaaccaaagcaccaga

SEQ ID NO: 37358 - DNA, 21 bp, Artificial Sequence
  Description of Artificial Sequence: Synthetic oligonucleotide
gggacttttagtactcagagt

SEQ ID NO: 37359 - DNA, 21 bp, Artificial Sequence
  Description of Artificial Sequence: Synthetic oligonucleotide
aatatttcgtctaaggttgcg

SEQ ID NO: 37360 - DNA, 21 bp, Artificial Sequence
  Description of Artificial Sequence: Synthetic oligonucleotide
caagccgtcgccagacaagcc

SEQ ID NO: 37361 - DNA, 21 bp, Artificial Sequence
  Description of Artificial Sequence: Synthetic oligonucleotide
cctttggagcgtactactaag

SEQ ID NO: 37362 - DNA, 21 bp, Artificial Sequence
  Description of Artificial Sequence: Synthetic oligonucleotide
taccaaaccaacaacaaacac

SEQ ID NO: 37363 - DNA, 21 bp, Artificial Sequence
  Description of Artificial Sequence: Synthetic oligonucleotide
agaaccgacacccacagcctc

SEQ ID NO: 37364 - DNA, 21 bp, Artificial Sequence
  Description of Artificial Sequence: Synthetic oligonucleotide
agttttagggctcaggagggg

SEQ ID NO: 37365 - DNA, 21 bp, Artificial Sequence
  Description of Artificial Sequence: Synthetic oligonucleotide
accaccggcggccacgccctc

SEQ ID NO: 37366 - DNA, 21 bp, Artificial Sequence
  Description of Artificial Sequence: Synthetic oligonucleotide
atgagcagcaaacaagtcagc

SEQ ID NO: 37367 - DNA, 21 bp, Artificial Sequence
  Description of Artificial Sequence: Synthetic oligonucleotide
ccgtataatgttaggcctgct

SEQ ID NO: 37368 - DNA, 21 bp, Artificial Sequence
  Description of Artificial Sequence: Synthetic oligonucleotide
caacaaagccccagaaacggc

SEQ ID NO: 37369 - DNA, 21 bp, Artificial Sequence
  Description of Artificial Sequence: Synthetic oligonucleotide
accaccatgagcaaagtcggc

SEQ ID NO: 37370 - DNA, 21 bp, Artificial Sequence
  Description of Artificial Sequence: Synthetic oligonucleotide
ccttataattctaaggcttcg

SEQ ID NO: 37371 - DNA, 21 bp, Artificial Sequence
  Description of Artificial Sequence: Synthetic oligonucleotide
cgggctattacgcagtctaat

SEQ ID NO: 37372 - DNA, 21 bp, Artificial Sequence
  Description of Artificial Sequence: Synthetic oligonucleotide
cggcatgcttctgatttttat

SEQ ID NO: 37373 - DNA, 21 bp, Artificial Sequence
  Description of Artificial Sequence: Synthetic oligonucleotide
aacacccaaagctacaccagc

SEQ ID NO: 37374 - DNA, 21 bp, Artificial Sequence
  Description of Artificial Sequence: Synthetic oligonucleotide
cccaccgacagaatcaacaga

SEQ ID NO: 37375 - DNA, 21 bp, Artificial Sequence
  Description of Artificial Sequence: Synthetic oligonucleotide
aacgcccaacaagcccaaaga

SEQ ID NO: 37376 - DNA, 21 bp, Artificial Sequence
  Description of Artificial Sequence: Synthetic oligonucleotide
atgagcctcagcaaaaaccac

SEQ ID NO: 37377 - DNA, 21 bp, Artificial Sequence
  Description of Artificial Sequence: Synthetic oligonucleotide
gctactactagtcgtattagt

SEQ ID NO: 37378 - DNA, 21 bp, Artificial Sequence
  Description of Artificial Sequence: Synthetic oligonucleotide
tctttgggttctggttttcag

SEQ ID NO: 37379 - DNA, 21 bp, Artificial Sequence
  Description of Artificial Sequence: Synthetic oligonucleotide
gaggggcttaatactagtcgt

SEQ ID NO: 37380 - DNA, 21 bp, Artificial Sequence
  Description of Artificial Sequence: Synthetic oligonucleotide
tcttcgcaggaggttttgcgg

SEQ ID NO: 37381 - DNA, 21 bp, Artificial Sequence
  Description of Artificial Sequence: Synthetic oligonucleotide
cgtgcgacggagggtgttttt

SEQ ID NO: 37382 - DNA, 21 bp, Artificial Sequence
  Description of Artificial Sequence: Synthetic oligonucleotide
ggcaccaccagcagcagagac

SEQ ID NO: 37383 - DNA, 21 bp, Artificial Sequence
  Description of Artificial Sequence: Synthetic oligonucleotide
aatcgtcaggggattctgtct

SEQ ID NO: 37384 - DNA, 21 bp, Artificial Sequence
  Description of Artificial Sequence: Synthetic oligonucleotide
agcaccaccaaagacggcatc

SEQ ID NO: 37385 - DNA, 21 bp, Artificial Sequence
  Description of Artificial Sequence: Synthetic oligonucleotide
agaagcggcagcgtcaacccc

SEQ ID NO: 37386 - DNA, 21 bp, Artificial Sequence
  Description of Artificial Sequence: Synthetic oligonucleotide
gatacgaataagactagttat

SEQ ID NO: 37387 - DNA, 21 bp, Artificial Sequence
  Description of Artificial Sequence: Synthetic oligonucleotide
cttcctgggcagttgaggact

SEQ ID NO: 37388 - DNA, 21 bp, Artificial Sequence
  Description of Artificial Sequence: Synthetic oligonucleotide
actacttcgggtgctgggcgt

SEQ ID NO: 37389 - DNA, 21 bp, Artificial Sequence
  Description of Artificial Sequence: Synthetic oligonucleotide
gccttcggcggcgaaaccaaa

SEQ ID NO: 37390 - DNA, 21 bp, Artificial Sequence
  Description of Artificial Sequence: Synthetic oligonucleotide
tctactggtgttcgggtgggg

SEQ ID NO: 37391 - DNA, 21 bp, Artificial Sequence
  Description of Artificial Sequence: Synthetic oligonucleotide
cctgcgcgtgatagtaagtcg

SEQ ID NO: 37392 - DNA, 21 bp, Artificial Sequence
  Description of Artificial Sequence: Synthetic oligonucleotide
gggcatcctacgaatacgact

SEQ ID NO: 37393 - DNA, 21 bp, Artificial Sequence
  Description of Artificial Sequence: Synthetic oligonucleotide
tcgagtgcggggacttatact

SEQ ID NO: 37394 - DNA, 21 bp, Artificial Sequence
  Description of Artificial Sequence: Synthetic oligonucleotide
actccgattactcctatgact

SEQ ID NO: 37395 - DNA, 21 bp, Artificial Sequence
  Description of Artificial Sequence: Synthetic oligonucleotide
attaggtcgaaggcgtctgcg

SEQ ID NO: 37396 - DNA, 21 bp, Artificial Sequence
  Description of Artificial Sequence: Synthetic oligonucleotide
cctgttggttcgagtggtcct

SEQ ID NO: 37397 - DNA, 21 bp, Artificial Sequence
  Description of Artificial Sequence: Synthetic oligonucleotide
actcagcagcatgggagtaat

SEQ ID NO: 37398 - DNA, 21 bp, Artificial Sequence
  Description of Artificial Sequence: Synthetic oligonucleotide
agtactacgaatagtaagaat

SEQ ID NO: 37399 - DNA, 21 bp, Artificial Sequence
  Description of Artificial Sequence: Synthetic oligonucleotide
cctggtagttcgaataggaat

SEQ ID NO: 37400 - DNA, 21 bp, Artificial Sequence
  Description of Artificial Sequence: Synthetic oligonucleotide
cccatcggcagccaacacatc

SEQ ID NO: 37401 - DNA, 21 bp, Artificial Sequence
  Description of Artificial Sequence: Synthetic oligonucleotide
aataatgctcatagttcgtct

SEQ ID NO: 37402 - DNA, 21 bp, Artificial Sequence
  Description of Artificial Sequence: Synthetic oligonucleotide
aatacgcttcaggggcatcgg

SEQ ID NO: 37403 - DNA, 21 bp, Artificial Sequence
  Description of Artificial Sequence: Synthetic oligonucleotide
tacaacagaagcgaaagaccc

SEQ ID NO: 37404 - DNA, 21 bp, Artificial Sequence
  Description of Artificial Sequence: Synthetic oligonucleotide
ccgacgaagggggctaatgcg

SEQ ID NO: 37405 - DNA, 21 bp, Artificial Sequence
  Description of Artificial Sequence: Synthetic oligonucleotide
ccgctgggtcagtcttatcgg

SEQ ID NO: 37406 - DNA, 21 bp, Artificial Sequence
  Description of Artificial Sequence: Synthetic oligonucleotide
actaatccgaagtcgtcttct

SEQ ID NO: 37407 - DNA, 21 bp, Artificial Sequence
  Description of Artificial Sequence: Synthetic oligonucleotide
gccgaacaaagacccggccaa

SEQ ID NO: 37408 - DNA, 21 bp, Artificial Sequence
  Description of Artificial Sequence: Synthetic oligonucleotide
gatcctcgtaattctacgtct

SEQ ID NO: 37409 - DNA, 21 bp, Artificial Sequence
  Description of Artificial Sequence: Synthetic oligonucleotide
gtgagtactcggagtatttcg

SEQ ID NO: 37410 - DNA, 21 bp, Artificial Sequence
  Description of Artificial Sequence: Synthetic oligonucleotide
tggagaaccagcaaagccacc

SEQ ID NO: 37411 - DNA, 21 bp, Artificial Sequence
  Description of Artificial Sequence: Synthetic oligonucleotide
tatactgggagtcagtatatg

SEQ ID NO: 37412 - DNA, 21 bp, Artificial Sequence
  Description of Artificial Sequence: Synthetic oligonucleotide
tgtggtcgtcctcagattcgt

SEQ ID NO: 37413 - DNA, 21 bp, Artificial Sequence
  Description of Artificial Sequence: Synthetic oligonucleotide
gtcttcaacagaaacgccagc

SEQ ID NO: 37414 - DNA, 21 bp, Artificial Sequence
  Description of Artificial Sequence: Synthetic oligonucleotide
ggtacttctgggggtattgtt

SEQ ID NO: 37415 - DNA, 21 bp, Artificial Sequence
  Description of Artificial Sequence: Synthetic oligonucleotide
cgtgttgtgacgaataatctg

SEQ ID NO: 37416 - DNA, 21 bp, Artificial Sequence
  Description of Artificial Sequence: Synthetic oligonucleotide
caaaccagaagcgccgaaaga

SEQ ID NO: 37417 - DNA, 21 bp, Artificial Sequence
  Description of Artificial Sequence: Synthetic oligonucleotide
ctgaatcattcgaagtattcg

SEQ ID NO: 37418 - DNA, 21 bp, Artificial Sequence
  Description of Artificial Sequence: Synthetic oligonucleotide
gccaccaaccacagcccccaa

SEQ ID NO: 37419 - DNA, 21 bp, Artificial Sequence
  Description of Artificial Sequence: Synthetic oligonucleotide
tgttcgaatcagcgtatgctg

SEQ ID NO: 37420 - DNA, 21 bp, Artificial Sequence
  Description of Artificial Sequence: Synthetic oligonucleotide
cacggttctggacagaatcaa

SEQ ID NO: 37421 - DNA, 21 bp, Artificial Sequence
  Description of Artificial Sequence: Synthetic oligonucleotide
cctgggactacgagtgtgggg

SEQ ID NO: 37422 - DNA, 21 bp, Artificial Sequence
  Description of Artificial Sequence: Synthetic oligonucleotide
attggtaataagcagtcgcag

SEQ ID NO: 37423 - DNA, 21 bp, Artificial Sequence
  Description of Artificial Sequence: Synthetic oligonucleotide
aatccgggtaaggggtcgtct

SEQ ID NO: 37424 - DNA, 21 bp, Artificial Sequence
  Description of Artificial Sequence: Synthetic oligonucleotide
aattctaatactcgtggtcct

SEQ ID NO: 37425 - DNA, 21 bp, Artificial Sequence
  Description of Artificial Sequence: Synthetic oligonucleotide
gcgggttcgtctcctcctacg

SEQ ID NO: 37426 - DNA, 21 bp, Artificial Sequence
  Description of Artificial Sequence: Synthetic oligonucleotide
caaaaccaaaacagcggcaga

SEQ ID NO: 37427 - DNA, 21 bp, Artificial Sequence
  Description of Artificial Sequence: Synthetic oligonucleotide
agtatggcgaatacggtggct

SEQ ID NO: 37428 - DNA, 21 bp, Artificial Sequence
  Description of Artificial Sequence: Synthetic oligonucleotide
gtccaaagaagcagcaaccaa

SEQ ID NO: 37429 - DNA, 21 bp, Artificial Sequence
  Description of Artificial Sequence: Synthetic oligonucleotide
aatggtaatatttctattggg

SEQ ID NO: 37430 - DNA, 21 bp, Artificial Sequence
  Description of Artificial Sequence: Synthetic oligonucleotide
tcgcctgagaagaatatgcgg

SEQ ID NO: 37431 - DNA, 21 bp, Artificial Sequence
  Description of Artificial Sequence: Synthetic oligonucleotide
caagacatgagactcagcggc

SEQ ID NO: 37432 - DNA, 21 bp, Artificial Sequence
  Description of Artificial Sequence: Synthetic oligonucleotide
ggtaatgggatttctactaag

SEQ ID NO: 37433 - DNA, 21 bp, Artificial Sequence
  Description of Artificial Sequence: Synthetic oligonucleotide
tttcagccgaggagttctacg

SEQ ID NO: 37434 - DNA, 21 bp, Artificial Sequence
  Description of Artificial Sequence: Synthetic oligonucleotide
gaccccgtcaccagacaaagc

SEQ ID NO: 37435 - DNA, 21 bp, Artificial Sequence
  Description of Artificial Sequence: Synthetic oligonucleotide
tcgatttctcattcgtctagt

SEQ ID NO: 37436 - DNA, 21 bp, Artificial Sequence
  Description of Artificial Sequence: Synthetic oligonucleotide
ccgggtaatatgacgagtcgt

SEQ ID NO: 37437 - DNA, 21 bp, Artificial Sequence
  Description of Artificial Sequence: Synthetic oligonucleotide
ctctgcgccagcaaatgcgac

SEQ ID NO: 37438 - DNA, 21 bp, Artificial Sequence
  Description of Artificial Sequence: Synthetic oligonucleotide
aacgattctggacagaatcaa

SEQ ID NO: 37439 - DNA, 21 bp, Artificial Sequence
  Description of Artificial Sequence: Synthetic oligonucleotide
cccagcaacagcggcaacaac

SEQ ID NO: 37440 - DNA, 21 bp, Artificial Sequence
  Description of Artificial Sequence: Synthetic oligonucleotide
cgtcagaatggtggtgtgaag

SEQ ID NO: 37441 - DNA, 21 bp, Artificial Sequence
  Description of Artificial Sequence: Synthetic oligonucleotide
accagcgaaagacccacctgc

SEQ ID NO: 37442 - DNA, 21 bp, Artificial Sequence
  Description of Artificial Sequence: Synthetic oligonucleotide
accagatacgacaacgtcggc

SEQ ID NO: 37443 - DNA, 21 bp, Artificial Sequence
  Description of Artificial Sequence: Synthetic oligonucleotide
ggcgccggcagagccctccaa

SEQ ID NO: 37444 - DNA, 21 bp, Artificial Sequence
  Description of Artificial Sequence: Synthetic oligonucleotide
aacggcgtcccccaccccaaa

SEQ ID NO: 37445 - DNA, 21 bp, Artificial Sequence
  Description of Artificial Sequence: Synthetic oligonucleotide
ccttctactcagtcgagttct

SEQ ID NO: 37446 - DNA, 21 bp, Artificial Sequence
  Description of Artificial Sequence: Synthetic oligonucleotide
actaagccgggggttggttct

SEQ ID NO: 37447 - DNA, 21 bp, Artificial Sequence
  Description of Artificial Sequence: Synthetic oligonucleotide
agcatcaaaaccgtcaccaac

SEQ ID NO: 37448 - DNA, 21 bp, Artificial Sequence
  Description of Artificial Sequence: Synthetic oligonucleotide
agacaaagcaccaacatcggc

SEQ ID NO: 37449 - DNA, 21 bp, Artificial Sequence
  Description of Artificial Sequence: Synthetic oligonucleotide
cccaccagccaacaaagaccc

SEQ ID NO: 37450 - DNA, 21 bp, Artificial Sequence
  Description of Artificial Sequence: Synthetic oligonucleotide
ccgacggttcaggttacgaag

SEQ ID NO: 37451 - DNA, 21 bp, Artificial Sequence
  Description of Artificial Sequence: Synthetic oligonucleotide
aatacgtctaataatattcag

SEQ ID NO: 37452 - DNA, 21 bp, Artificial Sequence
  Description of Artificial Sequence: Synthetic oligonucleotide
cagccggcggggaaggtggtt

SEQ ID NO: 37453 - DNA, 21 bp, Artificial Sequence
  Description of Artificial Sequence: Synthetic oligonucleotide
gttcgtgagtctcgttcttct

SEQ ID NO: 37454 - DNA, 21 bp, Artificial Sequence
  Description of Artificial Sequence: Synthetic oligonucleotide
atgggttctgtggcgatgctt

SEQ ID NO: 37455 - DNA, 21 bp, Artificial Sequence
  Description of Artificial Sequence: Synthetic oligonucleotide
cttcctggtcagggtgttggt

SEQ ID NO: 37456 - DNA, 21 bp, Artificial Sequence
  Description of Artificial Sequence: Synthetic oligonucleotide
agtaatggtcagaggaaggag

SEQ ID NO: 37457 - DNA, 21 bp, Artificial Sequence
  Description of Artificial Sequence: Synthetic oligonucleotide
ccgggtattaatactaatagt

SEQ ID NO: 37458 - DNA, 21 bp, Artificial Sequence
  Description of Artificial Sequence: Synthetic oligonucleotide
ccgactactaggatggtgaat

SEQ ID NO: 37459 - DNA, 21 bp, Artificial Sequence
  Description of Artificial Sequence: Synthetic oligonucleotide
tatgggaagagtgttacgcct

SEQ ID NO: 37460 - DNA, 21 bp, Artificial Sequence
  Description of Artificial Sequence: Synthetic oligonucleotide
agcctccaccaagtcggcggc

SEQ ID NO: 37461 - DNA, 21 bp, Artificial Sequence
  Description of Artificial Sequence: Synthetic oligonucleotide
gagaattctagtaaggctaag

SEQ ID NO: 37462 - DNA, 21 bp, Artificial Sequence
  Description of Artificial Sequence: Synthetic oligonucleotide
atgagttctgagcgtccgggt

SEQ ID NO: 37463 - DNA, 21 bp, Artificial Sequence
  Description of Artificial Sequence: Synthetic oligonucleotide
agcaaagccggcagagtcacc

SEQ ID NO: 37464 - DNA, 21 bp, Artificial Sequence
  Description of Artificial Sequence: Synthetic oligonucleotide
cacaaagtccccggcagcggc

SEQ ID NO: 37465 - DNA, 21 bp, Artificial Sequence
  Description of Artificial Sequence: Synthetic oligonucleotide
catctgagggataagtattcg

SEQ ID NO: 37466 - DNA, 21 bp, Artificial Sequence
  Description of Artificial Sequence: Synthetic oligonucleotide
aagaatggttctgtggctctt

SEQ ID NO: 37467 - DNA, 21 bp, Artificial Sequence
  Description of Artificial Sequence: Synthetic oligonucleotide
tttacttctaataaggcgtcg

SEQ ID NO: 37468 - DNA, 21 bp, Artificial Sequence
  Description of Artificial Sequence: Synthetic oligonucleotide
ggtactggtaagattatgccg

SEQ ID NO: 37469 - DNA, 21 bp, Artificial Sequence
  Description of Artificial Sequence: Synthetic oligonucleotide
ccgagtgggtcgccggtgagg

SEQ ID NO: 37470 - DNA, 21 bp, Artificial Sequence
  Description of Artificial Sequence: Synthetic oligonucleotide
cctagggagactcataagcag

SEQ ID NO: 37471 - DNA, 21 bp, Artificial Sequence
  Description of Artificial Sequence: Synthetic oligonucleotide
cagggtcctaagaatgctgat

SEQ ID NO: 37472 - DNA, 21 bp, Artificial Sequence
  Description of Artificial Sequence: Synthetic oligonucleotide
accagcaacggcggcagcgcc

SEQ ID NO: 37473 - DNA, 21 bp, Artificial Sequence
  Description of Artificial Sequence: Synthetic oligonucleotide
cagggtgcgggggtttcgtct

SEQ ID NO: 37474 - DNA, 21 bp, Artificial Sequence
  Description of Artificial Sequence: Synthetic oligonucleotide
attggggggaataagcctctt

SEQ ID NO: 37475 - DNA, 21 bp, Artificial Sequence
  Description of Artificial Sequence: Synthetic oligonucleotide
tatcctctttctcggtctact

SEQ ID NO: 37476 - DNA, 21 bp, Artificial Sequence
  Description of Artificial Sequence: Synthetic oligonucleotide
agtactactgggggggctagt

SEQ ID NO: 37477 - DNA, 21 bp, Artificial Sequence
  Description of Artificial Sequence: Synthetic oligonucleotide
tacagcggcggcacccaacaa

SEQ ID NO: 37478 - DNA, 21 bp, Artificial Sequence
  Description of Artificial Sequence: Synthetic oligonucleotide
ggggttgttcctcctacgaag

SEQ ID NO: 37479 - DNA, 21 bp, Artificial Sequence
  Description of Artificial Sequence: Synthetic oligonucleotide
agcagaaccaacgccaccgcc

SEQ ID NO: 37480 - DNA, 21 bp, Artificial Sequence
  Description of Artificial Sequence: Synthetic oligonucleotide
aagaatgagtcgatggttctt

SEQ ID NO: 37481 - DNA, 21 bp, Artificial Sequence
  Description of Artificial Sequence: Synthetic oligonucleotide
accatgagagccacccccccc

SEQ ID NO: 37482 - DNA, 21 bp, Artificial Sequence
  Description of Artificial Sequence: Synthetic oligonucleotide
gagcagggttcgggtaatcat

SEQ ID NO: 37483 - DNA, 21 bp, Artificial Sequence
  Description of Artificial Sequence: Synthetic oligonucleotide
gttaatacgaatctggttggt

SEQ ID NO: 37484 - DNA, 21 bp, Artificial Sequence
  Description of Artificial Sequence: Synthetic oligonucleotide
agcggcaacgacaaaaacaac

SEQ ID NO: 37485 - DNA, 21 bp, Artificial Sequence
  Description of Artificial Sequence: Synthetic oligonucleotide
cccctcagccacagcaaaatg

SEQ ID NO: 37486 - DNA, 21 bp, Artificial Sequence
  Description of Artificial Sequence: Synthetic oligonucleotide
gctcagcagctgaatggtgtt

SEQ ID NO: 37487 - DNA, 21 bp, Artificial Sequence
  Description of Artificial Sequence: Synthetic oligonucleotide
aaaaaagtcaccggccaaggc

SEQ ID NO: 37488 - DNA, 21 bp, Artificial Sequence
  Description of Artificial Sequence: Synthetic oligonucleotide
gataatgtgtcgacttttacg

SEQ ID NO: 37489 - DNA, 21 bp, Artificial Sequence
  Description of Artificial Sequence: Synthetic oligonucleotide
gccagcagcaaaggcctcacc

SEQ ID NO: 37490 - DNA, 21 bp, Artificial Sequence
  Description of Artificial Sequence: Synthetic oligonucleotide
agagacggcggccaagacaga

SEQ ID NO: 37491 - DNA, 21 bp, Artificial Sequence
  Description of Artificial Sequence: Synthetic oligonucleotide
ctccccagcggcaacaccagc

SEQ ID NO: 37492 - DNA, 21 bp, Artificial Sequence
  Description of Artificial Sequence: Synthetic oligonucleotide
tcgaaggctacgcataatatt

SEQ ID NO: 37493 - DNA, 21 bp, Artificial Sequence
  Description of Artificial Sequence: Synthetic oligonucleotide
tctggtacgcagatgcatttg

SEQ ID NO: 37494 - DNA, 21 bp, Artificial Sequence
  Description of Artificial Sequence: Synthetic oligonucleotide
gcgacggttcagtcggcgact

SEQ ID NO: 37495 - DNA, 21 bp, Artificial Sequence
  Description of Artificial Sequence: Synthetic oligonucleotide
cccgtcagagacggcggcaga

SEQ ID NO: 37496 - DNA, 21 bp, Artificial Sequence
  Description of Artificial Sequence: Synthetic oligonucleotide
tatgtgaggcctggtactggt

SEQ ID NO: 37497 - DNA, 21 bp, Artificial Sequence
  Description of Artificial Sequence: Synthetic oligonucleotide
actggttctggtcggggtctt

SEQ ID NO: 37498 - DNA, 21 bp, Artificial Sequence
  Description of Artificial Sequence: Synthetic oligonucleotide
atgagcagcagaagcagcgtc

SEQ ID NO: 37499 - DNA, 21 bp, Artificial Sequence
  Description of Artificial Sequence: Synthetic oligonucleotide
gattatgggaaggggagttct

SEQ ID NO: 37500 - DNA, 21 bp, Artificial Sequence
  Description of Artificial Sequence: Synthetic oligonucleotide
agtaagactgggactagtttg

SEQ ID NO: 37501 - DNA, 21 bp, Artificial Sequence
  Description of Artificial Sequence: Synthetic oligonucleotide
atgcccagccaaagagacggc

SEQ ID NO: 37502 - DNA, 21 bp, Artificial Sequence
  Description of Artificial Sequence: Synthetic oligonucleotide
ggccaaagcggcagcagactc

SEQ ID NO: 37503 - DNA, 21 bp, Artificial Sequence
  Description of Artificial Sequence: Synthetic oligonucleotide
agcagaaacgtcaacgccatg

SEQ ID NO: 37504 - DNA, 21 bp, Artificial Sequence
  Description of Artificial Sequence: Synthetic oligonucleotide
caggtgagtccgttgaatgcg

SEQ ID NO: 37505 - DNA, 21 bp, Artificial Sequence
  Description of Artificial Sequence: Synthetic oligonucleotide
ctcaacagcaccgccggcaaa

SEQ ID NO: 37506 - DNA, 21 bp, Artificial Sequence
  Description of Artificial Sequence: Synthetic oligonucleotide
cccacccaacccagataccaa

SEQ ID NO: 37507 - DNA, 21 bp, Artificial Sequence
  Description of Artificial Sequence: Synthetic oligonucleotide
actaggagtgacagggtggct

SEQ ID NO: 37508 - DNA, 21 bp, Artificial Sequence
  Description of Artificial Sequence: Synthetic oligonucleotide
tgttccacgggtactcggaag

SEQ ID NO: 37509 - DNA, 21 bp, Artificial Sequence
  Description of Artificial Sequence: Synthetic oligonucleotide
ggcacccccaacaccaaagtc

SEQ ID NO: 37510 - DNA, 21 bp, Artificial Sequence
  Description of Artificial Sequence: Synthetic oligonucleotide
gcgggttctagtaggaatctt

SEQ ID NO: 37511 - DNA, 21 bp, Artificial Sequence
  Description of Artificial Sequence: Synthetic oligonucleotide
tacaccgccagcagaatggaa

SEQ ID NO: 37512 - DNA, 21 bp, Artificial Sequence
  Description of Artificial Sequence: Synthetic oligonucleotide
ggccaaaacagaaacaacacc

SEQ ID NO: 37513 - DNA, 21 bp, Artificial Sequence
  Description of Artificial Sequence: Synthetic oligonucleotide
aacccctacaccgccaacaac

SEQ ID NO: 37514 - DNA, 21 bp, Artificial Sequence
  Description of Artificial Sequence: Synthetic oligonucleotide
agaagcctcagcaccgaaaac

SEQ ID NO: 37515 - DNA, 21 bp, Artificial Sequence
  Description of Artificial Sequence: Synthetic oligonucleotide
tctgggcctagggggaattcg

SEQ ID NO: 37516 - DNA, 21 bp, Artificial Sequence
  Description of Artificial Sequence: Synthetic oligonucleotide
acgcaggatcatcatgttaag

SEQ ID NO: 37517 - DNA, 21 bp, Artificial Sequence
  Description of Artificial Sequence: Synthetic oligonucleotide
gaggtgactcctctgaggaag

SEQ ID NO: 37518 - DNA, 21 bp, Artificial Sequence
  Description of Artificial Sequence: Synthetic oligonucleotide
gacatggtcagccccagaaac

SEQ ID NO: 37519 - DNA, 21 bp, Artificial Sequence
  Description of Artificial Sequence: Synthetic oligonucleotide
gactacagcgaaaccagaaga

SEQ ID NO: 37520 - DNA, 21 bp, Artificial Sequence
  Description of Artificial Sequence: Synthetic oligonucleotide
cccagaagcaccgccagcctc

SEQ ID NO: 37521 - DNA, 21 bp, Artificial Sequence
  Description of Artificial Sequence: Synthetic oligonucleotide
tacttcaacagccacagcaac

SEQ ID NO: 37522 - DNA, 21 bp, Artificial Sequence
  Description of Artificial Sequence: Synthetic oligonucleotide
aacctcgtccaagacagaaga

SEQ ID NO: 37523 - DNA, 21 bp, Artificial Sequence
  Description of Artificial Sequence: Synthetic oligonucleotide
gccgacgacaaaagcctcaga

SEQ ID NO: 37524 - DNA, 21 bp, Artificial Sequence
  Description of Artificial Sequence: Synthetic oligonucleotide
gaagccagagaaagaaaaggc

SEQ ID NO: 37525 - DNA, 21 bp, Artificial Sequence
  Description of Artificial Sequence: Synthetic oligonucleotide
tacagaagcgccgccaacagc

SEQ ID NO: 37526 - DNA, 21 bp, Artificial Sequence
  Description of Artificial Sequence: Synthetic oligonucleotide
agccacaacagcaaagacagc

SEQ ID NO: 37527 - DNA, 21 bp, Artificial Sequence
  Description of Artificial Sequence: Synthetic oligonucleotide
ctcagcggccacagcccccaa

SEQ ID NO: 37528 - DNA, 21 bp, Artificial Sequence
  Description of Artificial Sequence: Synthetic oligonucleotide
tgcaccggcagcagaagcatg

SEQ ID NO: 37529 - DNA, 21 bp, Artificial Sequence
  Description of Artificial Sequence: Synthetic oligonucleotide
agacactacaccggcgaaagc

SEQ ID NO: 37530 - DNA, 21 bp, Artificial Sequence
  Description of Artificial Sequence: Synthetic oligonucleotide
aattcgagttcgtctaatcat

SEQ ID NO: 37531 - DNA, 21 bp, Artificial Sequence
  Description of Artificial Sequence: Synthetic oligonucleotide
acgccgacgctgtctcatact

SEQ ID NO: 37532 - DNA, 21 bp, Artificial Sequence
  Description of Artificial Sequence: Synthetic oligonucleotide
aacagcatcagcagagtcacc

SEQ ID NO: 37533 - DNA, 21 bp, Artificial Sequence
  Description of Artificial Sequence: Synthetic oligonucleotide
aacaacctccccagaaacctc

SEQ ID NO: 37534 - DNA, 21 bp, Artificial Sequence
  Description of Artificial Sequence: Synthetic oligonucleotide
ggcagacaaaacgaatacaga

SEQ ID NO: 37535 - DNA, 21 bp, Artificial Sequence
  Description of Artificial Sequence: Synthetic oligonucleotide
gccaacaccaccagactcacc

SEQ ID NO: 37536 - DNA, 21 bp, Artificial Sequence
  Description of Artificial Sequence: Synthetic oligonucleotide
aatctttcgcatagtgcgggg

SEQ ID NO: 37537 - DNA, 21 bp, Artificial Sequence
  Description of Artificial Sequence: Synthetic oligonucleotide
cagactcgtagtactggtaat

SEQ ID NO: 37538 - DNA, 21 bp, Artificial Sequence
  Description of Artificial Sequence: Synthetic oligonucleotide
aataatgtgggtgttcgtggt

SEQ ID NO: 37539 - DNA, 21 bp, Artificial Sequence
  Description of Artificial Sequence: Synthetic oligonucleotide
gggatgacgcaggggggtaag

SEQ ID NO: 37540 - DNA, 21 bp, Artificial Sequence
  Description of Artificial Sequence: Synthetic oligonucleotide
ccggttgctagggctgcgcag

SEQ ID NO: 37541 - DNA, 21 bp, Artificial Sequence
  Description of Artificial Sequence: Synthetic oligonucleotide
agccacagcaccagactcggc

SEQ ID NO: 37542 - DNA, 21 bp, Artificial Sequence
  Description of Artificial Sequence: Synthetic oligonucleotide
accaacagccaaaaactcgcc

SEQ ID NO: 37543 - DNA, 21 bp, Artificial Sequence
  Description of Artificial Sequence: Synthetic oligonucleotide
cccacccacagcagcagagac

SEQ ID NO: 37544 - DNA, 21 bp, Artificial Sequence
  Description of Artificial Sequence: Synthetic oligonucleotide
tctcattctgttactcctggg

SEQ ID NO: 37545 - DNA, 21 bp, Artificial Sequence
  Description of Artificial Sequence: Synthetic oligonucleotide
cctaatctgagtaagagtttg

SEQ ID NO: 37546 - DNA, 21 bp, Artificial Sequence
  Description of Artificial Sequence: Synthetic oligonucleotide
attattcagaatcagtctaag

SEQ ID NO: 37547 - DNA, 21 bp, Artificial Sequence
  Description of Artificial Sequence: Synthetic oligonucleotide
cagacttcgcattctgctaag

SEQ ID NO: 37548 - DNA, 21 bp, Artificial Sequence
  Description of Artificial Sequence: Synthetic oligonucleotide
gacggcaaccacgccagagcc

SEQ ID NO: 37549 - DNA, 21 bp, Artificial Sequence
  Description of Artificial Sequence: Synthetic oligonucleotide
gagcggatggggaagaatcag

SEQ ID NO: 37550 - DNA, 21 bp, Artificial Sequence
  Description of Artificial Sequence: Synthetic oligonucleotide
agcgtcctcaacagaaacggc

SEQ ID NO: 37551 - DNA, 21 bp, Artificial Sequence
  Description of Artificial Sequence: Synthetic oligonucleotide
caaagcagcagccaacaaaga

SEQ ID NO: 37552 - DNA, 21 bp, Artificial Sequence
  Description of Artificial Sequence: Synthetic oligonucleotide
ccttataagggtaatgggctt

SEQ ID NO: 37553 - DNA, 21 bp, Artificial Sequence
  Description of Artificial Sequence: Synthetic oligonucleotide
tcttcgcagcagaaggcttct

SEQ ID NO: 37554 - DNA, 21 bp, Artificial Sequence
  Description of Artificial Sequence: Synthetic oligonucleotide
agtaatccgagtgggttttcg

SEQ ID NO: 37555 - DNA, 21 bp, Artificial Sequence
  Description of Artificial Sequence: Synthetic oligonucleotide
catgtgcaggatgggaggact

SEQ ID NO: 37556 - DNA, 21 bp, Artificial Sequence
  Description of Artificial Sequence: Synthetic oligonucleotide
ggcagccacaacgacagcaga

SEQ ID NO: 37557 - DNA, 21 bp, Artificial Sequence
  Description of Artificial Sequence: Synthetic oligonucleotide
gctaagactaatttgaggtct

SEQ ID NO: 37558 - DNA, 21 bp, Artificial Sequence
  Description of Artificial Sequence: Synthetic oligonucleotide
gtgcagccgtctggtcgtcct

SEQ ID NO: 37559 - DNA, 21 bp, Artificial Sequence
  Description of Artificial Sequence: Synthetic oligonucleotide
agcgaaagcggccaacaaaga

SEQ ID NO: 37560 - DNA, 21 bp, Artificial Sequence
  Description of Artificial Sequence: Synthetic oligonucleotide
tttagtagtgcttcttttacg

SEQ ID NO: 37561 - DNA, 21 bp, Artificial Sequence
  Description of Artificial Sequence: Synthetic oligonucleotide
gttcagccggtgaagatgagt

SEQ ID NO: 37562 - DNA, 21 bp, Artificial Sequence
  Description of Artificial Sequence: Synthetic oligonucleotide
accggcaccggcagcttccac

SEQ ID NO: 37563 - DNA, 21 bp, Artificial Sequence
  Description of Artificial Sequence: Synthetic oligonucleotide
aacggttctggacagagtcaa

SEQ ID NO: 37564 - DNA, 21 bp, Artificial Sequence
  Description of Artificial Sequence: Synthetic oligonucleotide
ctccccaccgacagcctcaga

SEQ ID NO: 37565 - DNA, 21 bp, Artificial Sequence
  Description of Artificial Sequence: Synthetic oligonucleotide
gaccccgccaccagaaaaagc

SEQ ID NO: 37566 - DNA, 21 bp, Artificial Sequence
  Description of Artificial Sequence: Synthetic oligonucleotide
cgtgttactaatcagaatgcg

SEQ ID NO: 37567 - DNA, 21 bp, Artificial Sequence
  Description of Artificial Sequence: Synthetic oligonucleotide
ctcaacaaccaaagaatcgcc

SEQ ID NO: 37568 - DNA, 21 bp, Artificial Sequence
  Description of Artificial Sequence: Synthetic oligonucleotide
gttaatggtcatggggttagt

SEQ ID NO: 37569 - DNA, 21 bp, Artificial Sequence
  Description of Artificial Sequence: Synthetic oligonucleotide
aatcagtcgaaggcgtctgtt

SEQ ID NO: 37570 - DNA, 21 bp, Artificial Sequence
  Description of Artificial Sequence: Synthetic oligonucleotide
cccaccggcgaaaaaagactc

SEQ ID NO: 37571 - DNA, 21 bp, Artificial Sequence
  Description of Artificial Sequence: Synthetic oligonucleotide
tctaatgcgactaggtctagt

SEQ ID NO: 37572 - DNA, 21 bp, Artificial Sequence
  Description of Artificial Sequence: Synthetic oligonucleotide
cctggtgctagtggtaaggtt

SEQ ID NO: 37573 - DNA, 21 bp, Artificial Sequence
  Description of Artificial Sequence: Synthetic oligonucleotide
tatgctaataatcttaatcgt

SEQ ID NO: 37574 - DNA, 21 bp, Artificial Sequence
  Description of Artificial Sequence: Synthetic oligonucleotide
gggcttaatgttaattctaat

SEQ ID NO: 37575 - DNA, 21 bp, Artificial Sequence
  Description of Artificial Sequence: Synthetic oligonucleotide
tcttctccgcaggatcataat

SEQ ID NO: 37576 - DNA, 21 bp, Artificial Sequence
  Description of Artificial Sequence: Synthetic oligonucleotide
aaccaaggcggctaccacggc

SEQ ID NO: 37577 - DNA, 21 bp, Artificial Sequence
  Description of Artificial Sequence: Synthetic oligonucleotide
gatttggatacgaaggcgctt

SEQ ID NO: 37578 - DNA, 21 bp, Artificial Sequence
  Description of Artificial Sequence: Synthetic oligonucleotide
actatggatgtgcgttctgat

SEQ ID NO: 37579 - DNA, 21 bp, Artificial Sequence
  Description of Artificial Sequence: Synthetic oligonucleotide
aataataaggggaatccgggt

SEQ ID NO: 37580 - DNA, 21 bp, Artificial Sequence
  Description of Artificial Sequence: Synthetic oligonucleotide
aatctgagtagttcgggtggt

SEQ ID NO: 37581 - DNA, 21 bp, Artificial Sequence
  Description of Artificial Sequence: Synthetic oligonucleotide
agcagcagccccagcagcctc

SEQ ID NO: 37582 - DNA, 21 bp, Artificial Sequence
  Description of Artificial Sequence: Synthetic oligonucleotide
agcaccaacggcaacggcctc

SEQ ID NO: 37583 - DNA, 21 bp, Artificial Sequence
  Description of Artificial Sequence: Synthetic oligonucleotide
aacgcttctggacagaatcaa

SEQ ID NO: 37584 - DNA, 21 bp, Artificial Sequence
  Description of Artificial Sequence: Synthetic oligonucleotide
cccagaaccagagaaaaccaa

SEQ ID NO: 37585 - DNA, 21 bp, Artificial Sequence
  Description of Artificial Sequence: Synthetic oligonucleotide
cagcagggtgtgggtaataat

SEQ ID NO: 37586 - DNA, 21 bp, Artificial Sequence
  Description of Artificial Sequence: Synthetic oligonucleotide
gcgcgggctagttctaattcg

SEQ ID NO: 37587 - DNA, 21 bp, Artificial Sequence
  Description of Artificial Sequence: Synthetic oligonucleotide
gggagtaatcttaatagtact

SEQ ID NO: 37588 - DNA, 21 bp, Artificial Sequence
  Description of Artificial Sequence: Synthetic oligonucleotide
acgtctagtggtcattctgtt

SEQ ID NO: 37589 - DNA, 21 bp, Artificial Sequence
  Description of Artificial Sequence: Synthetic oligonucleotide
ccttctcatgaggggcagcag

SEQ ID NO: 37590 - DNA, 21 bp, Artificial Sequence
  Description of Artificial Sequence: Synthetic oligonucleotide
tacacccaaagcaccagcaga

SEQ ID NO: 37591 - DNA, 21 bp, Artificial Sequence
  Description of Artificial Sequence: Synthetic oligonucleotide
gttcgggctaaggtggcttcg

SEQ ID NO: 37592 - DNA, 21 bp, Artificial Sequence
  Description of Artificial Sequence: Synthetic oligonucleotide
gacatccccagcagagccgcc

SEQ ID NO: 37593 - DNA, 21 bp, Artificial Sequence
  Description of Artificial Sequence: Synthetic oligonucleotide
ccgcctcatgatgggcagcgt

SEQ ID NO: 37594 - DNA, 21 bp, Artificial Sequence
  Description of Artificial Sequence: Synthetic oligonucleotide
atggagattaagcctaatcgg

SEQ ID NO: 37595 - DNA, 21 bp, Artificial Sequence
  Description of Artificial Sequence: Synthetic oligonucleotide
tgggtcggcagccccgtctgc

SEQ ID NO: 37596 - DNA, 21 bp, Artificial Sequence
  Description of Artificial Sequence: Synthetic oligonucleotide
ggttatgaggctaataggggg

SEQ ID NO: 37597 - DNA, 21 bp, Artificial Sequence
  Description of Artificial Sequence: Synthetic oligonucleotide
ctcgtcagcaaaagcggcacc

SEQ ID NO: 37598 - DNA, 21 bp, Artificial Sequence
  Description of Artificial Sequence: Synthetic oligonucleotide
aaaggctacagcagcaacgaa

SEQ ID NO: 37599 - DNA, 21 bp, Artificial Sequence
  Description of Artificial Sequence: Synthetic oligonucleotide
cccctcgccgaaatgcacggc

SEQ ID NO: 37600 - DNA, 21 bp, Artificial Sequence
  Description of Artificial Sequence: Synthetic oligonucleotide
cctagtcgggcgtcgattact

SEQ ID NO: 37601 - DNA, 21 bp, Artificial Sequence
  Description of Artificial Sequence: Synthetic oligonucleotide
ctgaggaatagtacgagtgtg

SEQ ID NO: 37602 - DNA, 21 bp, Artificial Sequence
  Description of Artificial Sequence: Synthetic oligonucleotide
gaacccctcagcaaacaaagc

SEQ ID NO: 37603 - DNA, 21 bp, Artificial Sequence
  Description of Artificial Sequence: Synthetic oligonucleotide
gccagccacctccccgtcaac

SEQ ID NO: 37604 - DNA, 21 bp, Artificial Sequence
  Description of Artificial Sequence: Synthetic oligonucleotide
agttcgggtaagtcgttttct

SEQ ID NO: 37605 - DNA, 21 bp, Artificial Sequence
  Description of Artificial Sequence: Synthetic oligonucleotide
cccctcagcggcagaatcggc

SEQ ID NO: 37606 - DNA, 21 bp, Artificial Sequence
  Description of Artificial Sequence: Synthetic oligonucleotide
ggtcagtcgaatgttactttg

SEQ ID NO: 37607 - DNA, 21 bp, Artificial Sequence
  Description of Artificial Sequence: Synthetic oligonucleotide
atgaacatgagcgccagacaa

SEQ ID NO: 37608 - DNA, 21 bp, Artificial Sequence
  Description of Artificial Sequence: Synthetic oligonucleotide
gtgaatcagagtggttttagt

SEQ ID NO: 37609 - DNA, 21 bp, Artificial Sequence
  Description of Artificial Sequence: Synthetic oligonucleotide
tctgttactagtcctaataag

SEQ ID NO: 37610 - DNA, 21 bp, Artificial Sequence
  Description of Artificial Sequence: Synthetic oligonucleotide
agcagcgccagcacctacaaa

SEQ ID NO: 37611 - DNA, 21 bp, Artificial Sequence
  Description of Artificial Sequence: Synthetic oligonucleotide
ctggttcagggtggtgttaat

SEQ ID NO: 37612 - DNA, 21 bp, Artificial Sequence
  Description of Artificial Sequence: Synthetic oligonucleotide
agacccctcctcagccacgaa

SEQ ID NO: 37613 - DNA, 21 bp, Artificial Sequence
  Description of Artificial Sequence: Synthetic oligonucleotide
ttcagaacccaaagcgtcggc

SEQ ID NO: 37614 - DNA, 21 bp, Artificial Sequence
  Description of Artificial Sequence: Synthetic oligonucleotide
ggtacggagggggcgtcgggt

SEQ ID NO: 37615 - DNA, 21 bp, Artificial Sequence
  Description of Artificial Sequence: Synthetic oligonucleotide
cccagcagaaacaccagcctc

SEQ ID NO: 37616 - DNA, 21 bp, Artificial Sequence
  Description of Artificial Sequence: Synthetic oligonucleotide
aagcttagtcagactagtcag

SEQ ID NO: 37617 - DNA, 21 bp, Artificial Sequence
  Description of Artificial Sequence: Synthetic oligonucleotide
aacaacggcaaagtcagaagc

SEQ ID NO: 37618 - DNA, 21 bp, Artificial Sequence
  Description of Artificial Sequence: Synthetic oligonucleotide
accgccagaggcggccccacc

SEQ ID NO: 37619 - DNA, 21 bp, Artificial Sequence
  Description of Artificial Sequence: Synthetic oligonucleotide
gtcagaagcagagaaagcccc

SEQ ID NO: 37620 - DNA, 21 bp, Artificial Sequence
  Description of Artificial Sequence: Synthetic oligonucleotide
aacagcgccgccgccatgaaa

SEQ ID NO: 37621 - DNA, 21 bp, Artificial Sequence
  Description of Artificial Sequence: Synthetic oligonucleotide
tcgaatatgcctggtatggtg

SEQ ID NO: 37622 - DNA, 21 bp, Artificial Sequence
  Description of Artificial Sequence: Synthetic oligonucleotide
agagccaacaacagccaaatg

SEQ ID NO: 37623 - DNA, 21 bp, Artificial Sequence
  Description of Artificial Sequence: Synthetic oligonucleotide
atgcttcctcagaatggtagg

SEQ ID NO: 37624 - DNA, 21 bp, Artificial Sequence
  Description of Artificial Sequence: Synthetic oligonucleotide
agcagcctcgaaaaaagcaac

SEQ ID NO: 37625 - DNA, 21 bp, Artificial Sequence
  Description of Artificial Sequence: Synthetic oligonucleotide
catcgggttgataatcagggg

SEQ ID NO: 37626 - DNA, 21 bp, Artificial Sequence
  Description of Artificial Sequence: Synthetic oligonucleotide
gccaccagaggcatcagcagc

SEQ ID NO: 37627 - DNA, 21 bp, Artificial Sequence
  Description of Artificial Sequence: Synthetic oligonucleotide
cagatgaagcatctgcagggt

SEQ ID NO: 37628 - DNA, 21 bp, Artificial Sequence
  Description of Artificial Sequence: Synthetic oligonucleotide
aatacgtcgactcagaagatt

SEQ ID NO: 37629 - DNA, 21 bp, Artificial Sequence
  Description of Artificial Sequence: Synthetic oligonucleotide
atgaaggttaagttgaatcag

SEQ ID NO: 37630 - DNA, 21 bp, Artificial Sequence
  Description of Artificial Sequence: Synthetic oligonucleotide
ggtccggcgaatactagtggt

SEQ ID NO: 37631 - DNA, 21 bp, Artificial Sequence
  Description of Artificial Sequence: Synthetic oligonucleotide
cagagggagcagcttcttaag

SEQ ID NO: 37632 - DNA, 21 bp, Artificial Sequence
  Description of Artificial Sequence: Synthetic oligonucleotide
ggtgttaatcgtagtagtggt

SEQ ID NO: 37633 - DNA, 21 bp, Artificial Sequence
  Description of Artificial Sequence: Synthetic oligonucleotide
gatcctcaggtgagggctctt

SEQ ID NO: 37634 - DNA, 21 bp, Artificial Sequence
  Description of Artificial Sequence: Synthetic oligonucleotide
gcggggattaattctcaggtg

SEQ ID NO: 37635 - DNA, 21 bp, Artificial Sequence
  Description of Artificial Sequence: Synthetic oligonucleotide
cgtatgtctcctcctactggg

SEQ ID NO: 37636 - DNA, 21 bp, Artificial Sequence
  Description of Artificial Sequence: Synthetic oligonucleotide
gtgcgtaatgcgtctagtgct

SEQ ID NO: 37637 - DNA, 21 bp, Artificial Sequence
  Description of Artificial Sequence: Synthetic oligonucleotide
aatactacgccgtctaggggt

SEQ ID NO: 37638 - DNA, 21 bp, Artificial Sequence
  Description of Artificial Sequence: Synthetic oligonucleotide
tatgttagtaattctaatgcg

SEQ ID NO: 37639 - DNA, 21 bp, Artificial Sequence
  Description of Artificial Sequence: Synthetic oligonucleotide
aattctagtcataatgtttct

SEQ ID NO: 37640 - DNA, 21 bp, Artificial Sequence
  Description of Artificial Sequence: Synthetic oligonucleotide
tggagcaacggcagaaccagc

SEQ ID NO: 37641 - DNA, 21 bp, Artificial Sequence
  Description of Artificial Sequence: Synthetic oligonucleotide
accatcagcaccagacaaagc

SEQ ID NO: 37642 - DNA, 21 bp, Artificial Sequence
  Description of Artificial Sequence: Synthetic oligonucleotide
atgaaaggcaacaacctcagc

SEQ ID NO: 37643 - DNA, 21 bp, Artificial Sequence
  Description of Artificial Sequence: Synthetic oligonucleotide
cccggcgaaagcggcaaagtc

SEQ ID NO: 37644 - DNA, 21 bp, Artificial Sequence
  Description of Artificial Sequence: Synthetic oligonucleotide
ggtactcagaagcagacgagt

SEQ ID NO: 37645 - DNA, 21 bp, Artificial Sequence
  Description of Artificial Sequence: Synthetic oligonucleotide
gatacgaataatagggctaat

SEQ ID NO: 37646 - DNA, 21 bp, Artificial Sequence
  Description of Artificial Sequence: Synthetic oligonucleotide
atgagcggcggcaacatgaga

SEQ ID NO: 37647 - DNA, 21 bp, Artificial Sequence
  Description of Artificial Sequence: Synthetic oligonucleotide
aatggtccgattcggaattcg

SEQ ID NO: 37648 - DNA, 21 bp, Artificial Sequence
  Description of Artificial Sequence: Synthetic oligonucleotide
gggtcgagtgataagtcgact

SEQ ID NO: 37649 - DNA, 21 bp, Artificial Sequence
  Description of Artificial Sequence: Synthetic oligonucleotide
ccttctcagactaagccgagt

SEQ ID NO: 37650 - DNA, 21 bp, Artificial Sequence
  Description of Artificial Sequence: Synthetic oligonucleotide
tcggtttcgaatactaatact

SEQ ID NO: 37651 - DNA, 21 bp, Artificial Sequence
  Description of Artificial Sequence: Synthetic oligonucleotide
acggctagtggtaatttgtct

SEQ ID NO: 37652 - DNA, 21 bp, Artificial Sequence
  Description of Artificial Sequence: Synthetic oligonucleotide
tcgtatagtggtactcttggt

SEQ ID NO: 37653 - DNA, 21 bp, Artificial Sequence
  Description of Artificial Sequence: Synthetic oligonucleotide
ggggctaagccgggtttggct

SEQ ID NO: 37654 - DNA, 21 bp, Artificial Sequence
  Description of Artificial Sequence: Synthetic oligonucleotide
ctgaagagtactgggacgact

SEQ ID NO: 37655 - DNA, 21 bp, Artificial Sequence
  Description of Artificial Sequence: Synthetic oligonucleotide
catgggagtcgtagtatgtct

SEQ ID NO: 37656 - DNA, 21 bp, Artificial Sequence
  Description of Artificial Sequence: Synthetic oligonucleotide
cacagcagcagacccctcgaa

SEQ ID NO: 37657 - DNA, 21 bp, Artificial Sequence
  Description of Artificial Sequence: Synthetic oligonucleotide
ggcacctacggcgaaatgaga

SEQ ID NO: 37658 - DNA, 21 bp, Artificial Sequence
  Description of Artificial Sequence: Synthetic oligonucleotide
tttaatacttctaagcttagt

SEQ ID NO: 37659 - DNA, 21 bp, Artificial Sequence
  Description of Artificial Sequence: Synthetic oligonucleotide
tctacgtctcgtgatgctact

SEQ ID NO: 37660 - DNA, 21 bp, Artificial Sequence
  Description of Artificial Sequence: Synthetic oligonucleotide
tctaatcggccttctattgtg

SEQ ID NO: 37661 - DNA, 21 bp, Artificial Sequence
  Description of Artificial Sequence: Synthetic oligonucleotide
ggcctcgccaaagaccaaaga

SEQ ID NO: 37662 - DNA, 21 bp, Artificial Sequence
  Description of Artificial Sequence: Synthetic oligonucleotide
agccccagagccagcctcaac

SEQ ID NO: 37663 - DNA, 21 bp, Artificial Sequence
  Description of Artificial Sequence: Synthetic oligonucleotide
aacggttctggacagaatcta

SEQ ID NO: 37664 - DNA, 21 bp, Artificial Sequence
  Description of Artificial Sequence: Synthetic oligonucleotide
aagaatagtagtggtagtacg

SEQ ID NO: 37665 - DNA, 21 bp, Artificial Sequence
  Description of Artificial Sequence: Synthetic oligonucleotide
agttcgccgtcgaggtctagt

SEQ ID NO: 37666 - DNA, 21 bp, Artificial Sequence
  Description of Artificial Sequence: Synthetic oligonucleotide
aaggggagtgctggttctgtg

SEQ ID NO: 37667 - DNA, 21 bp, Artificial Sequence
  Description of Artificial Sequence: Synthetic oligonucleotide
atgggccccaccacccacaaa

SEQ ID NO: 37668 - DNA, 21 bp, Artificial Sequence
  Description of Artificial Sequence: Synthetic oligonucleotide
gatgctggttctcgttcttct

SEQ ID NO: 37669 - DNA, 21 bp, Artificial Sequence
  Description of Artificial Sequence: Synthetic oligonucleotide
accggcgaaagacaaagcagc

SEQ ID NO: 37670 - DNA, 21 bp, Artificial Sequence
  Description of Artificial Sequence: Synthetic oligonucleotide
cagaatgttggtgggattcgt

SEQ ID NO: 37671 - DNA, 21 bp, Artificial Sequence
  Description of Artificial Sequence: Synthetic oligonucleotide
acgaatgctaagcaggcgatt

SEQ ID NO: 37672 - DNA, 21 bp, Artificial Sequence
  Description of Artificial Sequence: Synthetic oligonucleotide
gcgactggttctcctagtaag

SEQ ID NO: 37673 - DNA, 21 bp, Artificial Sequence
  Description of Artificial Sequence: Synthetic oligonucleotide
aggtcgtcgaattctgatcat

SEQ ID NO: 37674 - DNA, 21 bp, Artificial Sequence
  Description of Artificial Sequence: Synthetic oligonucleotide
ggtactaattctactaggggt

SEQ ID NO: 37675 - DNA, 21 bp, Artificial Sequence
  Description of Artificial Sequence: Synthetic oligonucleotide
tcttctactagggcgctgtct

SEQ ID NO: 37676 - DNA, 21 bp, Artificial Sequence
  Description of Artificial Sequence: Synthetic oligonucleotide
cctaagctgcatcaggatcgg

SEQ ID NO: 37677 - DNA, 21 bp, Artificial Sequence
  Description of Artificial Sequence: Synthetic oligonucleotide
gattctagtgagaggattagg

SEQ ID NO: 37678 - DNA, 21 bp, Artificial Sequence
  Description of Artificial Sequence: Synthetic oligonucleotide
aagggttctaatcattcgggt

SEQ ID NO: 37679 - DNA, 21 bp, Artificial Sequence
  Description of Artificial Sequence: Synthetic oligonucleotide
aagactgataagactgttgat

SEQ ID NO: 37680 - DNA, 21 bp, Artificial Sequence
  Description of Artificial Sequence: Synthetic oligonucleotide
aataagtcgaatgggcagtcg

SEQ ID NO: 37681 - DNA, 21 bp, Artificial Sequence
  Description of Artificial Sequence: Synthetic oligonucleotide
gggcctcgttctatgtctaat

SEQ ID NO: 37682 - DNA, 21 bp, Artificial Sequence
  Description of Artificial Sequence: Synthetic oligonucleotide
gtcctcgccggcagcaacacc

SEQ ID NO: 37683 - DNA, 21 bp, Artificial Sequence
  Description of Artificial Sequence: Synthetic oligonucleotide
catgatcgtggtaagaatggg

SEQ ID NO: 37684 - DNA, 21 bp, Artificial Sequence
  Description of Artificial Sequence: Synthetic oligonucleotide
cttaattctaggcaggttacg

SEQ ID NO: 37685 - DNA, 21 bp, Artificial Sequence
  Description of Artificial Sequence: Synthetic oligonucleotide
atccaaaacagcagcaacacc

SEQ ID NO: 37686 - DNA, 21 bp, Artificial Sequence
  Description of Artificial Sequence: Synthetic oligonucleotide
aaccaaagcgccaaaagcacc

SEQ ID NO: 37687 - DNA, 21 bp, Artificial Sequence
  Description of Artificial Sequence: Synthetic oligonucleotide
gatacggcgactcgtaatagg

SEQ ID NO: 37688 - DNA, 21 bp, Artificial Sequence
  Description of Artificial Sequence: Synthetic oligonucleotide
agcagaagcaacgccatggcc

SEQ ID NO: 37689 - DNA, 21 bp, Artificial Sequence
  Description of Artificial Sequence: Synthetic oligonucleotide
gtcgccagccaaagaaccctc

SEQ ID NO: 37690 - DNA, 21 bp, Artificial Sequence
  Description of Artificial Sequence: Synthetic oligonucleotide
ttttctcagcattcttctaat

SEQ ID NO: 37691 - DNA, 21 bp, Artificial Sequence
  Description of Artificial Sequence: Synthetic oligonucleotide
atgaagaatacgactgtggtt

SEQ ID NO: 37692 - DNA, 21 bp, Artificial Sequence
  Description of Artificial Sequence: Synthetic oligonucleotide
cactacaccggcaaacaaaac

SEQ ID NO: 37693 - DNA, 21 bp, Artificial Sequence
  Description of Artificial Sequence: Synthetic oligonucleotide
tacagagtcacccaaagcagc

SEQ ID NO: 37694 - DNA, 21 bp, Artificial Sequence
  Description of Artificial Sequence: Synthetic oligonucleotide
ccttctcaggaggggcagcag

SEQ ID NO: 37695 - DNA, 21 bp, Artificial Sequence
  Description of Artificial Sequence: Synthetic oligonucleotide
agcaccgacagaagcttcaac

SEQ ID NO: 37696 - DNA, 21 bp, Artificial Sequence
  Description of Artificial Sequence: Synthetic oligonucleotide
aatatggatggggctactcgg

SEQ ID NO: 37697 - DNA, 21 bp, Artificial Sequence
  Description of Artificial Sequence: Synthetic oligonucleotide
gacggcagcggccaaaaccaa

SEQ ID NO: 37698 - DNA, 21 bp, Artificial Sequence
  Description of Artificial Sequence: Synthetic oligonucleotide
tatcaggcgaatgctctgggt

SEQ ID NO: 37699 - DNA, 21 bp, Artificial Sequence
  Description of Artificial Sequence: Synthetic oligonucleotide
aatgggagtccgggtttttat

SEQ ID NO: 37700 - DNA, 21 bp, Artificial Sequence
  Description of Artificial Sequence: Synthetic oligonucleotide
cggcgtgagattgcgtcttct

SEQ ID NO: 37701 - DNA, 21 bp, Artificial Sequence
  Description of Artificial Sequence: Synthetic oligonucleotide
ttttgttcgccggtgggtaag

SEQ ID NO: 37702 - DNA, 21 bp, Artificial Sequence
  Description of Artificial Sequence: Synthetic oligonucleotide
aacgtctgcaccaaccaaatc

SEQ ID NO: 37703 - DNA, 21 bp, Artificial Sequence
  Description of Artificial Sequence: Synthetic oligonucleotide
gccagcagcccccaagaaaaa

SEQ ID NO: 37704 - DNA, 21 bp, Artificial Sequence
  Description of Artificial Sequence: Synthetic oligonucleotide
ggcatccacaaagaatacctc

SEQ ID NO: 37705 - DNA, 21 bp, Artificial Sequence
  Description of Artificial Sequence: Synthetic oligonucleotide
ggggatcataataggcttaat

SEQ ID NO: 37706 - DNA, 21 bp, Artificial Sequence
  Description of Artificial Sequence: Synthetic oligonucleotide
cctcgggatactactgggtct

SEQ ID NO: 37707 - DNA, 21 bp, Artificial Sequence
  Description of Artificial Sequence: Synthetic oligonucleotide
gggtatactgtggggactaat

SEQ ID NO: 37708 - DNA, 21 bp, Artificial Sequence
  Description of Artificial Sequence: Synthetic oligonucleotide
tctcgtgtgacttctggtggt

SEQ ID NO: 37709 - DNA, 21 bp, Artificial Sequence
  Description of Artificial Sequence: Synthetic oligonucleotide
gagcgtaagacttctaatgcg

SEQ ID NO: 37710 - DNA, 21 bp, Artificial Sequence
  Description of Artificial Sequence: Synthetic oligonucleotide
aatcgtgagaagttgtcgtat

SEQ ID NO: 37711 - DNA, 21 bp, Artificial Sequence
  Description of Artificial Sequence: Synthetic oligonucleotide
gtttcttctccgaggcagatt

SEQ ID NO: 37712 - DNA, 21 bp, Artificial Sequence
  Description of Artificial Sequence: Synthetic oligonucleotide
agtccgaatgcgaatagtgtt

SEQ ID NO: 37713 - DNA, 21 bp, Artificial Sequence
  Description of Artificial Sequence: Synthetic oligonucleotide
ttgcctattactgcgcgtaat

SEQ ID NO: 37714 - DNA, 21 bp, Artificial Sequence
  Description of Artificial Sequence: Synthetic oligonucleotide
gttagtaagagtccgtctact

SEQ ID NO: 37715 - DNA, 21 bp, Artificial Sequence
  Description of Artificial Sequence: Synthetic oligonucleotide
cctctgagtcattcgaatatg

SEQ ID NO: 37716 - DNA, 21 bp, Artificial Sequence
  Description of Artificial Sequence: Synthetic oligonucleotide
accggcgcccaaagcaccatg

SEQ ID NO: 37717 - DNA, 21 bp, Artificial Sequence
  Description of Artificial Sequence: Synthetic oligonucleotide
tttgtttcgcgggagcatact

SEQ ID NO: 37718 - DNA, 21 bp, Artificial Sequence
  Description of Artificial Sequence: Synthetic oligonucleotide
attatttcgcagaatgggctg

SEQ ID NO: 37719 - DNA, 21 bp, Artificial Sequence
  Description of Artificial Sequence: Synthetic oligonucleotide
gtgggtgaggctgggaaggct

SEQ ID NO: 37720 - DNA, 21 bp, Artificial Sequence
  Description of Artificial Sequence: Synthetic oligonucleotide
ggcggccacagccccaacaga

SEQ ID NO: 37721 - DNA, 21 bp, Artificial Sequence
  Description of Artificial Sequence: Synthetic oligonucleotide
acgcagttgggggggtttaag

SEQ ID NO: 37722 - DNA, 21 bp, Artificial Sequence
  Description of Artificial Sequence: Synthetic oligonucleotide
gggaagcatggtactaattct

SEQ ID NO: 37723 - DNA, 21 bp, Artificial Sequence
  Description of Artificial Sequence: Synthetic oligonucleotide
tacggcctccacaacgccaga

SEQ ID NO: 37724 - DNA, 21 bp, Artificial Sequence
  Description of Artificial Sequence: Synthetic oligonucleotide
accatcagcaccagaaaaagc

SEQ ID NO: 37725 - DNA, 21 bp, Artificial Sequence
  Description of Artificial Sequence: Synthetic oligonucleotide
cttccttcgtcgattgtgcct

SEQ ID NO: 37726 - DNA, 21 bp, Artificial Sequence
  Description of Artificial Sequence: Synthetic oligonucleotide
agagtccaaagcaacctcaaa

SEQ ID NO: 37727 - DNA, 21 bp, Artificial Sequence
  Description of Artificial Sequence: Synthetic oligonucleotide
cccctcgcctacgaaaacaac

SEQ ID NO: 37728 - DNA, 21 bp, Artificial Sequence
  Description of Artificial Sequence: Synthetic oligonucleotide
ggggctctgaatagtcgtggg

SEQ ID NO: 37729 - DNA, 21 bp, Artificial Sequence
  Description of Artificial Sequence: Synthetic oligonucleotide
gggattgctactactaatagg

SEQ ID NO: 37730 - DNA, 21 bp, Artificial Sequence
  Description of Artificial Sequence: Synthetic oligonucleotide
atgaggtctgagcgtgctgct

SEQ ID NO: 37731 - DNA, 21 bp, Artificial Sequence
  Description of Artificial Sequence: Synthetic oligonucleotide
ccgatgtctcatgtgtcgggg

SEQ ID NO: 37732 - DNA, 21 bp, Artificial Sequence
  Description of Artificial Sequence: Synthetic oligonucleotide
atgtctgctaggcctgtttct

SEQ ID NO: 37733 - DNA, 21 bp, Artificial Sequence
  Description of Artificial Sequence: Synthetic oligonucleotide
cgggatcatagtggttcgagg

SEQ ID NO: 37734 - DNA, 21 bp, Artificial Sequence
  Description of Artificial Sequence: Synthetic oligonucleotide
ctcaccgccaccaaccccaga

SEQ ID NO: 37735 - DNA, 21 bp, Artificial Sequence
  Description of Artificial Sequence: Synthetic oligonucleotide
aatatgcgtgctagtacggag

SEQ ID NO: 37736 - DNA, 21 bp, Artificial Sequence
  Description of Artificial Sequence: Synthetic oligonucleotide
aagggtacgccgggtcattcg

SEQ ID NO: 37737 - DNA, 21 bp, Artificial Sequence
  Description of Artificial Sequence: Synthetic oligonucleotide
gaaagcagaaaaagcgtcagc

SEQ ID NO: 37738 - DNA, 21 bp, Artificial Sequence
  Description of Artificial Sequence: Synthetic oligonucleotide
cctgctgatcgtactcatatt

SEQ ID NO: 37739 - DNA, 21 bp, Artificial Sequence
  Description of Artificial Sequence: Synthetic oligonucleotide
aggagtacggatcctcatggg

SEQ ID NO: 37740 - DNA, 21 bp, Artificial Sequence
  Description of Artificial Sequence: Synthetic oligonucleotide
agaagcgccagcggccaactc

SEQ ID NO: 37741 - DNA, 21 bp, Artificial Sequence
  Description of Artificial Sequence: Synthetic oligonucleotide
ggcgccagcggcaaaatcggc

SEQ ID NO: 37742 - DNA, 21 bp, Artificial Sequence
  Description of Artificial Sequence: Synthetic oligonucleotide
cattctacgaggtcttcgttg

SEQ ID NO: 37743 - DNA, 21 bp, Artificial Sequence
  Description of Artificial Sequence: Synthetic oligonucleotide
ggtatgagttcgccgcatatt

SEQ ID NO: 37744 - DNA, 21 bp, Artificial Sequence
  Description of Artificial Sequence: Synthetic oligonucleotide
aggtcttctgggggtttgact

SEQ ID NO: 37745 - DNA, 21 bp, Artificial Sequence
  Description of Artificial Sequence: Synthetic oligonucleotide
aacggcgccaccaaaaacagc

SEQ ID NO: 37746 - DNA, 21 bp, Artificial Sequence
  Description of Artificial Sequence: Synthetic oligonucleotide
aacggttctgtacagaatcaa

SEQ ID NO: 37747 - DNA, 21 bp, Artificial Sequence
  Description of Artificial Sequence: Synthetic oligonucleotide
actactgataagagtcgtttg

SEQ ID NO: 37748 - DNA, 21 bp, Artificial Sequence
  Description of Artificial Sequence: Synthetic oligonucleotide
tctaggtcgcctggtacgtcg

SEQ ID NO: 37749 - DNA, 21 bp, Artificial Sequence
  Description of Artificial Sequence: Synthetic oligonucleotide
agttttactaagggggcgggg

SEQ ID NO: 37750 - DNA, 21 bp, Artificial Sequence
  Description of Artificial Sequence: Synthetic oligonucleotide
aatgtgactacgccgcttatt

SEQ ID NO: 37751 - DNA, 21 bp, Artificial Sequence
  Description of Artificial Sequence: Synthetic oligonucleotide
accctcggccaagccgtcaga

SEQ ID NO: 37752 - DNA, 21 bp, Artificial Sequence
  Description of Artificial Sequence: Synthetic oligonucleotide
agcaccaccaccgccagcagc

SEQ ID NO: 37753 - DNA, 21 bp, Artificial Sequence
  Description of Artificial Sequence: Synthetic oligonucleotide
tcgggtacgattggtcaggtt

SEQ ID NO: 37754 - DNA, 21 bp, Artificial Sequence
  Description of Artificial Sequence: Synthetic oligonucleotide
cccagcaccgaaagaaacaga

SEQ ID NO: 37755 - DNA, 21 bp, Artificial Sequence
  Description of Artificial Sequence: Synthetic oligonucleotide
cttcttacgtcgcctaattcg

SEQ ID NO: 37756 - DNA, 21 bp, Artificial Sequence
  Description of Artificial Sequence: Synthetic oligonucleotide
agcagagacagcagcatccac

SEQ ID NO: 37757 - DNA, 21 bp, Artificial Sequence
  Description of Artificial Sequence: Synthetic oligonucleotide
aatcttgcttctagttcttat

SEQ ID NO: 37758 - DNA, 21 bp, Artificial Sequence
  Description of Artificial Sequence: Synthetic oligonucleotide
ctgagggctggtactgtgcgt

SEQ ID NO: 37759 - DNA, 21 bp, Artificial Sequence
  Description of Artificial Sequence: Synthetic oligonucleotide
atggtttcgggtaagagttat

SEQ ID NO: 37760 - DNA, 21 bp, Artificial Sequence
  Description of Artificial Sequence: Synthetic oligonucleotide
gtgcctagtacggctggtaag

SEQ ID NO: 37761 - DNA, 21 bp, Artificial Sequence
  Description of Artificial Sequence: Synthetic oligonucleotide
ggtttttcgaggcctaatacg

SEQ ID NO: 37762 - DNA, 21 bp, Artificial Sequence
  Description of Artificial Sequence: Synthetic oligonucleotide
caggttgggcgtccgaatgcg

SEQ ID NO: 37763 - DNA, 21 bp, Artificial Sequence
  Description of Artificial Sequence: Synthetic oligonucleotide
gatactgcgcgtcctactaag

SEQ ID NO: 37764 - DNA, 21 bp, Artificial Sequence
  Description of Artificial Sequence: Synthetic oligonucleotide
cggctggatggtctgtctcgt

SEQ ID NO: 37765 - DNA, 21 bp, Artificial Sequence
  Description of Artificial Sequence: Synthetic oligonucleotide
gacagacacaacaccaccagc

SEQ ID NO: 37766 - DNA, 21 bp, Artificial Sequence
  Description of Artificial Sequence: Synthetic oligonucleotide
tatgctaaggatcagcagtcg

SEQ ID NO: 37767 - DNA, 21 bp, Artificial Sequence
  Description of Artificial Sequence: Synthetic oligonucleotide
aatagtactccgtcgactagg

SEQ ID NO: 37768 - DNA, 21 bp, Artificial Sequence
  Description of Artificial Sequence: Synthetic oligonucleotide
gcccccctccaaagcaacctc

SEQ ID NO: 37769 - DNA, 21 bp, Artificial Sequence
  Description of Artificial Sequence: Synthetic oligonucleotide
gaggggatttcgtctatttct

SEQ ID NO: 37770 - DNA, 21 bp, Artificial Sequence
  Description of Artificial Sequence: Synthetic oligonucleotide
caaagcctcaccagaacccac

SEQ ID NO: 37771 - DNA, 21 bp, Artificial Sequence
  Description of Artificial Sequence: Synthetic oligonucleotide
gtggtgtcggctactggtact

SEQ ID NO: 37772 - DNA, 21 bp, Artificial Sequence
  Description of Artificial Sequence: Synthetic oligonucleotide
cgtaatggtgctatgtctaat

SEQ ID NO: 37773 - DNA, 21 bp, Artificial Sequence
  Description of Artificial Sequence: Synthetic oligonucleotide
caactcaaccacagcgccaaa

SEQ ID NO: 37774 - DNA, 21 bp, Artificial Sequence
  Description of Artificial Sequence: Synthetic oligonucleotide
tcgtttacgggtaatacggtg

SEQ ID NO: 37775 - DNA, 21 bp, Artificial Sequence
  Description of Artificial Sequence: Synthetic oligonucleotide
agagacaccaaaagcggcatg

SEQ ID NO: 37776 - DNA, 21 bp, Artificial Sequence
  Description of Artificial Sequence: Synthetic oligonucleotide
gattctcgttctattaagggg

SEQ ID NO: 37777 - DNA, 21 bp, Artificial Sequence
  Description of Artificial Sequence: Synthetic oligonucleotide
agccacggcccccaaatcacc

SEQ ID NO: 37778 - DNA, 21 bp, Artificial Sequence
  Description of Artificial Sequence: Synthetic oligonucleotide
attgtttcgccggtttctaag

SEQ ID NO: 37779 - DNA, 21 bp, Artificial Sequence
  Description of Artificial Sequence: Synthetic oligonucleotide
gggtctccgaatcatagtagt

SEQ ID NO: 37780 - DNA, 21 bp, Artificial Sequence
  Description of Artificial Sequence: Synthetic oligonucleotide
agtcctcttcttgattataag

SEQ ID NO: 37781 - DNA, 21 bp, Artificial Sequence
  Description of Artificial Sequence: Synthetic oligonucleotide
cggatgcagccgagtggtaat

SEQ ID NO: 37782 - DNA, 21 bp, Artificial Sequence
  Description of Artificial Sequence: Synthetic oligonucleotide
cctgggcctgaggttggtcgg

SEQ ID NO: 37783 - DNA, 21 bp, Artificial Sequence
  Description of Artificial Sequence: Synthetic oligonucleotide
tctacgcctagtaatgttttg

SEQ ID NO: 37784 - DNA, 21 bp, Artificial Sequence
  Description of Artificial Sequence: Synthetic oligonucleotide
tctaattcgggtcgtggtatg

SEQ ID NO: 37785 - DNA, 21 bp, Artificial Sequence
  Description of Artificial Sequence: Synthetic oligonucleotide
gctctttcttcgcctgctaat

SEQ ID NO: 37786 - DNA, 21 bp, Artificial Sequence
  Description of Artificial Sequence: Synthetic oligonucleotide
ctcggcgaaaccagcatgaga

SEQ ID NO: 37787 - DNA, 21 bp, Artificial Sequence
  Description of Artificial Sequence: Synthetic oligonucleotide
ctgatttcgtctaagagtagt

SEQ ID NO: 37788 - DNA, 21 bp, Artificial Sequence
  Description of Artificial Sequence: Synthetic oligonucleotide
cccgtcagacccgccaacctc

SEQ ID NO: 37789 - DNA, 21 bp, Artificial Sequence
  Description of Artificial Sequence: Synthetic oligonucleotide
ggtattcagccggggtctaat

SEQ ID NO: 37790 - DNA, 21 bp, Artificial Sequence
  Description of Artificial Sequence: Synthetic oligonucleotide
atgaattcggggccgaaggtt

SEQ ID NO: 37791 - DNA, 21 bp, Artificial Sequence
  Description of Artificial Sequence: Synthetic oligonucleotide
ctcatcagcaccgcccaaaga

SEQ ID NO: 37792 - DNA, 21 bp, Artificial Sequence
  Description of Artificial Sequence: Synthetic oligonucleotide
agttctgatttgggtaagcgt

SEQ ID NO: 37793 - DNA, 21 bp, Artificial Sequence
  Description of Artificial Sequence: Synthetic oligonucleotide
gatattgggaatcctactaat

SEQ ID NO: 37794 - DNA, 21 bp, Artificial Sequence
  Description of Artificial Sequence: Synthetic oligonucleotide
tctggtattaacaatcctccg

SEQ ID NO: 37795 - DNA, 21 bp, Artificial Sequence
  Description of Artificial Sequence: Synthetic oligonucleotide
tcgagtccgtctaagatggcg

SEQ ID NO: 37796 - DNA, 21 bp, Artificial Sequence
  Description of Artificial Sequence: Synthetic oligonucleotide
ggtagggataattctcggcag

SEQ ID NO: 37797 - DNA, 21 bp, Artificial Sequence
  Description of Artificial Sequence: Synthetic oligonucleotide
atgtctttgcctggtcagcgg

SEQ ID NO: 37798 - DNA, 21 bp, Artificial Sequence
  Description of Artificial Sequence: Synthetic oligonucleotide
agcgtcgaccaaagaagactc

SEQ ID NO: 37799 - DNA, 21 bp, Artificial Sequence
  Description of Artificial Sequence: Synthetic oligonucleotide
ggtgttaggagtgtggctggg

SEQ ID NO: 37800 - DNA, 21 bp, Artificial Sequence
  Description of Artificial Sequence: Synthetic oligonucleotide
agcgaccaagtcagaagcgcc

SEQ ID NO: 37801 - DNA, 21 bp, Artificial Sequence
  Description of Artificial Sequence: Synthetic oligonucleotide
aaaagaatggacaaaagcagc

SEQ ID NO: 37802 - DNA, 21 bp, Artificial Sequence
  Description of Artificial Sequence: Synthetic oligonucleotide
cattcgggtacgaggactagt

SEQ ID NO: 37803 - DNA, 21 bp, Artificial Sequence
  Description of Artificial Sequence: Synthetic oligonucleotide
atgcctcatccttcgtcgaag

SEQ ID NO: 37804 - DNA, 21 bp, Artificial Sequence
  Description of Artificial Sequence: Synthetic oligonucleotide
gcgggtgcttcttctaatacg

SEQ ID NO: 37805 - DNA, 21 bp, Artificial Sequence
  Description of Artificial Sequence: Synthetic oligonucleotide
cctagtaataagactaattcg

SEQ ID NO: 37806 - DNA, 21 bp, Artificial Sequence
  Description of Artificial Sequence: Synthetic oligonucleotide
tctaatgtgtcgaagccgcag

SEQ ID NO: 37807 - DNA, 21 bp, Artificial Sequence
  Description of Artificial Sequence: Synthetic oligonucleotide
tacaacgtcaacagaaacacc

SEQ ID NO: 37808 - DNA, 21 bp, Artificial Sequence
  Description of Artificial Sequence: Synthetic oligonucleotide
ccccacagcaccggcagcatc

SEQ ID NO: 37809 - DNA, 21 bp, Artificial Sequence
  Description of Artificial Sequence: Synthetic oligonucleotide
cccagaagcaacacccaaaga

SEQ ID NO: 37810 - DNA, 21 bp, Artificial Sequence
  Description of Artificial Sequence: Synthetic oligonucleotide
cacggccaaaccggcatgatc

SEQ ID NO: 37811 - DNA, 21 bp, Artificial Sequence
  Description of Artificial Sequence: Synthetic oligonucleotide
catggtgttaataagactgag

SEQ ID NO: 37812 - DNA, 21 bp, Artificial Sequence
  Description of Artificial Sequence: Synthetic oligonucleotide
tttagtactattaagggtgtg

SEQ ID NO: 37813 - DNA, 21 bp, Artificial Sequence
  Description of Artificial Sequence: Synthetic oligonucleotide
aacggcagcggccaaaacgaa

SEQ ID NO: 37814 - DNA, 21 bp, Artificial Sequence
  Description of Artificial Sequence: Synthetic oligonucleotide
cggctgtcttctcgggattct

SEQ ID NO: 37815 - DNA, 21 bp, Artificial Sequence
  Description of Artificial Sequence: Synthetic oligonucleotide
tgccacgccagagaacacatc

SEQ ID NO: 37816 - DNA, 21 bp, Artificial Sequence
  Description of Artificial Sequence: Synthetic oligonucleotide
atgagaaccagcagcttctac

SEQ ID NO: 37817 - DNA, 21 bp, Artificial Sequence
  Description of Artificial Sequence: Synthetic oligonucleotide
gtttcgggtcggccgactggt

SEQ ID NO: 37818 - DNA, 21 bp, Artificial Sequence
  Description of Artificial Sequence: Synthetic oligonucleotide
ggtattactaagaatcttgcg

SEQ ID NO: 37819 - DNA, 21 bp, Artificial Sequence
  Description of Artificial Sequence: Synthetic oligonucleotide
gtcagaatccccaaaagcaac

SEQ ID NO: 37820 - DNA, 21 bp, Artificial Sequence
  Description of Artificial Sequence: Synthetic oligonucleotide
cagaatcttccgaaggcgtct

SEQ ID NO: 37821 - DNA, 21 bp, Artificial Sequence
  Description of Artificial Sequence: Synthetic oligonucleotide
ctcagagccaccagcggcaac

SEQ ID NO: 37822 - DNA, 21 bp, Artificial Sequence
  Description of Artificial Sequence: Synthetic oligonucleotide
gtttctggttctaaggttggt

SEQ ID NO: 37823 - DNA, 21 bp, Artificial Sequence
  Description of Artificial Sequence: Synthetic oligonucleotide
cggtctggtaatgctacgatt

SEQ ID NO: 37824 - DNA, 21 bp, Artificial Sequence
  Description of Artificial Sequence: Synthetic oligonucleotide
gccgaaaaaaccagaagcctc

SEQ ID NO: 37825 - DNA, 21 bp, Artificial Sequence
  Description of Artificial Sequence: Synthetic oligonucleotide
ggcggccacaaaagcctcaac

SEQ ID NO: 37826 - DNA, 21 bp, Artificial Sequence
  Description of Artificial Sequence: Synthetic oligonucleotide
gtcggcgacagaagctggagc

SEQ ID NO: 37827 - DNA, 21 bp, Artificial Sequence
  Description of Artificial Sequence: Synthetic oligonucleotide
agagacagcaccgccgccaga

SEQ ID NO: 37828 - DNA, 21 bp, Artificial Sequence
  Description of Artificial Sequence: Synthetic oligonucleotide
atggcccccagaaccgtcccc

SEQ ID NO: 37829 - DNA, 21 bp, Artificial Sequence
  Description of Artificial Sequence: Synthetic oligonucleotide
cttcttggggatacgaagccg

SEQ ID NO: 37830 - DNA, 21 bp, Artificial Sequence
  Description of Artificial Sequence: Synthetic oligonucleotide
gacagccacctcgtcgacaaa

SEQ ID NO: 37831 - DNA, 21 bp, Artificial Sequence
  Description of Artificial Sequence: Synthetic oligonucleotide
aggtcgactaatacggataat

SEQ ID NO: 37832 - DNA, 21 bp, Artificial Sequence
  Description of Artificial Sequence: Synthetic oligonucleotide
tctagttttcaggcgaataag

SEQ ID NO: 37833 - DNA, 21 bp, Artificial Sequence
  Description of Artificial Sequence: Synthetic oligonucleotide
cctactagtaatgggagtctt

SEQ ID NO: 37834 - DNA, 21 bp, Artificial Sequence
  Description of Artificial Sequence: Synthetic oligonucleotide
ctttcggctaatccgcataat

SEQ ID NO: 37835 - DNA, 21 bp, Artificial Sequence
  Description of Artificial Sequence: Synthetic oligonucleotide
caacccaacagcggcaccacc

SEQ ID NO: 37836 - DNA, 21 bp, Artificial Sequence
  Description of Artificial Sequence: Synthetic oligonucleotide
gccaccgccaacacccacatg

SEQ ID NO: 37837 - DNA, 21 bp, Artificial Sequence
  Description of Artificial Sequence: Synthetic oligonucleotide
ccctacgccggcaccagcccc

SEQ ID NO: 37838 - DNA, 21 bp, Artificial Sequence
  Description of Artificial Sequence: Synthetic oligonucleotide
ccgctgggttctagggtgaat

SEQ ID NO: 37839 - DNA, 21 bp, Artificial Sequence
  Description of Artificial Sequence: Synthetic oligonucleotide
gttaatacgaatcgggctgct

SEQ ID NO: 37840 - DNA, 21 bp, Artificial Sequence
  Description of Artificial Sequence: Synthetic oligonucleotide
agtccgaattctcatccttct

SEQ ID NO: 37841 - DNA, 21 bp, Artificial Sequence
  Description of Artificial Sequence: Synthetic oligonucleotide
tcgttgaatagtagggagggt

SEQ ID NO: 37842 - DNA, 21 bp, Artificial Sequence
  Description of Artificial Sequence: Synthetic oligonucleotide
tgcaaccaaagccccaacaga

SEQ ID NO: 37843 - DNA, 21 bp, Artificial Sequence
  Description of Artificial Sequence: Synthetic oligonucleotide
tcttttgattcgaagccgcct

SEQ ID NO: 37844 - DNA, 21 bp, Artificial Sequence
  Description of Artificial Sequence: Synthetic oligonucleotide
ccgaatgggggtattcctcct

SEQ ID NO: 37845 - DNA, 21 bp, Artificial Sequence
  Description of Artificial Sequence: Synthetic oligonucleotide
caaggcagcttcaacgccctc

SEQ ID NO: 37846 - DNA, 21 bp, Artificial Sequence
  Description of Artificial Sequence: Synthetic oligonucleotide
catactgatacgagtgcggtg

SEQ ID NO: 37847 - DNA, 21 bp, Artificial Sequence
  Description of Artificial Sequence: Synthetic oligonucleotide
cttttggatcggagggctgct

SEQ ID NO: 37848 - DNA, 21 bp, Artificial Sequence
  Description of Artificial Sequence: Synthetic oligonucleotide
cgtttggagactaagtcgggt

SEQ ID NO: 37849 - DNA, 21 bp, Artificial Sequence
  Description of Artificial Sequence: Synthetic oligonucleotide
gttgcggataagggttctatg

SEQ ID NO: 37850 - DNA, 21 bp, Artificial Sequence
  Description of Artificial Sequence: Synthetic oligonucleotide
tctatgctgccgggggataat

SEQ ID NO: 37851 - DNA, 21 bp, Artificial Sequence
  Description of Artificial Sequence: Synthetic oligonucleotide
tgtgcgacgcgtgcgagttat

SEQ ID NO: 37852 - DNA, 21 bp, Artificial Sequence
  Description of Artificial Sequence: Synthetic oligonucleotide
cagacgcctgtttcggctcct

SEQ ID NO: 37853 - DNA, 21 bp, Artificial Sequence
  Description of Artificial Sequence: Synthetic oligonucleotide
actgagtctcggtcggcgaat

SEQ ID NO: 37854 - DNA, 21 bp, Artificial Sequence
  Description of Artificial Sequence: Synthetic oligonucleotide
aattctgttaagactcctgag

SEQ ID NO: 37855 - DNA, 21 bp, Artificial Sequence
  Description of Artificial Sequence: Synthetic oligonucleotide
cctacgtctttttcgggtact

SEQ ID NO: 37856 - DNA, 21 bp, Artificial Sequence
  Description of Artificial Sequence: Synthetic oligonucleotide
aatacttcttcttctcatacg

SEQ ID NO: 37857 - DNA, 21 bp, Artificial Sequence
  Description of Artificial Sequence: Synthetic oligonucleotide
cccatcctcgacagaaaaagc

SEQ ID NO: 37858 - DNA, 21 bp, Artificial Sequence
  Description of Artificial Sequence: Synthetic oligonucleotide
cgtacttcgacttctcttctt

SEQ ID NO: 37859 - DNA, 21 bp, Artificial Sequence
  Description of Artificial Sequence: Synthetic oligonucleotide
actacgtctgctcggcctaat

SEQ ID NO: 37860 - DNA, 21 bp, Artificial Sequence
  Description of Artificial Sequence: Synthetic oligonucleotide
ttgagtcaggggaggatggtt

SEQ ID NO: 37861 - DNA, 21 bp, Artificial Sequence
  Description of Artificial Sequence: Synthetic oligonucleotide
aaccaaagcagacccggcgtc

SEQ ID NO: 37862 - DNA, 21 bp, Artificial Sequence
  Description of Artificial Sequence: Synthetic oligonucleotide
acggagcaggctcgggctatg

SEQ ID NO: 37863 - DNA, 21 bp, Artificial Sequence
  Description of Artificial Sequence: Synthetic oligonucleotide
ggcagcagcctcaccagcaga

SEQ ID NO: 37864 - DNA, 21 bp, Artificial Sequence
  Description of Artificial Sequence: Synthetic oligonucleotide
agagacagaccccaaagcacc

SEQ ID NO: 37865 - DNA, 21 bp, Artificial Sequence
  Description of Artificial Sequence: Synthetic oligonucleotide
gggtctgggtctcggttgatt

SEQ ID NO: 37866 - DNA, 21 bp, Artificial Sequence
  Description of Artificial Sequence: Synthetic oligonucleotide
ggggatatggggatttcgaag

SEQ ID NO: 37867 - DNA, 21 bp, Artificial Sequence
  Description of Artificial Sequence: Synthetic oligonucleotide
gtgagtggtcaggggaattct

SEQ ID NO: 37868 - DNA, 21 bp, Artificial Sequence
  Description of Artificial Sequence: Synthetic oligonucleotide
atcagcacccccaaaaccgcc

SEQ ID NO: 37869 - DNA, 21 bp, Artificial Sequence
  Description of Artificial Sequence: Synthetic oligonucleotide
ggtcctggtaggaatttgatt

SEQ ID NO: 37870 - DNA, 21 bp, Artificial Sequence
  Description of Artificial Sequence: Synthetic oligonucleotide
attgcgactaaggcggttgct

SEQ ID NO: 37871 - DNA, 21 bp, Artificial Sequence
  Description of Artificial Sequence: Synthetic oligonucleotide
cctccgctgggttcgacggtg

SEQ ID NO: 37872 - DNA, 21 bp, Artificial Sequence
  Description of Artificial Sequence: Synthetic oligonucleotide
ggcgccagcacccccagactc

SEQ ID NO: 37873 - DNA, 21 bp, Artificial Sequence
  Description of Artificial Sequence: Synthetic oligonucleotide
accagcagcggcggcctcacc

SEQ ID NO: 37874 - DNA, 21 bp, Artificial Sequence
  Description of Artificial Sequence: Synthetic oligonucleotide
cagtctgatcatcggagtttg

SEQ ID NO: 37875 - DNA, 21 bp, Artificial Sequence
  Description of Artificial Sequence: Synthetic oligonucleotide
tacagaaacaccaccagcgcc

SEQ ID NO: 37876 - DNA, 21 bp, Artificial Sequence
  Description of Artificial Sequence: Synthetic oligonucleotide
gctatgactggttcgcatact

SEQ ID NO: 37877 - DNA, 21 bp, Artificial Sequence
  Description of Artificial Sequence: Synthetic oligonucleotide
aaccaaagcagcagcgccaga

SEQ ID NO: 37878 - DNA, 21 bp, Artificial Sequence
  Description of Artificial Sequence: Synthetic oligonucleotide
gttcagcagtcgaaggcgtat

SEQ ID NO: 37879 - DNA, 21 bp, Artificial Sequence
  Description of Artificial Sequence: Synthetic oligonucleotide
actggtactcaggggactagg

SEQ ID NO: 37880 - DNA, 21 bp, Artificial Sequence
  Description of Artificial Sequence: Synthetic oligonucleotide
ggcagcagaaacaccagcacc

SEQ ID NO: 37881 - DNA, 21 bp, Artificial Sequence
  Description of Artificial Sequence: Synthetic oligonucleotide
cctggtatgaaggtgagtccg

SEQ ID NO: 37882 - DNA, 21 bp, Artificial Sequence
  Description of Artificial Sequence: Synthetic oligonucleotide
accctcgaaaacagcagaaga

SEQ ID NO: 37883 - DNA, 21 bp, Artificial Sequence
  Description of Artificial Sequence: Synthetic oligonucleotide
cagattactccgcggagtggg

SEQ ID NO: 37884 - DNA, 21 bp, Artificial Sequence
  Description of Artificial Sequence: Synthetic oligonucleotide
cgtagtgcgacttctagtgtt

SEQ ID NO: 37885 - DNA, 21 bp, Artificial Sequence
  Description of Artificial Sequence: Synthetic oligonucleotide
tatcagaaggagcgtgttgtt

SEQ ID NO: 37886 - DNA, 21 bp, Artificial Sequence
  Description of Artificial Sequence: Synthetic oligonucleotide
cttaggagtgctcctagtatt

SEQ ID NO: 37887 - DNA, 21 bp, Artificial Sequence
  Description of Artificial Sequence: Synthetic oligonucleotide
cctcctgcggtggggtcgtcg

SEQ ID NO: 37888 - DNA, 21 bp, Artificial Sequence
  Description of Artificial Sequence: Synthetic oligonucleotide
tcgagtcgtggtgggaatact

SEQ ID NO: 37889 - DNA, 21 bp, Artificial Sequence
  Description of Artificial Sequence: Synthetic oligonucleotide
ctccaaagagccccccaaacc

SEQ ID NO: 37890 - DNA, 21 bp, Artificial Sequence
  Description of Artificial Sequence: Synthetic oligonucleotide
gctggtactggtagttcgctt

SEQ ID NO: 37891 - DNA, 21 bp, Artificial Sequence
  Description of Artificial Sequence: Synthetic oligonucleotide
aatcatgagagttcgtatcgg

SEQ ID NO: 37892 - DNA, 21 bp, Artificial Sequence
  Description of Artificial Sequence: Synthetic oligonucleotide
ctcggcaccagccaccaacaa

SEQ ID NO: 37893 - DNA, 21 bp, Artificial Sequence
  Description of Artificial Sequence: Synthetic oligonucleotide
cccatcaccagaagcctcctc

SEQ ID NO: 37894 - DNA, 21 bp, Artificial Sequence
  Description of Artificial Sequence: Synthetic oligonucleotide
gtgcagcatactcattcgggt

SEQ ID NO: 37895 - DNA, 21 bp, Artificial Sequence
  Description of Artificial Sequence: Synthetic oligonucleotide
cctctgccggctcatagtcct

SEQ ID NO: 37896 - DNA, 21 bp, Artificial Sequence
  Description of Artificial Sequence: Synthetic oligonucleotide
atcatccaagacaccgccaga

SEQ ID NO: 37897 - DNA, 21 bp, Artificial Sequence
  Description of Artificial Sequence: Synthetic oligonucleotide
cccagcctcaacaaaaactac

SEQ ID NO: 37898 - DNA, 21 bp, Artificial Sequence
  Description of Artificial Sequence: Synthetic oligonucleotide
cccagactcaacgtcggcggc

SEQ ID NO: 37899 - DNA, 21 bp, Artificial Sequence
  Description of Artificial Sequence: Synthetic oligonucleotide
actaatccgaatccgcatagg

SEQ ID NO: 37900 - DNA, 21 bp, Artificial Sequence
  Description of Artificial Sequence: Synthetic oligonucleotide
aacagagaacaactcagagac

SEQ ID NO: 37901 - DNA, 21 bp, Artificial Sequence
  Description of Artificial Sequence: Synthetic oligonucleotide
agtatgggtcatactttgaat

SEQ ID NO: 37902 - DNA, 21 bp, Artificial Sequence
  Description of Artificial Sequence: Synthetic oligonucleotide
gctcctacttcgggtccgagt

SEQ ID NO: 37903 - DNA, 21 bp, Artificial Sequence
  Description of Artificial Sequence: Synthetic oligonucleotide
caaagcagcaacgccagaaac

SEQ ID NO: 37904 - DNA, 21 bp, Artificial Sequence
  Description of Artificial Sequence: Synthetic oligonucleotide
aaacaacacaacaccctcggc

SEQ ID NO: 37905 - DNA, 21 bp, Artificial Sequence
  Description of Artificial Sequence: Synthetic oligonucleotide
agtcctgggacgaatactagt

SEQ ID NO: 37906 - DNA, 21 bp, Artificial Sequence
  Description of Artificial Sequence: Synthetic oligonucleotide
acccaaagaagccaagccgcc

SEQ ID NO: 37907 - DNA, 21 bp, Artificial Sequence
  Description of Artificial Sequence: Synthetic oligonucleotide
gacatcaccagaggccccagc

SEQ ID NO: 37908 - DNA, 21 bp, Artificial Sequence
  Description of Artificial Sequence: Synthetic oligonucleotide
gtccaacccagaaccagcacc

SEQ ID NO: 37909 - DNA, 21 bp, Artificial Sequence
  Description of Artificial Sequence: Synthetic oligonucleotide
gacaccagaggccaaatgaga

SEQ ID NO: 37910 - DNA, 21 bp, Artificial Sequence
  Description of Artificial Sequence: Synthetic oligonucleotide
attaggacgaaggagtctgcg

SEQ ID NO: 37911 - DNA, 21 bp, Artificial Sequence
  Description of Artificial Sequence: Synthetic oligonucleotide
gttagtgtggataagcgtcct

SEQ ID NO: 37912 - DNA, 21 bp, Artificial Sequence
  Description of Artificial Sequence: Synthetic oligonucleotide
cccacccacgccagcagcctc

SEQ ID NO: 37913 - DNA, 21 bp, Artificial Sequence
  Description of Artificial Sequence: Synthetic oligonucleotide
catgcgacgcagagtcgtaat

SEQ ID NO: 37914 - DNA, 21 bp, Artificial Sequence
  Description of Artificial Sequence: Synthetic oligonucleotide
ggtcttgcgcgggctggtcat

SEQ ID NO: 37915 - DNA, 21 bp, Artificial Sequence
  Description of Artificial Sequence: Synthetic oligonucleotide
cacgccagccccagcaccaga

SEQ ID NO: 37916 - DNA, 21 bp, Artificial Sequence
  Description of Artificial Sequence: Synthetic oligonucleotide
ggcaacagacaaggcatgggc

SEQ ID NO: 37917 - DNA, 21 bp, Artificial Sequence
  Description of Artificial Sequence: Synthetic oligonucleotide
atgtcgacgagttcgaagtct

SEQ ID NO: 37918 - DNA, 21 bp, Artificial Sequence
  Description of Artificial Sequence: Synthetic oligonucleotide
agtgcgaataataagtcgggg

SEQ ID NO: 37919 - DNA, 21 bp, Artificial Sequence
  Description of Artificial Sequence: Synthetic oligonucleotide
agccaacacagacccagcagc

SEQ ID NO: 37920 - DNA, 21 bp, Artificial Sequence
  Description of Artificial Sequence: Synthetic oligonucleotide
accccccaaaacgtcagaaac

SEQ ID NO: 37921 - DNA, 21 bp, Artificial Sequence
  Description of Artificial Sequence: Synthetic oligonucleotide
actcctgtgaataggactcat

SEQ ID NO: 37922 - DNA, 21 bp, Artificial Sequence
  Description of Artificial Sequence: Synthetic oligonucleotide
ctcacccccagcaaaatcggc

SEQ ID NO: 37923 - DNA, 21 bp, Artificial Sequence
  Description of Artificial Sequence: Synthetic oligonucleotide
gtgccgcatggggctacttct

SEQ ID NO: 37924 - DNA, 21 bp, Artificial Sequence
  Description of Artificial Sequence: Synthetic oligonucleotide
agcggcagagacaaattcagc

SEQ ID NO: 37925 - DNA, 21 bp, Artificial Sequence
  Description of Artificial Sequence: Synthetic oligonucleotide
agaggcgacccccacagagcc

SEQ ID NO: 37926 - DNA, 21 bp, Artificial Sequence
  Description of Artificial Sequence: Synthetic oligonucleotide
ccgggtaattcgcataagatt

SEQ ID NO: 37927 - DNA, 21 bp, Artificial Sequence
  Description of Artificial Sequence: Synthetic oligonucleotide
aatccggctcatggtcttaat

SEQ ID NO: 37928 - DNA, 21 bp, Artificial Sequence
  Description of Artificial Sequence: Synthetic oligonucleotide
agaaccgccagcagcctcccc

SEQ ID NO: 37929 - DNA, 21 bp, Artificial Sequence
  Description of Artificial Sequence: Synthetic oligonucleotide
agaagacaagacacccaagaa

SEQ ID NO: 37930 - DNA, 21 bp, Artificial Sequence
  Description of Artificial Sequence: Synthetic oligonucleotide
gggtctgagcataagaagcag

SEQ ID NO: 37931 - DNA, 21 bp, Artificial Sequence
  Description of Artificial Sequence: Synthetic oligonucleotide
gtcaacgaacacaacgtcaga

SEQ ID NO: 37932 - DNA, 21 bp, Artificial Sequence
  Description of Artificial Sequence: Synthetic oligonucleotide
cccgaacccgccgccagaaac

SEQ ID NO: 37933 - DNA, 21 bp, Artificial Sequence
  Description of Artificial Sequence: Synthetic oligonucleotide
cattataatcagactggtttg

SEQ ID NO: 37934 - DNA, 21 bp, Artificial Sequence
  Description of Artificial Sequence: Synthetic oligonucleotide
agccaccaaacccccggctac

SEQ ID NO: 37935 - DNA, 21 bp, Artificial Sequence
  Description of Artificial Sequence: Synthetic oligonucleotide
agtcttagttcgaagcagatg

SEQ ID NO: 37936 - DNA, 21 bp, Artificial Sequence
  Description of Artificial Sequence: Synthetic oligonucleotide
aacgcccaaggcaccgccaaa

SEQ ID NO: 37937 - DNA, 21 bp, Artificial Sequence
  Description of Artificial Sequence: Synthetic oligonucleotide
gtgactggtagtgtgtcggat

SEQ ID NO: 37938 - DNA, 21 bp, Artificial Sequence
  Description of Artificial Sequence: Synthetic oligonucleotide
cccggccaaagcaccagcaaa

SEQ ID NO: 37939 - DNA, 21 bp, Artificial Sequence
  Description of Artificial Sequence: Synthetic oligonucleotide
gtgctggatactaaggattgt

SEQ ID NO: 37940 - DNA, 21 bp, Artificial Sequence
  Description of Artificial Sequence: Synthetic oligonucleotide
acggggggtaatcgtgttttg

SEQ ID NO: 37941 - DNA, 21 bp, Artificial Sequence
  Description of Artificial Sequence: Synthetic oligonucleotide
gttagtaataagtctgtgctt

SEQ ID NO: 37942 - DNA, 21 bp, Artificial Sequence
  Description of Artificial Sequence: Synthetic oligonucleotide
aatcatagggctaatcttatt

SEQ ID NO: 37943 - DNA, 21 bp, Artificial Sequence
  Description of Artificial Sequence: Synthetic oligonucleotide
catgtgaatagtgggaagctg

SEQ ID NO: 37944 - DNA, 21 bp, Artificial Sequence
  Description of Artificial Sequence: Synthetic oligonucleotide
caacaattcggcaccctcaaa

SEQ ID NO: 37945 - DNA, 21 bp, Artificial Sequence
  Description of Artificial Sequence: Synthetic oligonucleotide
tggcaggaggagcgggggcag

SEQ ID NO: 37946 - DNA, 21 bp, Artificial Sequence
  Description of Artificial Sequence: Synthetic oligonucleotide
ttcaccatccccagagccgcc

SEQ ID NO: 37947 - DNA, 21 bp, Artificial Sequence
  Description of Artificial Sequence: Synthetic oligonucleotide
cagggtaagagtggggagcag

SEQ ID NO: 37948 - DNA, 21 bp, Artificial Sequence
  Description of Artificial Sequence: Synthetic oligonucleotide
actgggacgtctgggagtcgt

SEQ ID NO: 37949 - DNA, 21 bp, Artificial Sequence
  Description of Artificial Sequence: Synthetic oligonucleotide
actacgagtaagggtgggatt

SEQ ID NO: 37950 - DNA, 21 bp, Artificial Sequence
  Description of Artificial Sequence: Synthetic oligonucleotide
aagccggcgactcctaatggg

SEQ ID NO: 37951 - DNA, 21 bp, Artificial Sequence
  Description of Artificial Sequence: Synthetic oligonucleotide
cagaatacgaatgcggctatt

SEQ ID NO: 37952 - DNA, 21 bp, Artificial Sequence
  Description of Artificial Sequence: Synthetic oligonucleotide
aattctcataatggtgcttct

SEQ ID NO: 37953 - DNA, 21 bp, Artificial Sequence
  Description of Artificial Sequence: Synthetic oligonucleotide
cccgtcagcagaggcagcggc

SEQ ID NO: 37954 - DNA, 21 bp, Artificial Sequence
  Description of Artificial Sequence: Synthetic oligonucleotide
tcgatggggaattcgattagt

SEQ ID NO: 37955 - DNA, 21 bp, Artificial Sequence
  Description of Artificial Sequence: Synthetic oligonucleotide
agcggcagcggccaaaaccaa

SEQ ID NO: 37956 - DNA, 21 bp, Artificial Sequence
  Description of Artificial Sequence: Synthetic oligonucleotide
ttcagaacccaaagcaccaaa

SEQ ID NO: 37957 - DNA, 21 bp, Artificial Sequence
  Description of Artificial Sequence: Synthetic oligonucleotide
caggttccggctagtcatggg

SEQ ID NO: 37958 - DNA, 21 bp, Artificial Sequence
  Description of Artificial Sequence: Synthetic oligonucleotide
cccaacctccaaagcagcaac

SEQ ID NO: 37959 - DNA, 21 bp, Artificial Sequence
  Description of Artificial Sequence: Synthetic oligonucleotide
ggtcttgggcagcagacgaat

SEQ ID NO: 37960 - DNA, 21 bp, Artificial Sequence
  Description of Artificial Sequence: Synthetic oligonucleotide
aaaaacgccccccaacaagcc

SEQ ID NO: 37961 - DNA, 21 bp, Artificial Sequence
  Description of Artificial Sequence: Synthetic oligonucleotide
gacatccccgccaaaaccgcc

SEQ ID NO: 37962 - DNA, 21 bp, Artificial Sequence
  Description of Artificial Sequence: Synthetic oligonucleotide
gtcacccccaccaaacacccc

SEQ ID NO: 37963 - DNA, 21 bp, Artificial Sequence
  Description of Artificial Sequence: Synthetic oligonucleotide
agaatgagcaacctcctcggc

SEQ ID NO: 37964 - DNA, 21 bp, Artificial Sequence
  Description of Artificial Sequence: Synthetic oligonucleotide
ccgaatacgaagcctgtgttg

SEQ ID NO: 37965 - DNA, 21 bp, Artificial Sequence
  Description of Artificial Sequence: Synthetic oligonucleotide
gtcaccggcaccaccagcgaa

SEQ ID NO: 37966 - DNA, 21 bp, Artificial Sequence
  Description of Artificial Sequence: Synthetic oligonucleotide
gttcctagggctcctggtatg

SEQ ID NO: 37967 - DNA, 21 bp, Artificial Sequence
  Description of Artificial Sequence: Synthetic oligonucleotide
tctgcttctcgttctgcgtat

SEQ ID NO: 37968 - DNA, 21 bp, Artificial Sequence
  Description of Artificial Sequence: Synthetic oligonucleotide
agaggcagcggcctcctcctc

SEQ ID NO: 37969 - DNA, 21 bp, Artificial Sequence
  Description of Artificial Sequence: Synthetic oligonucleotide
cccaccaccgccagcagacaa

SEQ ID NO: 37970 - DNA, 21 bp, Artificial Sequence
  Description of Artificial Sequence: Synthetic oligonucleotide
cacagcaccaccgtcgccaaa

SEQ ID NO: 37971 - DNA, 21 bp, Artificial Sequence
  Description of Artificial Sequence: Synthetic oligonucleotide
aatagtgggaagccgaatgcg

SEQ ID NO: 37972 - DNA, 21 bp, Artificial Sequence
  Description of Artificial Sequence: Synthetic oligonucleotide
tatggtcgtgataagtttagt

SEQ ID NO: 37973 - DNA, 21 bp, Artificial Sequence
  Description of Artificial Sequence: Synthetic oligonucleotide
gtgggtccgtcgaagattcag

SEQ ID NO: 37974 - DNA, 21 bp, Artificial Sequence
  Description of Artificial Sequence: Synthetic oligonucleotide
aacggcagcggccaataccaa

SEQ ID NO: 37975 - DNA, 21 bp, Artificial Sequence
  Description of Artificial Sequence: Synthetic oligonucleotide
cctgggacgaagcagagttcg

SEQ ID NO: 37976 - DNA, 21 bp, Artificial Sequence
  Description of Artificial Sequence: Synthetic oligonucleotide
ttcggcagcagcaacgccgtc

SEQ ID NO: 37977 - DNA, 21 bp, Artificial Sequence
  Description of Artificial Sequence: Synthetic oligonucleotide
ctgtcgaatcagaataatcag

SEQ ID NO: 37978 - DNA, 21 bp, Artificial Sequence
  Description of Artificial Sequence: Synthetic oligonucleotide
aggacgggtgagtcttatatg

SEQ ID NO: 37979 - DNA, 21 bp, Artificial Sequence
  Description of Artificial Sequence: Synthetic oligonucleotide
tctattcattcgactaaggcg

SEQ ID NO: 37980 - DNA, 21 bp, Artificial Sequence
  Description of Artificial Sequence: Synthetic oligonucleotide
tttagtaataatggttcgcat

SEQ ID NO: 37981 - DNA, 21 bp, Artificial Sequence
  Description of Artificial Sequence: Synthetic oligonucleotide
ctcgtcagcgtcaaccaactc

SEQ ID NO: 37982 - DNA, 21 bp, Artificial Sequence
  Description of Artificial Sequence: Synthetic oligonucleotide
tcgggttctacgaggagggat

SEQ ID NO: 37983 - DNA, 21 bp, Artificial Sequence
  Description of Artificial Sequence: Synthetic oligonucleotide
gcgggtggtattaataagctt

SEQ ID NO: 37984 - DNA, 21 bp, Artificial Sequence
  Description of Artificial Sequence: Synthetic oligonucleotide
actgctattggggatgtgtct

SEQ ID NO: 37985 - DNA, 21 bp, Artificial Sequence
  Description of Artificial Sequence: Synthetic oligonucleotide
ccgtatgttaagagtgctggg

SEQ ID NO: 37986 - DNA, 21 bp, Artificial Sequence
  Description of Artificial Sequence: Synthetic oligonucleotide
agaagccccggcagcaacacc

SEQ ID NO: 37987 - DNA, 21 bp, Artificial Sequence
  Description of Artificial Sequence: Synthetic oligonucleotide
atgtaccaaaaacccgccagc

SEQ ID NO: 37988 - DNA, 21 bp, Artificial Sequence
  Description of Artificial Sequence: Synthetic oligonucleotide
aattctcgtgagaagggtgcg

SEQ ID NO: 37989 - DNA, 21 bp, Artificial Sequence
  Description of Artificial Sequence: Synthetic oligonucleotide
tctagtgggaatcggactact

SEQ ID NO: 37990 - DNA, 21 bp, Artificial Sequence
  Description of Artificial Sequence: Synthetic oligonucleotide
gttgcgagtcagcctgttcgt

SEQ ID NO: 37991 - DNA, 21 bp, Artificial Sequence
  Description of Artificial Sequence: Synthetic oligonucleotide
atgacccaacacaaacaagcc

SEQ ID NO: 37992 - DNA, 21 bp, Artificial Sequence
  Description of Artificial Sequence: Synthetic oligonucleotide
tcgtcttatgtggggccttcg

SEQ ID NO: 37993 - DNA, 21 bp, Artificial Sequence
  Description of Artificial Sequence: Synthetic oligonucleotide
cggatgagggataatcctggt

SEQ ID NO: 37994 - DNA, 21 bp, Artificial Sequence
  Description of Artificial Sequence: Synthetic oligonucleotide
atgagtcatactaataggccg

SEQ ID NO: 37995 - DNA, 21 bp, Artificial Sequence
  Description of Artificial Sequence: Synthetic oligonucleotide
ctgcgtgataagactggtgct

SEQ ID NO: 37996 - DNA, 21 bp, Artificial Sequence
  Description of Artificial Sequence: Synthetic oligonucleotide
tctcagcagtctgctgcgctt

SEQ ID NO: 37997 - DNA, 21 bp, Artificial Sequence
  Description of Artificial Sequence: Synthetic oligonucleotide
cagttgccggctttgcagggt

SEQ ID NO: 37998 - DNA, 21 bp, Artificial Sequence
  Description of Artificial Sequence: Synthetic oligonucleotide
ccgtctggggagactagtaag

SEQ ID NO: 37999 - DNA, 21 bp, Artificial Sequence
  Description of Artificial Sequence: Synthetic oligonucleotide
gctcgtggtggtgttttgagt

SEQ ID NO: 38000 - DNA, 21 bp, Artificial Sequence
  Description of Artificial Sequence: Synthetic oligonucleotide
accgccagcggcagcaacgcc

SEQ ID NO: 38001 - DNA, 21 bp, Artificial Sequence
  Description of Artificial Sequence: Synthetic oligonucleotide
aattcgtcgacgtcggcgaag

SEQ ID NO: 38002 - DNA, 21 bp, Artificial Sequence
  Description of Artificial Sequence: Synthetic oligonucleotide
tacggcagcgaaagcaacaaa

SEQ ID NO: 38003 - DNA, 21 bp, Artificial Sequence
  Description of Artificial Sequence: Synthetic oligonucleotide
cctcatatttcgcctaagggg

SEQ ID NO: 38004 - DNA, 21 bp, Artificial Sequence
  Description of Artificial Sequence: Synthetic oligonucleotide
cccgtcagcgacagaagaggc

SEQ ID NO: 38005 - DNA, 21 bp, Artificial Sequence
  Description of Artificial Sequence: Synthetic oligonucleotide
cagagtgggccgggggttact

SEQ ID NO: 38006 - DNA, 21 bp, Artificial Sequence
  Description of Artificial Sequence: Synthetic oligonucleotide
cttcttagtgctaaggggggg

SEQ ID NO: 38007 - DNA, 21 bp, Artificial Sequence
  Description of Artificial Sequence: Synthetic oligonucleotide
gtggggaatcgggcgaattgt

SEQ ID NO: 38008 - DNA, 21 bp, Artificial Sequence
  Description of Artificial Sequence: Synthetic oligonucleotide
acgggtagttcggggcgtatt

SEQ ID NO: 38009 - DNA, 21 bp, Artificial Sequence
  Description of Artificial Sequence: Synthetic oligonucleotide
gaagtcttcagcagccaaaaa

SEQ ID NO: 38010 - DNA, 21 bp, Artificial Sequence
  Description of Artificial Sequence: Synthetic oligonucleotide
aacagccaccaaaaacccagc

SEQ ID NO: 38011 - DNA, 21 bp, Artificial Sequence
  Description of Artificial Sequence: Synthetic oligonucleotide
cccctcagcggcagcaaagcc

SEQ ID NO: 38012 - DNA, 21 bp, Artificial Sequence
  Description of Artificial Sequence: Synthetic oligonucleotide
accaccatgagcaaacccagc

SEQ ID NO: 38013 - DNA, 21 bp, Artificial Sequence
  Description of Artificial Sequence: Synthetic oligonucleotide
gctttggcgggtactaagggg

SEQ ID NO: 38014 - DNA, 21 bp, Artificial Sequence
  Description of Artificial Sequence: Synthetic oligonucleotide
cggggggatactaagaatttg

SEQ ID NO: 38015 - DNA, 21 bp, Artificial Sequence
  Description of Artificial Sequence: Synthetic oligonucleotide
agcatcagcgacaaactcggc

SEQ ID NO: 38016 - DNA, 21 bp, Artificial Sequence
  Description of Artificial Sequence: Synthetic oligonucleotide
agagaatacaacaccaccagc

SEQ ID NO: 38017 - DNA, 21 bp, Artificial Sequence
  Description of Artificial Sequence: Synthetic oligonucleotide
ctttcgcggaatgggattaat

SEQ ID NO: 38018 - DNA, 21 bp, Artificial Sequence
  Description of Artificial Sequence: Synthetic oligonucleotide
agacaaaacaacggcatcaaa

SEQ ID NO: 38019 - DNA, 21 bp, Artificial Sequence
  Description of Artificial Sequence: Synthetic oligonucleotide
tctgttgttagtgaggttcgg

SEQ ID NO: 38020 - DNA, 21 bp, Artificial Sequence
  Description of Artificial Sequence: Synthetic oligonucleotide
atcggccccagcggcgtcctc

SEQ ID NO: 38021 - DNA, 21 bp, Artificial Sequence
  Description of Artificial Sequence: Synthetic oligonucleotide
agtgtgacgcctcgtgagtat

SEQ ID NO: 38022 - DNA, 21 bp, Artificial Sequence
  Description of Artificial Sequence: Synthetic oligonucleotide
agcggcacccaaacctggagc

SEQ ID NO: 38023 - DNA, 21 bp, Artificial Sequence
  Description of Artificial Sequence: Synthetic oligonucleotide
agtagttcggcgcctcgtctt

SEQ ID NO: 38024 - DNA, 21 bp, Artificial Sequence
  Description of Artificial Sequence: Synthetic oligonucleotide
ccgatgggtaggaatgcgggg

SEQ ID NO: 38025 - DNA, 21 bp, Artificial Sequence
  Description of Artificial Sequence: Synthetic oligonucleotide
ttcagacaaggcggcgccatc

SEQ ID NO: 38026 - DNA, 21 bp, Artificial Sequence
  Description of Artificial Sequence: Synthetic oligonucleotide
gaccaagtcagccacaaactc

SEQ ID NO: 38027 - DNA, 21 bp, Artificial Sequence
  Description of Artificial Sequence: Synthetic oligonucleotide
agcagcagccccaacgtcaaa

SEQ ID NO: 38028 - DNA, 21 bp, Artificial Sequence
  Description of Artificial Sequence: Synthetic oligonucleotide
cagcctactcagaggatgggt

SEQ ID NO: 38029 - DNA, 21 bp, Artificial Sequence
  Description of Artificial Sequence: Synthetic oligonucleotide
cataatgtggttggtcgtggt

SEQ ID NO: 38030 - DNA, 21 bp, Artificial Sequence
  Description of Artificial Sequence: Synthetic oligonucleotide
ggttttcctaatgttgcgact

SEQ ID NO: 38031 - DNA, 21 bp, Artificial Sequence
  Description of Artificial Sequence: Synthetic oligonucleotide
cagcctacgcggtctacggct

SEQ ID NO: 38032 - DNA, 21 bp, Artificial Sequence
  Description of Artificial Sequence: Synthetic oligonucleotide
ggcaccgacagcaaaagacac

SEQ ID NO: 38033 - DNA, 21 bp, Artificial Sequence
  Description of Artificial Sequence: Synthetic oligonucleotide
actggtatgtcgaataatcgt

SEQ ID NO: 38034 - DNA, 21 bp, Artificial Sequence
  Description of Artificial Sequence: Synthetic oligonucleotide
ctcggcggcagaagcagcaac

SEQ ID NO: 38035 - DNA, 21 bp, Artificial Sequence
  Description of Artificial Sequence: Synthetic oligonucleotide
accagagaaagcagaaccaac

SEQ ID NO: 38036 - DNA, 21 bp, Artificial Sequence
  Description of Artificial Sequence: Synthetic oligonucleotide
catcaggagagggcgagtatg

SEQ ID NO: 38037 - DNA, 21 bp, Artificial Sequence
  Description of Artificial Sequence: Synthetic oligonucleotide
ccccaagccagcagaggcatg

SEQ ID NO: 38038 - DNA, 21 bp, Artificial Sequence
  Description of Artificial Sequence: Synthetic oligonucleotide
aaggatgagcgtaaggggatg

SEQ ID NO: 38039 - DNA, 21 bp, Artificial Sequence
  Description of Artificial Sequence: Synthetic oligonucleotide
tcgatggggaagttgtctagt

SEQ ID NO: 38040 - DNA, 21 bp, Artificial Sequence
  Description of Artificial Sequence: Synthetic oligonucleotide
aaaatcgccagcaaaagcgaa

SEQ ID NO: 38041 - DNA, 21 bp, Artificial Sequence
  Description of Artificial Sequence: Synthetic oligonucleotide
caactccccgtccccagcaac

SEQ ID NO: 38042 - DNA, 21 bp, Artificial Sequence
  Description of Artificial Sequence: Synthetic oligonucleotide
ggtacgcctaataatcgttct

SEQ ID NO: 38043 - DNA, 21 bp, Artificial Sequence
  Description of Artificial Sequence: Synthetic oligonucleotide
gtgatgaatcgtacgggtggt

SEQ ID NO: 38044 - DNA, 21 bp, Artificial Sequence
  Description of Artificial Sequence: Synthetic oligonucleotide
aacaccgtcagcaaaagccaa

SEQ ID NO: 38045 - DNA, 21 bp, Artificial Sequence
  Description of Artificial Sequence: Synthetic oligonucleotide
gtttctagtcgtgcgtcgagt

SEQ ID NO: 38046 - DNA, 21 bp, Artificial Sequence
  Description of Artificial Sequence: Synthetic oligonucleotide
tacgtccaaaacggcggcaga

SEQ ID NO: 38047 - DNA, 21 bp, Artificial Sequence
  Description of Artificial Sequence: Synthetic oligonucleotide
agccccggcaacaaactcctc

SEQ ID NO: 38048 - DNA, 21 bp, Artificial Sequence
  Description of Artificial Sequence: Synthetic oligonucleotide
tcgattaagagtgctgctgct

SEQ ID NO: 38049 - DNA, 21 bp, Artificial Sequence
  Description of Artificial Sequence: Synthetic oligonucleotide
agcagaaccgcccacgaacaa

SEQ ID NO: 38050 - DNA, 21 bp, Artificial Sequence
  Description of Artificial Sequence: Synthetic oligonucleotide
cctcttggttataaggctacg

SEQ ID NO: 38051 - DNA, 21 bp, Artificial Sequence
  Description of Artificial Sequence: Synthetic oligonucleotide
aatagtggggcgaggcttagt

SEQ ID NO: 38052 - DNA, 21 bp, Artificial Sequence
  Description of Artificial Sequence: Synthetic oligonucleotide
actgctactaggcagcctgat

SEQ ID NO: 38053 - DNA, 21 bp, Artificial Sequence
  Description of Artificial Sequence: Synthetic oligonucleotide
caaagaaccagcgaccaaacc

SEQ ID NO: 38054 - DNA, 21 bp, Artificial Sequence
  Description of Artificial Sequence: Synthetic oligonucleotide
agcggcagcgacaaattcagc

SEQ ID NO: 38055 - DNA, 21 bp, Artificial Sequence
  Description of Artificial Sequence: Synthetic oligonucleotide
aagcttgctacggattcgttt

SEQ ID NO: 38056 - DNA, 21 bp, Artificial Sequence
  Description of Artificial Sequence: Synthetic oligonucleotide
ccccaacacatgacccacacc

SEQ ID NO: 38057 - DNA, 21 bp, Artificial Sequence
  Description of Artificial Sequence: Synthetic oligonucleotide
ttccaaaccagaaccgtcgcc

SEQ ID NO: 38058 - DNA, 21 bp, Artificial Sequence
  Description of Artificial Sequence: Synthetic oligonucleotide
ggccaagccagccacatgaaa

SEQ ID NO: 38059 - DNA, 21 bp, Artificial Sequence
  Description of Artificial Sequence: Synthetic oligonucleotide
aagcatcttgataatgagagt

SEQ ID NO: 38060 - DNA, 21 bp, Artificial Sequence
  Description of Artificial Sequence: Synthetic oligonucleotide
gggtctagtcagcgttcggat

SEQ ID NO: 38061 - DNA, 21 bp, Artificial Sequence
  Description of Artificial Sequence: Synthetic oligonucleotide
ggtcagggttctcatatgaag

SEQ ID NO: 38062 - DNA, 21 bp, Artificial Sequence
  Description of Artificial Sequence: Synthetic oligonucleotide
aatactactgcgaagtctagt

SEQ ID NO: 38063 - DNA, 21 bp, Artificial Sequence
  Description of Artificial Sequence: Synthetic oligonucleotide
accagcgtcagaagcctccaa

SEQ ID NO: 38064 - DNA, 21 bp, Artificial Sequence
  Description of Artificial Sequence: Synthetic oligonucleotide
ggttcgccgggggttttgcgt

SEQ ID NO: 38065 - DNA, 21 bp, Artificial Sequence
  Description of Artificial Sequence: Synthetic oligonucleotide
cacgccaccagcggcaccaga

SEQ ID NO: 38066 - DNA, 21 bp, Artificial Sequence
  Description of Artificial Sequence: Synthetic oligonucleotide
aggacggggaataatcatgag

SEQ ID NO: 38067 - DNA, 21 bp, Artificial Sequence
  Description of Artificial Sequence: Synthetic oligonucleotide
gataatatttctcggagtagg

SEQ ID NO: 38068 - DNA, 21 bp, Artificial Sequence
  Description of Artificial Sequence: Synthetic oligonucleotide
cgtgagggtggtcagatggtg

SEQ ID NO: 38069 - DNA, 21 bp, Artificial Sequence
  Description of Artificial Sequence: Synthetic oligonucleotide
ccttcgttgcagatgactagg

SEQ ID NO: 38070 - DNA, 21 bp, Artificial Sequence
  Description of Artificial Sequence: Synthetic oligonucleotide
ctcccccaccacaccagcgcc

SEQ ID NO: 38071 - DNA, 21 bp, Artificial Sequence
  Description of Artificial Sequence: Synthetic oligonucleotide
aacccccccgtctacaccagc

SEQ ID NO: 38072 - DNA, 21 bp, Artificial Sequence
  Description of Artificial Sequence: Synthetic oligonucleotide
aagacgggggctaagatgggg

SEQ ID NO: 38073 - DNA, 21 bp, Artificial Sequence
  Description of Artificial Sequence: Synthetic oligonucleotide
agggatgataagcagaattcg

SEQ ID NO: 38074 - DNA, 21 bp, Artificial Sequence
  Description of Artificial Sequence: Synthetic oligonucleotide
ttcaaccaacacagcagcctc

SEQ ID NO: 38075 - DNA, 21 bp, Artificial Sequence
  Description of Artificial Sequence: Synthetic oligonucleotide
atgaccgaaagcagcagaacc

SEQ ID NO: 38076 - DNA, 21 bp, Artificial Sequence
  Description of Artificial Sequence: Synthetic oligonucleotide
aacggtactggacagaatcaa

SEQ ID NO: 38077 - DNA, 21 bp, Artificial Sequence
  Description of Artificial Sequence: Synthetic oligonucleotide
ccgttgtcggctggtaagagt

SEQ ID NO: 38078 - DNA, 21 bp, Artificial Sequence
  Description of Artificial Sequence: Synthetic oligonucleotide
ggttcggctcagtcgcctagg

SEQ ID NO: 38079 - DNA, 21 bp, Artificial Sequence
  Description of Artificial Sequence: Synthetic oligonucleotide
ccggcttcgcttggtcagggt

SEQ ID NO: 38080 - DNA, 21 bp, Artificial Sequence
  Description of Artificial Sequence: Synthetic oligonucleotide
tctcatgctagtagtactgcg

SEQ ID NO: 38081 - DNA, 21 bp, Artificial Sequence
  Description of Artificial Sequence: Synthetic oligonucleotide
cagaatacgcctaagagtact

SEQ ID NO: 38082 - DNA, 21 bp, Artificial Sequence
  Description of Artificial Sequence: Synthetic oligonucleotide
ctcagaagcaaagaaagcgcc

SEQ ID NO: 38083 - DNA, 21 bp, Artificial Sequence
  Description of Artificial Sequence: Synthetic oligonucleotide
agcagacccggcctcagccaa

SEQ ID NO: 38084 - DNA, 21 bp, Artificial Sequence
  Description of Artificial Sequence: Synthetic oligonucleotide
gaaggcaccagaggcgtcggc

SEQ ID NO: 38085 - DNA, 21 bp, Artificial Sequence
  Description of Artificial Sequence: Synthetic oligonucleotide
aattcgatgcctactacgctt

SEQ ID NO: 38086 - DNA, 21 bp, Artificial Sequence
  Description of Artificial Sequence: Synthetic oligonucleotide
gggacgactaattcgcgtaat

SEQ ID NO: 38087 - DNA, 21 bp, Artificial Sequence
  Description of Artificial Sequence: Synthetic oligonucleotide
agcaccttcagccccagcaaa

SEQ ID NO: 38088 - DNA, 21 bp, Artificial Sequence
  Description of Artificial Sequence: Synthetic oligonucleotide
gccagagacgaccaaagaaga

SEQ ID NO: 38089 - DNA, 21 bp, Artificial Sequence
  Description of Artificial Sequence: Synthetic oligonucleotide
tcttctacgagtagtccgtat

SEQ ID NO: 38090 - DNA, 21 bp, Artificial Sequence
  Description of Artificial Sequence: Synthetic oligonucleotide
tacagaaccacccacaccctc

SEQ ID NO: 38091 - DNA, 21 bp, Artificial Sequence
  Description of Artificial Sequence: Synthetic oligonucleotide
tttggtccttcgcagcttccg

SEQ ID NO: 38092 - DNA, 21 bp, Artificial Sequence
  Description of Artificial Sequence: Synthetic oligonucleotide
ggcggcctcagccccaaagtc

SEQ ID NO: 38093 - DNA, 21 bp, Artificial Sequence
  Description of Artificial Sequence: Synthetic oligonucleotide
ggcaaaatccaagacatcaaa

SEQ ID NO: 38094 - DNA, 21 bp, Artificial Sequence
  Description of Artificial Sequence: Synthetic oligonucleotide
caaaacctcagagtcggcgcc

SEQ ID NO: 38095 - DNA, 21 bp, Artificial Sequence
  Description of Artificial Sequence: Synthetic oligonucleotide
cgtgttgagaaggctactctt

SEQ ID NO: 38096 - DNA, 21 bp, Artificial Sequence
  Description of Artificial Sequence: Synthetic oligonucleotide
tctactacgggtgattcgaag

SEQ ID NO: 38097 - DNA, 21 bp, Artificial Sequence
  Description of Artificial Sequence: Synthetic oligonucleotide
acggtggctcatcctagtcat

SEQ ID NO: 38098 - DNA, 21 bp, Artificial Sequence
  Description of Artificial Sequence: Synthetic oligonucleotide
cagagtaagggtgggtcgaat

SEQ ID NO: 38099 - DNA, 21 bp, Artificial Sequence
  Description of Artificial Sequence: Synthetic oligonucleotide
agacaaaccacccccctcggc

SEQ ID NO: 38100 - DNA, 21 bp, Artificial Sequence
  Description of Artificial Sequence: Synthetic oligonucleotide
gggtgtattactaattgtagt

SEQ ID NO: 38101 - DNA, 21 bp, Artificial Sequence
  Description of Artificial Sequence: Synthetic oligonucleotide
agttcgtctgataagcttcgt

SEQ ID NO: 38102 - DNA, 21 bp, Artificial Sequence
  Description of Artificial Sequence: Synthetic oligonucleotide
gggattacggctaagttgacg

SEQ ID NO: 38103 - DNA, 21 bp, Artificial Sequence
  Description of Artificial Sequence: Synthetic oligonucleotide
gcctaccccagcggcagcagc

SEQ ID NO: 38104 - DNA, 21 bp, Artificial Sequence
  Description of Artificial Sequence: Synthetic oligonucleotide
atgggcctcggcagcaccaaa

SEQ ID NO: 38105 - DNA, 21 bp, Artificial Sequence
  Description of Artificial Sequence: Synthetic oligonucleotide
ggcggccaaaccgccagaatc

SEQ ID NO: 38106 - DNA, 21 bp, Artificial Sequence
  Description of Artificial Sequence: Synthetic oligonucleotide
cctcttcagcagaatcggtct

SEQ ID NO: 38107 - DNA, 21 bp, Artificial Sequence
  Description of Artificial Sequence: Synthetic oligonucleotide
tctgatcgtaatatgtctcgt

SEQ ID NO: 38108 - DNA, 21 bp, Artificial Sequence
  Description of Artificial Sequence: Synthetic oligonucleotide
gttcctagggttcctggtatg

SEQ ID NO: 38109 - DNA, 21 bp, Artificial Sequence
  Description of Artificial Sequence: Synthetic oligonucleotide
tctgttcttcattcgtcgcag

SEQ ID NO: 38110 - DNA, 21 bp, Artificial Sequence
  Description of Artificial Sequence: Synthetic oligonucleotide
cccaccggcgtcaacaaaatg

SEQ ID NO: 38111 - DNA, 21 bp, Artificial Sequence
  Description of Artificial Sequence: Synthetic oligonucleotide
gagccgacgcatccgcggggt

SEQ ID NO: 38112 - DNA, 21 bp, Artificial Sequence
  Description of Artificial Sequence: Synthetic oligonucleotide
aagaatccttcgagtgttaat

SEQ ID NO: 38113 - DNA, 21 bp, Artificial Sequence
  Description of Artificial Sequence: Synthetic oligonucleotide
gtccaccaactccccatcgcc

SEQ ID NO: 38114 - DNA, 21 bp, Artificial Sequence
  Description of Artificial Sequence: Synthetic oligonucleotide
ccttataatgtgagtcagaat

SEQ ID NO: 38115 - DNA, 21 bp, Artificial Sequence
  Description of Artificial Sequence: Synthetic oligonucleotide
cttttgtcgtctaaggggaat

SEQ ID NO: 38116 - DNA, 21 bp, Artificial Sequence
  Description of Artificial Sequence: Synthetic oligonucleotide
cacagccccaccggccccgcc

SEQ ID NO: 38117 - DNA, 21 bp, Artificial Sequence
  Description of Artificial Sequence: Synthetic oligonucleotide
agaatgaaaagcctcgacaac

SEQ ID NO: 38118 - DNA, 21 bp, Artificial Sequence
  Description of Artificial Sequence: Synthetic oligonucleotide
gcggtgccggcgaagggggct

SEQ ID NO: 38119 - DNA, 21 bp, Artificial Sequence
  Description of Artificial Sequence: Synthetic oligonucleotide
actcctacgttggctcatggt

SEQ ID NO: 38120 - DNA, 21 bp, Artificial Sequence
  Description of Artificial Sequence: Synthetic oligonucleotide
cacgacatcggcaaacaaaga

SEQ ID NO: 38121 - DNA, 21 bp, Artificial Sequence
  Description of Artificial Sequence: Synthetic oligonucleotide
agaggccccaccggcatgatg

SEQ ID NO: 38122 - DNA, 21 bp, Artificial Sequence
  Description of Artificial Sequence: Synthetic oligonucleotide
ccgacgaggaatgggaatatg

SEQ ID NO: 38123 - DNA, 21 bp, Artificial Sequence
  Description of Artificial Sequence: Synthetic oligonucleotide
aacaccagaagcagcagcggc

SEQ ID NO: 38124 - DNA, 21 bp, Artificial Sequence
  Description of Artificial Sequence: Synthetic oligonucleotide
gccggcggccccgccaacaga

SEQ ID NO: 38125 - DNA, 21 bp, Artificial Sequence
  Description of Artificial Sequence: Synthetic oligonucleotide
cccagccacaaccccaccaac

SEQ ID NO: 38126 - DNA, 21 bp, Artificial Sequence
  Description of Artificial Sequence: Synthetic oligonucleotide
tctcatgcgacggctgctact

SEQ ID NO: 38127 - DNA, 21 bp, Artificial Sequence
  Description of Artificial Sequence: Synthetic oligonucleotide
cctgggacgccttcttctggt

SEQ ID NO: 38128 - DNA, 21 bp, Artificial Sequence
  Description of Artificial Sequence: Synthetic oligonucleotide
aggcctgcggggcagcattct

SEQ ID NO: 38129 - DNA, 21 bp, Artificial Sequence
  Description of Artificial Sequence: Synthetic oligonucleotide
cctcgtgtggggaatcgtacg

SEQ ID NO: 38130 - DNA, 21 bp, Artificial Sequence
  Description of Artificial Sequence: Synthetic oligonucleotide
gacagaaaaaccctcagccac

SEQ ID NO: 38131 - DNA, 21 bp, Artificial Sequence
  Description of Artificial Sequence: Synthetic oligonucleotide
taccaaaacgtcagcagcaaa

SEQ ID NO: 38132 - DNA, 21 bp, Artificial Sequence
  Description of Artificial Sequence: Synthetic oligonucleotide
accggcatcgaaagacccatg

SEQ ID NO: 38133 - DNA, 21 bp, Artificial Sequence
  Description of Artificial Sequence: Synthetic oligonucleotide
gcctaccccaaaaacagcaac

SEQ ID NO: 38134 - DNA, 21 bp, Artificial Sequence
  Description of Artificial Sequence: Synthetic oligonucleotide
tctggggttactactaggggt

SEQ ID NO: 38135 - DNA, 21 bp, Artificial Sequence
  Description of Artificial Sequence: Synthetic oligonucleotide
caagtccccgccaccaacaga

SEQ ID NO: 38136 - DNA, 21 bp, Artificial Sequence
  Description of Artificial Sequence: Synthetic oligonucleotide
aaccaaatcaacgcccccaga

SEQ ID NO: 38137 - DNA, 21 bp, Artificial Sequence
  Description of Artificial Sequence: Synthetic oligonucleotide
tttcttaagggtactggttcg

SEQ ID NO: 38138 - DNA, 21 bp, Artificial Sequence
  Description of Artificial Sequence: Synthetic oligonucleotide
agggaggatactaagatgcat

SEQ ID NO: 38139 - DNA, 21 bp, Artificial Sequence
  Description of Artificial Sequence: Synthetic oligonucleotide
aggattacgtcgagtaatcag

SEQ ID NO: 38140 - DNA, 21 bp, Artificial Sequence
  Description of Artificial Sequence: Synthetic oligonucleotide
aatacgacgggtcatgctggg

SEQ ID NO: 38141 - DNA, 21 bp, Artificial Sequence
  Description of Artificial Sequence: Synthetic oligonucleotide
aataatcctaagaatgttgtt

SEQ ID NO: 38142 - DNA, 21 bp, Artificial Sequence
  Description of Artificial Sequence: Synthetic oligonucleotide
tctgttaattctcggagtgag

SEQ ID NO: 38143 - DNA, 21 bp, Artificial Sequence
  Description of Artificial Sequence: Synthetic oligonucleotide
cttcttcgggagaggcatggg

SEQ ID NO: 38144 - DNA, 21 bp, Artificial Sequence
  Description of Artificial Sequence: Synthetic oligonucleotide
catggtgagtctcggcaggcg

SEQ ID NO: 38145 - DNA, 21 bp, Artificial Sequence
  Description of Artificial Sequence: Synthetic oligonucleotide
ggcaccagaagcgccgtcgtc

SEQ ID NO: 38146 - DNA, 21 bp, Artificial Sequence
  Description of Artificial Sequence: Synthetic oligonucleotide
acgtctcaggtgtctcatggg

SEQ ID NO: 38147 - DNA, 21 bp, Artificial Sequence
  Description of Artificial Sequence: Synthetic oligonucleotide
agggatagtacgaagttggtg

SEQ ID NO: 38148 - DNA, 21 bp, Artificial Sequence
  Description of Artificial Sequence: Synthetic oligonucleotide
tttaattcgacggctaatcgg

SEQ ID NO: 38149 - DNA, 21 bp, Artificial Sequence
  Description of Artificial Sequence: Synthetic oligonucleotide
aagacgggggatcagatgggg

SEQ ID NO: 38150 - DNA, 21 bp, Artificial Sequence
  Description of Artificial Sequence: Synthetic oligonucleotide
gctcagtctacgtatcagtcg

SEQ ID NO: 38151 - DNA, 21 bp, Artificial Sequence
  Description of Artificial Sequence: Synthetic oligonucleotide
ggtaataggtcttctgggctt

SEQ ID NO: 38152 - DNA, 21 bp, Artificial Sequence
  Description of Artificial Sequence: Synthetic oligonucleotide
gccagcaccagcagaagcacc

SEQ ID NO: 38153 - DNA, 21 bp, Artificial Sequence
  Description of Artificial Sequence: Synthetic oligonucleotide
caaagcgtcaaaacccccgaa

SEQ ID NO: 38154 - DNA, 21 bp, Artificial Sequence
  Description of Artificial Sequence: Synthetic oligonucleotide
ttgaagcagcattcgagtctt

SEQ ID NO: 38155 - DNA, 21 bp, Artificial Sequence
  Description of Artificial Sequence: Synthetic oligonucleotide
gccaccggcagaaacaccgcc

SEQ ID NO: 38156 - DNA, 21 bp, Artificial Sequence
  Description of Artificial Sequence: Synthetic oligonucleotide
atggaaagcaaagccaacagc

SEQ ID NO: 38157 - DNA, 21 bp, Artificial Sequence
  Description of Artificial Sequence: Synthetic oligonucleotide
aactacgacagcctcaaaaaa

SEQ ID NO: 38158 - DNA, 21 bp, Artificial Sequence
  Description of Artificial Sequence: Synthetic oligonucleotide
gcgcatagtaataattcgtat

SEQ ID NO: 38159 - DNA, 21 bp, Artificial Sequence
  Description of Artificial Sequence: Synthetic oligonucleotide
tttcgggcgcaggctaatgtt

SEQ ID NO: 38160 - DNA, 21 bp, Artificial Sequence
  Description of Artificial Sequence: Synthetic oligonucleotide
tacagccaagaagtcttcaga

SEQ ID NO: 38161 - DNA, 21 bp, Artificial Sequence
  Description of Artificial Sequence: Synthetic oligonucleotide
ccgacgagtagtccgcagagg

SEQ ID NO: 38162 - DNA, 21 bp, Artificial Sequence
  Description of Artificial Sequence: Synthetic oligonucleotide
gccacccacaacagcagccaa

SEQ ID NO: 38163 - DNA, 21 bp, Artificial Sequence
  Description of Artificial Sequence: Synthetic oligonucleotide
cccaacaacgccaccaaaaac

SEQ ID NO: 38164 - DNA, 21 bp, Artificial Sequence
  Description of Artificial Sequence: Synthetic oligonucleotide
aatgctaatagtcgtcctgtt

SEQ ID NO: 38165 - DNA, 21 bp, Artificial Sequence
  Description of Artificial Sequence: Synthetic oligonucleotide
gtttcggatggtattagtaag

SEQ ID NO: 38166 - DNA, 21 bp, Artificial Sequence
  Description of Artificial Sequence: Synthetic oligonucleotide
agcaccgtcggccacatgacc

SEQ ID NO: 38167 - DNA, 21 bp, Artificial Sequence
  Description of Artificial Sequence: Synthetic oligonucleotide
gttgcgccggttgggatgagt

SEQ ID NO: 38168 - DNA, 21 bp, Artificial Sequence
  Description of Artificial Sequence: Synthetic oligonucleotide
agtccgtcttttaatcagggg

SEQ ID NO: 38169 - DNA, 21 bp, Artificial Sequence
  Description of Artificial Sequence: Synthetic oligonucleotide
ttgttgagttcgaagacggct

SEQ ID NO: 38170 - DNA, 21 bp, Artificial Sequence
  Description of Artificial Sequence: Synthetic oligonucleotide
gggtcggggcatggtacgaat

SEQ ID NO: 38171 - DNA, 21 bp, Artificial Sequence
  Description of Artificial Sequence: Synthetic oligonucleotide
aggcttcctagtgtgtctagt

SEQ ID NO: 38172 - DNA, 21 bp, Artificial Sequence
  Description of Artificial Sequence: Synthetic oligonucleotide
catgataatgctaattataat

SEQ ID NO: 38173 - DNA, 21 bp, Artificial Sequence
  Description of Artificial Sequence: Synthetic oligonucleotide
caaagattccaaagcagccaa

SEQ ID NO: 38174 - DNA, 21 bp, Artificial Sequence
  Description of Artificial Sequence: Synthetic oligonucleotide
accggcatcaccaaactcagc

SEQ ID NO: 38175 - DNA, 21 bp, Artificial Sequence
  Description of Artificial Sequence: Synthetic oligonucleotide
ggtcgtactgggccgctggtt

SEQ ID NO: 38176 - DNA, 21 bp, Artificial Sequence
  Description of Artificial Sequence: Synthetic oligonucleotide
catgagcgtggtcagaatggg

SEQ ID NO: 38177 - DNA, 21 bp, Artificial Sequence
  Description of Artificial Sequence: Synthetic oligonucleotide
attactccgagtaatattggt

SEQ ID NO: 38178 - DNA, 21 bp, Artificial Sequence
  Description of Artificial Sequence: Synthetic oligonucleotide
cacaccaccggcatgctcggc

SEQ ID NO: 38179 - DNA, 21 bp, Artificial Sequence
  Description of Artificial Sequence: Synthetic oligonucleotide
atgcccagcgccagcctcggc

SEQ ID NO: 38180 - DNA, 21 bp, Artificial Sequence
  Description of Artificial Sequence: Synthetic oligonucleotide
accgtcaaaagccccagaagc

SEQ ID NO: 38181 - DNA, 21 bp, Artificial Sequence
  Description of Artificial Sequence: Synthetic oligonucleotide
cagagtagtcatgaggggagg

SEQ ID NO: 38182 - DNA, 21 bp, Artificial Sequence
  Description of Artificial Sequence: Synthetic oligonucleotide
ggcgccgaaagaatcctcaga

SEQ ID NO: 38183 - DNA, 21 bp, Artificial Sequence
  Description of Artificial Sequence: Synthetic oligonucleotide
tctacggtggttcatatgact

SEQ ID NO: 38184 - DNA, 21 bp, Artificial Sequence
  Description of Artificial Sequence: Synthetic oligonucleotide
gattatgatgcgacgagtagg

SEQ ID NO: 38185 - DNA, 21 bp, Artificial Sequence
  Description of Artificial Sequence: Synthetic oligonucleotide
agaaacgaccaaaccctcaaa

SEQ ID NO: 38186 - DNA, 21 bp, Artificial Sequence
  Description of Artificial Sequence: Synthetic oligonucleotide
aacagactcggccaagccggc

SEQ ID NO: 38187 - DNA, 21 bp, Artificial Sequence
  Description of Artificial Sequence: Synthetic oligonucleotide
gagaattggactaatcggaag

SEQ ID NO: 38188 - DNA, 21 bp, Artificial Sequence
  Description of Artificial Sequence: Synthetic oligonucleotide
tcgtgtacgactcgttgtttg

SEQ ID NO: 38189 - DNA, 21 bp, Artificial Sequence
  Description of Artificial Sequence: Synthetic oligonucleotide
tatacttcgaagtctactgcg

SEQ ID NO: 38190 - DNA, 21 bp, Artificial Sequence
  Description of Artificial Sequence: Synthetic oligonucleotide
agcgtccacggcaaccaactc

SEQ ID NO: 38191 - DNA, 21 bp, Artificial Sequence
  Description of Artificial Sequence: Synthetic oligonucleotide
ggtattcagagttctcctact

SEQ ID NO: 38192 - DNA, 21 bp, Artificial Sequence
  Description of Artificial Sequence: Synthetic oligonucleotide
tcgaatatgactagtacgagg

SEQ ID NO: 38193 - DNA, 21 bp, Artificial Sequence
  Description of Artificial Sequence: Synthetic oligonucleotide
atgtctacggctcgttctgct

SEQ ID NO: 38194 - DNA, 21 bp, Artificial Sequence
  Description of Artificial Sequence: Synthetic oligonucleotide
tcgtatgcgagtactcagcag

SEQ ID NO: 38195 - DNA, 21 bp, Artificial Sequence
  Description of Artificial Sequence: Synthetic oligonucleotide
gccggcagcaacagccaaggc

SEQ ID NO: 38196 - DNA, 21 bp, Artificial Sequence
  Description of Artificial Sequence: Synthetic oligonucleotide
ccctacgccggcaaccaaaga

SEQ ID NO: 38197 - DNA, 21 bp, Artificial Sequence
  Description of Artificial Sequence: Synthetic oligonucleotide
cgtcgtgatactaatatgtcg

SEQ ID NO: 38198 - DNA, 21 bp, Artificial Sequence
  Description of Artificial Sequence: Synthetic oligonucleotide
agcttcgccaaaagcgccagc

SEQ ID NO: 38199 - DNA, 21 bp, Artificial Sequence
  Description of Artificial Sequence: Synthetic oligonucleotide
ggtgtgtctgcgacggtgaag

SEQ ID NO: 38200 - DNA, 21 bp, Artificial Sequence
  Description of Artificial Sequence: Synthetic oligonucleotide
ggtacttcgacgtctcttcgg

SEQ ID NO: 38201 - DNA, 21 bp, Artificial Sequence
  Description of Artificial Sequence: Synthetic oligonucleotide
cgtaatgatacgaagcttttt

SEQ ID NO: 38202 - DNA, 21 bp, Artificial Sequence
  Description of Artificial Sequence: Synthetic oligonucleotide
actcctgcggggccgaataag

SEQ ID NO: 38203 - DNA, 21 bp, Artificial Sequence
  Description of Artificial Sequence: Synthetic oligonucleotide
aacaaccccaacagagaccaa

SEQ ID NO: 38204 - DNA, 21 bp, Artificial Sequence
  Description of Artificial Sequence: Synthetic oligonucleotide
agagccgaaaccaacgccatc

SEQ ID NO: 38205 - DNA, 21 bp, Artificial Sequence
  Description of Artificial Sequence: Synthetic oligonucleotide
catgagctgtcgaggactact

SEQ ID NO: 38206 - DNA, 21 bp, Artificial Sequence
  Description of Artificial Sequence: Synthetic oligonucleotide
gcgggttctcagactggtgtt

SEQ ID NO: 38207 - DNA, 21 bp, Artificial Sequence
  Description of Artificial Sequence: Synthetic oligonucleotide
agctacggcggccaaagcaga

SEQ ID NO: 38208 - DNA, 21 bp, Artificial Sequence
  Description of Artificial Sequence: Synthetic oligonucleotide
taccaacccgaaagaagcagc

SEQ ID NO: 38209 - DNA, 21 bp, Artificial Sequence
  Description of Artificial Sequence: Synthetic oligonucleotide
accgccaacaacagcatcgtc

SEQ ID NO: 38210 - DNA, 21 bp, Artificial Sequence
  Description of Artificial Sequence: Synthetic oligonucleotide
atcgtcagcggcaaactcacc

SEQ ID NO: 38211 - DNA, 21 bp, Artificial Sequence
  Description of Artificial Sequence: Synthetic oligonucleotide
cacatcacccccgccaccagc

SEQ ID NO: 38212 - DNA, 21 bp, Artificial Sequence
  Description of Artificial Sequence: Synthetic oligonucleotide
agcaccagcaacatcgccagc

SEQ ID NO: 38213 - DNA, 21 bp, Artificial Sequence
  Description of Artificial Sequence: Synthetic oligonucleotide
caagtcaccgccatcggcgcc

SEQ ID NO: 38214 - DNA, 21 bp, Artificial Sequence
  Description of Artificial Sequence: Synthetic oligonucleotide
aatactcaggcgggtcattcg

SEQ ID NO: 38215 - DNA, 21 bp, Artificial Sequence
  Description of Artificial Sequence: Synthetic oligonucleotide
gacgtccacagaagcagcggc

SEQ ID NO: 38216 - DNA, 21 bp, Artificial Sequence
  Description of Artificial Sequence: Synthetic oligonucleotide
caaggcagcagccccatggaa

SEQ ID NO: 38217 - DNA, 21 bp, Artificial Sequence
  Description of Artificial Sequence: Synthetic oligonucleotide
ttggatgctagtgctatgagg

SEQ ID NO: 38218 - DNA, 21 bp, Artificial Sequence
  Description of Artificial Sequence: Synthetic oligonucleotide
ccggtggcgaatgtttcgcgt

SEQ ID NO: 38219 - DNA, 21 bp, Artificial Sequence
  Description of Artificial Sequence: Synthetic oligonucleotide
tttccggttactgggctgagt

SEQ ID NO: 38220 - DNA, 21 bp, Artificial Sequence
  Description of Artificial Sequence: Synthetic oligonucleotide
cagatgaatcatctgcaggtt

SEQ ID NO: 38221 - DNA, 21 bp, Artificial Sequence
  Description of Artificial Sequence: Synthetic oligonucleotide
tcttatgggaaggggagttct

SEQ ID NO: 38222 - DNA, 21 bp, Artificial Sequence
  Description of Artificial Sequence: Synthetic oligonucleotide
agagacgccagcggcctcaga

SEQ ID NO: 38223 - DNA, 21 bp, Artificial Sequence
  Description of Artificial Sequence: Synthetic oligonucleotide
tcgagttcgcgtaatgtggct

SEQ ID NO: 38224 - DNA, 21 bp, Artificial Sequence
  Description of Artificial Sequence: Synthetic oligonucleotide
atcaccgccacccacgcccac

SEQ ID NO: 38225 - DNA, 21 bp, Artificial Sequence
  Description of Artificial Sequence: Synthetic oligonucleotide
aatcagcagaatgggagtaat

SEQ ID NO: 38226 - DNA, 21 bp, Artificial Sequence
  Description of Artificial Sequence: Synthetic oligonucleotide
ggcagcgccggcaaagaaatg

SEQ ID NO: 38227 - DNA, 21 bp, Artificial Sequence
  Description of Artificial Sequence: Synthetic oligonucleotide
aatgttaggcagactgagctg

SEQ ID NO: 38228 - DNA, 21 bp, Artificial Sequence
  Description of Artificial Sequence: Synthetic oligonucleotide
ccgattcatccgtcgagtggg

SEQ ID NO: 38229 - DNA, 21 bp, Artificial Sequence
  Description of Artificial Sequence: Synthetic oligonucleotide
gatcgggttggttcgatttct

SEQ ID NO: 38230 - DNA, 21 bp, Artificial Sequence
  Description of Artificial Sequence: Synthetic oligonucleotide
gttggttctgggcgtgctaat

SEQ ID NO: 38231 - DNA, 21 bp, Artificial Sequence
  Description of Artificial Sequence: Synthetic oligonucleotide
aacagcagcggccactaccaa

SEQ ID NO: 38232 - DNA, 21 bp, Artificial Sequence
  Description of Artificial Sequence: Synthetic oligonucleotide
catacttcgagtaattctctt

SEQ ID NO: 38233 - DNA, 21 bp, Artificial Sequence
  Description of Artificial Sequence: Synthetic oligonucleotide
ctccccagcaacagcatccac

SEQ ID NO: 38234 - DNA, 21 bp, Artificial Sequence
  Description of Artificial Sequence: Synthetic oligonucleotide
agcgacagagacagaaaaacc

SEQ ID NO: 38235 - DNA, 21 bp, Artificial Sequence
  Description of Artificial Sequence: Synthetic oligonucleotide
acccccggcagcaccatcaga

SEQ ID NO: 38236 - DNA, 21 bp, Artificial Sequence
  Description of Artificial Sequence: Synthetic oligonucleotide
agtgttgcgggtactagtagg

SEQ ID NO: 38237 - DNA, 21 bp, Artificial Sequence
  Description of Artificial Sequence: Synthetic oligonucleotide
atgagaagcaaccccaccagc

SEQ ID NO: 38238 - DNA, 21 bp, Artificial Sequence
  Description of Artificial Sequence: Synthetic oligonucleotide
ggcagacccaacatgaccgtc

SEQ ID NO: 38239 - DNA, 21 bp, Artificial Sequence
  Description of Artificial Sequence: Synthetic oligonucleotide
gatacgcatgtgagtggtcgg

SEQ ID NO: 38240 - DNA, 21 bp, Artificial Sequence
  Description of Artificial Sequence: Synthetic oligonucleotide
atggggtcgagtgtgaggtct

SEQ ID NO: 38241 - DNA, 21 bp, Artificial Sequence
  Description of Artificial Sequence: Synthetic oligonucleotide
cttaatgttggttctgtgagg

SEQ ID NO: 38242 - DNA, 21 bp, Artificial Sequence
  Description of Artificial Sequence: Synthetic oligonucleotide
cctgtgcagcattcgagtaat

SEQ ID NO: 38243 - DNA, 21 bp, Artificial Sequence
  Description of Artificial Sequence: Synthetic oligonucleotide
ggggatcagcataagccgttg

SEQ ID NO: 38244 - DNA, 21 bp, Artificial Sequence
  Description of Artificial Sequence: Synthetic oligonucleotide
tcgccggcgagggcttctctt

SEQ ID NO: 38245 - DNA, 21 bp, Artificial Sequence
  Description of Artificial Sequence: Synthetic oligonucleotide
atccccctcagcagccaaaga

SEQ ID NO: 38246 - DNA, 21 bp, Artificial Sequence
  Description of Artificial Sequence: Synthetic oligonucleotide
tgtaatcggtctgggactttg

SEQ ID NO: 38247 - DNA, 21 bp, Artificial Sequence
  Description of Artificial Sequence: Synthetic oligonucleotide
ctccccagcctccccatcaga

SEQ ID NO: 38248 - DNA, 21 bp, Artificial Sequence
  Description of Artificial Sequence: Synthetic oligonucleotide
cacggcagcctccacccccaa

SEQ ID NO: 38249 - DNA, 21 bp, Artificial Sequence
  Description of Artificial Sequence: Synthetic oligonucleotide
gtcatcagacccagcagcaaa

SEQ ID NO: 38250 - DNA, 21 bp, Artificial Sequence
  Description of Artificial Sequence: Synthetic oligonucleotide
cttcctggggttcgtgttgcg

SEQ ID NO: 38251 - DNA, 21 bp, Artificial Sequence
  Description of Artificial Sequence: Synthetic oligonucleotide
aacatcaacagcagactcgcc

SEQ ID NO: 38252 - DNA, 21 bp, Artificial Sequence
  Description of Artificial Sequence: Synthetic oligonucleotide
caacccatcaacgtccacaac

SEQ ID NO: 38253 - DNA, 21 bp, Artificial Sequence
  Description of Artificial Sequence: Synthetic oligonucleotide
ccgcttaatgctcggggtagt

SEQ ID NO: 38254 - DNA, 21 bp, Artificial Sequence
  Description of Artificial Sequence: Synthetic oligonucleotide
aaacaacccggcagcacccac

SEQ ID NO: 38255 - DNA, 21 bp, Artificial Sequence
  Description of Artificial Sequence: Synthetic oligonucleotide
gagggtactcggatggcggcg

SEQ ID NO: 38256 - DNA, 21 bp, Artificial Sequence
  Description of Artificial Sequence: Synthetic oligonucleotide
agagtcgaaagccccaccaac

SEQ ID NO: 38257 - DNA, 21 bp, Artificial Sequence
  Description of Artificial Sequence: Synthetic oligonucleotide
gatagtgttgctggttttacg

SEQ ID NO: 38258 - DNA, 21 bp, Artificial Sequence
  Description of Artificial Sequence: Synthetic oligonucleotide
aacaccggcagcggcagcaga

SEQ ID NO: 38259 - DNA, 21 bp, Artificial Sequence
  Description of Artificial Sequence: Synthetic oligonucleotide
tcgaagactaatgctaaggtt

SEQ ID NO: 38260 - DNA, 21 bp, Artificial Sequence
  Description of Artificial Sequence: Synthetic oligonucleotide
gagtctgctacgcctattagg

SEQ ID NO: 38261 - DNA, 21 bp, Artificial Sequence
  Description of Artificial Sequence: Synthetic oligonucleotide
cgtgaggttgatgggattagg

SEQ ID NO: 38262 - DNA, 21 bp, Artificial Sequence
  Description of Artificial Sequence: Synthetic oligonucleotide
tgttcgaatcatagtactcgg

SEQ ID NO: 38263 - DNA, 21 bp, Artificial Sequence
  Description of Artificial Sequence: Synthetic oligonucleotide
ctcaaaagccccaaacaagcc

SEQ ID NO: 38264 - DNA, 21 bp, Artificial Sequence
  Description of Artificial Sequence: Synthetic oligonucleotide
gacctcaccagagccaccagc

SEQ ID NO: 38265 - DNA, 21 bp, Artificial Sequence
  Description of Artificial Sequence: Synthetic oligonucleotide
gatttgaggacgaattcgtct

SEQ ID NO: 38266 - DNA, 21 bp, Artificial Sequence
  Description of Artificial Sequence: Synthetic oligonucleotide
gttaggtctaaggaggcgcat

SEQ ID NO: 38267 - DNA, 21 bp, Artificial Sequence
  Description of Artificial Sequence: Synthetic oligonucleotide
gtgaagtgtagtggttgtagt

SEQ ID NO: 38268 - DNA, 21 bp, Artificial Sequence
  Description of Artificial Sequence: Synthetic oligonucleotide
caacacaccaccaccaaccaa

SEQ ID NO: 38269 - DNA, 21 bp, Artificial Sequence
  Description of Artificial Sequence: Synthetic oligonucleotide
aacggttctggacagactcaa

SEQ ID NO: 38270 - DNA, 21 bp, Artificial Sequence
  Description of Artificial Sequence: Synthetic oligonucleotide
ggcaacacccaaaccagcaga

SEQ ID NO: 38271 - DNA, 21 bp, Artificial Sequence
  Description of Artificial Sequence: Synthetic oligonucleotide
gccaccaacaacggcagcaaa

SEQ ID NO: 38272 - DNA, 21 bp, Artificial Sequence
  Description of Artificial Sequence: Synthetic oligonucleotide
gatgtgaagtctacgcatgcg

SEQ ID NO: 38273 - DNA, 21 bp, Artificial Sequence
  Description of Artificial Sequence: Synthetic oligonucleotide
ccggttggtactaagtctggt

SEQ ID NO: 38274 - DNA, 21 bp, Artificial Sequence
  Description of Artificial Sequence: Synthetic oligonucleotide
tctactgggtcggtgagtaag

SEQ ID NO: 38275 - DNA, 21 bp, Artificial Sequence
  Description of Artificial Sequence: Synthetic oligonucleotide
tatcggaatgtgaatgcgatg

SEQ ID NO: 38276 - DNA, 21 bp, Artificial Sequence
  Description of Artificial Sequence: Synthetic oligonucleotide
tacggcgccagccccagcctc

SEQ ID NO: 38277 - DNA, 21 bp, Artificial Sequence
  Description of Artificial Sequence: Synthetic oligonucleotide
aaaaaccacaccgccgtccaa

SEQ ID NO: 38278 - DNA, 21 bp, Artificial Sequence
  Description of Artificial Sequence: Synthetic oligonucleotide
catcttggggttccgctgaag

SEQ ID NO: 38279 - DNA, 21 bp, Artificial Sequence
  Description of Artificial Sequence: Synthetic oligonucleotide
aattttgggtctggtcctacg

SEQ ID NO: 38280 - DNA, 21 bp, Artificial Sequence
  Description of Artificial Sequence: Synthetic oligonucleotide
gaccccgtcaccagaaaaagc

SEQ ID NO: 38281 - DNA, 21 bp, Artificial Sequence
  Description of Artificial Sequence: Synthetic oligonucleotide
ggtacggttcttagtgatcgt

SEQ ID NO: 38282 - DNA, 21 bp, Artificial Sequence
  Description of Artificial Sequence: Synthetic oligonucleotide
gatgggtctagtcgtgttggt

SEQ ID NO: 38283 - DNA, 21 bp, Artificial Sequence
  Description of Artificial Sequence: Synthetic oligonucleotide
tcttcgacgtctcctgggagg

SEQ ID NO: 38284 - DNA, 21 bp, Artificial Sequence
  Description of Artificial Sequence: Synthetic oligonucleotide
caacccaacagcgccagccac

SEQ ID NO: 38285 - DNA, 21 bp, Artificial Sequence
  Description of Artificial Sequence: Synthetic oligonucleotide
gttcatgcttcgaatgttcag

SEQ ID NO: 38286 - DNA, 21 bp, Artificial Sequence
  Description of Artificial Sequence: Synthetic oligonucleotide
tatggttctcgggagaatagt

SEQ ID NO: 38287 - DNA, 21 bp, Artificial Sequence
  Description of Artificial Sequence: Synthetic oligonucleotide
aataatggtcatcagggtaag

SEQ ID NO: 38288 - DNA, 21 bp, Artificial Sequence
  Description of Artificial Sequence: Synthetic oligonucleotide
cccagcagcagacaaagcgtc

SEQ ID NO: 38289 - DNA, 21 bp, Artificial Sequence
  Description of Artificial Sequence: Synthetic oligonucleotide
cacctcgccatgaacagaaac

SEQ ID NO: 38290 - DNA, 21 bp, Artificial Sequence
  Description of Artificial Sequence: Synthetic oligonucleotide
tttatgggtcgtcctaatgtt

SEQ ID NO: 38291 - DNA, 21 bp, Artificial Sequence
  Description of Artificial Sequence: Synthetic oligonucleotide
tataatcggacttctattgtg

SEQ ID NO: 38292 - DNA, 21 bp, Artificial Sequence
  Description of Artificial Sequence: Synthetic oligonucleotide
gccggcagcagcagccccgcc

SEQ ID NO: 38293 - DNA, 21 bp, Artificial Sequence
  Description of Artificial Sequence: Synthetic oligonucleotide
ggtattgatactaagatgttg

SEQ ID NO: 38294 - DNA, 21 bp, Artificial Sequence
  Description of Artificial Sequence: Synthetic oligonucleotide
cttgtttatgataatactcgt

SEQ ID NO: 38295 - DNA, 21 bp, Artificial Sequence
  Description of Artificial Sequence: Synthetic oligonucleotide
ttgttggagtctacggggcgt

SEQ ID NO: 38296 - DNA, 21 bp, Artificial Sequence
  Description of Artificial Sequence: Synthetic oligonucleotide
cttactccgagtaatattggt

SEQ ID NO: 38297 - DNA, 21 bp, Artificial Sequence
  Description of Artificial Sequence: Synthetic oligonucleotide
tcggggggtactcacattgcg

SEQ ID NO: 38298 - DNA, 21 bp, Artificial Sequence
  Description of Artificial Sequence: Synthetic oligonucleotide
ggcctcgccggcagcctccaa

SEQ ID NO: 38299 - DNA, 21 bp, Artificial Sequence
  Description of Artificial Sequence: Synthetic oligonucleotide
tatactgctgctcctgggcgt

SEQ ID NO: 38300 - DNA, 21 bp, Artificial Sequence
  Description of Artificial Sequence: Synthetic oligonucleotide
gattctgtgacttctagtggg

SEQ ID NO: 38301 - DNA, 21 bp, Artificial Sequence
  Description of Artificial Sequence: Synthetic oligonucleotide
cgtattagtgagaatatgcgg

SEQ ID NO: 38302 - DNA, 21 bp, Artificial Sequence
  Description of Artificial Sequence: Synthetic oligonucleotide
ggttcgtattctaatcctact

SEQ ID NO: 38303 - DNA, 21 bp, Artificial Sequence
  Description of Artificial Sequence: Synthetic oligonucleotide
ctccccggcagcagactcagc

SEQ ID NO: 38304 - DNA, 21 bp, Artificial Sequence
  Description of Artificial Sequence: Synthetic oligonucleotide
accagcaacaccaaaagcgtc

SEQ ID NO: 38305 - DNA, 21 bp, Artificial Sequence
  Description of Artificial Sequence: Synthetic oligonucleotide
tctcatgttaattctactcgg

SEQ ID NO: 38306 - DNA, 21 bp, Artificial Sequence
  Description of Artificial Sequence: Synthetic oligonucleotide
aggaatggtcagcgtgtgggg

SEQ ID NO: 38307 - DNA, 21 bp, Artificial Sequence
  Description of Artificial Sequence: Synthetic oligonucleotide
gatgctggggctgctcctaag

SEQ ID NO: 38308 - DNA, 21 bp, Artificial Sequence
  Description of Artificial Sequence: Synthetic oligonucleotide
acccaacaaaaaggcagcaac

SEQ ID NO: 38309 - DNA, 21 bp, Artificial Sequence
  Description of Artificial Sequence: Synthetic oligonucleotide
tataggaatactcattctgag

SEQ ID NO: 38310 - DNA, 21 bp, Artificial Sequence
  Description of Artificial Sequence: Synthetic oligonucleotide
actcttcatgatccgcggact

SEQ ID NO: 38311 - DNA, 21 bp, Artificial Sequence
  Description of Artificial Sequence: Synthetic oligonucleotide
actgggcgggggtcggaggtg

SEQ ID NO: 38312 - DNA, 21 bp, Artificial Sequence
  Description of Artificial Sequence: Synthetic oligonucleotide
tacaacaccaccagaatgacc

SEQ ID NO: 38313 - DNA, 21 bp, Artificial Sequence
  Description of Artificial Sequence: Synthetic oligonucleotide
ggccaaaacacccacctcacc

SEQ ID NO: 38314 - DNA, 21 bp, Artificial Sequence
  Description of Artificial Sequence: Synthetic oligonucleotide
cccagcaacaccggcaccatc

SEQ ID NO: 38315 - DNA, 21 bp, Artificial Sequence
  Description of Artificial Sequence: Synthetic oligonucleotide
gctatggggtcgagtctgtct

SEQ ID NO: 38316 - DNA, 21 bp, Artificial Sequence
  Description of Artificial Sequence: Synthetic oligonucleotide
ggcttcgaaagaaacagagaa

SEQ ID NO: 38317 - DNA, 21 bp, Artificial Sequence
  Description of Artificial Sequence: Synthetic oligonucleotide
gggagtaatcgtaatcatgct

SEQ ID NO: 38318 - DNA, 21 bp, Artificial Sequence
  Description of Artificial Sequence: Synthetic oligonucleotide
cttaatggtactcctcagtct

SEQ ID NO: 38319 - DNA, 21 bp, Artificial Sequence
  Description of Artificial Sequence: Synthetic oligonucleotide
agacaaatcggcaaacaagtc

SEQ ID NO: 38320 - DNA, 21 bp, Artificial Sequence
  Description of Artificial Sequence: Synthetic oligonucleotide
cccaccagaaccgccagcaac

SEQ ID NO: 38321 - DNA, 21 bp, Artificial Sequence
  Description of Artificial Sequence: Synthetic oligonucleotide
agtaatactaggtctctttcg

SEQ ID NO: 38322 - DNA, 21 bp, Artificial Sequence
  Description of Artificial Sequence: Synthetic oligonucleotide
tctaggtctcctccttcgggg

SEQ ID NO: 38323 - DNA, 21 bp, Artificial Sequence
  Description of Artificial Sequence: Synthetic oligonucleotide
gtggtgtcgtctaagggttat

SEQ ID NO: 38324 - DNA, 21 bp, Artificial Sequence
  Description of Artificial Sequence: Synthetic oligonucleotide
gtgtctgggcatcgttcggtt

SEQ ID NO: 38325 - DNA, 21 bp, Artificial Sequence
  Description of Artificial Sequence: Synthetic oligonucleotide
ggcaacaccggcagctaccaa

SEQ ID NO: 38326 - DNA, 21 bp, Artificial Sequence
  Description of Artificial Sequence: Synthetic oligonucleotide
ggtcatgataatggtattcag

SEQ ID NO: 38327 - DNA, 21 bp, Artificial Sequence
  Description of Artificial Sequence: Synthetic oligonucleotide
ccgttgattaatcgtactatg

SEQ ID NO: 38328 - DNA, 21 bp, Artificial Sequence
  Description of Artificial Sequence: Synthetic oligonucleotide
gggaataatcggccggcttcg

SEQ ID NO: 38329 - DNA, 21 bp, Artificial Sequence
  Description of Artificial Sequence: Synthetic oligonucleotide
gaaagaggcaaaaacgccctc

SEQ ID NO: 38330 - DNA, 21 bp, Artificial Sequence
  Description of Artificial Sequence: Synthetic oligonucleotide
ccccaccaaagagccggcagc

SEQ ID NO: 38331 - DNA, 21 bp, Artificial Sequence
  Description of Artificial Sequence: Synthetic oligonucleotide
agccccaacaaaaccagcctc

SEQ ID NO: 38332 - DNA, 21 bp, Artificial Sequence
  Description of Artificial Sequence: Synthetic oligonucleotide
aacaacgtcaccaaagccccc

SEQ ID NO: 38333 - DNA, 21 bp, Artificial Sequence
  Description of Artificial Sequence: Synthetic oligonucleotide
agcatcaaaagcgtcaccaac

SEQ ID NO: 38334 - DNA, 21 bp, Artificial Sequence
  Description of Artificial Sequence: Synthetic oligonucleotide
catcctactatgaattatagt

SEQ ID NO: 38335 - DNA, 21 bp, Artificial Sequence
  Description of Artificial Sequence: Synthetic oligonucleotide
cacatgagagccaacgtcacc

SEQ ID NO: 38336 - DNA, 21 bp, Artificial Sequence
  Description of Artificial Sequence: Synthetic oligonucleotide
ttgacggcgaagtcgagtcag

SEQ ID NO: 38337 - DNA, 21 bp, Artificial Sequence
  Description of Artificial Sequence: Synthetic oligonucleotide
tctaatcggacttctattgtg

SEQ ID NO: 38338 - DNA, 21 bp, Artificial Sequence
  Description of Artificial Sequence: Synthetic oligonucleotide
gatacgaatgtggattatagg

SEQ ID NO: 38339 - DNA, 21 bp, Artificial Sequence
  Description of Artificial Sequence: Synthetic oligonucleotide
cccagaagcaccaccggcggc

SEQ ID NO: 38340 - DNA, 21 bp, Artificial Sequence
  Description of Artificial Sequence: Synthetic oligonucleotide
atgcccgccagaaacgtcagc

SEQ ID NO: 38341 - DNA, 21 bp, Artificial Sequence
  Description of Artificial Sequence: Synthetic oligonucleotide
cctaggatgcgggctgtgtct

SEQ ID NO: 38342 - DNA, 21 bp, Artificial Sequence
  Description of Artificial Sequence: Synthetic oligonucleotide
ttcggcgaaagcagaggcaga

SEQ ID NO: 38343 - DNA, 21 bp, Artificial Sequence
  Description of Artificial Sequence: Synthetic oligonucleotide
atggccaccgcccacggcggc

SEQ ID NO: 38344 - DNA, 21 bp, Artificial Sequence
  Description of Artificial Sequence: Synthetic oligonucleotide
gctctgattgatcgtggtgat

SEQ ID NO: 38345 - DNA, 21 bp, Artificial Sequence
  Description of Artificial Sequence: Synthetic oligonucleotide
ctgcctcaggggtcgatttct

SEQ ID NO: 38346 - DNA, 21 bp, Artificial Sequence
  Description of Artificial Sequence: Synthetic oligonucleotide
aaactcgtcaacagcaacggc

SEQ ID NO: 38347 - DNA, 21 bp, Artificial Sequence
  Description of Artificial Sequence: Synthetic oligonucleotide
atgaacgccagcgtcaacaga

SEQ ID NO: 38348 - DNA, 21 bp, Artificial Sequence
  Description of Artificial Sequence: Synthetic oligonucleotide
ctggctacgaataggagtaat

SEQ ID NO: 38349 - DNA, 21 bp, Artificial Sequence
  Description of Artificial Sequence: Synthetic oligonucleotide
ggcagacaagtcacccccacc

SEQ ID NO: 38350 - DNA, 21 bp, Artificial Sequence
  Description of Artificial Sequence: Synthetic oligonucleotide
ctcggcaccagcaccatgaaa

SEQ ID NO: 38351 - DNA, 21 bp, Artificial Sequence
  Description of Artificial Sequence: Synthetic oligonucleotide
aaccccaaccaaagcctcggc

SEQ ID NO: 38352 - DNA, 21 bp, Artificial Sequence
  Description of Artificial Sequence: Synthetic oligonucleotide
gacttcagcgaaaaaagactc

SEQ ID NO: 38353 - DNA, 21 bp, Artificial Sequence
  Description of Artificial Sequence: Synthetic oligonucleotide
accagcagagtcggccaagtc

SEQ ID NO: 38354 - DNA, 21 bp, Artificial Sequence
  Description of Artificial Sequence: Synthetic oligonucleotide
catacgcagagtgcgacgggg

SEQ ID NO: 38355 - DNA, 21 bp, Artificial Sequence
  Description of Artificial Sequence: Synthetic oligonucleotide
gccaccaccaaagccggcatc

SEQ ID NO: 38356 - DNA, 21 bp, Artificial Sequence
  Description of Artificial Sequence: Synthetic oligonucleotide
cagcagtatgcgaagcaggcg

SEQ ID NO: 38357 - DNA, 21 bp, Artificial Sequence
  Description of Artificial Sequence: Synthetic oligonucleotide
tcgaggcatcctagtactggt

SEQ ID NO: 38358 - DNA, 21 bp, Artificial Sequence
  Description of Artificial Sequence: Synthetic oligonucleotide
ttgcgtaatcctacgtctaag

SEQ ID NO: 38359 - DNA, 21 bp, Artificial Sequence
  Description of Artificial Sequence: Synthetic oligonucleotide
aatagttatgatccgaagcgt

SEQ ID NO: 38360 - DNA, 21 bp, Artificial Sequence
  Description of Artificial Sequence: Synthetic oligonucleotide
actgggttgaaggatcagcat

SEQ ID NO: 38361 - DNA, 21 bp, Artificial Sequence
  Description of Artificial Sequence: Synthetic oligonucleotide
gctagggatacggttgttagg

SEQ ID NO: 38362 - DNA, 21 bp, Artificial Sequence
  Description of Artificial Sequence: Synthetic oligonucleotide
tcgcatgatacttcttatcgt

SEQ ID NO: 38363 - DNA, 21 bp, Artificial Sequence
  Description of Artificial Sequence: Synthetic oligonucleotide
aatcctcgtatgagtatgtcg

SEQ ID NO: 38364 - DNA, 21 bp, Artificial Sequence
  Description of Artificial Sequence: Synthetic oligonucleotide
ctcaacaccggcatcgtcaga

SEQ ID NO: 38365 - DNA, 21 bp, Artificial Sequence
  Description of Artificial Sequence: Synthetic oligonucleotide
actagtcatatgcagcttagt

SEQ ID NO: 38366 - DNA, 21 bp, Artificial Sequence
  Description of Artificial Sequence: Synthetic oligonucleotide
aaccccgtcgccctcagagac

SEQ ID NO: 38367 - DNA, 21 bp, Artificial Sequence
  Description of Artificial Sequence: Synthetic oligonucleotide
gggaatcagagtcctcgggtt

SEQ ID NO: 38368 - DNA, 21 bp, Artificial Sequence
  Description of Artificial Sequence: Synthetic oligonucleotide
gccaccaacagcacccccaga

SEQ ID NO: 38369 - DNA, 21 bp, Artificial Sequence
  Description of Artificial Sequence: Synthetic oligonucleotide
cacagagtcgacagaagctgc

SEQ ID NO: 38370 - DNA, 21 bp, Artificial Sequence
  Description of Artificial Sequence: Synthetic oligonucleotide
gacagaagcgccaccgtcaaa

SEQ ID NO: 38371 - DNA, 21 bp, Artificial Sequence
  Description of Artificial Sequence: Synthetic oligonucleotide
gttactcttccgcctaatgcg

SEQ ID NO: 38372 - DNA, 21 bp, Artificial Sequence
  Description of Artificial Sequence: Synthetic oligonucleotide
aacatcgcccaaaaagaactc

SEQ ID NO: 38373 - DNA, 21 bp, Artificial Sequence
  Description of Artificial Sequence: Synthetic oligonucleotide
cacaccaccggcatcctcggc

SEQ ID NO: 38374 - DNA, 21 bp, Artificial Sequence
  Description of Artificial Sequence: Synthetic oligonucleotide
ggcatcatggccaccagaggc

SEQ ID NO: 38375 - DNA, 21 bp, Artificial Sequence
  Description of Artificial Sequence: Synthetic oligonucleotide
actacgtcgcgtccgaatgtt

SEQ ID NO: 38376 - DNA, 21 bp, Artificial Sequence
  Description of Artificial Sequence: Synthetic oligonucleotide
cctatggcgcggtcggctggg

SEQ ID NO: 38377 - DNA, 21 bp, Artificial Sequence
  Description of Artificial Sequence: Synthetic oligonucleotide
cagagtaatgatcgtgcgaag

SEQ ID NO: 38378 - DNA, 21 bp, Artificial Sequence
  Description of Artificial Sequence: Synthetic oligonucleotide
aattctgcgggtactcgggtg

SEQ ID NO: 38379 - DNA, 21 bp, Artificial Sequence
  Description of Artificial Sequence: Synthetic oligonucleotide
ggccccaaccaaagcggcaga

SEQ ID NO: 38380 - DNA, 21 bp, Artificial Sequence
  Description of Artificial Sequence: Synthetic oligonucleotide
ccccaaaccagccccagaacc

SEQ ID NO: 38381 - DNA, 21 bp, Artificial Sequence
  Description of Artificial Sequence: Synthetic oligonucleotide
gcggattctaatcgtccgggg

SEQ ID NO: 38382 - DNA, 21 bp, Artificial Sequence
  Description of Artificial Sequence: Synthetic oligonucleotide
tgggacagcaaaacccccaga

SEQ ID NO: 38383 - DNA, 21 bp, Artificial Sequence
  Description of Artificial Sequence: Synthetic oligonucleotide
ccgagtactagtggtgcgatg

SEQ ID NO: 38384 - DNA, 21 bp, Artificial Sequence
  Description of Artificial Sequence: Synthetic oligonucleotide
attttgggtaataagtctagt

SEQ ID NO: 38385 - DNA, 21 bp, Artificial Sequence
  Description of Artificial Sequence: Synthetic oligonucleotide
ttcaacagcagcagcagcaaa

SEQ ID NO: 38386 - DNA, 21 bp, Artificial Sequence
  Description of Artificial Sequence: Synthetic oligonucleotide
gtggatgttagggggatgtcg

SEQ ID NO: 38387 - DNA, 21 bp, Artificial Sequence
  Description of Artificial Sequence: Synthetic oligonucleotide
agttcggattcggggcggctt

SEQ ID NO: 38388 - DNA, 21 bp, Artificial Sequence
  Description of Artificial Sequence: Synthetic oligonucleotide
gatagtccgaatcggggtagg

SEQ ID NO: 38389 - DNA, 21 bp, Artificial Sequence
  Description of Artificial Sequence: Synthetic oligonucleotide
gtgacgcagtcttcgagtaag

SEQ ID NO: 38390 - DNA, 21 bp, Artificial Sequence
  Description of Artificial Sequence: Synthetic oligonucleotide
cctgggattcggcctgagctt

SEQ ID NO: 38391 - DNA, 21 bp, Artificial Sequence
  Description of Artificial Sequence: Synthetic oligonucleotide
cgtacggatcatgggggtgtg

SEQ ID NO: 38392 - DNA, 21 bp, Artificial Sequence
  Description of Artificial Sequence: Synthetic oligonucleotide
aatgtgaatagtcagatgctg

SEQ ID NO: 38393 - DNA, 21 bp, Artificial Sequence
  Description of Artificial Sequence: Synthetic oligonucleotide
gccgtcagagcccaccaacaa

SEQ ID NO: 38394 - DNA, 21 bp, Artificial Sequence
  Description of Artificial Sequence: Synthetic oligonucleotide
gtccccggcaaaagcgcccaa

SEQ ID NO: 38395 - DNA, 21 bp, Artificial Sequence
  Description of Artificial Sequence: Synthetic oligonucleotide
cttactccgagtaatatgggt

SEQ ID NO: 38396 - DNA, 21 bp, Artificial Sequence
  Description of Artificial Sequence: Synthetic oligonucleotide
ggcaacggcaccagacaaaac

SEQ ID NO: 38397 - DNA, 21 bp, Artificial Sequence
  Description of Artificial Sequence: Synthetic oligonucleotide
ggggatattacgcgtcttggt

SEQ ID NO: 38398 - DNA, 21 bp, Artificial Sequence
  Description of Artificial Sequence: Synthetic oligonucleotide
aatagtcgtgagtcgcagggg

SEQ ID NO: 38399 - DNA, 21 bp, Artificial Sequence
  Description of Artificial Sequence: Synthetic oligonucleotide
cccgccaccagacaacccgac

SEQ ID NO: 38400 - DNA, 21 bp, Artificial Sequence
  Description of Artificial Sequence: Synthetic oligonucleotide
gtgactactagtcggggtgtt

SEQ ID NO: 38401 - DNA, 21 bp, Artificial Sequence
  Description of Artificial Sequence: Synthetic oligonucleotide
gctggtgcgcctaagacggat

SEQ ID NO: 38402 - DNA, 21 bp, Artificial Sequence
  Description of Artificial Sequence: Synthetic oligonucleotide
aacagagtcgaacacacccaa

SEQ ID NO: 38403 - DNA, 21 bp, Artificial Sequence
  Description of Artificial Sequence: Synthetic oligonucleotide
caaatcagcgccagcaccaga

SEQ ID NO: 38404 - DNA, 21 bp, Artificial Sequence
  Description of Artificial Sequence: Synthetic oligonucleotide
caaaacgtcagcaccatgaac

SEQ ID NO: 38405 - DNA, 21 bp, Artificial Sequence
  Description of Artificial Sequence: Synthetic oligonucleotide
gttcctcttcagaagccttct

SEQ ID NO: 38406 - DNA, 21 bp, Artificial Sequence
  Description of Artificial Sequence: Synthetic oligonucleotide
gttacgcgttctcggctggat

SEQ ID NO: 38407 - DNA, 21 bp, Artificial Sequence
  Description of Artificial Sequence: Synthetic oligonucleotide
tatcgtacggcgacgtctcat

SEQ ID NO: 38408 - DNA, 21 bp, Artificial Sequence
  Description of Artificial Sequence: Synthetic oligonucleotide
gacgtcatgcccagcggcaga

SEQ ID NO: 38409 - DNA, 21 bp, Artificial Sequence
  Description of Artificial Sequence: Synthetic oligonucleotide
ttggatggtcgtcagcattcg

SEQ ID NO: 38410 - DNA, 21 bp, Artificial Sequence
  Description of Artificial Sequence: Synthetic oligonucleotide
ctcagacccaacggccaactc

SEQ ID NO: 38411 - DNA, 21 bp, Artificial Sequence
  Description of Artificial Sequence: Synthetic oligonucleotide
cgtggtgtggggaagcttacg

SEQ ID NO: 38412 - DNA, 21 bp, Artificial Sequence
  Description of Artificial Sequence: Synthetic oligonucleotide
accagcaccagcagaagcagc

SEQ ID NO: 38413 - DNA, 21 bp, Artificial Sequence
  Description of Artificial Sequence: Synthetic oligonucleotide
gaacccctccaaggcagcaga

SEQ ID NO: 38414 - DNA, 21 bp, Artificial Sequence
  Description of Artificial Sequence: Synthetic oligonucleotide
tctcagacggttaagactggt

SEQ ID NO: 38415 - DNA, 21 bp, Artificial Sequence
  Description of Artificial Sequence: Synthetic oligonucleotide
agcaccagcaaagactacacc

SEQ ID NO: 38416 - DNA, 21 bp, Artificial Sequence
  Description of Artificial Sequence: Synthetic oligonucleotide
agagacaccaacagattcggc

SEQ ID NO: 38417 - DNA, 21 bp, Artificial Sequence
  Description of Artificial Sequence: Synthetic oligonucleotide
agtcagattccgccgtctact

SEQ ID NO: 38418 - DNA, 21 bp, Artificial Sequence
  Description of Artificial Sequence: Synthetic oligonucleotide
gcttctactccgaataatact

SEQ ID NO: 38419 - DNA, 21 bp, Artificial Sequence
  Description of Artificial Sequence: Synthetic oligonucleotide
atccaccaaaaagtcaacgtc

SEQ ID NO: 38420 - DNA, 21 bp, Artificial Sequence
  Description of Artificial Sequence: Synthetic oligonucleotide
aatcatggtagtggtacggct

SEQ ID NO: 38421 - DNA, 21 bp, Artificial Sequence
  Description of Artificial Sequence: Synthetic oligonucleotide
aagtgtaattcggcttgtcag

SEQ ID NO: 38422 - DNA, 21 bp, Artificial Sequence
  Description of Artificial Sequence: Synthetic oligonucleotide
gccagcctcaaaacccaaatg

SEQ ID NO: 38423 - DNA, 21 bp, Artificial Sequence
  Description of Artificial Sequence: Synthetic oligonucleotide
aaactcggccaagacgtcaga

SEQ ID NO: 38424 - DNA, 21 bp, Artificial Sequence
  Description of Artificial Sequence: Synthetic oligonucleotide
acccccagcgtcagcaccaaa

SEQ ID NO: 38425 - DNA, 21 bp, Artificial Sequence
  Description of Artificial Sequence: Synthetic oligonucleotide
cacacccccgaagtcggcaaa

SEQ ID NO: 38426 - DNA, 21 bp, Artificial Sequence
  Description of Artificial Sequence: Synthetic oligonucleotide
gggattgggtcggctgcggtt

SEQ ID NO: 38427 - DNA, 21 bp, Artificial Sequence
  Description of Artificial Sequence: Synthetic oligonucleotide
gggggtcaggcgtctggtcgg

SEQ ID NO: 38428 - DNA, 21 bp, Artificial Sequence
  Description of Artificial Sequence: Synthetic oligonucleotide
agaaacgacagcagacccccc

SEQ ID NO: 38429 - DNA, 21 bp, Artificial Sequence
  Description of Artificial Sequence: Synthetic oligonucleotide
tgggggggttctgcggatagg

SEQ ID NO: 38430 - DNA, 21 bp, Artificial Sequence
  Description of Artificial Sequence: Synthetic oligonucleotide
agcggcggcaaaggccccacc

SEQ ID NO: 38431 - DNA, 21 bp, Artificial Sequence
  Description of Artificial Sequence: Synthetic oligonucleotide
agcagccccctcgaacacagc

SEQ ID NO: 38432 - DNA, 21 bp, Artificial Sequence
  Description of Artificial Sequence: Synthetic oligonucleotide
ccgatggattattctcgttcg

SEQ ID NO: 38433 - DNA, 21 bp, Artificial Sequence
  Description of Artificial Sequence: Synthetic oligonucleotide
ttgattaatcctgctggttct

SEQ ID NO: 38434 - DNA, 21 bp, Artificial Sequence
  Description of Artificial Sequence: Synthetic oligonucleotide
ccgtggggtacgaatcttgat

SEQ ID NO: 38435 - DNA, 21 bp, Artificial Sequence
  Description of Artificial Sequence: Synthetic oligonucleotide
caacaagccagcctcagcagc

SEQ ID NO: 38436 - DNA, 21 bp, Artificial Sequence
  Description of Artificial Sequence: Synthetic oligonucleotide
ggttctaatattaataatggt

SEQ ID NO: 38437 - DNA, 21 bp, Artificial Sequence
  Description of Artificial Sequence: Synthetic oligonucleotide
cccatcagccacaccaccggc

SEQ ID NO: 38438 - DNA, 21 bp, Artificial Sequence
  Description of Artificial Sequence: Synthetic oligonucleotide
ttcgccagcagacccgtccaa

SEQ ID NO: 38439 - DNA, 21 bp, Artificial Sequence
  Description of Artificial Sequence: Synthetic oligonucleotide
cttggggtgcatcatacgaat

SEQ ID NO: 38440 - DNA, 21 bp, Artificial Sequence
  Description of Artificial Sequence: Synthetic oligonucleotide
gggtataataagtcgcttgcg

SEQ ID NO: 38441 - DNA, 21 bp, Artificial Sequence
  Description of Artificial Sequence: Synthetic oligonucleotide
tgtccgattcgtatgagtaat

SEQ ID NO: 38442 - DNA, 21 bp, Artificial Sequence
  Description of Artificial Sequence: Synthetic oligonucleotide
tggagccccgaaagaaccatc

SEQ ID NO: 38443 - DNA, 21 bp, Artificial Sequence
  Description of Artificial Sequence: Synthetic oligonucleotide
atgtatagtgatcgttgtgct

SEQ ID NO: 38444 - DNA, 21 bp, Artificial Sequence
  Description of Artificial Sequence: Synthetic oligonucleotide
catcagacgcgtactgcggcg

SEQ ID NO: 38445 - DNA, 21 bp, Artificial Sequence
  Description of Artificial Sequence: Synthetic oligonucleotide
gtgggtagtcagactaatagt

SEQ ID NO: 38446 - DNA, 21 bp, Artificial Sequence
  Description of Artificial Sequence: Synthetic oligonucleotide
agtcagcctaatagtgcgtat

SEQ ID NO: 38447 - DNA, 21 bp, Artificial Sequence
  Description of Artificial Sequence: Synthetic oligonucleotide
ggtggggttccttctaggctt

SEQ ID NO: 38448 - DNA, 21 bp, Artificial Sequence
  Description of Artificial Sequence: Synthetic oligonucleotide
acgactgtgggtagtggttat

SEQ ID NO: 38449 - DNA, 21 bp, Artificial Sequence
  Description of Artificial Sequence: Synthetic oligonucleotide
aaaggttctggacagaatcaa

SEQ ID NO: 38450 - DNA, 21 bp, Artificial Sequence
  Description of Artificial Sequence: Synthetic oligonucleotide
ctcaacagcggcaacggcagc

SEQ ID NO: 38451 - DNA, 21 bp, Artificial Sequence
  Description of Artificial Sequence: Synthetic oligonucleotide
catacggctaatagtcagagt

SEQ ID NO: 38452 - DNA, 21 bp, Artificial Sequence
  Description of Artificial Sequence: Synthetic oligonucleotide
tcgtatcctagtcagttgaat

SEQ ID NO: 38453 - DNA, 21 bp, Artificial Sequence
  Description of Artificial Sequence: Synthetic oligonucleotide
tcgggggcttcgagtaattct

SEQ ID NO: 38454 - DNA, 21 bp, Artificial Sequence
  Description of Artificial Sequence: Synthetic oligonucleotide
aggctggatcggcagcagggg

SEQ ID NO: 38455 - DNA, 21 bp, Artificial Sequence
  Description of Artificial Sequence: Synthetic oligonucleotide
ctcgtcgccggcagcccccaa

SEQ ID NO: 38456 - DNA, 21 bp, Artificial Sequence
  Description of Artificial Sequence: Synthetic oligonucleotide
accgtccccggcagaagcacc

SEQ ID NO: 38457 - DNA, 21 bp, Artificial Sequence
  Description of Artificial Sequence: Synthetic oligonucleotide
cccagccacggccaaaacaga

SEQ ID NO: 38458 - DNA, 21 bp, Artificial Sequence
  Description of Artificial Sequence: Synthetic oligonucleotide
gagaataatagtcgtgctact

SEQ ID NO: 38459 - DNA, 21 bp, Artificial Sequence
  Description of Artificial Sequence: Synthetic oligonucleotide
aataatgctgctactcattcg

SEQ ID NO: 38460 - DNA, 21 bp, Artificial Sequence
  Description of Artificial Sequence: Synthetic oligonucleotide
aacggcagcaccagcagcggc

SEQ ID NO: 38461 - DNA, 21 bp, Artificial Sequence
  Description of Artificial Sequence: Synthetic oligonucleotide
cacggcatggaagtcgccaga

SEQ ID NO: 38462 - DNA, 21 bp, Artificial Sequence
  Description of Artificial Sequence: Synthetic oligonucleotide
tgtattagtccgtcttcgcgt

SEQ ID NO: 38463 - DNA, 21 bp, Artificial Sequence
  Description of Artificial Sequence: Synthetic oligonucleotide
aatccttctatggctatgaag

SEQ ID NO: 38464 - DNA, 21 bp, Artificial Sequence
  Description of Artificial Sequence: Synthetic oligonucleotide
agtaagtctcagcctccgaag

SEQ ID NO: 38465 - DNA, 21 bp, Artificial Sequence
  Description of Artificial Sequence: Synthetic oligonucleotide
cttaatagtatgtctcctagg

SEQ ID NO: 38466 - DNA, 21 bp, Artificial Sequence
  Description of Artificial Sequence: Synthetic oligonucleotide
actcagcagaatgggaggaat

SEQ ID NO: 38467 - DNA, 21 bp, Artificial Sequence
  Description of Artificial Sequence: Synthetic oligonucleotide
gtttctacgccgcgtcttagt

SEQ ID NO: 38468 - DNA, 21 bp, Artificial Sequence
  Description of Artificial Sequence: Synthetic oligonucleotide
gtcaccgccaacagaagcacc

SEQ ID NO: 38469 - DNA, 21 bp, Artificial Sequence
  Description of Artificial Sequence: Synthetic oligonucleotide
actcaggggtctcgtttgtct

SEQ ID NO: 38470 - DNA, 21 bp, Artificial Sequence
  Description of Artificial Sequence: Synthetic oligonucleotide
agcaacggcagcagactcgcc

SEQ ID NO: 38471 - DNA, 21 bp, Artificial Sequence
  Description of Artificial Sequence: Synthetic oligonucleotide
tttagttctaagacttctccg

SEQ ID NO: 38472 - DNA, 21 bp, Artificial Sequence
  Description of Artificial Sequence: Synthetic oligonucleotide
gtcagcgacagcaacaccaaa

SEQ ID NO: 38473 - DNA, 21 bp, Artificial Sequence
  Description of Artificial Sequence: Synthetic oligonucleotide
ggcgccctcgccacctacaga

SEQ ID NO: 38474 - DNA, 21 bp, Artificial Sequence
  Description of Artificial Sequence: Synthetic oligonucleotide
cataggacgagtcgggatggt

SEQ ID NO: 38475 - DNA, 21 bp, Artificial Sequence
  Description of Artificial Sequence: Synthetic oligonucleotide
atgcgtcagacggcttctctt

SEQ ID NO: 38476 - DNA, 21 bp, Artificial Sequence
  Description of Artificial Sequence: Synthetic oligonucleotide
tcggtgacgggtggtcggggt

SEQ ID NO: 38477 - DNA, 21 bp, Artificial Sequence
  Description of Artificial Sequence: Synthetic oligonucleotide
accacccaaagcagaagcctc

SEQ ID NO: 38478 - DNA, 21 bp, Artificial Sequence
  Description of Artificial Sequence: Synthetic oligonucleotide
ctcaacagaggcaaacccgtc

SEQ ID NO: 38479 - DNA, 21 bp, Artificial Sequence
  Description of Artificial Sequence: Synthetic oligonucleotide
agcagactcgaaaaaagcaac

SEQ ID NO: 38480 - DNA, 21 bp, Artificial Sequence
  Description of Artificial Sequence: Synthetic oligonucleotide
agagtcagagccgacgacgac

SEQ ID NO: 38481 - DNA, 21 bp, Artificial Sequence
  Description of Artificial Sequence: Synthetic oligonucleotide
gtcagcaccggcagcttcacc

SEQ ID NO: 38482 - DNA, 21 bp, Artificial Sequence
  Description of Artificial Sequence: Synthetic oligonucleotide
agtggtgttgagcgggttaat

SEQ ID NO: 38483 - DNA, 21 bp, Artificial Sequence
  Description of Artificial Sequence: Synthetic oligonucleotide
ccgtctaattctaagtgtggt

SEQ ID NO: 38484 - DNA, 21 bp, Artificial Sequence
  Description of Artificial Sequence: Synthetic oligonucleotide
tatcatcttaattctcagtct

SEQ ID NO: 38485 - DNA, 21 bp, Artificial Sequence
  Description of Artificial Sequence: Synthetic oligonucleotide
aatacttctacgaatggtatt

SEQ ID NO: 38486 - DNA, 21 bp, Artificial Sequence
  Description of Artificial Sequence: Synthetic oligonucleotide
tcgcataataggacgaatgat

SEQ ID NO: 38487 - DNA, 21 bp, Artificial Sequence
  Description of Artificial Sequence: Synthetic oligonucleotide
ggtagtcagagggcgcctggt

SEQ ID NO: 38488 - DNA, 21 bp, Artificial Sequence
  Description of Artificial Sequence: Synthetic oligonucleotide
ttggggactagtactattttg

SEQ ID NO: 38489 - DNA, 21 bp, Artificial Sequence
  Description of Artificial Sequence: Synthetic oligonucleotide
atgatgaatcggagtgctagt

SEQ ID NO: 38490 - DNA, 21 bp, Artificial Sequence
  Description of Artificial Sequence: Synthetic oligonucleotide
tttgcgaatactgctaatagg

SEQ ID NO: 38491 - DNA, 21 bp, Artificial Sequence
  Description of Artificial Sequence: Synthetic oligonucleotide
acttctaatagtaatattgcg

SEQ ID NO: 38492 - DNA, 21 bp, Artificial Sequence
  Description of Artificial Sequence: Synthetic oligonucleotide
ctggataaggagcctaggggt

SEQ ID NO: 38493 - DNA, 21 bp, Artificial Sequence
  Description of Artificial Sequence: Synthetic oligonucleotide
tacggcaaccccagacaagcc

SEQ ID NO: 38494 - DNA, 21 bp, Artificial Sequence
  Description of Artificial Sequence: Synthetic oligonucleotide
atccaaagccccggcaacatg

SEQ ID NO: 38495 - DNA, 21 bp, Artificial Sequence
  Description of Artificial Sequence: Synthetic oligonucleotide
gaccccgtcagaaaaaccagc

SEQ ID NO: 38496 - DNA, 21 bp, Artificial Sequence
  Description of Artificial Sequence: Synthetic oligonucleotide
tgttgtactgtgcctttggtg

SEQ ID NO: 38497 - DNA, 21 bp, Artificial Sequence
  Description of Artificial Sequence: Synthetic oligonucleotide
aagaatattggttctcatggg

SEQ ID NO: 38498 - DNA, 21 bp, Artificial Sequence
  Description of Artificial Sequence: Synthetic oligonucleotide
gctgcttctatggagtatagt

SEQ ID NO: 38499 - DNA, 21 bp, Artificial Sequence
  Description of Artificial Sequence: Synthetic oligonucleotide
agtaatgggactaagcgtcag

SEQ ID NO: 38500 - DNA, 21 bp, Artificial Sequence
  Description of Artificial Sequence: Synthetic oligonucleotide
aacgtcgaaagcaaaagctgc

SEQ ID NO: 38501 - DNA, 21 bp, Artificial Sequence
  Description of Artificial Sequence: Synthetic oligonucleotide
atgcttcctcagcatggtagg

SEQ ID NO: 38502 - DNA, 21 bp, Artificial Sequence
  Description of Artificial Sequence: Synthetic oligonucleotide
acggggtctgggagtaatcat

SEQ ID NO: 38503 - DNA, 21 bp, Artificial Sequence
  Description of Artificial Sequence: Synthetic oligonucleotide
cttaggaatggtattgcttct

SEQ ID NO: 38504 - DNA, 21 bp, Artificial Sequence
  Description of Artificial Sequence: Synthetic oligonucleotide
atgagaagcggcacccacaac

SEQ ID NO: 38505 - DNA, 21 bp, Artificial Sequence
  Description of Artificial Sequence: Synthetic oligonucleotide
acgtcgaatactaagcagggt

SEQ ID NO: 38506 - DNA, 21 bp, Artificial Sequence
  Description of Artificial Sequence: Synthetic oligonucleotide
cctgggatggctggtcgtggg

SEQ ID NO: 38507 - DNA, 21 bp, Artificial Sequence
  Description of Artificial Sequence: Synthetic oligonucleotide
cccagcaacagacaaatcgcc

SEQ ID NO: 38508 - DNA, 21 bp, Artificial Sequence
  Description of Artificial Sequence: Synthetic oligonucleotide
gatggtcttcgtaattcgttg

SEQ ID NO: 38509 - DNA, 21 bp, Artificial Sequence
  Description of Artificial Sequence: Synthetic oligonucleotide
ccgtcgacgccgacgattaag

SEQ ID NO: 38510 - DNA, 21 bp, Artificial Sequence
  Description of Artificial Sequence: Synthetic oligonucleotide
gaggtgcatgctaagaataat

SEQ ID NO: 38511 - DNA, 21 bp, Artificial Sequence
  Description of Artificial Sequence: Synthetic oligonucleotide
aataatgctcatcgggttgcg

SEQ ID NO: 38512 - DNA, 21 bp, Artificial Sequence
  Description of Artificial Sequence: Synthetic oligonucleotide
aaagacaacacccccggcaga

SEQ ID NO: 38513 - DNA, 21 bp, Artificial Sequence
  Description of Artificial Sequence: Synthetic oligonucleotide
tctcttggtcgtgatcatgct

SEQ ID NO: 38514 - DNA, 21 bp, Artificial Sequence
  Description of Artificial Sequence: Synthetic oligonucleotide
actaatattcaggcgtctaag

SEQ ID NO: 38515 - DNA, 21 bp, Artificial Sequence
  Description of Artificial Sequence: Synthetic oligonucleotide
caggggactcatactttgcgt

SEQ ID NO: 38516 - DNA, 21 bp, Artificial Sequence
  Description of Artificial Sequence: Synthetic oligonucleotide
acgggttcggggacgattctt

SEQ ID NO: 38517 - DNA, 21 bp, Artificial Sequence
  Description of Artificial Sequence: Synthetic oligonucleotide
gctcagcatgagcttcgtgct

SEQ ID NO: 38518 - DNA, 21 bp, Artificial Sequence
  Description of Artificial Sequence: Synthetic oligonucleotide
catgttgatactaggcatgtg

SEQ ID NO: 38519 - DNA, 21 bp, Artificial Sequence
  Description of Artificial Sequence: Synthetic oligonucleotide
tctgggggtaagtcggcgctt

SEQ ID NO: 38520 - DNA, 21 bp, Artificial Sequence
  Description of Artificial Sequence: Synthetic oligonucleotide
atggctgggaatccgcatagt

SEQ ID NO: 38521 - DNA, 21 bp, Artificial Sequence
  Description of Artificial Sequence: Synthetic oligonucleotide
aatagggtgcagccggcttcg

SEQ ID NO: 38522 - DNA, 21 bp, Artificial Sequence
  Description of Artificial Sequence: Synthetic oligonucleotide
gaggctaaggctaatgggaag

SEQ ID NO: 38523 - DNA, 21 bp, Artificial Sequence
  Description of Artificial Sequence: Synthetic oligonucleotide
ggcaccgtcagaaccctccac

SEQ ID NO: 38524 - DNA, 21 bp, Artificial Sequence
  Description of Artificial Sequence: Synthetic oligonucleotide
cagacttcggctacgcagcgg

SEQ ID NO: 38525 - DNA, 21 bp, Artificial Sequence
  Description of Artificial Sequence: Synthetic oligonucleotide
ccggggggtaagtcgcagttg

SEQ ID NO: 38526 - DNA, 21 bp, Artificial Sequence
  Description of Artificial Sequence: Synthetic oligonucleotide
cgtacggtgccttcgagtctt

SEQ ID NO: 38527 - DNA, 21 bp, Artificial Sequence
  Description of Artificial Sequence: Synthetic oligonucleotide
gtgctttcgtcttcgcctaag

SEQ ID NO: 38528 - DNA, 21 bp, Artificial Sequence
  Description of Artificial Sequence: Synthetic oligonucleotide
tgcggcagaagcggcggcggc

SEQ ID NO: 38529 - DNA, 21 bp, Artificial Sequence
  Description of Artificial Sequence: Synthetic oligonucleotide
cagaatagtaaggggtatgtg

SEQ ID NO: 38530 - DNA, 21 bp, Artificial Sequence
  Description of Artificial Sequence: Synthetic oligonucleotide
taccaaaacaaaagcctcacc

SEQ ID NO: 38531 - DNA, 21 bp, Artificial Sequence
  Description of Artificial Sequence: Synthetic oligonucleotide
accagcagaaccagctacgaa

SEQ ID NO: 38532 - DNA, 21 bp, Artificial Sequence
  Description of Artificial Sequence: Synthetic oligonucleotide
atgcagactagtcagtcgact

SEQ ID NO: 38533 - DNA, 21 bp, Artificial Sequence
  Description of Artificial Sequence: Synthetic oligonucleotide
aacggttgtggacagaatcaa

SEQ ID NO: 38534 - DNA, 21 bp, Artificial Sequence
  Description of Artificial Sequence: Synthetic oligonucleotide
agttttcctcctggtaatgtt

SEQ ID NO: 38535 - DNA, 21 bp, Artificial Sequence
  Description of Artificial Sequence: Synthetic oligonucleotide
ccgactggggcgcatgttacg

SEQ ID NO: 38536 - DNA, 21 bp, Artificial Sequence
  Description of Artificial Sequence: Synthetic oligonucleotide
gacagcaaacaaaacctcacc

SEQ ID NO: 38537 - DNA, 21 bp, Artificial Sequence
  Description of Artificial Sequence: Synthetic oligonucleotide
cttattcgtggtgggaataat

SEQ ID NO: 38538 - DNA, 21 bp, Artificial Sequence
  Description of Artificial Sequence: Synthetic oligonucleotide
ggtttgaagaatgagcctgct

SEQ ID NO: 38539 - DNA, 21 bp, Artificial Sequence
  Description of Artificial Sequence: Synthetic oligonucleotide
catgcttcgagggttaatatt

SEQ ID NO: 38540 - DNA, 21 bp, Artificial Sequence
  Description of Artificial Sequence: Synthetic oligonucleotide
ttgaatctgaagcctattaat

SEQ ID NO: 38541 - DNA, 21 bp, Artificial Sequence
  Description of Artificial Sequence: Synthetic oligonucleotide
acgacgcagactccgtataag

SEQ ID NO: 38542 - DNA, 21 bp, Artificial Sequence
  Description of Artificial Sequence: Synthetic oligonucleotide
attgggttgggtaatacgcct

SEQ ID NO: 38543 - DNA, 21 bp, Artificial Sequence
  Description of Artificial Sequence: Synthetic oligonucleotide
aactgcagcggccaaaaacaa

SEQ ID NO: 38544 - DNA, 21 bp, Artificial Sequence
  Description of Artificial Sequence: Synthetic oligonucleotide
agccaagtcagccacagcgtc

SEQ ID NO: 38545 - DNA, 21 bp, Artificial Sequence
  Description of Artificial Sequence: Synthetic oligonucleotide
tggaacaaaaccagcccccaa

SEQ ID NO: 38546 - DNA, 21 bp, Artificial Sequence
  Description of Artificial Sequence: Synthetic oligonucleotide
caggggtctgggagtaatcat

SEQ ID NO: 38547 - DNA, 21 bp, Artificial Sequence
  Description of Artificial Sequence: Synthetic oligonucleotide
gctctgaggaatcagagtcag

SEQ ID NO: 38548 - DNA, 21 bp, Artificial Sequence
  Description of Artificial Sequence: Synthetic oligonucleotide
cccgccgaccacggcaaactc

SEQ ID NO: 38549 - DNA, 21 bp, Artificial Sequence
  Description of Artificial Sequence: Synthetic oligonucleotide
gattctattggtagttctaag

SEQ ID NO: 38550 - DNA, 21 bp, Artificial Sequence
  Description of Artificial Sequence: Synthetic oligonucleotide
aacggcatcaccaaaagcagc

SEQ ID NO: 38551 - DNA, 21 bp, Artificial Sequence
  Description of Artificial Sequence: Synthetic oligonucleotide
ccgttgcaggcgactggtaag

SEQ ID NO: 38552 - DNA, 21 bp, Artificial Sequence
  Description of Artificial Sequence: Synthetic oligonucleotide
tctagggtgcgtgatagtcat

SEQ ID NO: 38553 - DNA, 21 bp, Artificial Sequence
  Description of Artificial Sequence: Synthetic oligonucleotide
tcttatgggaaggagagtagt

SEQ ID NO: 38554 - DNA, 21 bp, Artificial Sequence
  Description of Artificial Sequence: Synthetic oligonucleotide
agactcgtcgacagccacaaa

SEQ ID NO: 38555 - DNA, 21 bp, Artificial Sequence
  Description of Artificial Sequence: Synthetic oligonucleotide
tacgtcagcagcggcaaagcc

SEQ ID NO: 38556 - DNA, 21 bp, Artificial Sequence
  Description of Artificial Sequence: Synthetic oligonucleotide
cagagtacggttgagtcgagg

SEQ ID NO: 38557 - DNA, 21 bp, Artificial Sequence
  Description of Artificial Sequence: Synthetic oligonucleotide
tcttcgtctacgtcgcctagg

SEQ ID NO: 38558 - DNA, 21 bp, Artificial Sequence
  Description of Artificial Sequence: Synthetic oligonucleotide
cgtcctggggggaaggatggg

SEQ ID NO: 38559 - DNA, 21 bp, Artificial Sequence
  Description of Artificial Sequence: Synthetic oligonucleotide
agccccaccagacccatgaac

SEQ ID NO: 38560 - DNA, 21 bp, Artificial Sequence
  Description of Artificial Sequence: Synthetic oligonucleotide
tctagtcagatgcatgggtcg

SEQ ID NO: 38561 - DNA, 21 bp, Artificial Sequence
  Description of Artificial Sequence: Synthetic oligonucleotide
accggcagagcccccagcagc

SEQ ID NO: 38562 - DNA, 21 bp, Artificial Sequence
  Description of Artificial Sequence: Synthetic oligonucleotide
caaagcaacaccagccccacc

SEQ ID NO: 38563 - DNA, 21 bp, Artificial Sequence
  Description of Artificial Sequence: Synthetic oligonucleotide
ggtactatttcgcatatgacg

SEQ ID NO: 38564 - DNA, 21 bp, Artificial Sequence
  Description of Artificial Sequence: Synthetic oligonucleotide
attcctgcgtcgtcgtcgggt

SEQ ID NO: 38565 - DNA, 21 bp, Artificial Sequence
  Description of Artificial Sequence: Synthetic oligonucleotide
ttggcgactgcgaatagtcgt

SEQ ID NO: 38566 - DNA, 21 bp, Artificial Sequence
  Description of Artificial Sequence: Synthetic oligonucleotide
gggactgcggatcggcatttg

SEQ ID NO: 38567 - DNA, 21 bp, Artificial Sequence
  Description of Artificial Sequence: Synthetic oligonucleotide
acccaccaaagcagcaccagc

SEQ ID NO: 38568 - DNA, 21 bp, Artificial Sequence
  Description of Artificial Sequence: Synthetic oligonucleotide
tctcctaataatcggggtatg

SEQ ID NO: 38569 - DNA, 21 bp, Artificial Sequence
  Description of Artificial Sequence: Synthetic oligonucleotide
ggcggcggcaccagcttcggc

SEQ ID NO: 38570 - DNA, 21 bp, Artificial Sequence
  Description of Artificial Sequence: Synthetic oligonucleotide
agaccccacgacaacgacaac

SEQ ID NO: 38571 - DNA, 21 bp, Artificial Sequence
  Description of Artificial Sequence: Synthetic oligonucleotide
tatcctaatggtaagtcttcg

SEQ ID NO: 38572 - DNA, 21 bp, Artificial Sequence
  Description of Artificial Sequence: Synthetic oligonucleotide
atcagaagcaaagaaagcgaa

SEQ ID NO: 38573 - DNA, 21 bp, Artificial Sequence
  Description of Artificial Sequence: Synthetic oligonucleotide
ggccaagtcaaacaagccctc

SEQ ID NO: 38574 - DNA, 21 bp, Artificial Sequence
  Description of Artificial Sequence: Synthetic oligonucleotide
aagcagccggtttctacgcat

SEQ ID NO: 38575 - DNA, 21 bp, Artificial Sequence
  Description of Artificial Sequence: Synthetic oligonucleotide
actcagcagaatgggagtaat

SEQ ID NO: 38576 - DNA, 21 bp, Artificial Sequence
  Description of Artificial Sequence: Synthetic oligonucleotide
gggggtgataataagcttacg

SEQ ID NO: 38577 - DNA, 21 bp, Artificial Sequence
  Description of Artificial Sequence: Synthetic oligonucleotide
tacagcggcggcaacatgagc

SEQ ID NO: 38578 - DNA, 21 bp, Artificial Sequence
  Description of Artificial Sequence: Synthetic oligonucleotide
tcgcatgatagtcgtgtggct

SEQ ID NO: 38579 - DNA, 21 bp, Artificial Sequence
  Description of Artificial Sequence: Synthetic oligonucleotide
caatacaaccaagccggcctc

SEQ ID NO: 38580 - DNA, 21 bp, Artificial Sequence
  Description of Artificial Sequence: Synthetic oligonucleotide
tctaattcggcgtcgtatggt

SEQ ID NO: 38581 - DNA, 21 bp, Artificial Sequence
  Description of Artificial Sequence: Synthetic oligonucleotide
tttacggttactgggctgagt

SEQ ID NO: 38582 - DNA, 21 bp, Artificial Sequence
  Description of Artificial Sequence: Synthetic oligonucleotide
catggtcggacttcggttttg

SEQ ID NO: 38583 - DNA, 21 bp, Artificial Sequence
  Description of Artificial Sequence: Synthetic oligonucleotide
atgggtaatgcgggtgtgcgg

SEQ ID NO: 38584 - DNA, 21 bp, Artificial Sequence
  Description of Artificial Sequence: Synthetic oligonucleotide
gattgtgtttcgcggtgtaag

SEQ ID NO: 38585 - DNA, 21 bp, Artificial Sequence
  Description of Artificial Sequence: Synthetic oligonucleotide
ggtgtgaatattcatgcgtct

SEQ ID NO: 38586 - DNA, 21 bp, Artificial Sequence
  Description of Artificial Sequence: Synthetic oligonucleotide
agaaacagcgccagcatcttc

SEQ ID NO: 38587 - DNA, 21 bp, Artificial Sequence
  Description of Artificial Sequence: Synthetic oligonucleotide
caggcgaatactagtacggat

SEQ ID NO: 38588 - DNA, 21 bp, Artificial Sequence
  Description of Artificial Sequence: Synthetic oligonucleotide
atcgccaacgcccactacaac

SEQ ID NO: 38589 - DNA, 21 bp, Artificial Sequence
  Description of Artificial Sequence: Synthetic oligonucleotide
acgacgactactcgtccgagt

SEQ ID NO: 38590 - DNA, 21 bp, Artificial Sequence
  Description of Artificial Sequence: Synthetic oligonucleotide
gtgctgaatgctaagtcgtct

SEQ ID NO: 38591 - DNA, 21 bp, Artificial Sequence
  Description of Artificial Sequence: Synthetic oligonucleotide
cctggtcagagtacttctagt

SEQ ID NO: 38592 - DNA, 21 bp, Artificial Sequence
  Description of Artificial Sequence: Synthetic oligonucleotide
ggtgatgctggtagttttagt

SEQ ID NO: 38593 - DNA, 21 bp, Artificial Sequence
  Description of Artificial Sequence: Synthetic oligonucleotide
gtccaaggcagcctccccagc

SEQ ID NO: 38594 - DNA, 21 bp, Artificial Sequence
  Description of Artificial Sequence: Synthetic oligonucleotide
gctcatcgtaatatttcttcg

SEQ ID NO: 38595 - DNA, 21 bp, Artificial Sequence
  Description of Artificial Sequence: Synthetic oligonucleotide
gttgggaataataatcgtctg

SEQ ID NO: 38596 - DNA, 21 bp, Artificial Sequence
  Description of Artificial Sequence: Synthetic oligonucleotide
ccccaaagcagaaaaggcgaa

SEQ ID NO: 38597 - DNA, 21 bp, Artificial Sequence
  Description of Artificial Sequence: Synthetic oligonucleotide
atcggcagcggccaaaaccaa

SEQ ID NO: 38598 - DNA, 21 bp, Artificial Sequence
  Description of Artificial Sequence: Synthetic oligonucleotide
cggattcctaataatccgagt

SEQ ID NO: 38599 - DNA, 21 bp, Artificial Sequence
  Description of Artificial Sequence: Synthetic oligonucleotide
aagaatcaggcgccgttgctt

SEQ ID NO: 38600 - DNA, 21 bp, Artificial Sequence
  Description of Artificial Sequence: Synthetic oligonucleotide
tcttcgagggcttctcaggat

SEQ ID NO: 38601 - DNA, 21 bp, Artificial Sequence
  Description of Artificial Sequence: Synthetic oligonucleotide
cgtacgggtcgtgaggttgat

SEQ ID NO: 38602 - DNA, 21 bp, Artificial Sequence
  Description of Artificial Sequence: Synthetic oligonucleotide
aacaacgtccccctcatcaaa

SEQ ID NO: 38603 - DNA, 21 bp, Artificial Sequence
  Description of Artificial Sequence: Synthetic oligonucleotide
tatggttcgaatacgccgact

SEQ ID NO: 38604 - DNA, 21 bp, Artificial Sequence
  Description of Artificial Sequence: Synthetic oligonucleotide
aggcctagtagtgtgaaggat

SEQ ID NO: 38605 - DNA, 21 bp, Artificial Sequence
  Description of Artificial Sequence: Synthetic oligonucleotide
tacagcagaacccaacaaagc

SEQ ID NO: 38606 - DNA, 21 bp, Artificial Sequence
  Description of Artificial Sequence: Synthetic oligonucleotide
cgggatgttggttctgctgct

SEQ ID NO: 38607 - DNA, 21 bp, Artificial Sequence
  Description of Artificial Sequence: Synthetic oligonucleotide
caaggccaaaacagaaccgtc

SEQ ID NO: 38608 - DNA, 21 bp, Artificial Sequence
  Description of Artificial Sequence: Synthetic oligonucleotide
agccaaagcagccccgtcgcc

SEQ ID NO: 38609 - DNA, 21 bp, Artificial Sequence
  Description of Artificial Sequence: Synthetic oligonucleotide
agcacccacgaccacagcaga

SEQ ID NO: 38610 - DNA, 21 bp, Artificial Sequence
  Description of Artificial Sequence: Synthetic oligonucleotide
cgtaatgttagtggtatgaat

SEQ ID NO: 38611 - DNA, 21 bp, Artificial Sequence
  Description of Artificial Sequence: Synthetic oligonucleotide
attagggcgaaggagtctgcg

SEQ ID NO: 38612 - DNA, 21 bp, Artificial Sequence
  Description of Artificial Sequence: Synthetic oligonucleotide
cacgccaacagccccgccacc

SEQ ID NO: 38613 - DNA, 21 bp, Artificial Sequence
  Description of Artificial Sequence: Synthetic oligonucleotide
agaatgaccaccatgcaagcc

SEQ ID NO: 38614 - DNA, 21 bp, Artificial Sequence
  Description of Artificial Sequence: Synthetic oligonucleotide
agtggtacgactcggactctg

SEQ ID NO: 38615 - DNA, 21 bp, Artificial Sequence
  Description of Artificial Sequence: Synthetic oligonucleotide
gggcttgatcatcttcggacg

SEQ ID NO: 38616 - DNA, 21 bp, Artificial Sequence
  Description of Artificial Sequence: Synthetic oligonucleotide
ctcagcctcaacaaaagccaa

SEQ ID NO: 38617 - DNA, 21 bp, Artificial Sequence
  Description of Artificial Sequence: Synthetic oligonucleotide
ggcgccgccgtccaagccaac

SEQ ID NO: 38618 - DNA, 21 bp, Artificial Sequence
  Description of Artificial Sequence: Synthetic oligonucleotide
ttcaacagcaacagagacagc

SEQ ID NO: 38619 - DNA, 21 bp, Artificial Sequence
  Description of Artificial Sequence: Synthetic oligonucleotide
gtgcatacgggtcagaatggg

SEQ ID NO: 38620 - DNA, 21 bp, Artificial Sequence
  Description of Artificial Sequence: Synthetic oligonucleotide
gaaagcaacagaagccaagtc

SEQ ID NO: 38621 - DNA, 21 bp, Artificial Sequence
  Description of Artificial Sequence: Synthetic oligonucleotide
gctggtacgaattctaggcag

SEQ ID NO: 38622 - DNA, 21 bp, Artificial Sequence
  Description of Artificial Sequence: Synthetic oligonucleotide
agtgctgttgggaaggcgagt

SEQ ID NO: 38623 - DNA, 21 bp, Artificial Sequence
  Description of Artificial Sequence: Synthetic oligonucleotide
accgtcctcggcgccagaggc

SEQ ID NO: 38624 - DNA, 21 bp, Artificial Sequence
  Description of Artificial Sequence: Synthetic oligonucleotide
aacagacaaagcagccccacc

SEQ ID NO: 38625 - DNA, 21 bp, Artificial Sequence
  Description of Artificial Sequence: Synthetic oligonucleotide
atgaacaccagcagaagcagc

SEQ ID NO: 38626 - DNA, 21 bp, Artificial Sequence
  Description of Artificial Sequence: Synthetic oligonucleotide
gcgaatggtactaagtctagt

SEQ ID NO: 38627 - DNA, 21 bp, Artificial Sequence
  Description of Artificial Sequence: Synthetic oligonucleotide
agtccgcttcagtctattgtt

SEQ ID NO: 38628 - DNA, 21 bp, Artificial Sequence
  Description of Artificial Sequence: Synthetic oligonucleotide
tacagagtcggcagcatcagc

SEQ ID NO: 38629 - DNA, 21 bp, Artificial Sequence
  Description of Artificial Sequence: Synthetic oligonucleotide
aattctgggcattcgcatgat

SEQ ID NO: 38630 - DNA, 21 bp, Artificial Sequence
  Description of Artificial Sequence: Synthetic oligonucleotide
caaaacagaaacaccgtcggc

SEQ ID NO: 38631 - DNA, 21 bp, Artificial Sequence
  Description of Artificial Sequence: Synthetic oligonucleotide
cctacgaaggcgaatgttacg

SEQ ID NO: 38632 - DNA, 21 bp, Artificial Sequence
  Description of Artificial Sequence: Synthetic oligonucleotide
ttcagagtcaccggcagcacc

SEQ ID NO: 38633 - DNA, 21 bp, Artificial Sequence
  Description of Artificial Sequence: Synthetic oligonucleotide
atcaccagcggcagcaccaga

SEQ ID NO: 38634 - DNA, 21 bp, Artificial Sequence
  Description of Artificial Sequence: Synthetic oligonucleotide
tctccgacgagtcctatgaat

SEQ ID NO: 38635 - DNA, 21 bp, Artificial Sequence
  Description of Artificial Sequence: Synthetic oligonucleotide
gagctggctgcgccttctaag

SEQ ID NO: 38636 - DNA, 21 bp, Artificial Sequence
  Description of Artificial Sequence: Synthetic oligonucleotide
ccccccaacctcaaactcagc

SEQ ID NO: 38637 - DNA, 21 bp, Artificial Sequence
  Description of Artificial Sequence: Synthetic oligonucleotide
aatagtaattcgcatggttct

SEQ ID NO: 38638 - DNA, 21 bp, Artificial Sequence
  Description of Artificial Sequence: Synthetic oligonucleotide
aatctgggtcagaatctgtct

SEQ ID NO: 38639 - DNA, 21 bp, Artificial Sequence
  Description of Artificial Sequence: Synthetic oligonucleotide
aatcttggggctactgctagt

SEQ ID NO: 38640 - DNA, 21 bp, Artificial Sequence
  Description of Artificial Sequence: Synthetic oligonucleotide
aacatgcccatgagaagcggc

SEQ ID NO: 38641 - DNA, 21 bp, Artificial Sequence
  Description of Artificial Sequence: Synthetic oligonucleotide
agtcttcctttggcgattaat

SEQ ID NO: 38642 - DNA, 21 bp, Artificial Sequence
  Description of Artificial Sequence: Synthetic oligonucleotide
cctcagaataatcaggcgcat

SEQ ID NO: 38643 - DNA, 21 bp, Artificial Sequence
  Description of Artificial Sequence: Synthetic oligonucleotide
agcagcgaagccgccaccaga

SEQ ID NO: 38644 - DNA, 21 bp, Artificial Sequence
  Description of Artificial Sequence: Synthetic oligonucleotide
tctgtgagttctcctagggat

SEQ ID NO: 38645 - DNA, 21 bp, Artificial Sequence
  Description of Artificial Sequence: Synthetic oligonucleotide
cccggctacggcagcaaccac

SEQ ID NO: 38646 - DNA, 21 bp, Artificial Sequence
  Description of Artificial Sequence: Synthetic oligonucleotide
aagattccgaattatgatcgt

SEQ ID NO: 38647 - DNA, 21 bp, Artificial Sequence
  Description of Artificial Sequence: Synthetic oligonucleotide
cctcttcagacgagtaggact

SEQ ID NO: 38648 - DNA, 21 bp, Artificial Sequence
  Description of Artificial Sequence: Synthetic oligonucleotide
agagaccccaaagccggcgtc

SEQ ID NO: 38649 - DNA, 21 bp, Artificial Sequence
  Description of Artificial Sequence: Synthetic oligonucleotide
aatgcgactgctaatgggcag

SEQ ID NO: 38650 - DNA, 21 bp, Artificial Sequence
  Description of Artificial Sequence: Synthetic oligonucleotide
actgggtcggggaggttgctt

SEQ ID NO: 38651 - DNA, 21 bp, Artificial Sequence
  Description of Artificial Sequence: Synthetic oligonucleotide
attactggttctttgagtaag

SEQ ID NO: 38652 - DNA, 21 bp, Artificial Sequence
  Description of Artificial Sequence: Synthetic oligonucleotide
tggtctcttggttcgcagtcg

SEQ ID NO: 38653 - DNA, 21 bp, Artificial Sequence
  Description of Artificial Sequence: Synthetic oligonucleotide
acccccacccccgtcaaccaa

SEQ ID NO: 38654 - DNA, 21 bp, Artificial Sequence
  Description of Artificial Sequence: Synthetic oligonucleotide
tcggatatgtctggtcagcgt

SEQ ID NO: 38655 - DNA, 21 bp, Artificial Sequence
  Description of Artificial Sequence: Synthetic oligonucleotide
cccggcgacagcggcaaagtc

SEQ ID NO: 38656 - DNA, 21 bp, Artificial Sequence
  Description of Artificial Sequence: Synthetic oligonucleotide
ggcgtcaacagaatccccgcc

SEQ ID NO: 38657 - DNA, 21 bp, Artificial Sequence
  Description of Artificial Sequence: Synthetic oligonucleotide
gagcgtgctaaggggtctagt

SEQ ID NO: 38658 - DNA, 21 bp, Artificial Sequence
  Description of Artificial Sequence: Synthetic oligonucleotide
gctgtgtctaagggtggtcct

SEQ ID NO: 38659 - DNA, 21 bp, Artificial Sequence
  Description of Artificial Sequence: Synthetic oligonucleotide
ggcaccaaccccggcaccctc

SEQ ID NO: 38660 - DNA, 21 bp, Artificial Sequence
  Description of Artificial Sequence: Synthetic oligonucleotide
gcctacggcaaaggcagcagc

SEQ ID NO: 38661 - DNA, 21 bp, Artificial Sequence
  Description of Artificial Sequence: Synthetic oligonucleotide
ctttctattaagggtgcttcg

SEQ ID NO: 38662 - DNA, 21 bp, Artificial Sequence
  Description of Artificial Sequence: Synthetic oligonucleotide
tctcagtggcagtcgtcttct

SEQ ID NO: 38663 - DNA, 21 bp, Artificial Sequence
  Description of Artificial Sequence: Synthetic oligonucleotide
agcaacaccagagacatcaaa

SEQ ID NO: 38664 - DNA, 21 bp, Artificial Sequence
  Description of Artificial Sequence: Synthetic oligonucleotide
aattctagtcataattcgcct

SEQ ID NO: 38665 - DNA, 21 bp, Artificial Sequence
  Description of Artificial Sequence: Synthetic oligonucleotide
accacccacagcagcatcaac

SEQ ID NO: 38666 - DNA, 21 bp, Artificial Sequence
  Description of Artificial Sequence: Synthetic oligonucleotide
tttgctcgtagtgctagttct

SEQ ID NO: 38667 - DNA, 21 bp, Artificial Sequence
  Description of Artificial Sequence: Synthetic oligonucleotide
aagcagactatgggtactctt

SEQ ID NO: 38668 - DNA, 21 bp, Artificial Sequence
  Description of Artificial Sequence: Synthetic oligonucleotide
gccatgagcgacacctaccac

SEQ ID NO: 38669 - DNA, 21 bp, Artificial Sequence
  Description of Artificial Sequence: Synthetic oligonucleotide
ccgagtagtaatcatgttaag

SEQ ID NO: 38670 - DNA, 21 bp, Artificial Sequence
  Description of Artificial Sequence: Synthetic oligonucleotide
gtcagcgccggcgccagaagc

SEQ ID NO: 38671 - DNA, 21 bp, Artificial Sequence
  Description of Artificial Sequence: Synthetic oligonucleotide
caaaacggcgacgccatgggc

SEQ ID NO: 38672 - DNA, 21 bp, Artificial Sequence
  Description of Artificial Sequence: Synthetic oligonucleotide
ttttcgcgtagtccggcggtg

SEQ ID NO: 38673 - DNA, 21 bp, Artificial Sequence
  Description of Artificial Sequence: Synthetic oligonucleotide
agtgatgtgcgtgctcggagt

SEQ ID NO: 38674 - DNA, 21 bp, Artificial Sequence
  Description of Artificial Sequence: Synthetic oligonucleotide
cccctcagaatcggcacccaa

SEQ ID NO: 38675 - DNA, 21 bp, Artificial Sequence
  Description of Artificial Sequence: Synthetic oligonucleotide
ctccccgccagaagcgacggc

SEQ ID NO: 38676 - DNA, 21 bp, Artificial Sequence
  Description of Artificial Sequence: Synthetic oligonucleotide
gtcctcaaaagcaacggctac

SEQ ID NO: 38677 - DNA, 21 bp, Artificial Sequence
  Description of Artificial Sequence: Synthetic oligonucleotide
accaccaacagaagcgacaga

SEQ ID NO: 38678 - DNA, 21 bp, Artificial Sequence
  Description of Artificial Sequence: Synthetic oligonucleotide
agccacagcagcagccacaaa

SEQ ID NO: 38679 - DNA, 21 bp, Artificial Sequence
  Description of Artificial Sequence: Synthetic oligonucleotide
gcgtgtcagcctcagtcgttg

SEQ ID NO: 38680 - DNA, 21 bp, Artificial Sequence
  Description of Artificial Sequence: Synthetic oligonucleotide
agaaacaacaacacccccggc

SEQ ID NO: 38681 - DNA, 21 bp, Artificial Sequence
  Description of Artificial Sequence: Synthetic oligonucleotide
ttcgtcagcagcgacctcaga

SEQ ID NO: 38682 - DNA, 21 bp, Artificial Sequence
  Description of Artificial Sequence: Synthetic oligonucleotide
gtgccgttggctgggaggccg

SEQ ID NO: 38683 - DNA, 21 bp, Artificial Sequence
  Description of Artificial Sequence: Synthetic oligonucleotide
tattttaatagtccttcgaat

SEQ ID NO: 38684 - DNA, 21 bp, Artificial Sequence
  Description of Artificial Sequence: Synthetic oligonucleotide
ctcggcagcatcaaccccgtc

SEQ ID NO: 38685 - DNA, 21 bp, Artificial Sequence
  Description of Artificial Sequence: Synthetic oligonucleotide
acggttgttcagccgcatgcg

SEQ ID NO: 38686 - DNA, 21 bp, Artificial Sequence
  Description of Artificial Sequence: Synthetic oligonucleotide
gtcagcaccggcaaaagcgtc

SEQ ID NO: 38687 - DNA, 21 bp, Artificial Sequence
  Description of Artificial Sequence: Synthetic oligonucleotide
ggggggtcgaattctaggctg

SEQ ID NO: 38688 - DNA, 21 bp, Artificial Sequence
  Description of Artificial Sequence: Synthetic oligonucleotide
tcgagtccgactaatatggcg

SEQ ID NO: 38689 - DNA, 21 bp, Artificial Sequence
  Description of Artificial Sequence: Synthetic oligonucleotide
catagtacgtctttgtctaag

SEQ ID NO: 38690 - DNA, 21 bp, Artificial Sequence
  Description of Artificial Sequence: Synthetic oligonucleotide
cccgtcctcaacaaagccacc

SEQ ID NO: 38691 - DNA, 21 bp, Artificial Sequence
  Description of Artificial Sequence: Synthetic oligonucleotide
gctgttaatactaaggcgctt

SEQ ID NO: 38692 - DNA, 21 bp, Artificial Sequence
  Description of Artificial Sequence: Synthetic oligonucleotide
ggtcagcctaattctgcgcgg

SEQ ID NO: 38693 - DNA, 21 bp, Artificial Sequence
  Description of Artificial Sequence: Synthetic oligonucleotide
cagaatcgtgtttctaatggg

SEQ ID NO: 38694 - DNA, 21 bp, Artificial Sequence
  Description of Artificial Sequence: Synthetic oligonucleotide
cggcattctaattcggtgttg

SEQ ID NO: 38695 - DNA, 21 bp, Artificial Sequence
  Description of Artificial Sequence: Synthetic oligonucleotide
gattcgtctacgcgggggcag

SEQ ID NO: 38696 - DNA, 21 bp, Artificial Sequence
  Description of Artificial Sequence: Synthetic oligonucleotide
ctcagcaacagaacccaacaa

SEQ ID NO: 38697 - DNA, 21 bp, Artificial Sequence
  Description of Artificial Sequence: Synthetic oligonucleotide
ccgagtagtccgaattctatt

SEQ ID NO: 38698 - DNA, 21 bp, Artificial Sequence
  Description of Artificial Sequence: Synthetic oligonucleotide
agtgcgggtggtgcggtgtct

SEQ ID NO: 38699 - DNA, 21 bp, Artificial Sequence
  Description of Artificial Sequence: Synthetic oligonucleotide
ggttccccggctgctggtagg

SEQ ID NO: 38700 - DNA, 21 bp, Artificial Sequence
  Description of Artificial Sequence: Synthetic oligonucleotide
agcagaccccacaccgacggc

SEQ ID NO: 38701 - DNA, 21 bp, Artificial Sequence
  Description of Artificial Sequence: Synthetic oligonucleotide
accagcagaggcaacctcagc

SEQ ID NO: 38702 - DNA, 21 bp, Artificial Sequence
  Description of Artificial Sequence: Synthetic oligonucleotide
cccctcgtccccagaggcacc

SEQ ID NO: 38703 - DNA, 21 bp, Artificial Sequence
  Description of Artificial Sequence: Synthetic oligonucleotide
ggcagcagccccaaactcacc

SEQ ID NO: 38704 - DNA, 21 bp, Artificial Sequence
  Description of Artificial Sequence: Synthetic oligonucleotide
agtgcgagtggtaataggtgt

SEQ ID NO: 38705 - DNA, 21 bp, Artificial Sequence
  Description of Artificial Sequence: Synthetic oligonucleotide
cgtcagacggataagttgagt

SEQ ID NO: 38706 - DNA, 21 bp, Artificial Sequence
  Description of Artificial Sequence: Synthetic oligonucleotide
ggtccttctagtattaatagg

SEQ ID NO: 38707 - DNA, 21 bp, Artificial Sequence
  Description of Artificial Sequence: Synthetic oligonucleotide
gagggtaatcgttctaatatg

SEQ ID NO: 38708 - DNA, 21 bp, Artificial Sequence
  Description of Artificial Sequence: Synthetic oligonucleotide
acgtctcagactaagattgtg

SEQ ID NO: 38709 - DNA, 21 bp, Artificial Sequence
  Description of Artificial Sequence: Synthetic oligonucleotide
cccagcagccccaccgacaga

SEQ ID NO: 38710 - DNA, 21 bp, Artificial Sequence
  Description of Artificial Sequence: Synthetic oligonucleotide
acttctcggcagtcttttgtg

SEQ ID NO: 38711 - DNA, 21 bp, Artificial Sequence
  Description of Artificial Sequence: Synthetic oligonucleotide
agaagccccagcaccaacccc

SEQ ID NO: 38712 - DNA, 21 bp, Artificial Sequence
  Description of Artificial Sequence: Synthetic oligonucleotide
tgtagttctgggaggcagagt

SEQ ID NO: 38713 - DNA, 21 bp, Artificial Sequence
  Description of Artificial Sequence: Synthetic oligonucleotide
cggaatagggagagtattgct

SEQ ID NO: 38714 - DNA, 21 bp, Artificial Sequence
  Description of Artificial Sequence: Synthetic oligonucleotide
gctcgtactaatagtgctcct

SEQ ID NO: 38715 - DNA, 21 bp, Artificial Sequence
  Description of Artificial Sequence: Synthetic oligonucleotide
gtttcgggtatgagtgggagt

SEQ ID NO: 38716 - DNA, 21 bp, Artificial Sequence
  Description of Artificial Sequence: Synthetic oligonucleotide
caactcagcggcgccagaagc

SEQ ID NO: 38717 - DNA, 21 bp, Artificial Sequence
  Description of Artificial Sequence: Synthetic oligonucleotide
aattcggcgagtctgaatcat

SEQ ID NO: 38718 - DNA, 21 bp, Artificial Sequence
  Description of Artificial Sequence: Synthetic oligonucleotide
ccttcgactaataggactggg

SEQ ID NO: 38719 - DNA, 21 bp, Artificial Sequence
  Description of Artificial Sequence: Synthetic oligonucleotide
tgcctccccggcgccgccatg

SEQ ID NO: 38720 - DNA, 21 bp, Artificial Sequence
  Description of Artificial Sequence: Synthetic oligonucleotide
gccggcgccggcaaagtctac

SEQ ID NO: 38721 - DNA, 21 bp, Artificial Sequence
  Description of Artificial Sequence: Synthetic oligonucleotide
agtcttgggagtaggccgagt

SEQ ID NO: 38722 - DNA, 21 bp, Artificial Sequence
  Description of Artificial Sequence: Synthetic oligonucleotide
tctattggtaaggggtataat

SEQ ID NO: 38723 - DNA, 21 bp, Artificial Sequence
  Description of Artificial Sequence: Synthetic oligonucleotide
gacaaaaccaacctcagcagc

SEQ ID NO: 38724 - DNA, 21 bp, Artificial Sequence
  Description of Artificial Sequence: Synthetic oligonucleotide
tcgctgtcgaagtctcagtcg

SEQ ID NO: 38725 - DNA, 21 bp, Artificial Sequence
  Description of Artificial Sequence: Synthetic oligonucleotide
gtcagaaccgccggcagcgac

SEQ ID NO: 38726 - DNA, 21 bp, Artificial Sequence
  Description of Artificial Sequence: Synthetic oligonucleotide
gatcagaatcgtgttccttat

SEQ ID NO: 38727 - DNA, 21 bp, Artificial Sequence
  Description of Artificial Sequence: Synthetic oligonucleotide
tctgggcggcaggatgtgctg

SEQ ID NO: 38728 - DNA, 21 bp, Artificial Sequence
  Description of Artificial Sequence: Synthetic oligonucleotide
agacaatacaccggcgacagc

SEQ ID NO: 38729 - DNA, 21 bp, Artificial Sequence
  Description of Artificial Sequence: Synthetic oligonucleotide
cacagagacaccaacggcaaa

SEQ ID NO: 38730 - DNA, 21 bp, Artificial Sequence
  Description of Artificial Sequence: Synthetic oligonucleotide
ggcctcatggcccaaagaagc

SEQ ID NO: 38731 - DNA, 21 bp, Artificial Sequence
  Description of Artificial Sequence: Synthetic oligonucleotide
ccggggctttctaattcgcgt

SEQ ID NO: 38732 - DNA, 21 bp, Artificial Sequence
  Description of Artificial Sequence: Synthetic oligonucleotide
gctattcctggtactatggct

SEQ ID NO: 38733 - DNA, 21 bp, Artificial Sequence
  Description of Artificial Sequence: Synthetic oligonucleotide
cccggcctcagagacaccgcc

SEQ ID NO: 38734 - DNA, 21 bp, Artificial Sequence
  Description of Artificial Sequence: Synthetic oligonucleotide
agtggtcctcagattattcgg

SEQ ID NO: 38735 - DNA, 21 bp, Artificial Sequence
  Description of Artificial Sequence: Synthetic oligonucleotide
agactcccccaaatgacctgc

SEQ ID NO: 38736 - DNA, 21 bp, Artificial Sequence
  Description of Artificial Sequence: Synthetic oligonucleotide
agcagcacccccagaagcgtc

SEQ ID NO: 38737 - DNA, 21 bp, Artificial Sequence
  Description of Artificial Sequence: Synthetic oligonucleotide
cttaataggggtaatggttcg

SEQ ID NO: 38738 - DNA, 21 bp, Artificial Sequence
  Description of Artificial Sequence: Synthetic oligonucleotide
cccagcaccagacaaagcaac

SEQ ID NO: 38739 - DNA, 21 bp, Artificial Sequence
  Description of Artificial Sequence: Synthetic oligonucleotide
gccagagtcggcagcatcagc

SEQ ID NO: 38740 - DNA, 21 bp, Artificial Sequence
  Description of Artificial Sequence: Synthetic oligonucleotide
aatcggttgactaatgtgagt

SEQ ID NO: 38741 - DNA, 21 bp, Artificial Sequence
  Description of Artificial Sequence: Synthetic oligonucleotide
caaacccacgcccccaccagc

SEQ ID NO: 38742 - DNA, 21 bp, Artificial Sequence
  Description of Artificial Sequence: Synthetic oligonucleotide
tcgggtaatcttcagcatgct

SEQ ID NO: 38743 - DNA, 21 bp, Artificial Sequence
  Description of Artificial Sequence: Synthetic oligonucleotide
agaaccaccaacgccacctac

SEQ ID NO: 38744 - DNA, 21 bp, Artificial Sequence
  Description of Artificial Sequence: Synthetic oligonucleotide
gcgcaggcgaggctgatgaat

SEQ ID NO: 38745 - DNA, 21 bp, Artificial Sequence
  Description of Artificial Sequence: Synthetic oligonucleotide
gccggcgccggcatgtacgcc

SEQ ID NO: 38746 - DNA, 21 bp, Artificial Sequence
  Description of Artificial Sequence: Synthetic oligonucleotide
aacagactccccgccaccaaa

SEQ ID NO: 38747 - DNA, 21 bp, Artificial Sequence
  Description of Artificial Sequence: Synthetic oligonucleotide
tacggcgacggcaaaagctac

SEQ ID NO: 38748 - DNA, 21 bp, Artificial Sequence
  Description of Artificial Sequence: Synthetic oligonucleotide
tcgacttctaatggtactctg

SEQ ID NO: 38749 - DNA, 21 bp, Artificial Sequence
  Description of Artificial Sequence: Synthetic oligonucleotide
ttcggcaccaacaaagtcgac

SEQ ID NO: 38750 - DNA, 21 bp, Artificial Sequence
  Description of Artificial Sequence: Synthetic oligonucleotide
atcagcaacagaagcagcagc

SEQ ID NO: 38751 - DNA, 21 bp, Artificial Sequence
  Description of Artificial Sequence: Synthetic oligonucleotide
tttgttagtggtaaggtgcag

SEQ ID NO: 38752 - DNA, 21 bp, Artificial Sequence
  Description of Artificial Sequence: Synthetic oligonucleotide
attgctgggcagtcgtatagg

SEQ ID NO: 38753 - DNA, 21 bp, Artificial Sequence
  Description of Artificial Sequence: Synthetic oligonucleotide
cggtcgtatgataagtcgagt

SEQ ID NO: 38754 - DNA, 21 bp, Artificial Sequence
  Description of Artificial Sequence: Synthetic oligonucleotide
gcccaagtcgacaaaagaagc

SEQ ID NO: 38755 - DNA, 21 bp, Artificial Sequence
  Description of Artificial Sequence: Synthetic oligonucleotide
cggtcttatgagggtatgcag

SEQ ID NO: 38756 - DNA, 21 bp, Artificial Sequence
  Description of Artificial Sequence: Synthetic oligonucleotide
gtccccatcaccagcagacaa

SEQ ID NO: 38757 - DNA, 21 bp, Artificial Sequence
  Description of Artificial Sequence: Synthetic oligonucleotide
cataatagtggtaatggttcg

SEQ ID NO: 38758 - DNA, 21 bp, Artificial Sequence
  Description of Artificial Sequence: Synthetic oligonucleotide
tcttcgggtgtgacggggcgt

SEQ ID NO: 38759 - DNA, 21 bp, Artificial Sequence
  Description of Artificial Sequence: Synthetic oligonucleotide
agttcggagcagactactcgt

SEQ ID NO: 38760 - DNA, 21 bp, Artificial Sequence
  Description of Artificial Sequence: Synthetic oligonucleotide
attcctcatgcggggacggcg

SEQ ID NO: 38761 - DNA, 21 bp, Artificial Sequence
  Description of Artificial Sequence: Synthetic oligonucleotide
cacgtcagcggccccagactc

SEQ ID NO: 38762 - DNA, 21 bp, Artificial Sequence
  Description of Artificial Sequence: Synthetic oligonucleotide
gtcagccaccaaaccgtcctc

SEQ ID NO: 38763 - DNA, 21 bp, Artificial Sequence
  Description of Artificial Sequence: Synthetic oligonucleotide
aggattccgccgcagcaggat

SEQ ID NO: 38764 - DNA, 21 bp, Artificial Sequence
  Description of Artificial Sequence: Synthetic oligonucleotide
caggaggcgcgtgtgtatagc

SEQ ID NO: 38765 - DNA, 21 bp, Artificial Sequence
  Description of Artificial Sequence: Synthetic oligonucleotide
caaatgaaacacctccaagtc

SEQ ID NO: 38766 - DNA, 21 bp, Artificial Sequence
  Description of Artificial Sequence: Synthetic oligonucleotide
gccgtccaagcccaaagaacc

SEQ ID NO: 38767 - DNA, 21 bp, Artificial Sequence
  Description of Artificial Sequence: Synthetic oligonucleotide
cgtgtgatgcgggagtctcag

SEQ ID NO: 38768 - DNA, 21 bp, Artificial Sequence
  Description of Artificial Sequence: Synthetic oligonucleotide
tcggatcctccgcctggtcag

SEQ ID NO: 38769 - DNA, 21 bp, Artificial Sequence
  Description of Artificial Sequence: Synthetic oligonucleotide
ggcgccaaagaaagccaaagc

SEQ ID NO: 38770 - DNA, 21 bp, Artificial Sequence
  Description of Artificial Sequence: Synthetic oligonucleotide
cgtacgaataagagtgttact

SEQ ID NO: 38771 - DNA, 21 bp, Artificial Sequence
  Description of Artificial Sequence: Synthetic oligonucleotide
ctcagcaccagcagaaccgcc

SEQ ID NO: 38772 - DNA, 21 bp, Artificial Sequence
  Description of Artificial Sequence: Synthetic oligonucleotide
tctactcctattcgttcggtt

SEQ ID NO: 38773 - DNA, 21 bp, Artificial Sequence
  Description of Artificial Sequence: Synthetic oligonucleotide
gatcgtgcggggaagcagagt

SEQ ID NO: 38774 - DNA, 21 bp, Artificial Sequence
  Description of Artificial Sequence: Synthetic oligonucleotide
accagaaaccaaagcgtcacc

SEQ ID NO: 38775 - DNA, 21 bp, Artificial Sequence
  Description of Artificial Sequence: Synthetic oligonucleotide
gaaagagccggcctcaacagc

SEQ ID NO: 38776 - DNA, 21 bp, Artificial Sequence
  Description of Artificial Sequence: Synthetic oligonucleotide
aacttcaccaccagcggccaa

SEQ ID NO: 38777 - DNA, 21 bp, Artificial Sequence
  Description of Artificial Sequence: Synthetic oligonucleotide
agccaacaaagccccagcatg

SEQ ID NO: 38778 - DNA, 21 bp, Artificial Sequence
  Description of Artificial Sequence: Synthetic oligonucleotide
agaaccagcgaacacgacaga

SEQ ID NO: 38779 - DNA, 21 bp, Artificial Sequence
  Description of Artificial Sequence: Synthetic oligonucleotide
tttcggcagactagtgggaat

SEQ ID NO: 38780 - DNA, 21 bp, Artificial Sequence
  Description of Artificial Sequence: Synthetic oligonucleotide
ttcagaaacacccacagcgaa

SEQ ID NO: 38781 - DNA, 21 bp, Artificial Sequence
  Description of Artificial Sequence: Synthetic oligonucleotide
ggtcctaatattagtctgggt

SEQ ID NO: 38782 - DNA, 21 bp, Artificial Sequence
  Description of Artificial Sequence: Synthetic oligonucleotide
atgggccaagtcggcgtcaga

SEQ ID NO: 38783 - DNA, 21 bp, Artificial Sequence
  Description of Artificial Sequence: Synthetic oligonucleotide
gtcaacatgagaaacaccatg

SEQ ID NO: 38784 - DNA, 21 bp, Artificial Sequence
  Description of Artificial Sequence: Synthetic oligonucleotide
actaatggtggtagggtgacg

SEQ ID NO: 38785 - DNA, 21 bp, Artificial Sequence
  Description of Artificial Sequence: Synthetic oligonucleotide
agcagagtcgacgtcagaagc

SEQ ID NO: 38786 - DNA, 21 bp, Artificial Sequence
  Description of Artificial Sequence: Synthetic oligonucleotide
aaggttcatcggagtgataat

SEQ ID NO: 38787 - DNA, 21 bp, Artificial Sequence
  Description of Artificial Sequence: Synthetic oligonucleotide
tctactccgcatcatacgact

SEQ ID NO: 38788 - DNA, 21 bp, Artificial Sequence
  Description of Artificial Sequence: Synthetic oligonucleotide
cctctgcctaataggaatcag

SEQ ID NO: 38789 - DNA, 21 bp, Artificial Sequence
  Description of Artificial Sequence: Synthetic oligonucleotide
gttagtagtcctcgtatgagt

SEQ ID NO: 38790 - DNA, 21 bp, Artificial Sequence
  Description of Artificial Sequence: Synthetic oligonucleotide
ccgaagggggcgcatgttacg

SEQ ID NO: 38791 - DNA, 21 bp, Artificial Sequence
  Description of Artificial Sequence: Synthetic oligonucleotide
agctacccccaacaaagcgcc

SEQ ID NO: 38792 - DNA, 21 bp, Artificial Sequence
  Description of Artificial Sequence: Synthetic oligonucleotide
ggcaccaacaccggcatcgtc

SEQ ID NO: 38793 - DNA, 21 bp, Artificial Sequence
  Description of Artificial Sequence: Synthetic oligonucleotide
ccgattactcatcctttgcgt

SEQ ID NO: 38794 - DNA, 21 bp, Artificial Sequence
  Description of Artificial Sequence: Synthetic oligonucleotide
ggcctccacagcgtcgccaaa

SEQ ID NO: 38795 - DNA, 21 bp, Artificial Sequence
  Description of Artificial Sequence: Synthetic oligonucleotide
cctagtgctaggatgtctggt

SEQ ID NO: 38796 - DNA, 21 bp, Artificial Sequence
  Description of Artificial Sequence: Synthetic oligonucleotide
aacagagtcacccaaagcagc

SEQ ID NO: 38797 - DNA, 21 bp, Artificial Sequence
  Description of Artificial Sequence: Synthetic oligonucleotide
agcctccccaacaccaacggc

SEQ ID NO: 38798 - DNA, 21 bp, Artificial Sequence
  Description of Artificial Sequence: Synthetic oligonucleotide
tctggtggtggtacgaggact

SEQ ID NO: 38799 - DNA, 21 bp, Artificial Sequence
  Description of Artificial Sequence: Synthetic oligonucleotide
gtcaacctcagccccaaccac

SEQ ID NO: 38800 - DNA, 21 bp, Artificial Sequence
  Description of Artificial Sequence: Synthetic oligonucleotide
gtgactcatggtccgtctcat

SEQ ID NO: 38801 - DNA, 21 bp, Artificial Sequence
  Description of Artificial Sequence: Synthetic oligonucleotide
cttttgaattctactgggatg

SEQ ID NO: 38802 - DNA, 21 bp, Artificial Sequence
  Description of Artificial Sequence: Synthetic oligonucleotide
aacagcgtcgtcagcgtcagc

SEQ ID NO: 38803 - DNA, 21 bp, Artificial Sequence
  Description of Artificial Sequence: Synthetic oligonucleotide
gtgcggggtagttcgaatggt

SEQ ID NO: 38804 - DNA, 21 bp, Artificial Sequence
  Description of Artificial Sequence: Synthetic oligonucleotide
tctgttaatactaaggcgctt

SEQ ID NO: 38805 - DNA, 21 bp, Artificial Sequence
  Description of Artificial Sequence: Synthetic oligonucleotide
cgtctggaggggagtatggcg

SEQ ID NO: 38806 - DNA, 21 bp, Artificial Sequence
  Description of Artificial Sequence: Synthetic oligonucleotide
cttggtaatgcgcatcagctt

SEQ ID NO: 38807 - DNA, 21 bp, Artificial Sequence
  Description of Artificial Sequence: Synthetic oligonucleotide
atgagcgacaccagcaccaga

SEQ ID NO: 38808 - DNA, 21 bp, Artificial Sequence
  Description of Artificial Sequence: Synthetic oligonucleotide
tcgacttcgagggtgcttaat

SEQ ID NO: 38809 - DNA, 21 bp, Artificial Sequence
  Description of Artificial Sequence: Synthetic oligonucleotide
gatcgtcttggtaatactatg

SEQ ID NO: 38810 - DNA, 21 bp, Artificial Sequence
  Description of Artificial Sequence: Synthetic oligonucleotide
cagaatttgccgaggacgtgt

SEQ ID NO: 38811 - DNA, 21 bp, Artificial Sequence
  Description of Artificial Sequence: Synthetic oligonucleotide
gagggtagttcgggtaggcgt

SEQ ID NO: 38812 - DNA, 21 bp, Artificial Sequence
  Description of Artificial Sequence: Synthetic oligonucleotide
agactcagcaacgcctacgcc

SEQ ID NO: 38813 - DNA, 21 bp, Artificial Sequence
  Description of Artificial Sequence: Synthetic oligonucleotide
acgggtttgagtcatatgggt

SEQ ID NO: 38814 - DNA, 21 bp, Artificial Sequence
  Description of Artificial Sequence: Synthetic oligonucleotide
tctacttcgggtacgagtagt

SEQ ID NO: 38815 - DNA, 21 bp, Artificial Sequence
  Description of Artificial Sequence: Synthetic oligonucleotide
gagcggaatgggaattttacg

SEQ ID NO: 38816 - DNA, 21 bp, Artificial Sequence
  Description of Artificial Sequence: Synthetic oligonucleotide
ggcagactcaacatgctcagc

SEQ ID NO: 38817 - DNA, 21 bp, Artificial Sequence
  Description of Artificial Sequence: Synthetic oligonucleotide
tgttcgcagcgtcagtgtaat

SEQ ID NO: 38818 - DNA, 21 bp, Artificial Sequence
  Description of Artificial Sequence: Synthetic oligonucleotide
ttcaaccaagccggcgtcaac

SEQ ID NO: 38819 - DNA, 21 bp, Artificial Sequence
  Description of Artificial Sequence: Synthetic oligonucleotide
acggggaatgctagtagggtg

SEQ ID NO: 38820 - DNA, 21 bp, Artificial Sequence
  Description of Artificial Sequence: Synthetic oligonucleotide
ggttcgacgggtcagcttatg

SEQ ID NO: 38821 - DNA, 21 bp, Artificial Sequence
  Description of Artificial Sequence: Synthetic oligonucleotide
tatgcttctggtaagcatagt

SEQ ID NO: 38822 - DNA, 21 bp, Artificial Sequence
  Description of Artificial Sequence: Synthetic oligonucleotide
agcagaaacaccctcggcagc

SEQ ID NO: 38823 - DNA, 21 bp, Artificial Sequence
  Description of Artificial Sequence: Synthetic oligonucleotide
aacggttatggacagaatcaa

SEQ ID NO: 38824 - DNA, 21 bp, Artificial Sequence
  Description of Artificial Sequence: Synthetic oligonucleotide
tcggcgaatctgcatggtaag

SEQ ID NO: 38825 - DNA, 21 bp, Artificial Sequence
  Description of Artificial Sequence: Synthetic oligonucleotide
gacgtcaaccccagcgccaaa

SEQ ID NO: 38826 - DNA, 21 bp, Artificial Sequence
  Description of Artificial Sequence: Synthetic oligonucleotide
agcctcaccacccaaaacagc

SEQ ID NO: 38827 - DNA, 21 bp, Artificial Sequence
  Description of Artificial Sequence: Synthetic oligonucleotide
agcaaaagcgtcgcccaaagc

SEQ ID NO: 38828 - DNA, 21 bp, Artificial Sequence
  Description of Artificial Sequence: Synthetic oligonucleotide
cacgccagcacccccgccaga

SEQ ID NO: 38829 - DNA, 21 bp, Artificial Sequence
  Description of Artificial Sequence: Synthetic oligonucleotide
taccaaatgaccaccccccaa

SEQ ID NO: 38830 - DNA, 21 bp, Artificial Sequence
  Description of Artificial Sequence: Synthetic oligonucleotide
ccttcgcatgggcctcctgct

SEQ ID NO: 38831 - DNA, 21 bp, Artificial Sequence
  Description of Artificial Sequence: Synthetic oligonucleotide
acctacagcagcaaagccgac

SEQ ID NO: 38832 - DNA, 21 bp, Artificial Sequence
  Description of Artificial Sequence: Synthetic oligonucleotide
cccgtcaccagaagcaaagac

SEQ ID NO: 38833 - DNA, 21 bp, Artificial Sequence
  Description of Artificial Sequence: Synthetic oligonucleotide
acccaaatgggcaaaagcaac

SEQ ID NO: 38834 - DNA, 21 bp, Artificial Sequence
  Description of Artificial Sequence: Synthetic oligonucleotide
tttgggtcgaggaatgagggt

SEQ ID NO: 38835 - DNA, 21 bp, Artificial Sequence
  Description of Artificial Sequence: Synthetic oligonucleotide
gggtcgcatactaatacttct

SEQ ID NO: 38836 - DNA, 21 bp, Artificial Sequence
  Description of Artificial Sequence: Synthetic oligonucleotide
ggggcttataatcatgttacg

SEQ ID NO: 38837 - DNA, 21 bp, Artificial Sequence
  Description of Artificial Sequence: Synthetic oligonucleotide
ccctaccaaagccacagcccc

SEQ ID NO: 38838 - DNA, 21 bp, Artificial Sequence
  Description of Artificial Sequence: Synthetic oligonucleotide
gggtctatttcgacggctcat

SEQ ID NO: 38839 - DNA, 21 bp, Artificial Sequence
  Description of Artificial Sequence: Synthetic oligonucleotide
ggtagggatactcggagtagt

SEQ ID NO: 38840 - DNA, 21 bp, Artificial Sequence
  Description of Artificial Sequence: Synthetic oligonucleotide
tatgggcagactaagacgcag

SEQ ID NO: 38841 - DNA, 21 bp, Artificial Sequence
  Description of Artificial Sequence: Synthetic oligonucleotide
accaccgcccccggcctcaga

SEQ ID NO: 38842 - DNA, 21 bp, Artificial Sequence
  Description of Artificial Sequence: Synthetic oligonucleotide
acgaagtatgagggttatact

SEQ ID NO: 38843 - DNA, 21 bp, Artificial Sequence
  Description of Artificial Sequence: Synthetic oligonucleotide
accaacgccgccagagacagc

SEQ ID NO: 38844 - DNA, 21 bp, Artificial Sequence
  Description of Artificial Sequence: Synthetic oligonucleotide
atccaacaaggcagcagaacc

SEQ ID NO: 38845 - DNA, 21 bp, Artificial Sequence
  Description of Artificial Sequence: Synthetic oligonucleotide
catcgttctgggaatcagggt

SEQ ID NO: 38846 - DNA, 21 bp, Artificial Sequence
  Description of Artificial Sequence: Synthetic oligonucleotide
tcgccgatgcgttcgcaggtt

SEQ ID NO: 38847 - DNA, 21 bp, Artificial Sequence
  Description of Artificial Sequence: Synthetic oligonucleotide
gctaggtctcctccttcgggg

SEQ ID NO: 38848 - DNA, 21 bp, Artificial Sequence
  Description of Artificial Sequence: Synthetic oligonucleotide
gagccgtcgcgtagttcgacg

SEQ ID NO: 38849 - DNA, 21 bp, Artificial Sequence
  Description of Artificial Sequence: Synthetic oligonucleotide
tcttctccgcaggctcataat

SEQ ID NO: 38850 - DNA, 21 bp, Artificial Sequence
  Description of Artificial Sequence: Synthetic oligonucleotide
gtcagctacgccagaaccgaa

SEQ ID NO: 38851 - DNA, 21 bp, Artificial Sequence
  Description of Artificial Sequence: Synthetic oligonucleotide
tcgagtggtctgggtttttcg

SEQ ID NO: 38852 - DNA, 21 bp, Artificial Sequence
  Description of Artificial Sequence: Synthetic oligonucleotide
aggtatacggggcagagtagt

SEQ ID NO: 38853 - DNA, 21 bp, Artificial Sequence
  Description of Artificial Sequence: Synthetic oligonucleotide
cctgctaggtcgactctttct

SEQ ID NO: 38854 - DNA, 21 bp, Artificial Sequence
  Description of Artificial Sequence: Synthetic oligonucleotide
tctggtgggagttcggttctg

SEQ ID NO: 38855 - DNA, 21 bp, Artificial Sequence
  Description of Artificial Sequence: Synthetic oligonucleotide
agcagcagaagcaccgccagc

SEQ ID NO: 38856 - DNA, 21 bp, Artificial Sequence
  Description of Artificial Sequence: Synthetic oligonucleotide
tcggcttatgagaggacttcg

SEQ ID NO: 38857 - DNA, 21 bp, Artificial Sequence
  Description of Artificial Sequence: Synthetic oligonucleotide
actgctaattcgcctgcgacg

SEQ ID NO: 38858 - DNA, 21 bp, Artificial Sequence
  Description of Artificial Sequence: Synthetic oligonucleotide
ccggttaatcttcagaatggg

SEQ ID NO: 38859 - DNA, 21 bp, Artificial Sequence
  Description of Artificial Sequence: Synthetic oligonucleotide
atgactcctgggagggttgct

SEQ ID NO: 38860 - DNA, 21 bp, Artificial Sequence
  Description of Artificial Sequence: Synthetic oligonucleotide
ccctacgcccccagaaaagac

SEQ ID NO: 38861 - DNA, 21 bp, Artificial Sequence
  Description of Artificial Sequence: Synthetic oligonucleotide
atttcgcagtctactactagg

SEQ ID NO: 38862 - DNA, 21 bp, Artificial Sequence
  Description of Artificial Sequence: Synthetic oligonucleotide
gaaaaactcagaaccagccaa

SEQ ID NO: 38863 - DNA, 21 bp, Artificial Sequence
  Description of Artificial Sequence: Synthetic oligonucleotide
gtgaataagattaatgggtcc

SEQ ID NO: 38864 - DNA, 21 bp, Artificial Sequence
  Description of Artificial Sequence: Synthetic oligonucleotide
aacagaagcaacaacagcgtc

SEQ ID NO: 38865 - DNA, 21 bp, Artificial Sequence
  Description of Artificial Sequence: Synthetic oligonucleotide
tgccaaagcagcagagtcacc

SEQ ID NO: 38866 - DNA, 21 bp, Artificial Sequence
  Description of Artificial Sequence: Synthetic oligonucleotide
actcagggtgcgagtaatttg

SEQ ID NO: 38867 - DNA, 21 bp, Artificial Sequence
  Description of Artificial Sequence: Synthetic oligonucleotide
aatactactggtagtgggttg

SEQ ID NO: 38868 - DNA, 21 bp, Artificial Sequence
  Description of Artificial Sequence: Synthetic oligonucleotide
gaaatcagagcccacaccacc

SEQ ID NO: 38869 - DNA, 21 bp, Artificial Sequence
  Description of Artificial Sequence: Synthetic oligonucleotide
tctttgcctggggagtctaag

SEQ ID NO: 38870 - DNA, 21 bp, Artificial Sequence
  Description of Artificial Sequence: Synthetic oligonucleotide
attacgggtaatcgtcatagt

SEQ ID NO: 38871 - DNA, 21 bp, Artificial Sequence
  Description of Artificial Sequence: Synthetic oligonucleotide
aacagcggcccccccaaaccc

SEQ ID NO: 38872 - DNA, 21 bp, Artificial Sequence
  Description of Artificial Sequence: Synthetic oligonucleotide
tggagtaagggtagtgggact

SEQ ID NO: 38873 - DNA, 21 bp, Artificial Sequence
  Description of Artificial Sequence: Synthetic oligonucleotide
tctggtgctcctggttcttcg

SEQ ID NO: 38874 - DNA, 21 bp, Artificial Sequence
  Description of Artificial Sequence: Synthetic oligonucleotide
agcatcagcaaaacccaagcc

SEQ ID NO: 38875 - DNA, 21 bp, Artificial Sequence
  Description of Artificial Sequence: Synthetic oligonucleotide
gagaatacgaagacttatagt

SEQ ID NO: 38876 - DNA, 21 bp, Artificial Sequence
  Description of Artificial Sequence: Synthetic oligonucleotide
aaggagcttgggtctccttct

SEQ ID NO: 38877 - DNA, 21 bp, Artificial Sequence
  Description of Artificial Sequence: Synthetic oligonucleotide
tatagggcttctggtatttcg

SEQ ID NO: 38878 - DNA, 21 bp, Artificial Sequence
  Description of Artificial Sequence: Synthetic oligonucleotide
gtccacggcaaccccagaaac

SEQ ID NO: 38879 - DNA, 21 bp, Artificial Sequence
  Description of Artificial Sequence: Synthetic oligonucleotide
cataagcatcctaatgcgtat

SEQ ID NO: 38880 - DNA, 21 bp, Artificial Sequence
  Description of Artificial Sequence: Synthetic oligonucleotide
caggggcatactcggtttact

SEQ ID NO: 38881 - DNA, 21 bp, Artificial Sequence
  Description of Artificial Sequence: Synthetic oligonucleotide
actgggcgggggccggatgtg

SEQ ID NO: 38882 - DNA, 21 bp, Artificial Sequence
  Description of Artificial Sequence: Synthetic oligonucleotide
cccgattcgctgcatgctaat

SEQ ID NO: 38883 - DNA, 21 bp, Artificial Sequence
  Description of Artificial Sequence: Synthetic oligonucleotide
acccaaaacaccaaaagcatc

SEQ ID NO: 38884 - DNA, 21 bp, Artificial Sequence
  Description of Artificial Sequence: Synthetic oligonucleotide
agcaacctccccagaaacctc

SEQ ID NO: 38885 - DNA, 21 bp, Artificial Sequence
  Description of Artificial Sequence: Synthetic oligonucleotide
aacggtcctggacagaatcaa

SEQ ID NO: 38886 - DNA, 21 bp, Artificial Sequence
  Description of Artificial Sequence: Synthetic oligonucleotide
ctcggcaccacccaacccaaa

SEQ ID NO: 38887 - DNA, 21 bp, Artificial Sequence
  Description of Artificial Sequence: Synthetic oligonucleotide
cccctcgccagccccatggtc

SEQ ID NO: 38888 - DNA, 21 bp, Artificial Sequence
  Description of Artificial Sequence: Synthetic oligonucleotide
cttgggcctgggaagaatact

SEQ ID NO: 38889 - DNA, 21 bp, Artificial Sequence
  Description of Artificial Sequence: Synthetic oligonucleotide
ggtcatgggaataagggggcg

SEQ ID NO: 38890 - DNA, 21 bp, Artificial Sequence
  Description of Artificial Sequence: Synthetic oligonucleotide
cccagcatccccagaaacgtc

SEQ ID NO: 38891 - DNA, 21 bp, Artificial Sequence
  Description of Artificial Sequence: Synthetic oligonucleotide
aacctccacgccacccccctc

SEQ ID NO: 38892 - DNA, 21 bp, Artificial Sequence
  Description of Artificial Sequence: Synthetic oligonucleotide
gttcttcataatgctagtagt

SEQ ID NO: 38893 - DNA, 21 bp, Artificial Sequence
  Description of Artificial Sequence: Synthetic oligonucleotide
cagcttggtacgaataatagt

SEQ ID NO: 38894 - DNA, 21 bp, Artificial Sequence
  Description of Artificial Sequence: Synthetic oligonucleotide
aacaacagaagcggcatgggc

SEQ ID NO: 38895 - DNA, 21 bp, Artificial Sequence
  Description of Artificial Sequence: Synthetic oligonucleotide
ggtgctaatacgaatccgggg

SEQ ID NO: 38896 - DNA, 21 bp, Artificial Sequence
  Description of Artificial Sequence: Synthetic oligonucleotide
agaccccaaaccagcatcagc

SEQ ID NO: 38897 - DNA, 21 bp, Artificial Sequence
  Description of Artificial Sequence: Synthetic oligonucleotide
gtgcctgtgactaagtcgagt

SEQ ID NO: 38898 - DNA, 21 bp, Artificial Sequence
  Description of Artificial Sequence: Synthetic oligonucleotide
tataggaatgttaatagttct

SEQ ID NO: 38899 - DNA, 21 bp, Artificial Sequence
  Description of Artificial Sequence: Synthetic oligonucleotide
gtccaaacccaccaagtcaga

SEQ ID NO: 38900 - DNA, 21 bp, Artificial Sequence
  Description of Artificial Sequence: Synthetic oligonucleotide
gttgcgactcggggtgatcat

SEQ ID NO: 38901 - DNA, 21 bp, Artificial Sequence
  Description of Artificial Sequence: Synthetic oligonucleotide
acgggtatgaggaatattggg

SEQ ID NO: 38902 - DNA, 21 bp, Artificial Sequence
  Description of Artificial Sequence: Synthetic oligonucleotide
cgtgagccggctaggggtgat

SEQ ID NO: 38903 - DNA, 21 bp, Artificial Sequence
  Description of Artificial Sequence: Synthetic oligonucleotide
ggcgccgaaagaaccgtcctc

SEQ ID NO: 38904 - DNA, 21 bp, Artificial Sequence
  Description of Artificial Sequence: Synthetic oligonucleotide
aaagccgacgccaccagaacc

SEQ ID NO: 38905 - DNA, 21 bp, Artificial Sequence
  Description of Artificial Sequence: Synthetic oligonucleotide
gacaaccacagcaccctcatc

SEQ ID NO: 38906 - DNA, 21 bp, Artificial Sequence
  Description of Artificial Sequence: Synthetic oligonucleotide
cgtaatactagtgatctggct

SEQ ID NO: 38907 - DNA, 21 bp, Artificial Sequence
  Description of Artificial Sequence: Synthetic oligonucleotide
actaagggtggttcgcagttg

SEQ ID NO: 38908 - DNA, 21 bp, Artificial Sequence
  Description of Artificial Sequence: Synthetic oligonucleotide
atccaccaaggcagcagcaga

SEQ ID NO: 38909 - DNA, 21 bp, Artificial Sequence
  Description of Artificial Sequence: Synthetic oligonucleotide
aacggcgtcccccaacccaaa

SEQ ID NO: 38910 - DNA, 21 bp, Artificial Sequence
  Description of Artificial Sequence: Synthetic oligonucleotide
aataatctggcggggagtaag

SEQ ID NO: 38911 - DNA, 21 bp, Artificial Sequence
  Description of Artificial Sequence: Synthetic oligonucleotide
gctatttcgaggcagggtatg

SEQ ID NO: 38912 - DNA, 21 bp, Artificial Sequence
  Description of Artificial Sequence: Synthetic oligonucleotide
cctgctaattcgcctgcgacg

SEQ ID NO: 38913 - DNA, 21 bp, Artificial Sequence
  Description of Artificial Sequence: Synthetic oligonucleotide
agagaaagaaccggcttcaac

SEQ ID NO: 38914 - DNA, 21 bp, Artificial Sequence
  Description of Artificial Sequence: Synthetic oligonucleotide
cccctcagcaaaagcgccctc

SEQ ID NO: 38915 - DNA, 21 bp, Artificial Sequence
  Description of Artificial Sequence: Synthetic oligonucleotide
ggggataagaatcatggtagt

SEQ ID NO: 38916 - DNA, 21 bp, Artificial Sequence
  Description of Artificial Sequence: Synthetic oligonucleotide
aataattctatttctaatccg

SEQ ID NO: 38917 - DNA, 21 bp, Artificial Sequence
  Description of Artificial Sequence: Synthetic oligonucleotide
attcatgcgactagtctggct

SEQ ID NO: 38918 - DNA, 21 bp, Artificial Sequence
  Description of Artificial Sequence: Synthetic oligonucleotide
tgcgccggcctcagcagcagc

SEQ ID NO: 38919 - DNA, 21 bp, Artificial Sequence
  Description of Artificial Sequence: Synthetic oligonucleotide
gacctcccccaccacaccaga

SEQ ID NO: 38920 - DNA, 21 bp, Artificial Sequence
  Description of Artificial Sequence: Synthetic oligonucleotide
gtcagcagaagcgccaccaac

SEQ ID NO: 38921 - DNA, 21 bp, Artificial Sequence
  Description of Artificial Sequence: Synthetic oligonucleotide
gcgaagacggctaagaatgtg

SEQ ID NO: 38922 - DNA, 21 bp, Artificial Sequence
  Description of Artificial Sequence: Synthetic oligonucleotide
gggtcttttaagccggattct

SEQ ID NO: 38923 - DNA, 21 bp, Artificial Sequence
  Description of Artificial Sequence: Synthetic oligonucleotide
ccgttgggtaatcgtccttct

SEQ ID NO: 38924 - DNA, 21 bp, Artificial Sequence
  Description of Artificial Sequence: Synthetic oligonucleotide
aatctgaattctgttagtaag

SEQ ID NO: 38925 - DNA, 21 bp, Artificial Sequence
  Description of Artificial Sequence: Synthetic oligonucleotide
cgtccgtatgagacgcagttg

SEQ ID NO: 38926 - DNA, 21 bp, Artificial Sequence
  Description of Artificial Sequence: Synthetic oligonucleotide
aacgccaaccaaaaccaaatg

SEQ ID NO: 38927 - DNA, 21 bp, Artificial Sequence
  Description of Artificial Sequence: Synthetic oligonucleotide
gatgggaagagtcctcgtgtg

SEQ ID NO: 38928 - DNA, 21 bp, Artificial Sequence
  Description of Artificial Sequence: Synthetic oligonucleotide
ccggtgggttcggtgcggggg

SEQ ID NO: 38929 - DNA, 21 bp, Artificial Sequence
  Description of Artificial Sequence: Synthetic oligonucleotide
aacggttctggacataatcaa

SEQ ID NO: 38930 - DNA, 21 bp, Artificial Sequence
  Description of Artificial Sequence: Synthetic oligonucleotide
actttgccgacgtcgattagg

SEQ ID NO: 38931 - DNA, 21 bp, Artificial Sequence
  Description of Artificial Sequence: Synthetic oligonucleotide
cgtgatcggactaatgctgct

SEQ ID NO: 38932 - DNA, 21 bp, Artificial Sequence
  Description of Artificial Sequence: Synthetic oligonucleotide
aataatgggaggcctattgcg

SEQ ID NO: 38933 - DNA, 21 bp, Artificial Sequence
  Description of Artificial Sequence: Synthetic oligonucleotide
agcagccccgtcagaaacacc

SEQ ID NO: 38934 - DNA, 21 bp, Artificial Sequence
  Description of Artificial Sequence: Synthetic oligonucleotide
ggcaaaaccaacgtcagcagc

SEQ ID NO: 38935 - DNA, 21 bp, Artificial Sequence
  Description of Artificial Sequence: Synthetic oligonucleotide
gagcctgtgcctaagactagg

SEQ ID NO: 38936 - DNA, 21 bp, Artificial Sequence
  Description of Artificial Sequence: Synthetic oligonucleotide
cagggtcgtgcgaatgggtct

SEQ ID NO: 38937 - DNA, 21 bp, Artificial Sequence
  Description of Artificial Sequence: Synthetic oligonucleotide
ccggggtctgggagtaataat

SEQ ID NO: 38938 - DNA, 21 bp, Artificial Sequence
  Description of Artificial Sequence: Synthetic oligonucleotide
ttgggggttcgtgataatact

SEQ ID NO: 38939 - DNA, 21 bp, Artificial Sequence
  Description of Artificial Sequence: Synthetic oligonucleotide
aacagcgtcgccggcatgggc

SEQ ID NO: 38940 - DNA, 21 bp, Artificial Sequence
  Description of Artificial Sequence: Synthetic oligonucleotide
gtcaacgaaaacagagtcagc

SEQ ID NO: 38941 - DNA, 21 bp, Artificial Sequence
  Description of Artificial Sequence: Synthetic oligonucleotide
ggcaaaaccggccccaacagc

SEQ ID NO: 38942 - DNA, 21 bp, Artificial Sequence
  Description of Artificial Sequence: Synthetic oligonucleotide
ggcctcgaaagcatgagacaa

SEQ ID NO: 38943 - DNA, 21 bp, Artificial Sequence
  Description of Artificial Sequence: Synthetic oligonucleotide
ggcggccacccccccaccagc

SEQ ID NO: 38944 - DNA, 21 bp, Artificial Sequence
  Description of Artificial Sequence: Synthetic oligonucleotide
gcgtcggtgagtcagcggtcg

SEQ ID NO: 38945 - DNA, 21 bp, Artificial Sequence
  Description of Artificial Sequence: Synthetic oligonucleotide
tctaatacgaatgctgctatg

SEQ ID NO: 38946 - DNA, 21 bp, Artificial Sequence
  Description of Artificial Sequence: Synthetic oligonucleotide
agaatgggcgtcagcaacacc

SEQ ID NO: 38947 - DNA, 21 bp, Artificial Sequence
  Description of Artificial Sequence: Synthetic oligonucleotide
gcgctggcttataataagggg

SEQ ID NO: 38948 - DNA, 21 bp, Artificial Sequence
  Description of Artificial Sequence: Synthetic oligonucleotide
aaaatcggcagcatgagcggc

SEQ ID NO: 38949 - DNA, 21 bp, Artificial Sequence
  Description of Artificial Sequence: Synthetic oligonucleotide
ggcgccagcagctacatgaaa

SEQ ID NO: 38950 - DNA, 21 bp, Artificial Sequence
  Description of Artificial Sequence: Synthetic oligonucleotide
agggtggctacgaataatccg

SEQ ID NO: 38951 - DNA, 21 bp, Artificial Sequence
  Description of Artificial Sequence: Synthetic oligonucleotide
cgtgttacggatgctcatctt

SEQ ID NO: 38952 - DNA, 21 bp, Artificial Sequence
  Description of Artificial Sequence: Synthetic oligonucleotide
tacagaagcaaacccctcacc

SEQ ID NO: 38953 - DNA, 21 bp, Artificial Sequence
  Description of Artificial Sequence: Synthetic oligonucleotide
ccccaaagcagccaccaaacc

SEQ ID NO: 38954 - DNA, 21 bp, Artificial Sequence
  Description of Artificial Sequence: Synthetic oligonucleotide
aacggcagccaaggcagacaa

SEQ ID NO: 38955 - DNA, 21 bp, Artificial Sequence
  Description of Artificial Sequence: Synthetic oligonucleotide
ggcagcctcggcggcctcaac

SEQ ID NO: 38956 - DNA, 21 bp, Artificial Sequence
  Description of Artificial Sequence: Synthetic oligonucleotide
cagtcgacgccgcgtatgggt

SEQ ID NO: 38957 - DNA, 21 bp, Artificial Sequence
  Description of Artificial Sequence: Synthetic oligonucleotide
ccccaccaaggcaaacacaac

SEQ ID NO: 38958 - DNA, 21 bp, Artificial Sequence
  Description of Artificial Sequence: Synthetic oligonucleotide
ggcagcggcaacaaagtcaac

SEQ ID NO: 38959 - DNA, 21 bp, Artificial Sequence
  Description of Artificial Sequence: Synthetic oligonucleotide
agcctcagaggcagcaccgcc

SEQ ID NO: 38960 - DNA, 21 bp, Artificial Sequence
  Description of Artificial Sequence: Synthetic oligonucleotide
atgctgaatagtcgtacgtct

SEQ ID NO: 38961 - DNA, 21 bp, Artificial Sequence
  Description of Artificial Sequence: Synthetic oligonucleotide
cgtctgactcagagtagtcag

SEQ ID NO: 38962 - DNA, 21 bp, Artificial Sequence
  Description of Artificial Sequence: Synthetic oligonucleotide
gttggtactaaggctgctacg

SEQ ID NO: 38963 - DNA, 21 bp, Artificial Sequence
  Description of Artificial Sequence: Synthetic oligonucleotide
gtcaacaccagccacaccaac

SEQ ID NO: 38964 - DNA, 21 bp, Artificial Sequence
  Description of Artificial Sequence: Synthetic oligonucleotide
tcgcgtgttagtttgagttcg

SEQ ID NO: 38965 - DNA, 21 bp, Artificial Sequence
  Description of Artificial Sequence: Synthetic oligonucleotide
cataagactacgtctatggct

SEQ ID NO: 38966 - DNA, 21 bp, Artificial Sequence
  Description of Artificial Sequence: Synthetic oligonucleotide
ccccacaccaacaaccccgac

SEQ ID NO: 38967 - DNA, 21 bp, Artificial Sequence
  Description of Artificial Sequence: Synthetic oligonucleotide
gctcagcggtcgactatggtg

SEQ ID NO: 38968 - DNA, 21 bp, Artificial Sequence
  Description of Artificial Sequence: Synthetic oligonucleotide
ccgactatgcagggggttcat

SEQ ID NO: 38969 - DNA, 21 bp, Artificial Sequence
  Description of Artificial Sequence: Synthetic oligonucleotide
agtaatctggggcagtatggg

SEQ ID NO: 38970 - DNA, 21 bp, Artificial Sequence
  Description of Artificial Sequence: Synthetic oligonucleotide
ccttctgggcatgatacggtt

SEQ ID NO: 38971 - DNA, 21 bp, Artificial Sequence
  Description of Artificial Sequence: Synthetic oligonucleotide
gtcggcagaagcagcaacccc

SEQ ID NO: 38972 - DNA, 21 bp, Artificial Sequence
  Description of Artificial Sequence: Synthetic oligonucleotide
ggtggtaatgataggtttcgg

SEQ ID NO: 38973 - DNA, 21 bp, Artificial Sequence
  Description of Artificial Sequence: Synthetic oligonucleotide
aggccgaaggagagtgggtat

SEQ ID NO: 38974 - DNA, 21 bp, Artificial Sequence
  Description of Artificial Sequence: Synthetic oligonucleotide
cctgggacgacttctgcgatg

SEQ ID NO: 38975 - DNA, 21 bp, Artificial Sequence
  Description of Artificial Sequence: Synthetic oligonucleotide
accagccacgtcaacatcgcc

SEQ ID NO: 38976 - DNA, 21 bp, Artificial Sequence
  Description of Artificial Sequence: Synthetic oligonucleotide
aggactcttaatcttaatact

SEQ ID NO: 38977 - DNA, 21 bp, Artificial Sequence
  Description of Artificial Sequence: Synthetic oligonucleotide
gctctttctagtcagaagggt

SEQ ID NO: 38978 - DNA, 21 bp, Artificial Sequence
  Description of Artificial Sequence: Synthetic oligonucleotide
cgttcgcagggttcgtatgcg

SEQ ID NO: 38979 - DNA, 21 bp, Artificial Sequence
  Description of Artificial Sequence: Synthetic oligonucleotide
gtgcatacttcgggggtgcag

SEQ ID NO: 38980 - DNA, 21 bp, Artificial Sequence
  Description of Artificial Sequence: Synthetic oligonucleotide
gaacacgaaaccagcagcaga

SEQ ID NO: 38981 - DNA, 21 bp, Artificial Sequence
  Description of Artificial Sequence: Synthetic oligonucleotide
cccaaaggcgtccacagcatg

SEQ ID NO: 38982 - DNA, 21 bp, Artificial Sequence
  Description of Artificial Sequence: Synthetic oligonucleotide
aacggttctgaacagaatcaa

SEQ ID NO: 38983 - DNA, 21 bp, Artificial Sequence
  Description of Artificial Sequence: Synthetic oligonucleotide
gattctaggaataatatgacg

SEQ ID NO: 38984 - DNA, 21 bp, Artificial Sequence
  Description of Artificial Sequence: Synthetic oligonucleotide
gagtcttcttcttctatgggt

SEQ ID NO: 38985 - DNA, 21 bp, Artificial Sequence
  Description of Artificial Sequence: Synthetic oligonucleotide
gggatttctactctttcgagg

SEQ ID NO: 38986 - DNA, 21 bp, Artificial Sequence
  Description of Artificial Sequence: Synthetic oligonucleotide
cataagtctggtttggttgat

SEQ ID NO: 38987 - DNA, 21 bp, Artificial Sequence
  Description of Artificial Sequence: Synthetic oligonucleotide
tgtgggaatgctcctcggact

SEQ ID NO: 38988 - DNA, 21 bp, Artificial Sequence
  Description of Artificial Sequence: Synthetic oligonucleotide
ctcaccagacccaaaatcatc

SEQ ID NO: 38989 - DNA, 21 bp, Artificial Sequence
  Description of Artificial Sequence: Synthetic oligonucleotide
catgtgagtggtaaggctgtt

SEQ ID NO: 38990 - DNA, 21 bp, Artificial Sequence
  Description of Artificial Sequence: Synthetic oligonucleotide
cgtcaggtgtcgactcctctt

SEQ ID NO: 38991 - DNA, 21 bp, Artificial Sequence
  Description of Artificial Sequence: Synthetic oligonucleotide
catggtactagtcctcttcgt

SEQ ID NO: 38992 - DNA, 21 bp, Artificial Sequence
  Description of Artificial Sequence: Synthetic oligonucleotide
ggtcctcttacgcggagtggt

SEQ ID NO: 38993 - DNA, 21 bp, Artificial Sequence
  Description of Artificial Sequence: Synthetic oligonucleotide
caactcggcagcaccaccaga

SEQ ID NO: 38994 - DNA, 21 bp, Artificial Sequence
  Description of Artificial Sequence: Synthetic oligonucleotide
gagcggactggtcgtcctggg

SEQ ID NO: 38995 - DNA, 21 bp, Artificial Sequence
  Description of Artificial Sequence: Synthetic oligonucleotide
gggcaggtgaatcatactact

SEQ ID NO: 38996 - DNA, 21 bp, Artificial Sequence
  Description of Artificial Sequence: Synthetic oligonucleotide
cggccggatcgtactactctg

SEQ ID NO: 38997 - DNA, 21 bp, Artificial Sequence
  Description of Artificial Sequence: Synthetic oligonucleotide
ccgatttcttcgcgtgctggt

SEQ ID NO: 38998 - DNA, 21 bp, Artificial Sequence
  Description of Artificial Sequence: Synthetic oligonucleotide
gaagccaccagcagcaccaaa

SEQ ID NO: 38999 - DNA, 21 bp, Artificial Sequence
  Description of Artificial Sequence: Synthetic oligonucleotide
agaggcgccgccgacagcaac

SEQ ID NO: 39000 - DNA, 21 bp, Artificial Sequence
  Description of Artificial Sequence: Synthetic oligonucleotide
gagcctgcttattctgtgaag

SEQ ID NO: 39001 - DNA, 21 bp, Artificial Sequence
  Description of Artificial Sequence: Synthetic oligonucleotide
caaagcagccaaagcggcccc

SEQ ID NO: 39002 - DNA, 21 bp, Artificial Sequence
  Description of Artificial Sequence: Synthetic oligonucleotide
gtgccgagtcagaatagggct

SEQ ID NO: 39003 - DNA, 21 bp, Artificial Sequence
  Description of Artificial Sequence: Synthetic oligonucleotide
aatcagaagactcgtactgat

SEQ ID NO: 39004 - DNA, 21 bp, Artificial Sequence
  Description of Artificial Sequence: Synthetic oligonucleotide
gtcaacgaccacaacgtcaga

SEQ ID NO: 39005 - DNA, 21 bp, Artificial Sequence
  Description of Artificial Sequence: Synthetic oligonucleotide
gtcgccccccccaaaatcgaa

SEQ ID NO: 39006 - DNA, 21 bp, Artificial Sequence
  Description of Artificial Sequence: Synthetic oligonucleotide
aaggtttcgaagccggcttat

SEQ ID NO: 39007 - DNA, 21 bp, Artificial Sequence
  Description of Artificial Sequence: Synthetic oligonucleotide
tacagaaacatcgaagcccac

SEQ ID NO: 39008 - DNA, 21 bp, Artificial Sequence
  Description of Artificial Sequence: Synthetic oligonucleotide
actacgtctcgggtttctgct

SEQ ID NO: 39009 - DNA, 21 bp, Artificial Sequence
  Description of Artificial Sequence: Synthetic oligonucleotide
aacagcagagtcggccaaagc

SEQ ID NO: 39010 - DNA, 21 bp, Artificial Sequence
  Description of Artificial Sequence: Synthetic oligonucleotide
tcgagtccgtctaatatggcg

SEQ ID NO: 39011 - DNA, 21 bp, Artificial Sequence
  Description of Artificial Sequence: Synthetic oligonucleotide
ccgttgtctaaggatcggctg

SEQ ID NO: 39012 - DNA, 21 bp, Artificial Sequence
  Description of Artificial Sequence: Synthetic oligonucleotide
gcgggtgcgaggtctatgcag

SEQ ID NO: 39013 - DNA, 21 bp, Artificial Sequence
  Description of Artificial Sequence: Synthetic oligonucleotide
tctggtggtgattatgcgaag

SEQ ID NO: 39014 - DNA, 21 bp, Artificial Sequence
  Description of Artificial Sequence: Synthetic oligonucleotide
atgggccacaaagtcgaagcc

SEQ ID NO: 39015 - DNA, 21 bp, Artificial Sequence
  Description of Artificial Sequence: Synthetic oligonucleotide
ggccaagccatgcccttcaaa

SEQ ID NO: 39016 - DNA, 21 bp, Artificial Sequence
  Description of Artificial Sequence: Synthetic oligonucleotide
ccggtgagtggggcgactatt

SEQ ID NO: 39017 - DNA, 21 bp, Artificial Sequence
  Description of Artificial Sequence: Synthetic oligonucleotide
ggccacagccaaagccaccaa

SEQ ID NO: 39018 - DNA, 21 bp, Artificial Sequence
  Description of Artificial Sequence: Synthetic oligonucleotide
tttggtagggcgacttctggt

SEQ ID NO: 39019 - DNA, 21 bp, Artificial Sequence
  Description of Artificial Sequence: Synthetic oligonucleotide
agtagtgcgaatcatcctagg

SEQ ID NO: 39020 - DNA, 21 bp, Artificial Sequence
  Description of Artificial Sequence: Synthetic oligonucleotide
attagttctggtacgcatggg

SEQ ID NO: 39021 - DNA, 21 bp, Artificial Sequence
  Description of Artificial Sequence: Synthetic oligonucleotide
aatattgctagtaaggggccg

SEQ ID NO: 39022 - DNA, 21 bp, Artificial Sequence
  Description of Artificial Sequence: Synthetic oligonucleotide
ccgcttgataagtctatgatg

SEQ ID NO: 39023 - DNA, 21 bp, Artificial Sequence
  Description of Artificial Sequence: Synthetic oligonucleotide
gctggttcggctcctagggtg

SEQ ID NO: 39024 - DNA, 21 bp, Artificial Sequence
  Description of Artificial Sequence: Synthetic oligonucleotide
agaagcaccaacgacggcaga

SEQ ID NO: 39025 - DNA, 21 bp, Artificial Sequence
  Description of Artificial Sequence: Synthetic oligonucleotide
agccccagcagcccccacgac

SEQ ID NO: 39026 - DNA, 21 bp, Artificial Sequence
  Description of Artificial Sequence: Synthetic oligonucleotide
tcgactaagagtaagccgatt

SEQ ID NO: 39027 - DNA, 21 bp, Artificial Sequence
  Description of Artificial Sequence: Synthetic oligonucleotide
actgagaggactaaggctact

SEQ ID NO: 39028 - DNA, 21 bp, Artificial Sequence
  Description of Artificial Sequence: Synthetic oligonucleotide
aagcagacgcattctgggtct

SEQ ID NO: 39029 - DNA, 21 bp, Artificial Sequence
  Description of Artificial Sequence: Synthetic oligonucleotide
gagacgaggaagcagggggtt

SEQ ID NO: 39030 - DNA, 21 bp, Artificial Sequence
  Description of Artificial Sequence: Synthetic oligonucleotide
cccctccccaaaaacagcagc

SEQ ID NO: 39031 - DNA, 21 bp, Artificial Sequence
  Description of Artificial Sequence: Synthetic oligonucleotide
cgttcgagtccggctagtttg

SEQ ID NO: 39032 - DNA, 21 bp, Artificial Sequence
  Description of Artificial Sequence: Synthetic oligonucleotide
agccaaagagccctcagcagc

SEQ ID NO: 39033 - DNA, 21 bp, Artificial Sequence
  Description of Artificial Sequence: Synthetic oligonucleotide
cctcctcagcagtcgccgctg

SEQ ID NO: 39034 - DNA, 21 bp, Artificial Sequence
  Description of Artificial Sequence: Synthetic oligonucleotide
aaaggcaacagcggcgccccc

SEQ ID NO: 39035 - DNA, 21 bp, Artificial Sequence
  Description of Artificial Sequence: Synthetic oligonucleotide
atcagactcggcagcaccaac

SEQ ID NO: 39036 - DNA, 21 bp, Artificial Sequence
  Description of Artificial Sequence: Synthetic oligonucleotide
ccggatgttaaggtgactagg

SEQ ID NO: 39037 - DNA, 21 bp, Artificial Sequence
  Description of Artificial Sequence: Synthetic oligonucleotide
agccccggcaaactcaccacc

SEQ ID NO: 39038 - DNA, 21 bp, Artificial Sequence
  Description of Artificial Sequence: Synthetic oligonucleotide
gggacgaatccttctttggct

SEQ ID NO: 39039 - DNA, 21 bp, Artificial Sequence
  Description of Artificial Sequence: Synthetic oligonucleotide
agcatggtcagcacccccatg

SEQ ID NO: 39040 - DNA, 21 bp, Artificial Sequence
  Description of Artificial Sequence: Synthetic oligonucleotide
cccctcagaggcggcagcagc

SEQ ID NO: 39041 - DNA, 21 bp, Artificial Sequence
  Description of Artificial Sequence: Synthetic oligonucleotide
cggcctcgggatcgtacggat

SEQ ID NO: 39042 - DNA, 21 bp, Artificial Sequence
  Description of Artificial Sequence: Synthetic oligonucleotide
cccaccctcagcggcagcaga

SEQ ID NO: 39043 - DNA, 21 bp, Artificial Sequence
  Description of Artificial Sequence: Synthetic oligonucleotide
ctcgccaccagcagcgtcaga

SEQ ID NO: 39044 - DNA, 21 bp, Artificial Sequence
  Description of Artificial Sequence: Synthetic oligonucleotide
accaccctccccagcagcaaa

SEQ ID NO: 39045 - DNA, 21 bp, Artificial Sequence
  Description of Artificial Sequence: Synthetic oligonucleotide
gatcttactaatcatactaag

SEQ ID NO: 39046 - DNA, 21 bp, Artificial Sequence
  Description of Artificial Sequence: Synthetic oligonucleotide
catacgcctgctgtgggtaag

SEQ ID NO: 39047 - DNA, 21 bp, Artificial Sequence
  Description of Artificial Sequence: Synthetic oligonucleotide
aatcgtgttaagccgatggtg

SEQ ID NO: 39048 - DNA, 21 bp, Artificial Sequence
  Description of Artificial Sequence: Synthetic oligonucleotide
tcgggtgcggggtcggctggg

SEQ ID NO: 39049 - DNA, 21 bp, Artificial Sequence
  Description of Artificial Sequence: Synthetic oligonucleotide
acgctttcttctactggtggt

SEQ ID NO: 39050 - DNA, 21 bp, Artificial Sequence
  Description of Artificial Sequence: Synthetic oligonucleotide
agcctcaccaccaaagccaac

SEQ ID NO: 39051 - DNA, 21 bp, Artificial Sequence
  Description of Artificial Sequence: Synthetic oligonucleotide
agcagaagcaacgccaccgcc

SEQ ID NO: 39052 - DNA, 21 bp, Artificial Sequence
  Description of Artificial Sequence: Synthetic oligonucleotide
ccttcgtctactccgaagctg

SEQ ID NO: 39053 - DNA, 21 bp, Artificial Sequence
  Description of Artificial Sequence: Synthetic oligonucleotide
agacaaaccgtcagcagccac

SEQ ID NO: 39054 - DNA, 21 bp, Artificial Sequence
  Description of Artificial Sequence: Synthetic oligonucleotide
aggcatgagtctaaggcgtat

SEQ ID NO: 39055 - DNA, 21 bp, Artificial Sequence
  Description of Artificial Sequence: Synthetic oligonucleotide
actacttatggtgggaatcgg

SEQ ID NO: 39056 - DNA, 21 bp, Artificial Sequence
  Description of Artificial Sequence: Synthetic oligonucleotide
gccttcagccacagcagcggc

SEQ ID NO: 39057 - DNA, 21 bp, Artificial Sequence
  Description of Artificial Sequence: Synthetic oligonucleotide
caggagactcgtgggaattct

SEQ ID NO: 39058 - DNA, 21 bp, Artificial Sequence
  Description of Artificial Sequence: Synthetic oligonucleotide
gatcctagggctcagagtcat

SEQ ID NO: 39059 - DNA, 21 bp, Artificial Sequence
  Description of Artificial Sequence: Synthetic oligonucleotide
tctcttggttctaatgctaat

SEQ ID NO: 39060 - DNA, 21 bp, Artificial Sequence
  Description of Artificial Sequence: Synthetic oligonucleotide
ggcctcagcagcggcaaaacc

SEQ ID NO: 39061 - DNA, 21 bp, Artificial Sequence
  Description of Artificial Sequence: Synthetic oligonucleotide
tatgcgacggatggtcttaag

SEQ ID NO: 39062 - DNA, 21 bp, Artificial Sequence
  Description of Artificial Sequence: Synthetic oligonucleotide
actcaggggctgggtcatctt

SEQ ID NO: 39063 - DNA, 21 bp, Artificial Sequence
  Description of Artificial Sequence: Synthetic oligonucleotide
gcctgcaacaccagcagatgc

SEQ ID NO: 39064 - DNA, 21 bp, Artificial Sequence
  Description of Artificial Sequence: Synthetic oligonucleotide
aataatggggcttcggttgtg

SEQ ID NO: 39065 - DNA, 21 bp, Artificial Sequence
  Description of Artificial Sequence: Synthetic oligonucleotide
aaaatcctcaacgtcggcacc

SEQ ID NO: 39066 - DNA, 21 bp, Artificial Sequence
  Description of Artificial Sequence: Synthetic oligonucleotide
cagtctatttctcatacgcgt

SEQ ID NO: 39067 - DNA, 21 bp, Artificial Sequence
  Description of Artificial Sequence: Synthetic oligonucleotide
agcgtccaaaaaagcgtcaac

SEQ ID NO: 39068 - DNA, 21 bp, Artificial Sequence
  Description of Artificial Sequence: Synthetic oligonucleotide
agagaaagcagccccagcctc

SEQ ID NO: 39069 - DNA, 21 bp, Artificial Sequence
  Description of Artificial Sequence: Synthetic oligonucleotide
tctgggtctgggattatgatg

SEQ ID NO: 39070 - DNA, 21 bp, Artificial Sequence
  Description of Artificial Sequence: Synthetic oligonucleotide
ggcagcagagacaaaagcacc

SEQ ID NO: 39071 - DNA, 21 bp, Artificial Sequence
  Description of Artificial Sequence: Synthetic oligonucleotide
agtgcggatcggacgtcgaat

SEQ ID NO: 39072 - DNA, 21 bp, Artificial Sequence
  Description of Artificial Sequence: Synthetic oligonucleotide
agcatccacagcgacagaacc

SEQ ID NO: 39073 - DNA, 21 bp, Artificial Sequence
  Description of Artificial Sequence: Synthetic oligonucleotide
ctcagaagcggcgacgtcaga

SEQ ID NO: 39074 - DNA, 21 bp, Artificial Sequence
  Description of Artificial Sequence: Synthetic oligonucleotide
gcccaacaaagagcccaagcc

SEQ ID NO: 39075 - DNA, 21 bp, Artificial Sequence
  Description of Artificial Sequence: Synthetic oligonucleotide
cccgccgccatgagcagcgtc

SEQ ID NO: 39076 - DNA, 21 bp, Artificial Sequence
  Description of Artificial Sequence: Synthetic oligonucleotide
gatgctcagcgtaggggtgtg

SEQ ID NO: 39077 - DNA, 21 bp, Artificial Sequence
  Description of Artificial Sequence: Synthetic oligonucleotide
accatggtccacggcaacacc

SEQ ID NO: 39078 - DNA, 21 bp, Artificial Sequence
  Description of Artificial Sequence: Synthetic oligonucleotide
gagaggcctgggggtacgcct

SEQ ID NO: 39079 - DNA, 21 bp, Artificial Sequence
  Description of Artificial Sequence: Synthetic oligonucleotide
gctggtgtgacgactgttaat

SEQ ID NO: 39080 - DNA, 21 bp, Artificial Sequence
  Description of Artificial Sequence: Synthetic oligonucleotide
cgtaatgttgataagtcgagt

SEQ ID NO: 39081 - DNA, 21 bp, Artificial Sequence
  Description of Artificial Sequence: Synthetic oligonucleotide
tatattcataatccgactggt

SEQ ID NO: 39082 - DNA, 21 bp, Artificial Sequence
  Description of Artificial Sequence: Synthetic oligonucleotide
tctatgtctgagcatctgaag

SEQ ID NO: 39083 - DNA, 21 bp, Artificial Sequence
  Description of Artificial Sequence: Synthetic oligonucleotide
tctcgtgcgaattcggttccg

SEQ ID NO: 39084 - DNA, 21 bp, Artificial Sequence
  Description of Artificial Sequence: Synthetic oligonucleotide
accagcgccgccccccacgcc

SEQ ID NO: 39085 - DNA, 21 bp, Artificial Sequence
  Description of Artificial Sequence: Synthetic oligonucleotide
gggcatctttcgccttctagt

SEQ ID NO: 39086 - DNA, 21 bp, Artificial Sequence
  Description of Artificial Sequence: Synthetic oligonucleotide
cccacccaaaacggcagaagc

SEQ ID NO: 39087 - DNA, 21 bp, Artificial Sequence
  Description of Artificial Sequence: Synthetic oligonucleotide
aagacgccgactcatactatg

SEQ ID NO: 39088 - DNA, 21 bp, Artificial Sequence
  Description of Artificial Sequence: Synthetic oligonucleotide
aattctgtggagcgtactcgt

SEQ ID NO: 39089 - DNA, 21 bp, Artificial Sequence
  Description of Artificial Sequence: Synthetic oligonucleotide
agtattacggatcggcattcg

SEQ ID NO: 39090 - DNA, 21 bp, Artificial Sequence
  Description of Artificial Sequence: Synthetic oligonucleotide
cccttcggcagcagcgccaga

SEQ ID NO: 39091 - DNA, 21 bp, Artificial Sequence
  Description of Artificial Sequence: Synthetic oligonucleotide
attagtgggtctgggtatcat

SEQ ID NO: 39092 - DNA, 21 bp, Artificial Sequence
  Description of Artificial Sequence: Synthetic oligonucleotide
aatgtggataatcgggggttt

SEQ ID NO: 39093 - DNA, 21 bp, Artificial Sequence
  Description of Artificial Sequence: Synthetic oligonucleotide
agtcgggcgcctaatactttg

SEQ ID NO: 39094 - DNA, 21 bp, Artificial Sequence
  Description of Artificial Sequence: Synthetic oligonucleotide
aataggaatgggtttaataat

SEQ ID NO: 39095 - DNA, 21 bp, Artificial Sequence
  Description of Artificial Sequence: Synthetic oligonucleotide
aatgctgagcctacttcgagt

SEQ ID NO: 39096 - DNA, 21 bp, Artificial Sequence
  Description of Artificial Sequence: Synthetic oligonucleotide
atgaatcgtaatggttcgctg

SEQ ID NO: 39097 - DNA, 21 bp, Artificial Sequence
  Description of Artificial Sequence: Synthetic oligonucleotide
caccaacccgaaaaaatcgcc

SEQ ID NO: 39098 - DNA, 21 bp, Artificial Sequence
  Description of Artificial Sequence: Synthetic oligonucleotide
agctacagcgaactcgtcaga

SEQ ID NO: 39099 - DNA, 21 bp, Artificial Sequence
  Description of Artificial Sequence: Synthetic oligonucleotide
cctgtggtgactggtgtgcct

SEQ ID NO: 39100 - DNA, 21 bp, Artificial Sequence
  Description of Artificial Sequence: Synthetic oligonucleotide
gccgacctcaccagaagcagc

SEQ ID NO: 39101 - DNA, 21 bp, Artificial Sequence
  Description of Artificial Sequence: Synthetic oligonucleotide
agatacgacaaacaaaacagc

SEQ ID NO: 39102 - DNA, 21 bp, Artificial Sequence
  Description of Artificial Sequence: Synthetic oligonucleotide
tgggggcggagttctatggat

SEQ ID NO: 39103 - DNA, 21 bp, Artificial Sequence
  Description of Artificial Sequence: Synthetic oligonucleotide
aacgtcagaagcggcaccccc

SEQ ID NO: 39104 - DNA, 21 bp, Artificial Sequence
  Description of Artificial Sequence: Synthetic oligonucleotide
cgtgcgggtagtgctgttgag

SEQ ID NO: 39105 - DNA, 21 bp, Artificial Sequence
  Description of Artificial Sequence: Synthetic oligonucleotide
gccaacggccacccccaaagc

SEQ ID NO: 39106 - DNA, 21 bp, Artificial Sequence
  Description of Artificial Sequence: Synthetic oligonucleotide
tacaccagcaccaacagaccc

SEQ ID NO: 39107 - DNA, 21 bp, Artificial Sequence
  Description of Artificial Sequence: Synthetic oligonucleotide
cataatctgaatggttttcat

SEQ ID NO: 39108 - DNA, 21 bp, Artificial Sequence
  Description of Artificial Sequence: Synthetic oligonucleotide
gacatgagagccaccgtcatg

SEQ ID NO: 39109 - DNA, 21 bp, Artificial Sequence
  Description of Artificial Sequence: Synthetic oligonucleotide
tacctcggcagagtccccccc

SEQ ID NO: 39110 - DNA, 21 bp, Artificial Sequence
  Description of Artificial Sequence: Synthetic oligonucleotide
ctcagcggccacgccagcggc

SEQ ID NO: 39111 - DNA, 21 bp, Artificial Sequence
  Description of Artificial Sequence: Synthetic oligonucleotide
tctattccgacgtctgctagg

SEQ ID NO: 39112 - DNA, 21 bp, Artificial Sequence
  Description of Artificial Sequence: Synthetic oligonucleotide
agcagaaacgccgccaacgcc

SEQ ID NO: 39113 - DNA, 21 bp, Artificial Sequence
  Description of Artificial Sequence: Synthetic oligonucleotide
cagatgcctggtcatactggg

SEQ ID NO: 39114 - DNA, 21 bp, Artificial Sequence
  Description of Artificial Sequence: Synthetic oligonucleotide
tgggctggtaataagtctgtg

SEQ ID NO: 39115 - DNA, 21 bp, Artificial Sequence
  Description of Artificial Sequence: Synthetic oligonucleotide
actcttcctcgtactagtggt

SEQ ID NO: 39116 - DNA, 21 bp, Artificial Sequence
  Description of Artificial Sequence: Synthetic oligonucleotide
gtccaaagaaacagcaacacc

SEQ ID NO: 39117 - DNA, 21 bp, Artificial Sequence
  Description of Artificial Sequence: Synthetic oligonucleotide
catattacgtcgaatcatgcg

SEQ ID NO: 39118 - DNA, 21 bp, Artificial Sequence
  Description of Artificial Sequence: Synthetic oligonucleotide
attaatgtgtcgaggagtacg

SEQ ID NO: 39119 - DNA, 21 bp, Artificial Sequence
  Description of Artificial Sequence: Synthetic oligonucleotide
ttgactaatcggtcttcgagt

SEQ ID NO: 39120 - DNA, 21 bp, Artificial Sequence
  Description of Artificial Sequence: Synthetic oligonucleotide
accagagacagccaagtcctc

SEQ ID NO: 39121 - DNA, 21 bp, Artificial Sequence
  Description of Artificial Sequence: Synthetic oligonucleotide
aggactgtgaatagtgctaat

SEQ ID NO: 39122 - DNA, 21 bp, Artificial Sequence
  Description of Artificial Sequence: Synthetic oligonucleotide
accaccaacaacatccaaggc

SEQ ID NO: 39123 - DNA, 21 bp, Artificial Sequence
  Description of Artificial Sequence: Synthetic oligonucleotide
gggattaattctcgggggtcg

SEQ ID NO: 39124 - DNA, 21 bp, Artificial Sequence
  Description of Artificial Sequence: Synthetic oligonucleotide
ctcggcagcagcggcagcaga

SEQ ID NO: 39125 - DNA, 21 bp, Artificial Sequence
  Description of Artificial Sequence: Synthetic oligonucleotide
acccaaagaagccaaaccgcc

SEQ ID NO: 39126 - DNA, 21 bp, Artificial Sequence
  Description of Artificial Sequence: Synthetic oligonucleotide
ggtagtgcgggtaatatgctt

SEQ ID NO: 39127 - DNA, 21 bp, Artificial Sequence
  Description of Artificial Sequence: Synthetic oligonucleotide
gctcctagtgctggtaattct

SEQ ID NO: 39128 - DNA, 21 bp, Artificial Sequence
  Description of Artificial Sequence: Synthetic oligonucleotide
ggcgtcagccaaggcaacaga

SEQ ID NO: 39129 - DNA, 21 bp, Artificial Sequence
  Description of Artificial Sequence: Synthetic oligonucleotide
ctcaccaccggcaaccacatc

SEQ ID NO: 39130 - DNA, 21 bp, Artificial Sequence
  Description of Artificial Sequence: Synthetic oligonucleotide
actcgttctactagtgcgact

SEQ ID NO: 39131 - DNA, 21 bp, Artificial Sequence
  Description of Artificial Sequence: Synthetic oligonucleotide
ctccaaaaacccagcctcgtc

SEQ ID NO: 39132 - DNA, 21 bp, Artificial Sequence
  Description of Artificial Sequence: Synthetic oligonucleotide
ggctacgccagcgtccccaga

SEQ ID NO: 39133 - DNA, 21 bp, Artificial Sequence
  Description of Artificial Sequence: Synthetic oligonucleotide
cattatggtccggattcgaag

SEQ ID NO: 39134 - DNA, 21 bp, Artificial Sequence
  Description of Artificial Sequence: Synthetic oligonucleotide
aatcgtgtgaataatgagatg

SEQ ID NO: 39135 - DNA, 21 bp, Artificial Sequence
  Description of Artificial Sequence: Synthetic oligonucleotide
ggtcttcttggtgcttctact

SEQ ID NO: 39136 - DNA, 21 bp, Artificial Sequence
  Description of Artificial Sequence: Synthetic oligonucleotide
agcggcagcgaacacctcaga

SEQ ID NO: 39137 - DNA, 21 bp, Artificial Sequence
  Description of Artificial Sequence: Synthetic oligonucleotide
gctcctcctaatgggtcgctt

SEQ ID NO: 39138 - DNA, 21 bp, Artificial Sequence
  Description of Artificial Sequence: Synthetic oligonucleotide
gggcgggagagtaatctgagt

SEQ ID NO: 39139 - DNA, 21 bp, Artificial Sequence
  Description of Artificial Sequence: Synthetic oligonucleotide
ttgaatcagcattcgagtctt

SEQ ID NO: 39140 - DNA, 21 bp, Artificial Sequence
  Description of Artificial Sequence: Synthetic oligonucleotide
atggggggtgttacgtcttct

SEQ ID NO: 39141 - DNA, 21 bp, Artificial Sequence
  Description of Artificial Sequence: Synthetic oligonucleotide
aacggttctggacagcatcaa

SEQ ID NO: 39142 - DNA, 21 bp, Artificial Sequence
  Description of Artificial Sequence: Synthetic oligonucleotide
aagagtgatgctcatacggct

SEQ ID NO: 39143 - DNA, 21 bp, Artificial Sequence
  Description of Artificial Sequence: Synthetic oligonucleotide
ggccccaaccccatcaacggc

SEQ ID NO: 39144 - DNA, 21 bp, Artificial Sequence
  Description of Artificial Sequence: Synthetic oligonucleotide
ctcatgcaaacccacggcagc

SEQ ID NO: 39145 - DNA, 21 bp, Artificial Sequence
  Description of Artificial Sequence: Synthetic oligonucleotide
gggagtcgtgataattcgcgt

SEQ ID NO: 39146 - DNA, 21 bp, Artificial Sequence
  Description of Artificial Sequence: Synthetic oligonucleotide
tgcagaagcaacgccaaatgc

SEQ ID NO: 39147 - DNA, 21 bp, Artificial Sequence
  Description of Artificial Sequence: Synthetic oligonucleotide
cttgatagtcgggcgacggag

SEQ ID NO: 39148 - DNA, 21 bp, Artificial Sequence
  Description of Artificial Sequence: Synthetic oligonucleotide
gcttcgtcgtctaagtctgtt

SEQ ID NO: 39149 - DNA, 21 bp, Artificial Sequence
  Description of Artificial Sequence: Synthetic oligonucleotide
agtgttcattcgaatgcgatt

SEQ ID NO: 39150 - DNA, 21 bp, Artificial Sequence
  Description of Artificial Sequence: Synthetic oligonucleotide
agaacccaagcccacaacgtc

SEQ ID NO: 39151 - DNA, 21 bp, Artificial Sequence
  Description of Artificial Sequence: Synthetic oligonucleotide
accagcagcgccagagtcacc

SEQ ID NO: 39152 - DNA, 21 bp, Artificial Sequence
  Description of Artificial Sequence: Synthetic oligonucleotide
gatggtcgtactcattcgtgt

SEQ ID NO: 39153 - DNA, 21 bp, Artificial Sequence
  Description of Artificial Sequence: Synthetic oligonucleotide
tgggccgtcagcagacccacc

SEQ ID NO: 39154 - DNA, 21 bp, Artificial Sequence
  Description of Artificial Sequence: Synthetic oligonucleotide
gatcctctgaggaatagtaat

SEQ ID NO: 39155 - DNA, 21 bp, Artificial Sequence
  Description of Artificial Sequence: Synthetic oligonucleotide
ctgtcttcttctcatacgctg

SEQ ID NO: 39156 - DNA, 21 bp, Artificial Sequence
  Description of Artificial Sequence: Synthetic oligonucleotide
tctcatcctagttcttttggg

SEQ ID NO: 39157 - DNA, 21 bp, Artificial Sequence
  Description of Artificial Sequence: Synthetic oligonucleotide
tctactatgcataagaatgtt

SEQ ID NO: 39158 - DNA, 21 bp, Artificial Sequence
  Description of Artificial Sequence: Synthetic oligonucleotide
tcgactgatttgaagtctagg

SEQ ID NO: 39159 - DNA, 21 bp, Artificial Sequence
  Description of Artificial Sequence: Synthetic oligonucleotide
agacccgtcgtcgccagcacc

SEQ ID NO: 39160 - DNA, 21 bp, Artificial Sequence
  Description of Artificial Sequence: Synthetic oligonucleotide
caactcagagtcggcaacggc

SEQ ID NO: 39161 - DNA, 21 bp, Artificial Sequence
  Description of Artificial Sequence: Synthetic oligonucleotide
ggggcgatttcgaatgagcat

SEQ ID NO: 39162 - DNA, 21 bp, Artificial Sequence
  Description of Artificial Sequence: Synthetic oligonucleotide
cacaaaaccggcgccaacgtc

SEQ ID NO: 39163 - DNA, 21 bp, Artificial Sequence
  Description of Artificial Sequence: Synthetic oligonucleotide
agtggtccgactcagattcgg

SEQ ID NO: 39164 - DNA, 21 bp, Artificial Sequence
  Description of Artificial Sequence: Synthetic oligonucleotide
atgagcagcaccagaagcatc

SEQ ID NO: 39165 - DNA, 21 bp, Artificial Sequence
  Description of Artificial Sequence: Synthetic oligonucleotide
aacgccgtcagaagcgaaaac

SEQ ID NO: 39166 - DNA, 21 bp, Artificial Sequence
  Description of Artificial Sequence: Synthetic oligonucleotide
tattcgatgaggcctactgag

SEQ ID NO: 39167 - DNA, 21 bp, Artificial Sequence
  Description of Artificial Sequence: Synthetic oligonucleotide
gaaggccccagcagcccccac

SEQ ID NO: 39168 - DNA, 21 bp, Artificial Sequence
  Description of Artificial Sequence: Synthetic oligonucleotide
ggtggggttggtgggaagtct

SEQ ID NO: 39169 - DNA, 21 bp, Artificial Sequence
  Description of Artificial Sequence: Synthetic oligonucleotide
gattcgactcatcgtgctact

SEQ ID NO: 39170 - DNA, 21 bp, Artificial Sequence
  Description of Artificial Sequence: Synthetic oligonucleotide
atgtctgctaatcagcatcgt

SEQ ID NO: 39171 - DNA, 21 bp, Artificial Sequence
  Description of Artificial Sequence: Synthetic oligonucleotide
cctgcgtcgaatgttaggggt

SEQ ID NO: 39172 - DNA, 21 bp, Artificial Sequence
  Description of Artificial Sequence: Synthetic oligonucleotide
ccgagtgtgcgtactcttggg

SEQ ID NO: 39173 - DNA, 21 bp, Artificial Sequence
  Description of Artificial Sequence: Synthetic oligonucleotide
caggctcaggggtctatgcag

SEQ ID NO: 39174 - DNA, 21 bp, Artificial Sequence
  Description of Artificial Sequence: Synthetic oligonucleotide
cagagggttcatccgagtggg

SEQ ID NO: 39175 - DNA, 21 bp, Artificial Sequence
  Description of Artificial Sequence: Synthetic oligonucleotide
gatccgcattcgggtgggaag

SEQ ID NO: 39176 - DNA, 21 bp, Artificial Sequence
  Description of Artificial Sequence: Synthetic oligonucleotide
tatttgacgagtacgtctaat

SEQ ID NO: 39177 - DNA, 21 bp, Artificial Sequence
  Description of Artificial Sequence: Synthetic oligonucleotide
agggttattacggggcagcat

SEQ ID NO: 39178 - DNA, 21 bp, Artificial Sequence
  Description of Artificial Sequence: Synthetic oligonucleotide
tcgcctcataagcaggcgaat

SEQ ID NO: 39179 - DNA, 21 bp, Artificial Sequence
  Description of Artificial Sequence: Synthetic oligonucleotide
aaagtcagcagcgccaccccc

SEQ ID NO: 39180 - DNA, 21 bp, Artificial Sequence
  Description of Artificial Sequence: Synthetic oligonucleotide
ggtactgcgaggggggttgct

SEQ ID NO: 39181 - DNA, 21 bp, Artificial Sequence
  Description of Artificial Sequence: Synthetic oligonucleotide
ccgtatgcgcgtaatgcggag

SEQ ID NO: 39182 - DNA, 21 bp, Artificial Sequence
  Description of Artificial Sequence: Synthetic oligonucleotide
tttgtgaatactagtgcgcag

SEQ ID NO: 39183 - DNA, 21 bp, Artificial Sequence
  Description of Artificial Sequence: Synthetic oligonucleotide
gggcgtaattctcattttgtg

SEQ ID NO: 39184 - DNA, 21 bp, Artificial Sequence
  Description of Artificial Sequence: Synthetic oligonucleotide
gatatgagtgtgcataatgtg

SEQ ID NO: 39185 - DNA, 21 bp, Artificial Sequence
  Description of Artificial Sequence: Synthetic oligonucleotide
cctatgctgcagcatcgggct

SEQ ID NO: 39186 - DNA, 21 bp, Artificial Sequence
  Description of Artificial Sequence: Synthetic oligonucleotide
ttgtctcagagtaatactcat

SEQ ID NO: 39187 - DNA, 21 bp, Artificial Sequence
  Description of Artificial Sequence: Synthetic oligonucleotide
agagcccccaaaagcagcagc

SEQ ID NO: 39188 - DNA, 21 bp, Artificial Sequence
  Description of Artificial Sequence: Synthetic oligonucleotide
caacccggcgtcagcggcaga

SEQ ID NO: 39189 - DNA, 21 bp, Artificial Sequence
  Description of Artificial Sequence: Synthetic oligonucleotide
ccgagtgaggtgaggtcttct

SEQ ID NO: 39190 - DNA, 21 bp, Artificial Sequence
  Description of Artificial Sequence: Synthetic oligonucleotide
gggattacgcatggttctcat

SEQ ID NO: 39191 - DNA, 21 bp, Artificial Sequence
  Description of Artificial Sequence: Synthetic oligonucleotide
aacaacagcagcggcgcccaa

SEQ ID NO: 39192 - DNA, 21 bp, Artificial Sequence
  Description of Artificial Sequence: Synthetic oligonucleotide
ttcagcgtccaaggccaatgc

SEQ ID NO: 39193 - DNA, 21 bp, Artificial Sequence
  Description of Artificial Sequence: Synthetic oligonucleotide
cctaaggttcatcctttgaag

SEQ ID NO: 39194 - DNA, 21 bp, Artificial Sequence
  Description of Artificial Sequence: Synthetic oligonucleotide
actaattcgcaggttccgcgt

SEQ ID NO: 39195 - DNA, 21 bp, Artificial Sequence
  Description of Artificial Sequence: Synthetic oligonucleotide
tacggcagcggccaaaaccaa

SEQ ID NO: 39196 - DNA, 21 bp, Artificial Sequence
  Description of Artificial Sequence: Synthetic oligonucleotide
tctcaggtgtcgaagccgcag

SEQ ID NO: 39197 - DNA, 21 bp, Artificial Sequence
  Description of Artificial Sequence: Synthetic oligonucleotide
tcgagtccgtctcatatggcg

SEQ ID NO: 39198 - DNA, 21 bp, Artificial Sequence
  Description of Artificial Sequence: Synthetic oligonucleotide
gatcgtcaggggttgtctggg

SEQ ID NO: 39199 - DNA, 21 bp, Artificial Sequence
  Description of Artificial Sequence: Synthetic oligonucleotide
acgaggcagggtatgggtagt

SEQ ID NO: 39200 - DNA, 21 bp, Artificial Sequence
  Description of Artificial Sequence: Synthetic oligonucleotide
aaaggcttcaaaaccgaaagc

SEQ ID NO: 39201 - DNA, 21 bp, Artificial Sequence
  Description of Artificial Sequence: Synthetic oligonucleotide
actggtcagcagacggctact

SEQ ID NO: 39202 - DNA, 21 bp, Artificial Sequence
  Description of Artificial Sequence: Synthetic oligonucleotide
gtccacgaagcccccctcaga

SEQ ID NO: 39203 - DNA, 21 bp, Artificial Sequence
  Description of Artificial Sequence: Synthetic oligonucleotide
gttactaagtcgggtaatggg

SEQ ID NO: 39204 - DNA, 21 bp, Artificial Sequence
  Description of Artificial Sequence: Synthetic oligonucleotide
agtggtcagcattctttgaat

SEQ ID NO: 39205 - DNA, 21 bp, Artificial Sequence
  Description of Artificial Sequence: Synthetic oligonucleotide
agagaagtcagcagctacaaa

SEQ ID NO: 39206 - DNA, 21 bp, Artificial Sequence
  Description of Artificial Sequence: Synthetic oligonucleotide
cacgccagaagcccccccgtc

SEQ ID NO: 39207 - DNA, 21 bp, Artificial Sequence
  Description of Artificial Sequence: Synthetic oligonucleotide
cataatttgccgcagcatgat

SEQ ID NO: 39208 - DNA, 21 bp, Artificial Sequence
  Description of Artificial Sequence: Synthetic oligonucleotide
gaattcaccaaagtcggcgcc

SEQ ID NO: 39209 - DNA, 21 bp, Artificial Sequence
  Description of Artificial Sequence: Synthetic oligonucleotide
gtgtctaattcgccttcgagg

SEQ ID NO: 39210 - DNA, 21 bp, Artificial Sequence
  Description of Artificial Sequence: Synthetic oligonucleotide
agcatcagccccaacagaacc

SEQ ID NO: 39211 - DNA, 21 bp, Artificial Sequence
  Description of Artificial Sequence: Synthetic oligonucleotide
gtcttcaaccacgccagcaaa

SEQ ID NO: 39212 - DNA, 21 bp, Artificial Sequence
  Description of Artificial Sequence: Synthetic oligonucleotide
gggcttatgactcatagtatt

SEQ ID NO: 39213 - DNA, 21 bp, Artificial Sequence
  Description of Artificial Sequence: Synthetic oligonucleotide
agttttggtacggagaatcgg

SEQ ID NO: 39214 - DNA, 21 bp, Artificial Sequence
  Description of Artificial Sequence: Synthetic oligonucleotide
aagcatggtggtagtagtgtg

SEQ ID NO: 39215 - DNA, 21 bp, Artificial Sequence
  Description of Artificial Sequence: Synthetic oligonucleotide
gaagtcagagccgaccccaga

SEQ ID NO: 39216 - DNA, 21 bp, Artificial Sequence
  Description of Artificial Sequence: Synthetic oligonucleotide
ggtcatatgggttcgattggt

SEQ ID NO: 39217 - DNA, 21 bp, Artificial Sequence
  Description of Artificial Sequence: Synthetic oligonucleotide
ttgcatcagctgagtgctggt

SEQ ID NO: 39218 - DNA, 21 bp, Artificial Sequence
  Description of Artificial Sequence: Synthetic oligonucleotide
acccacaccaacagactcggc

SEQ ID NO: 39219 - DNA, 21 bp, Artificial Sequence
  Description of Artificial Sequence: Synthetic oligonucleotide
agaagcgaaagaacccacagc

SEQ ID NO: 39220 - DNA, 21 bp, Artificial Sequence
  Description of Artificial Sequence: Synthetic oligonucleotide
agcagaatcaacaccagcccc

SEQ ID NO: 39221 - DNA, 21 bp, Artificial Sequence
  Description of Artificial Sequence: Synthetic oligonucleotide
aggcagcttgtggatcctccg

SEQ ID NO: 39222 - DNA, 21 bp, Artificial Sequence
  Description of Artificial Sequence: Synthetic oligonucleotide
gccagaagcagaagcaccgac

SEQ ID NO: 39223 - DNA, 21 bp, Artificial Sequence
  Description of Artificial Sequence: Synthetic oligonucleotide
cgtacgggtcattatcaggat

SEQ ID NO: 39224 - DNA, 21 bp, Artificial Sequence
  Description of Artificial Sequence: Synthetic oligonucleotide
ccttcgttgcagcttatgggt

SEQ ID NO: 39225 - DNA, 21 bp, Artificial Sequence
  Description of Artificial Sequence: Synthetic oligonucleotide
gccagcagcagcagacccagc

SEQ ID NO: 39226 - DNA, 21 bp, Artificial Sequence
  Description of Artificial Sequence: Synthetic oligonucleotide
ggccccagcagccccagactc

SEQ ID NO: 39227 - DNA, 21 bp, Artificial Sequence
  Description of Artificial Sequence: Synthetic oligonucleotide
ggcagagaaaccgtcagcaga

SEQ ID NO: 39228 - DNA, 21 bp, Artificial Sequence
  Description of Artificial Sequence: Synthetic oligonucleotide
cagtcttatgattctcatagg

SEQ ID NO: 39229 - DNA, 21 bp, Artificial Sequence
  Description of Artificial Sequence: Synthetic oligonucleotide
ggggggcagaattctagtaag

SEQ ID NO: 39230 - DNA, 21 bp, Artificial Sequence
  Description of Artificial Sequence: Synthetic oligonucleotide
ggggttcagactgctaggatt

SEQ ID NO: 39231 - DNA, 21 bp, Artificial Sequence
  Description of Artificial Sequence: Synthetic oligonucleotide
acgggtattgctccggttggt

SEQ ID NO: 39232 - DNA, 21 bp, Artificial Sequence
  Description of Artificial Sequence: Synthetic oligonucleotide
aggtcgggggggtcgttgtct

SEQ ID NO: 39233 - DNA, 21 bp, Artificial Sequence
  Description of Artificial Sequence: Synthetic oligonucleotide
atgggtgttggtatgaatggt

SEQ ID NO: 39234 - DNA, 21 bp, Artificial Sequence
  Description of Artificial Sequence: Synthetic oligonucleotide
gtcagaagccaagccatgagc

SEQ ID NO: 39235 - DNA, 21 bp, Artificial Sequence
  Description of Artificial Sequence: Synthetic oligonucleotide
agcaccgccaccaacgtctac

SEQ ID NO: 39236 - DNA, 21 bp, Artificial Sequence
  Description of Artificial Sequence: Synthetic oligonucleotide
ggtactcgtaatgctattgtt

SEQ ID NO: 39237 - DNA, 21 bp, Artificial Sequence
  Description of Artificial Sequence: Synthetic oligonucleotide
gccagaagcgtcaaaagcgtc

SEQ ID NO: 39238 - DNA, 21 bp, Artificial Sequence
  Description of Artificial Sequence: Synthetic oligonucleotide
agcagccaagccaaactcgtc

SEQ ID NO: 39239 - DNA, 21 bp, Artificial Sequence
  Description of Artificial Sequence: Synthetic oligonucleotide
ggcagcgtcaacagaagcagc

SEQ ID NO: 39240 - DNA, 21 bp, Artificial Sequence
  Description of Artificial Sequence: Synthetic oligonucleotide
cacaccagcccccccttcacc

SEQ ID NO: 39241 - DNA, 21 bp, Artificial Sequence
  Description of Artificial Sequence: Synthetic oligonucleotide
ccttctacgtcttctgcgggg

SEQ ID NO: 39242 - DNA, 21 bp, Artificial Sequence
  Description of Artificial Sequence: Synthetic oligonucleotide
acggggacggctactcttcgt

SEQ ID NO: 39243 - DNA, 21 bp, Artificial Sequence
  Description of Artificial Sequence: Synthetic oligonucleotide
atcagcaaagccagcacccac

SEQ ID NO: 39244 - DNA, 21 bp, Artificial Sequence
  Description of Artificial Sequence: Synthetic oligonucleotide
gaactcagaaccaacgccctc

SEQ ID NO: 39245 - DNA, 21 bp, Artificial Sequence
  Description of Artificial Sequence: Synthetic oligonucleotide
ggtcagacgatgtctacgatg

SEQ ID NO: 39246 - DNA, 21 bp, Artificial Sequence
  Description of Artificial Sequence: Synthetic oligonucleotide
ggcgtcaacaacaacatcaac

SEQ ID NO: 39247 - DNA, 21 bp, Artificial Sequence
  Description of Artificial Sequence: Synthetic oligonucleotide
tcgggtagttcgacttttagg

SEQ ID NO: 39248 - DNA, 21 bp, Artificial Sequence
  Description of Artificial Sequence: Synthetic oligonucleotide
agaagcgccaacaccaacgcc

SEQ ID NO: 39249 - DNA, 21 bp, Artificial Sequence
  Description of Artificial Sequence: Synthetic oligonucleotide
ggtgttctggggtcgcctaag

SEQ ID NO: 39250 - DNA, 21 bp, Artificial Sequence
  Description of Artificial Sequence: Synthetic oligonucleotide
gtgatgtcggcgaatactcat

SEQ ID NO: 39251 - DNA, 21 bp, Artificial Sequence
  Description of Artificial Sequence: Synthetic oligonucleotide
tctcggattggtatgagtacg

SEQ ID NO: 39252 - DNA, 21 bp, Artificial Sequence
  Description of Artificial Sequence: Synthetic oligonucleotide
cagcattctcctcggaatggg

SEQ ID NO: 39253 - DNA, 21 bp, Artificial Sequence
  Description of Artificial Sequence: Synthetic oligonucleotide
cctcatggggataagacttct

SEQ ID NO: 39254 - DNA, 21 bp, Artificial Sequence
  Description of Artificial Sequence: Synthetic oligonucleotide
agggagccgatgaagggtagt

SEQ ID NO: 39255 - DNA, 21 bp, Artificial Sequence
  Description of Artificial Sequence: Synthetic oligonucleotide
atgagaagcaaagaaagcgcc

SEQ ID NO: 39256 - DNA, 21 bp, Artificial Sequence
  Description of Artificial Sequence: Synthetic oligonucleotide
tggggcaccagaagcaccgtc

SEQ ID NO: 39257 - DNA, 21 bp, Artificial Sequence
  Description of Artificial Sequence: Synthetic oligonucleotide
cgtaatacttctgcggatcgt

SEQ ID NO: 39258 - DNA, 21 bp, Artificial Sequence
  Description of Artificial Sequence: Synthetic oligonucleotide
tcgtcttcgaataagcatgtt

SEQ ID NO: 39259 - DNA, 21 bp, Artificial Sequence
  Description of Artificial Sequence: Synthetic oligonucleotide
tgtaatggttctaggctggcg

SEQ ID NO: 39260 - DNA, 21 bp, Artificial Sequence
  Description of Artificial Sequence: Synthetic oligonucleotide
caaatgggcagcatgagcggc

SEQ ID NO: 39261 - DNA, 21 bp, Artificial Sequence
  Description of Artificial Sequence: Synthetic oligonucleotide
ccgtcgggtcctgttaggggg

SEQ ID NO: 39262 - DNA, 21 bp, Artificial Sequence
  Description of Artificial Sequence: Synthetic oligonucleotide
gatccgctgcggcattctgtt

SEQ ID NO: 39263 - DNA, 21 bp, Artificial Sequence
  Description of Artificial Sequence: Synthetic oligonucleotide
cctcctgttgctaggtctggt

SEQ ID NO: 39264 - DNA, 21 bp, Artificial Sequence
  Description of Artificial Sequence: Synthetic oligonucleotide
ggcagaccccaaatgcccaac

SEQ ID NO: 39265 - DNA, 21 bp, Artificial Sequence
  Description of Artificial Sequence: Synthetic oligonucleotide
cgttcgaatcctactttggtg

SEQ ID NO: 39266 - DNA, 21 bp, Artificial Sequence
  Description of Artificial Sequence: Synthetic oligonucleotide
ggcctccaaagcaaacaactc

SEQ ID NO: 39267 - DNA, 21 bp, Artificial Sequence
  Description of Artificial Sequence: Synthetic oligonucleotide
cacagaaccacccccgtcagc

SEQ ID NO: 39268 - DNA, 21 bp, Artificial Sequence
  Description of Artificial Sequence: Synthetic oligonucleotide
actccgcattcttctaagggt

SEQ ID NO: 39269 - DNA, 21 bp, Artificial Sequence
  Description of Artificial Sequence: Synthetic oligonucleotide
cagggtacgactgctaggtcg

SEQ ID NO: 39270 - DNA, 21 bp, Artificial Sequence
  Description of Artificial Sequence: Synthetic oligonucleotide
agcgtcagcaccaacttcagc

SEQ ID NO: 39271 - DNA, 21 bp, Artificial Sequence
  Description of Artificial Sequence: Synthetic oligonucleotide
cccatggtcaacaccagcctc

SEQ ID NO: 39272 - DNA, 21 bp, Artificial Sequence
  Description of Artificial Sequence: Synthetic oligonucleotide
ttcaacagcggcagcggcaga

SEQ ID NO: 39273 - DNA, 21 bp, Artificial Sequence
  Description of Artificial Sequence: Synthetic oligonucleotide
ctgtcggcggctcgtagtcag

SEQ ID NO: 39274 - DNA, 21 bp, Artificial Sequence
  Description of Artificial Sequence: Synthetic oligonucleotide
gctcagattaatacgcctact

SEQ ID NO: 39275 - DNA, 21 bp, Artificial Sequence
  Description of Artificial Sequence: Synthetic oligonucleotide
aatgatcaggctaagttgacg

SEQ ID NO: 39276 - DNA, 21 bp, Artificial Sequence
  Description of Artificial Sequence: Synthetic oligonucleotide
gaagccagcagcagcatgggc

SEQ ID NO: 39277 - DNA, 21 bp, Artificial Sequence
  Description of Artificial Sequence: Synthetic oligonucleotide
cagagtcatggtattacgaat

SEQ ID NO: 39278 - DNA, 21 bp, Artificial Sequence
  Description of Artificial Sequence: Synthetic oligonucleotide
gcgacttctaatggtactctg

SEQ ID NO: 39279 - DNA, 21 bp, Artificial Sequence
  Description of Artificial Sequence: Synthetic oligonucleotide
gttcagtattcgcagatgcgg

SEQ ID NO: 39280 - DNA, 21 bp, Artificial Sequence
  Description of Artificial Sequence: Synthetic oligonucleotide
agtaatagtaggcaggctgat

SEQ ID NO: 39281 - DNA, 21 bp, Artificial Sequence
  Description of Artificial Sequence: Synthetic oligonucleotide
agtatttcgggtgagagggat

SEQ ID NO: 39282 - DNA, 21 bp, Artificial Sequence
  Description of Artificial Sequence: Synthetic oligonucleotide
ggcagaagcagccacatggac

SEQ ID NO: 39283 - DNA, 21 bp, Artificial Sequence
  Description of Artificial Sequence: Synthetic oligonucleotide
aaagacgccagcagctggctc

SEQ ID NO: 39284 - DNA, 21 bp, Artificial Sequence
  Description of Artificial Sequence: Synthetic oligonucleotide
gatcctgttctgaagccggct

SEQ ID NO: 39285 - DNA, 21 bp, Artificial Sequence
  Description of Artificial Sequence: Synthetic oligonucleotide
tttgggcagaagccttggaag

SEQ ID NO: 39286 - DNA, 21 bp, Artificial Sequence
  Description of Artificial Sequence: Synthetic oligonucleotide
caggtgacgactattggtgct

SEQ ID NO: 39287 - DNA, 21 bp, Artificial Sequence
  Description of Artificial Sequence: Synthetic oligonucleotide
ccggggtctgggcgtaatcat

SEQ ID NO: 39288 - DNA, 21 bp, Artificial Sequence
  Description of Artificial Sequence: Synthetic oligonucleotide
ggggggcaggctggtacgatt

SEQ ID NO: 39289 - DNA, 21 bp, Artificial Sequence
  Description of Artificial Sequence: Synthetic oligonucleotide
atgcaaagaaacggccacgtc

SEQ ID NO: 39290 - DNA, 21 bp, Artificial Sequence
  Description of Artificial Sequence: Synthetic oligonucleotide
ggggctcgtgaggcttctcgg

SEQ ID NO: 39291 - DNA, 21 bp, Artificial Sequence
  Description of Artificial Sequence: Synthetic oligonucleotide
gatcgggctgatgcgaattct

SEQ ID NO: 39292 - DNA, 21 bp, Artificial Sequence
  Description of Artificial Sequence: Synthetic oligonucleotide
ccgacggttcggtcgtctacg

SEQ ID NO: 39293 - DNA, 21 bp, Artificial Sequence
  Description of Artificial Sequence: Synthetic oligonucleotide
gatagtccgaatcggggtagt

SEQ ID NO: 39294 - DNA, 21 bp, Artificial Sequence
  Description of Artificial Sequence: Synthetic oligonucleotide
gagattagtcgtcctgcttcg

SEQ ID NO: 39295 - DNA, 21 bp, Artificial Sequence
  Description of Artificial Sequence: Synthetic oligonucleotide
ggcatcgccggcgtcaccaga

SEQ ID NO: 39296 - DNA, 21 bp, Artificial Sequence
  Description of Artificial Sequence: Synthetic oligonucleotide
ctcgccagaaacaccacctac

SEQ ID NO: 39297 - DNA, 21 bp, Artificial Sequence
  Description of Artificial Sequence: Synthetic oligonucleotide
agtgatgttcggctttctggt

SEQ ID NO: 39298 - DNA, 21 bp, Artificial Sequence
  Description of Artificial Sequence: Synthetic oligonucleotide
cccgccaaccacaaaaccatg

SEQ ID NO: 39299 - DNA, 21 bp, Artificial Sequence
  Description of Artificial Sequence: Synthetic oligonucleotide
atgggggcgggggcgcttacg

SEQ ID NO: 39300 - DNA, 21 bp, Artificial Sequence
  Description of Artificial Sequence: Synthetic oligonucleotide
accgccagccccaacaacaga

SEQ ID NO: 39301 - DNA, 21 bp, Artificial Sequence
  Description of Artificial Sequence: Synthetic oligonucleotide
aacggcagcgcccaaaaccaa

SEQ ID NO: 39302 - DNA, 21 bp, Artificial Sequence
  Description of Artificial Sequence: Synthetic oligonucleotide
ggcatcacccaaagcggcggc

SEQ ID NO: 39303 - DNA, 21 bp, Artificial Sequence
  Description of Artificial Sequence: Synthetic oligonucleotide
agagaccccaaaagcagcacc

SEQ ID NO: 39304 - DNA, 21 bp, Artificial Sequence
  Description of Artificial Sequence: Synthetic oligonucleotide
gttaggcttggtagtgttaag

SEQ ID NO: 39305 - DNA, 21 bp, Artificial Sequence
  Description of Artificial Sequence: Synthetic oligonucleotide
aattcgcatacgcctgtgcgg

SEQ ID NO: 39306 - DNA, 21 bp, Artificial Sequence
  Description of Artificial Sequence: Synthetic oligonucleotide
agcgccaacaccagagtccaa

SEQ ID NO: 39307 - DNA, 21 bp, Artificial Sequence
  Description of Artificial Sequence: Synthetic oligonucleotide
tctggtcgtgataagattagt

SEQ ID NO: 39308 - DNA, 21 bp, Artificial Sequence
  Description of Artificial Sequence: Synthetic oligonucleotide
gtcagcggcacccccagagtc

SEQ ID NO: 39309 - DNA, 21 bp, Artificial Sequence
  Description of Artificial Sequence: Synthetic oligonucleotide
gtgccggttaataatgagcgt

SEQ ID NO: 39310 - DNA, 21 bp, Artificial Sequence
  Description of Artificial Sequence: Synthetic oligonucleotide
gggaatgagcatcttagggtt

SEQ ID NO: 39311 - DNA, 21 bp, Artificial Sequence
  Description of Artificial Sequence: Synthetic oligonucleotide
tcgggttctagtaagccgact

SEQ ID NO: 39312 - DNA, 21 bp, Artificial Sequence
  Description of Artificial Sequence: Synthetic oligonucleotide
gccgacagaaccaaaatgagc

SEQ ID NO: 39313 - DNA, 21 bp, Artificial Sequence
  Description of Artificial Sequence: Synthetic oligonucleotide
agcggcgccaccacccccaga

SEQ ID NO: 39314 - DNA, 21 bp, Artificial Sequence
  Description of Artificial Sequence: Synthetic oligonucleotide
catgcgcatagtaatgttggt

SEQ ID NO: 39315 - DNA, 21 bp, Artificial Sequence
  Description of Artificial Sequence: Synthetic oligonucleotide
caccccaccagaagcaccgcc

SEQ ID NO: 39316 - DNA, 21 bp, Artificial Sequence
  Description of Artificial Sequence: Synthetic oligonucleotide
atgtcgacttcttcttctcgt

SEQ ID NO: 39317 - DNA, 21 bp, Artificial Sequence
  Description of Artificial Sequence: Synthetic oligonucleotide
agcgccatcagaaacgtcacc

SEQ ID NO: 39318 - DNA, 21 bp, Artificial Sequence
  Description of Artificial Sequence: Synthetic oligonucleotide
accaacgacagaaacgccaga

SEQ ID NO: 39319 - DNA, 21 bp, Artificial Sequence
  Description of Artificial Sequence: Synthetic oligonucleotide
agcgacatcaacagaagcacc

SEQ ID NO: 39320 - DNA, 21 bp, Artificial Sequence
  Description of Artificial Sequence: Synthetic oligonucleotide
agaagcaccagaatcagcgaa

SEQ ID NO: 39321 - DNA, 21 bp, Artificial Sequence
  Description of Artificial Sequence: Synthetic oligonucleotide
tctagggggcagttgagtcag

SEQ ID NO: 39322 - DNA, 21 bp, Artificial Sequence
  Description of Artificial Sequence: Synthetic oligonucleotide
gctcggtctactcatctggag

SEQ ID NO: 39323 - DNA, 21 bp, Artificial Sequence
  Description of Artificial Sequence: Synthetic oligonucleotide
gactaccacaacagcaaactc

SEQ ID NO: 39324 - DNA, 21 bp, Artificial Sequence
  Description of Artificial Sequence: Synthetic oligonucleotide
caacccaacaccacctacaga

SEQ ID NO: 39325 - DNA, 21 bp, Artificial Sequence
  Description of Artificial Sequence: Synthetic oligonucleotide
cagtctggtactaagcagggt

SEQ ID NO: 39326 - DNA, 21 bp, Artificial Sequence
  Description of Artificial Sequence: Synthetic oligonucleotide
ggttatgggtctaaggttagt

SEQ ID NO: 39327 - DNA, 21 bp, Artificial Sequence
  Description of Artificial Sequence: Synthetic oligonucleotide
gatcgggttttgagtcagggg

SEQ ID NO: 39328 - DNA, 21 bp, Artificial Sequence
  Description of Artificial Sequence: Synthetic oligonucleotide
gggcagaatactgtttctcgt

SEQ ID NO: 39329 - DNA, 21 bp, Artificial Sequence
  Description of Artificial Sequence: Synthetic oligonucleotide
gctatgggtcatcctttggcg

SEQ ID NO: 39330 - DNA, 21 bp, Artificial Sequence
  Description of Artificial Sequence: Synthetic oligonucleotide
gcccaccaaagacccatccaa

SEQ ID NO: 39331 - DNA, 21 bp, Artificial Sequence
  Description of Artificial Sequence: Synthetic oligonucleotide
agcagcagcacccacgccgtc

SEQ ID NO: 39332 - DNA, 21 bp, Artificial Sequence
  Description of Artificial Sequence: Synthetic oligonucleotide
ggcggcaccaacaacctcaac

SEQ ID NO: 39333 - DNA, 21 bp, Artificial Sequence
  Description of Artificial Sequence: Synthetic oligonucleotide
cggtctcgtgctgagtcggat

SEQ ID NO: 39334 - DNA, 21 bp, Artificial Sequence
  Description of Artificial Sequence: Synthetic oligonucleotide
atgaacagaaccggcatcaaa

SEQ ID NO: 39335 - DNA, 21 bp, Artificial Sequence
  Description of Artificial Sequence: Synthetic oligonucleotide
atgagcagaagcgaccccccc

SEQ ID NO: 39336 - DNA, 21 bp, Artificial Sequence
  Description of Artificial Sequence: Synthetic oligonucleotide
agttcttctgttatggttagg

SEQ ID NO: 39337 - DNA, 21 bp, Artificial Sequence
  Description of Artificial Sequence: Synthetic oligonucleotide
actcgtgttgttcctcggctt

SEQ ID NO: 39338 - DNA, 21 bp, Artificial Sequence
  Description of Artificial Sequence: Synthetic oligonucleotide
catggtcagaagctgtttgat

SEQ ID NO: 39339 - DNA, 21 bp, Artificial Sequence
  Description of Artificial Sequence: Synthetic oligonucleotide
agcgccagcagaaccatgggc

SEQ ID NO: 39340 - DNA, 21 bp, Artificial Sequence
  Description of Artificial Sequence: Synthetic oligonucleotide
agagcccccggcagcaacacc

SEQ ID NO: 39341 - DNA, 21 bp, Artificial Sequence
  Description of Artificial Sequence: Synthetic oligonucleotide
tcgcgtgttacttctgtttcg

SEQ ID NO: 39342 - DNA, 21 bp, Artificial Sequence
  Description of Artificial Sequence: Synthetic oligonucleotide
gctaattctcgggatgctaag

SEQ ID NO: 39343 - DNA, 21 bp, Artificial Sequence
  Description of Artificial Sequence: Synthetic oligonucleotide
agcgaccacagcagaagcctc

SEQ ID NO: 39344 - DNA, 21 bp, Artificial Sequence
  Description of Artificial Sequence: Synthetic oligonucleotide
gggacgtctaatcggtatacg

SEQ ID NO: 39345 - DNA, 21 bp, Artificial Sequence
  Description of Artificial Sequence: Synthetic oligonucleotide
gggattccgcgtacttcttcg

SEQ ID NO: 39346 - DNA, 21 bp, Artificial Sequence
  Description of Artificial Sequence: Synthetic oligonucleotide
cgtggtaagtcgaatattgat

SEQ ID NO: 39347 - DNA, 21 bp, Artificial Sequence
  Description of Artificial Sequence: Synthetic oligonucleotide
cacgccgaaaccaacctcaga

SEQ ID NO: 39348 - DNA, 21 bp, Artificial Sequence
  Description of Artificial Sequence: Synthetic oligonucleotide
gccggcgaaaacaaactcagc

SEQ ID NO: 39349 - DNA, 21 bp, Artificial Sequence
  Description of Artificial Sequence: Synthetic oligonucleotide
ggtgttaatactggtactcag

SEQ ID NO: 39350 - DNA, 21 bp, Artificial Sequence
  Description of Artificial Sequence: Synthetic oligonucleotide
ccggtgggttcgcgtggtggt

SEQ ID NO: 39351 - DNA, 21 bp, Artificial Sequence
  Description of Artificial Sequence: Synthetic oligonucleotide
agtactatgaagagtgcggcg

SEQ ID NO: 39352 - DNA, 21 bp, Artificial Sequence
  Description of Artificial Sequence: Synthetic oligonucleotide
cttaataagtctacgcttccg

SEQ ID NO: 39353 - DNA, 21 bp, Artificial Sequence
  Description of Artificial Sequence: Synthetic oligonucleotide
cacgacagcagaagcaacgcc

SEQ ID NO: 39354 - DNA, 21 bp, Artificial Sequence
  Description of Artificial Sequence: Synthetic oligonucleotide
ggccccaaaagccccggcacc

SEQ ID NO: 39355 - DNA, 21 bp, Artificial Sequence
  Description of Artificial Sequence: Synthetic oligonucleotide
ggcgaaaacagcgccaaaaga

SEQ ID NO: 39356 - DNA, 21 bp, Artificial Sequence
  Description of Artificial Sequence: Synthetic oligonucleotide
gtccccggcagccaaatcggc

SEQ ID NO: 39357 - DNA, 21 bp, Artificial Sequence
  Description of Artificial Sequence: Synthetic oligonucleotide
ggttttcctagtgggacgagg

SEQ ID NO: 39358 - DNA, 21 bp, Artificial Sequence
  Description of Artificial Sequence: Synthetic oligonucleotide
ctcgacttcaaaaccctcccc

SEQ ID NO: 39359 - DNA, 21 bp, Artificial Sequence
  Description of Artificial Sequence: Synthetic oligonucleotide
catcagggtaatgttatttct

SEQ ID NO: 39360 - DNA, 21 bp, Artificial Sequence
  Description of Artificial Sequence: Synthetic oligonucleotide
ccgatggctcagcagcgggct

SEQ ID NO: 39361 - DNA, 21 bp, Artificial Sequence
  Description of Artificial Sequence: Synthetic oligonucleotide
gtggagcagctggggggtcgt

SEQ ID NO: 39362 - DNA, 21 bp, Artificial Sequence
  Description of Artificial Sequence: Synthetic oligonucleotide
ggtcggagtgatcatactaag

SEQ ID NO: 39363 - DNA, 21 bp, Artificial Sequence
  Description of Artificial Sequence: Synthetic oligonucleotide
catgctaatagtcgtcctgtt

SEQ ID NO: 39364 - DNA, 21 bp, Artificial Sequence
  Description of Artificial Sequence: Synthetic oligonucleotide
aacatccacaaacaaagcgcc

SEQ ID NO: 39365 - DNA, 21 bp, Artificial Sequence
  Description of Artificial Sequence: Synthetic oligonucleotide
gaacacatgacccccagaagc

SEQ ID NO: 39366 - DNA, 21 bp, Artificial Sequence
  Description of Artificial Sequence: Synthetic oligonucleotide
ggcgtcaccggcacccacgtc

SEQ ID NO: 39367 - DNA, 21 bp, Artificial Sequence
  Description of Artificial Sequence: Synthetic oligonucleotide
cccagaaccaacaaccccagc

SEQ ID NO: 39368 - DNA, 21 bp, Artificial Sequence
  Description of Artificial Sequence: Synthetic oligonucleotide
agtgcttctaatgttagtagg

SEQ ID NO: 39369 - DNA, 21 bp, Artificial Sequence
  Description of Artificial Sequence: Synthetic oligonucleotide
agtggtacttctcggtttagt

SEQ ID NO: 39370 - DNA, 21 bp, Artificial Sequence
  Description of Artificial Sequence: Synthetic oligonucleotide
cacagaaccaacggcctcacc

SEQ ID NO: 39371 - DNA, 21 bp, Artificial Sequence
  Description of Artificial Sequence: Synthetic oligonucleotide
cgtacttctaataaggatttg

SEQ ID NO: 39372 - DNA, 21 bp, Artificial Sequence
  Description of Artificial Sequence: Synthetic oligonucleotide
aacggttctggaaagaatcaa

SEQ ID NO: 39373 - DNA, 21 bp, Artificial Sequence
  Description of Artificial Sequence: Synthetic oligonucleotide
gctcggactactaagattcag

SEQ ID NO: 39374 - DNA, 21 bp, Artificial Sequence
  Description of Artificial Sequence: Synthetic oligonucleotide
ctcggcagcagcaccatcctc

SEQ ID NO: 39375 - DNA, 21 bp, Artificial Sequence
  Description of Artificial Sequence: Synthetic oligonucleotide
tctgattctcggtcgggtatg

SEQ ID NO: 39376 - DNA, 21 bp, Artificial Sequence
  Description of Artificial Sequence: Synthetic oligonucleotide
ggtgttggtactccgcgttcg

SEQ ID NO: 39377 - DNA, 21 bp, Artificial Sequence
  Description of Artificial Sequence: Synthetic oligonucleotide
tcgccgatgggtgttactcgg

SEQ ID NO: 39378 - DNA, 21 bp, Artificial Sequence
  Description of Artificial Sequence: Synthetic oligonucleotide
cacggcagcaaaccctacatc

SEQ ID NO: 39379 - DNA, 21 bp, Artificial Sequence
  Description of Artificial Sequence: Synthetic oligonucleotide
gatagtaggcctcgtctggcg

SEQ ID NO: 39380 - DNA, 21 bp, Artificial Sequence
  Description of Artificial Sequence: Synthetic oligonucleotide
cagagttctattcatacgaag

SEQ ID NO: 39381 - DNA, 21 bp, Artificial Sequence
  Description of Artificial Sequence: Synthetic oligonucleotide
atgagcagcagcatgaccctc

SEQ ID NO: 39382 - DNA, 21 bp, Artificial Sequence
  Description of Artificial Sequence: Synthetic oligonucleotide
ccggggattggtacgcctttt

SEQ ID NO: 39383 - DNA, 21 bp, Artificial Sequence
  Description of Artificial Sequence: Synthetic oligonucleotide
agcgtcgccggcatgcaaaga

SEQ ID NO: 39384 - DNA, 21 bp, Artificial Sequence
  Description of Artificial Sequence: Synthetic oligonucleotide
cacgggtcgtctgttcattct

SEQ ID NO: 39385 - DNA, 21 bp, Artificial Sequence
  Description of Artificial Sequence: Synthetic oligonucleotide
cacgtcaaccaagccgccaga

SEQ ID NO: 39386 - DNA, 21 bp, Artificial Sequence
  Description of Artificial Sequence: Synthetic oligonucleotide
cctggtcgtcctcagacggat

SEQ ID NO: 39387 - DNA, 21 bp, Artificial Sequence
  Description of Artificial Sequence: Synthetic oligonucleotide
atggccctccaacccaacaga

SEQ ID NO: 39388 - DNA, 21 bp, Artificial Sequence
  Description of Artificial Sequence: Synthetic oligonucleotide
agcaccatgaccaccagcaga

SEQ ID NO: 39389 - DNA, 21 bp, Artificial Sequence
  Description of Artificial Sequence: Synthetic oligonucleotide
agccacggcgaaagccaaaga

SEQ ID NO: 39390 - DNA, 21 bp, Artificial Sequence
  Description of Artificial Sequence: Synthetic oligonucleotide
caggatgctactcctcgtagt

SEQ ID NO: 39391 - DNA, 21 bp, Artificial Sequence
  Description of Artificial Sequence: Synthetic oligonucleotide
tgtggtaatacgggtcgtagt

SEQ ID NO: 39392 - DNA, 21 bp, Artificial Sequence
  Description of Artificial Sequence: Synthetic oligonucleotide
ccgaatgggagtcctctgagt

SEQ ID NO: 39393 - DNA, 21 bp, Artificial Sequence
  Description of Artificial Sequence: Synthetic oligonucleotide
gaactccacagcaaaaacgcc

SEQ ID NO: 39394 - DNA, 21 bp, Artificial Sequence
  Description of Artificial Sequence: Synthetic oligonucleotide
cccatgagcggcaccagactc

SEQ ID NO: 39395 - DNA, 21 bp, Artificial Sequence
  Description of Artificial Sequence: Synthetic oligonucleotide
atcggcatcaccaaccacagc

SEQ ID NO: 39396 - DNA, 21 bp, Artificial Sequence
  Description of Artificial Sequence: Synthetic oligonucleotide
agcagagtcggcaccgcctgc

SEQ ID NO: 39397 - DNA, 21 bp, Artificial Sequence
  Description of Artificial Sequence: Synthetic oligonucleotide
aatagggtggagcgtgctgtt

SEQ ID NO: 39398 - DNA, 21 bp, Artificial Sequence
  Description of Artificial Sequence: Synthetic oligonucleotide
tctatgtcgccgcgtaatggt

SEQ ID NO: 39399 - DNA, 21 bp, Artificial Sequence
  Description of Artificial Sequence: Synthetic oligonucleotide
gcgaatcttactcagagtcgt

SEQ ID NO: 39400 - DNA, 21 bp, Artificial Sequence
  Description of Artificial Sequence: Synthetic oligonucleotide
ggtcctagtacgcattcgggt

SEQ ID NO: 39401 - DNA, 21 bp, Artificial Sequence
  Description of Artificial Sequence: Synthetic oligonucleotide
ctcagaaacgccagcagcgcc

SEQ ID NO: 39402 - DNA, 21 bp, Artificial Sequence
  Description of Artificial Sequence: Synthetic oligonucleotide
gacccccacaacaccagcaga

SEQ ID NO: 39403 - DNA, 21 bp, Artificial Sequence
  Description of Artificial Sequence: Synthetic oligonucleotide
acgcctacggggcatcgttct

SEQ ID NO: 39404 - DNA, 21 bp, Artificial Sequence
  Description of Artificial Sequence: Synthetic oligonucleotide
aacggttctggacagaagcaa

SEQ ID NO: 39405 - DNA, 21 bp, Artificial Sequence
  Description of Artificial Sequence: Synthetic oligonucleotide
cgtatgccttctgggaattcg

SEQ ID NO: 39406 - DNA, 21 bp, Artificial Sequence
  Description of Artificial Sequence: Synthetic oligonucleotide
agagtcagcagccccagcaac

SEQ ID NO: 39407 - DNA, 21 bp, Artificial Sequence
  Description of Artificial Sequence: Synthetic oligonucleotide
agaagcacccaaagcagcccc

SEQ ID NO: 39408 - DNA, 21 bp, Artificial Sequence
  Description of Artificial Sequence: Synthetic oligonucleotide
tatcagactcctgcttatcgt

SEQ ID NO: 39409 - DNA, 21 bp, Artificial Sequence
  Description of Artificial Sequence: Synthetic oligonucleotide
catcttcatgcgtcgcctgct

SEQ ID NO: 39410 - DNA, 21 bp, Artificial Sequence
  Description of Artificial Sequence: Synthetic oligonucleotide
agaaccagcagcacctacagc

SEQ ID NO: 39411 - DNA, 21 bp, Artificial Sequence
  Description of Artificial Sequence: Synthetic oligonucleotide
agacactacaaaggcgacagc

SEQ ID NO: 39412 - DNA, 21 bp, Artificial Sequence
  Description of Artificial Sequence: Synthetic oligonucleotide
cacaccgccacccccctcctc

SEQ ID NO: 39413 - DNA, 21 bp, Artificial Sequence
  Description of Artificial Sequence: Synthetic oligonucleotide
gccaccagagacagccacagc

SEQ ID NO: 39414 - DNA, 21 bp, Artificial Sequence
  Description of Artificial Sequence: Synthetic oligonucleotide
agtagggttactgggggtact

SEQ ID NO: 39415 - DNA, 21 bp, Artificial Sequence
  Description of Artificial Sequence: Synthetic oligonucleotide
aatacttatcagtctaagaat

SEQ ID NO: 39416 - DNA, 21 bp, Artificial Sequence
  Description of Artificial Sequence: Synthetic oligonucleotide
gtggttcatcagccgtctacc

SEQ ID NO: 39417 - DNA, 21 bp, Artificial Sequence
  Description of Artificial Sequence: Synthetic oligonucleotide
cacagataccaacaagaaacc

SEQ ID NO: 39418 - DNA, 21 bp, Artificial Sequence
  Description of Artificial Sequence: Synthetic oligonucleotide
gccaacggcagcggcgtcggc

SEQ ID NO: 39419 - DNA, 21 bp, Artificial Sequence
  Description of Artificial Sequence: Synthetic oligonucleotide
gatattaatcgtcagaggact

SEQ ID NO: 39420 - DNA, 21 bp, Artificial Sequence
  Description of Artificial Sequence: Synthetic oligonucleotide
ttggcttctagttcttttaat

SEQ ID NO: 39421 - DNA, 21 bp, Artificial Sequence
  Description of Artificial Sequence: Synthetic oligonucleotide
aggagtatttctagtgcggtg

SEQ ID NO: 39422 - DNA, 21 bp, Artificial Sequence
  Description of Artificial Sequence: Synthetic oligonucleotide
ggtcagactagggagtctagt

SEQ ID NO: 39423 - DNA, 21 bp, Artificial Sequence
  Description of Artificial Sequence: Synthetic oligonucleotide
cctcgtcatgctcctcttctg

SEQ ID NO: 39424 - DNA, 21 bp, Artificial Sequence
  Description of Artificial Sequence: Synthetic oligonucleotide
aacaccctccccccctgcaaa

SEQ ID NO: 39425 - DNA, 21 bp, Artificial Sequence
  Description of Artificial Sequence: Synthetic oligonucleotide
gggctggttgagacgtctagg

SEQ ID NO: 39426 - DNA, 21 bp, Artificial Sequence
  Description of Artificial Sequence: Synthetic oligonucleotide
acttcgtctcctcagccgtcg

SEQ ID NO: 39427 - DNA, 21 bp, Artificial Sequence
  Description of Artificial Sequence: Synthetic oligonucleotide
caacccagcgaaaaaagcctc

SEQ ID NO: 39428 - DNA, 21 bp, Artificial Sequence
  Description of Artificial Sequence: Synthetic oligonucleotide
ttccccaacgtcaacagcgcc

SEQ ID NO: 39429 - DNA, 21 bp, Artificial Sequence
  Description of Artificial Sequence: Synthetic oligonucleotide
gggggtaatccttcggggagt

SEQ ID NO: 39430 - DNA, 21 bp, Artificial Sequence
  Description of Artificial Sequence: Synthetic oligonucleotide
cagcttcgttcggatcagact

SEQ ID NO: 39431 - DNA, 21 bp, Artificial Sequence
  Description of Artificial Sequence: Synthetic oligonucleotide
gctacgcattcgaaggctagt

SEQ ID NO: 39432 - DNA, 21 bp, Artificial Sequence
  Description of Artificial Sequence: Synthetic oligonucleotide
gatgctaattctacgcatgct

SEQ ID NO: 39433 - DNA, 21 bp, Artificial Sequence
  Description of Artificial Sequence: Synthetic oligonucleotide
ctgggtgtgaagactccgact

SEQ ID NO: 39434 - DNA, 21 bp, Artificial Sequence
  Description of Artificial Sequence: Synthetic oligonucleotide
ttgactacgtcggtgtataag

SEQ ID NO: 39435 - DNA, 21 bp, Artificial Sequence
  Description of Artificial Sequence: Synthetic oligonucleotide
attatttcgcagcatgggatg

SEQ ID NO: 39436 - DNA, 21 bp, Artificial Sequence
  Description of Artificial Sequence: Synthetic oligonucleotide
aattctggtactagggctaat

SEQ ID NO: 39437 - DNA, 21 bp, Artificial Sequence
  Description of Artificial Sequence: Synthetic oligonucleotide
acgaatgcggcgtcgcatact

SEQ ID NO: 39438 - DNA, 21 bp, Artificial Sequence
  Description of Artificial Sequence: Synthetic oligonucleotide
gaactcagaaacggccacaaa

SEQ ID NO: 39439 - DNA, 21 bp, Artificial Sequence
  Description of Artificial Sequence: Synthetic oligonucleotide
tgcccccaaagagccagcacc

SEQ ID NO: 39440 - DNA, 21 bp, Artificial Sequence
  Description of Artificial Sequence: Synthetic oligonucleotide
ttcctcaccggcagacaaagc

SEQ ID NO: 39441 - DNA, 21 bp, Artificial Sequence
  Description of Artificial Sequence: Synthetic oligonucleotide
gtcagcgacagcaacagcctc

SEQ ID NO: 39442 - DNA, 21 bp, Artificial Sequence
  Description of Artificial Sequence: Synthetic oligonucleotide
tgggcggcgggtagtcataag

SEQ ID NO: 39443 - DNA, 21 bp, Artificial Sequence
  Description of Artificial Sequence: Synthetic oligonucleotide
ggccccggcagcccctggaaa

SEQ ID NO: 39444 - DNA, 21 bp, Artificial Sequence
  Description of Artificial Sequence: Synthetic oligonucleotide
cccttcagccccaccgtcagc

SEQ ID NO: 39445 - DNA, 21 bp, Artificial Sequence
  Description of Artificial Sequence: Synthetic oligonucleotide
cacagcacccccagcaccatg

SEQ ID NO: 39446 - DNA, 21 bp, Artificial Sequence
  Description of Artificial Sequence: Synthetic oligonucleotide
gttcgggcggctagtaatcct

SEQ ID NO: 39447 - DNA, 21 bp, Artificial Sequence
  Description of Artificial Sequence: Synthetic oligonucleotide
catttggttaggtcgtcgtgt

SEQ ID NO: 39448 - DNA, 21 bp, Artificial Sequence
  Description of Artificial Sequence: Synthetic oligonucleotide
cccatgagccacaccctcggc

SEQ ID NO: 39449 - DNA, 21 bp, Artificial Sequence
  Description of Artificial Sequence: Synthetic oligonucleotide
agcagcgccggccacagcaaa

SEQ ID NO: 39450 - DNA, 21 bp, Artificial Sequence
  Description of Artificial Sequence: Synthetic oligonucleotide
catactactggtattattggg

SEQ ID NO: 39451 - DNA, 21 bp, Artificial Sequence
  Description of Artificial Sequence: Synthetic oligonucleotide
tgtactaatgatcggggggtt

SEQ ID NO: 39452 - DNA, 21 bp, Artificial Sequence
  Description of Artificial Sequence: Synthetic oligonucleotide
accggcctcagacacatgggc

SEQ ID NO: 39453 - DNA, 21 bp, Artificial Sequence
  Description of Artificial Sequence: Synthetic oligonucleotide
aggaatcagggtgcgttgcag

SEQ ID NO: 39454 - DNA, 21 bp, Artificial Sequence
  Description of Artificial Sequence: Synthetic oligonucleotide
tacaacggcggcaacagaagc

SEQ ID NO: 39455 - DNA, 21 bp, Artificial Sequence
  Description of Artificial Sequence: Synthetic oligonucleotide
tcgcggaatacgcagtcgatg

SEQ ID NO: 39456 - DNA, 21 bp, Artificial Sequence
  Description of Artificial Sequence: Synthetic oligonucleotide
ctggtttcgtctaagagtagt

SEQ ID NO: 39457 - DNA, 21 bp, Artificial Sequence
  Description of Artificial Sequence: Synthetic oligonucleotide
cgtgcttcgcagtctgtgggt

SEQ ID NO: 39458 - DNA, 21 bp, Artificial Sequence
  Description of Artificial Sequence: Synthetic oligonucleotide
aggattggtcagggttcgagt

SEQ ID NO: 39459 - DNA, 21 bp, Artificial Sequence
  Description of Artificial Sequence: Synthetic oligonucleotide
gtcaccaccagcaccggcaga

SEQ ID NO: 39460 - DNA, 21 bp, Artificial Sequence
  Description of Artificial Sequence: Synthetic oligonucleotide
agtcagtctcctaatcggggg

SEQ ID NO: 39461 - DNA, 21 bp, Artificial Sequence
  Description of Artificial Sequence: Synthetic oligonucleotide
cggactactaatcatcagtct

SEQ ID NO: 39462 - DNA, 21 bp, Artificial Sequence
  Description of Artificial Sequence: Synthetic oligonucleotide
gtgcgtactaatgcgaagggt

SEQ ID NO: 39463 - DNA, 21 bp, Artificial Sequence
  Description of Artificial Sequence: Synthetic oligonucleotide
gcgaatattcgttctacgggt

SEQ ID NO: 39464 - DNA, 21 bp, Artificial Sequence
  Description of Artificial Sequence: Synthetic oligonucleotide
cccaacctcaacagcagaggc

SEQ ID NO: 39465 - DNA, 21 bp, Artificial Sequence
  Description of Artificial Sequence: Synthetic oligonucleotide
agattcagcgacagcaacacc

SEQ ID NO: 39466 - DNA, 21 bp, Artificial Sequence
  Description of Artificial Sequence: Synthetic oligonucleotide
caacacaccaacaaccccgac

SEQ ID NO: 39467 - DNA, 21 bp, Artificial Sequence
  Description of Artificial Sequence: Synthetic oligonucleotide
gcccacaaaagcgccatgaac

SEQ ID NO: 39468 - DNA, 21 bp, Artificial Sequence
  Description of Artificial Sequence: Synthetic oligonucleotide
cgtgatacgagggagagtcag

SEQ ID NO: 39469 - DNA, 21 bp, Artificial Sequence
  Description of Artificial Sequence: Synthetic oligonucleotide
gggtcgaataggatgagtagt

SEQ ID NO: 39470 - DNA, 21 bp, Artificial Sequence
  Description of Artificial Sequence: Synthetic oligonucleotide
cctgggttgacgcctaagcag

SEQ ID NO: 39471 - DNA, 21 bp, Artificial Sequence
  Description of Artificial Sequence: Synthetic oligonucleotide
accaacggccaagccgccaga

SEQ ID NO: 39472 - DNA, 21 bp, Artificial Sequence
  Description of Artificial Sequence: Synthetic oligonucleotide
gccagcagcagagaaagcctc

SEQ ID NO: 39473 - DNA, 21 bp, Artificial Sequence
  Description of Artificial Sequence: Synthetic oligonucleotide
gccctcagaaccagcaactac

SEQ ID NO: 39474 - DNA, 21 bp, Artificial Sequence
  Description of Artificial Sequence: Synthetic oligonucleotide
ggcagacccggcatcagcaaa

SEQ ID NO: 39475 - DNA, 21 bp, Artificial Sequence
  Description of Artificial Sequence: Synthetic oligonucleotide
ccccaacacagaagcatcccc

SEQ ID NO: 39476 - DNA, 21 bp, Artificial Sequence
  Description of Artificial Sequence: Synthetic oligonucleotide
gccccccacagcgccgccaac

SEQ ID NO: 39477 - DNA, 21 bp, Artificial Sequence
  Description of Artificial Sequence: Synthetic oligonucleotide
aatggtgctagtccgaagcgt

SEQ ID NO: 39478 - DNA, 21 bp, Artificial Sequence
  Description of Artificial Sequence: Synthetic oligonucleotide
gtcagcatgaacaccaccaga

SEQ ID NO: 39479 - DNA, 21 bp, Artificial Sequence
  Description of Artificial Sequence: Synthetic oligonucleotide
atccccagcggcgtccacagc

SEQ ID NO: 39480 - DNA, 21 bp, Artificial Sequence
  Description of Artificial Sequence: Synthetic oligonucleotide
cccgtcaccagactcagcgaa

SEQ ID NO: 39481 - DNA, 21 bp, Artificial Sequence
  Description of Artificial Sequence: Synthetic oligonucleotide
aacgccaccagccccagaaaa

SEQ ID NO: 39482 - DNA, 21 bp, Artificial Sequence
  Description of Artificial Sequence: Synthetic oligonucleotide
gggaatcgtgggtctgttatt

SEQ ID NO: 39483 - DNA, 21 bp, Artificial Sequence
  Description of Artificial Sequence: Synthetic oligonucleotide
taccccaaaaccaacgtcacc

SEQ ID NO: 39484 - DNA, 21 bp, Artificial Sequence
  Description of Artificial Sequence: Synthetic oligonucleotide
caaagagtcaacaccgccagc

SEQ ID NO: 39485 - DNA, 21 bp, Artificial Sequence
  Description of Artificial Sequence: Synthetic oligonucleotide
tcgaatgataattcgttgagg

SEQ ID NO: 39486 - DNA, 21 bp, Artificial Sequence
  Description of Artificial Sequence: Synthetic oligonucleotide
aacggcagcggccaaatccaa

SEQ ID NO: 39487 - DNA, 21 bp, Artificial Sequence
  Description of Artificial Sequence: Synthetic oligonucleotide
catacgatgactgcgcggact

SEQ ID NO: 39488 - DNA, 21 bp, Artificial Sequence
  Description of Artificial Sequence: Synthetic oligonucleotide
atgagaagcaaagccagcatg

SEQ ID NO: 39489 - DNA, 21 bp, Artificial Sequence
  Description of Artificial Sequence: Synthetic oligonucleotide
gtgccgcaggtgagttctgct

SEQ ID NO: 39490 - DNA, 21 bp, Artificial Sequence
  Description of Artificial Sequence: Synthetic oligonucleotide
gccagcaccgccatcaaccaa

SEQ ID NO: 39491 - DNA, 21 bp, Artificial Sequence
  Description of Artificial Sequence: Synthetic oligonucleotide
agcagcaccaccagcaccagc

SEQ ID NO: 39492 - DNA, 21 bp, Artificial Sequence
  Description of Artificial Sequence: Synthetic oligonucleotide
accacctacggcagcctcggc

SEQ ID NO: 39493 - DNA, 21 bp, Artificial Sequence
  Description of Artificial Sequence: Synthetic oligonucleotide
ctccccaacagcagagccagc

SEQ ID NO: 39494 - DNA, 21 bp, Artificial Sequence
  Description of Artificial Sequence: Synthetic oligonucleotide
atgttccaaaaacaaggcaac

SEQ ID NO: 39495 - DNA, 21 bp, Artificial Sequence
  Description of Artificial Sequence: Synthetic oligonucleotide
ggcgaaagactcagcagaagc

SEQ ID NO: 39496 - DNA, 21 bp, Artificial Sequence
  Description of Artificial Sequence: Synthetic oligonucleotide
tcgatttcgcatacgcctgtg

SEQ ID NO: 39497 - DNA, 21 bp, Artificial Sequence
  Description of Artificial Sequence: Synthetic oligonucleotide
gtccaaagaagaagcaacgaa

SEQ ID NO: 39498 - DNA, 21 bp, Artificial Sequence
  Description of Artificial Sequence: Synthetic oligonucleotide
atgcttagttctagtcgtagt

SEQ ID NO: 39499 - DNA, 21 bp, Artificial Sequence
  Description of Artificial Sequence: Synthetic oligonucleotide
gttaatacgactcgtgctgag

SEQ ID NO: 39500 - DNA, 21 bp, Artificial Sequence
  Description of Artificial Sequence: Synthetic oligonucleotide
tatgctatggagagggttggg

SEQ ID NO: 39501 - DNA, 21 bp, Artificial Sequence
  Description of Artificial Sequence: Synthetic oligonucleotide
gacatcagcagaagccacggc

SEQ ID NO: 39502 - DNA, 21 bp, Artificial Sequence
  Description of Artificial Sequence: Synthetic oligonucleotide
atgggcagagaaatgaaaggc

SEQ ID NO: 39503 - DNA, 21 bp, Artificial Sequence
  Description of Artificial Sequence: Synthetic oligonucleotide
catgcttcggatcggaagatg

SEQ ID NO: 39504 - DNA, 21 bp, Artificial Sequence
  Description of Artificial Sequence: Synthetic oligonucleotide
ttgattaatgcgactcatcgg

SEQ ID NO: 39505 - DNA, 21 bp, Artificial Sequence
  Description of Artificial Sequence: Synthetic oligonucleotide
tggaatccgatgtcttctggt

SEQ ID NO: 39506 - DNA, 21 bp, Artificial Sequence
  Description of Artificial Sequence: Synthetic oligonucleotide
tccgatactaagccttttacg

SEQ ID NO: 39507 - DNA, 21 bp, Artificial Sequence
  Description of Artificial Sequence: Synthetic oligonucleotide
ggtccgattcggccgtttcag

SEQ ID NO: 39508 - DNA, 21 bp, Artificial Sequence
  Description of Artificial Sequence: Synthetic oligonucleotide
agcggcaccaccaccttcggc

SEQ ID NO: 39509 - DNA, 21 bp, Artificial Sequence
  Description of Artificial Sequence: Synthetic oligonucleotide
cctcaggagtctagggggatg

SEQ ID NO: 39510 - DNA, 21 bp, Artificial Sequence
  Description of Artificial Sequence: Synthetic oligonucleotide
tcggggagtacgaagggtcag

SEQ ID NO: 39511 - DNA, 21 bp, Artificial Sequence
  Description of Artificial Sequence: Synthetic oligonucleotide
ggcgccagcgaaaacatgaga

SEQ ID NO: 39512 - DNA, 21 bp, Artificial Sequence
  Description of Artificial Sequence: Synthetic oligonucleotide
ccgctgactacgaggccttcc

SEQ ID NO: 39513 - DNA, 21 bp, Artificial Sequence
  Description of Artificial Sequence: Synthetic oligonucleotide
gagaggtttactagttcttcg

SEQ ID NO: 39514 - DNA, 21 bp, Artificial Sequence
  Description of Artificial Sequence: Synthetic oligonucleotide
agcttcagccccgccagcaac

SEQ ID NO: 39515 - DNA, 21 bp, Artificial Sequence
  Description of Artificial Sequence: Synthetic oligonucleotide
gacagaagcgccaccgccacc

SEQ ID NO: 39516 - DNA, 21 bp, Artificial Sequence
  Description of Artificial Sequence: Synthetic oligonucleotide
tatggttcgcgtccgccttct

SEQ ID NO: 39517 - DNA, 21 bp, Artificial Sequence
  Description of Artificial Sequence: Synthetic oligonucleotide
caagtcaccgtcagacccgtc

SEQ ID NO: 39518 - DNA, 21 bp, Artificial Sequence
  Description of Artificial Sequence: Synthetic oligonucleotide
attgcttcgagtggtatgcat

SEQ ID NO: 39519 - DNA, 21 bp, Artificial Sequence
  Description of Artificial Sequence: Synthetic oligonucleotide
atgcttagtgggagtcggaat

SEQ ID NO: 39520 - DNA, 21 bp, Artificial Sequence
  Description of Artificial Sequence: Synthetic oligonucleotide
accagcagcggcaacctcagc

SEQ ID NO: 39521 - DNA, 21 bp, Artificial Sequence
  Description of Artificial Sequence: Synthetic oligonucleotide
cagcgggtgtcgagtactttg

SEQ ID NO: 39522 - DNA, 21 bp, Artificial Sequence
  Description of Artificial Sequence: Synthetic oligonucleotide
agttcttcgcatgctactcgt

SEQ ID NO: 39523 - DNA, 21 bp, Artificial Sequence
  Description of Artificial Sequence: Synthetic oligonucleotide
cccaccggcaaactcagacaa

SEQ ID NO: 39524 - DNA, 21 bp, Artificial Sequence
  Description of Artificial Sequence: Synthetic oligonucleotide
caagcccaacacaccagaagc

SEQ ID NO: 39525 - DNA, 21 bp, Artificial Sequence
  Description of Artificial Sequence: Synthetic oligonucleotide
ctgcctcgtggtgcgcatagt

SEQ ID NO: 39526 - DNA, 21 bp, Artificial Sequence
  Description of Artificial Sequence: Synthetic oligonucleotide
cagggtggtacgtcgcggcct

SEQ ID NO: 39527 - DNA, 21 bp, Artificial Sequence
  Description of Artificial Sequence: Synthetic oligonucleotide
ggccacggcaacaacggcgcc

SEQ ID NO: 39528 - DNA, 21 bp, Artificial Sequence
  Description of Artificial Sequence: Synthetic oligonucleotide
agcagcagcagaggccaaaac

SEQ ID NO: 39529 - DNA, 21 bp, Artificial Sequence
  Description of Artificial Sequence: Synthetic oligonucleotide
cctcatacgatggagaggacg

SEQ ID NO: 39530 - DNA, 21 bp, Artificial Sequence
  Description of Artificial Sequence: Synthetic oligonucleotide
gcgattcggtcggattatgtt

SEQ ID NO: 39531 - DNA, 21 bp, Artificial Sequence
  Description of Artificial Sequence: Synthetic oligonucleotide
ggtgatactcgtctgaatgcg

SEQ ID NO: 39532 - DNA, 21 bp, Artificial Sequence
  Description of Artificial Sequence: Synthetic oligonucleotide
acccccaccaccagcgccaac

SEQ ID NO: 39533 - DNA, 21 bp, Artificial Sequence
  Description of Artificial Sequence: Synthetic oligonucleotide
ccgcatgttgctcggcagatg

SEQ ID NO: 39534 - DNA, 21 bp, Artificial Sequence
  Description of Artificial Sequence: Synthetic oligonucleotide
gtgggtggtggtcgtgataat

SEQ ID NO: 39535 - DNA, 21 bp, Artificial Sequence
  Description of Artificial Sequence: Synthetic oligonucleotide
cataatacggctcatgcttcg

SEQ ID NO: 39536 - DNA, 21 bp, Artificial Sequence
  Description of Artificial Sequence: Synthetic oligonucleotide
caaaacatcggcagacccagc

SEQ ID NO: 39537 - DNA, 21 bp, Artificial Sequence
  Description of Artificial Sequence: Synthetic oligonucleotide
ctcaaacccgacagaaacgcc

SEQ ID NO: 39538 - DNA, 21 bp, Artificial Sequence
  Description of Artificial Sequence: Synthetic oligonucleotide
tttcatgcgaatagtactgtg

SEQ ID NO: 39539 - DNA, 21 bp, Artificial Sequence
  Description of Artificial Sequence: Synthetic oligonucleotide
tttgggaggactaatcagggt

SEQ ID NO: 39540 - DNA, 21 bp, Artificial Sequence
  Description of Artificial Sequence: Synthetic oligonucleotide
atgagaagcgaacccatcgcc

SEQ ID NO: 39541 - DNA, 21 bp, Artificial Sequence
  Description of Artificial Sequence: Synthetic oligonucleotide
cctcttgtttcggttgggagg

SEQ ID NO: 39542 - DNA, 21 bp, Artificial Sequence
  Description of Artificial Sequence: Synthetic oligonucleotide
cctctgcgtgatagtatgccg

SEQ ID NO: 39543 - DNA, 21 bp, Artificial Sequence
  Description of Artificial Sequence: Synthetic oligonucleotide
aatctgaattcgttgaagatg

SEQ ID NO: 39544 - DNA, 21 bp, Artificial Sequence
  Description of Artificial Sequence: Synthetic oligonucleotide
cctgtgctgggttctaggtat

SEQ ID NO: 39545 - DNA, 21 bp, Artificial Sequence
  Description of Artificial Sequence: Synthetic oligonucleotide
gcgcaggctcggcagacggct

SEQ ID NO: 39546 - DNA, 21 bp, Artificial Sequence
  Description of Artificial Sequence: Synthetic oligonucleotide
cccagaagcagcggcggcttc

SEQ ID NO: 39547 - DNA, 21 bp, Artificial Sequence
  Description of Artificial Sequence: Synthetic oligonucleotide
gggaagtctcagatgcagttg

SEQ ID NO: 39548 - DNA, 21 bp, Artificial Sequence
  Description of Artificial Sequence: Synthetic oligonucleotide
tcgaatactaatagtgcgaat

SEQ ID NO: 39549 - DNA, 21 bp, Artificial Sequence
  Description of Artificial Sequence: Synthetic oligonucleotide
tatcgggctacgtcgggtcag

SEQ ID NO: 39550 - DNA, 21 bp, Artificial Sequence
  Description of Artificial Sequence: Synthetic oligonucleotide
agttcgttgaagccgactctg

SEQ ID NO: 39551 - DNA, 21 bp, Artificial Sequence
  Description of Artificial Sequence: Synthetic oligonucleotide
cggtcgactgtgtctccgaat

SEQ ID NO: 39552 - DNA, 21 bp, Artificial Sequence
  Description of Artificial Sequence: Synthetic oligonucleotide
tgtagtgggtctccttgtcgt

SEQ ID NO: 39553 - DNA, 21 bp, Artificial Sequence
  Description of Artificial Sequence: Synthetic oligonucleotide
agcagcagaacccaaagcctc

SEQ ID NO: 39554 - DNA, 21 bp, Artificial Sequence
  Description of Artificial Sequence: Synthetic oligonucleotide
agcaccaaccccgccaacaga

SEQ ID NO: 39555 - DNA, 21 bp, Artificial Sequence
  Description of Artificial Sequence: Synthetic oligonucleotide
gctcctcctgcgacggcgccg

SEQ ID NO: 39556 - DNA, 21 bp, Artificial Sequence
  Description of Artificial Sequence: Synthetic oligonucleotide
tattcggataataagactact

SEQ ID NO: 39557 - DNA, 21 bp, Artificial Sequence
  Description of Artificial Sequence: Synthetic oligonucleotide
atgcccctcaaaccccacctc

SEQ ID NO: 39558 - DNA, 21 bp, Artificial Sequence
  Description of Artificial Sequence: Synthetic oligonucleotide
tctgattctcggaatcctgtt

SEQ ID NO: 39559 - DNA, 21 bp, Artificial Sequence
  Description of Artificial Sequence: Synthetic oligonucleotide
ttcctcagcagcagagccagc

SEQ ID NO: 39560 - DNA, 21 bp, Artificial Sequence
  Description of Artificial Sequence: Synthetic oligonucleotide
cacagagtcgaaggcagcctc

SEQ ID NO: 39561 - DNA, 21 bp, Artificial Sequence
  Description of Artificial Sequence: Synthetic oligonucleotide
tctagtgttcggccgtatgct

SEQ ID NO: 39562 - DNA, 21 bp, Artificial Sequence
  Description of Artificial Sequence: Synthetic oligonucleotide
accgtcctcaccaaacaacac

SEQ ID NO: 39563 - DNA, 21 bp, Artificial Sequence
  Description of Artificial Sequence: Synthetic oligonucleotide
aataggcaggttcctggtttg

SEQ ID NO: 39564 - DNA, 21 bp, Artificial Sequence
  Description of Artificial Sequence: Synthetic oligonucleotide
agtcatatgacgggggttact

SEQ ID NO: 39565 - DNA, 21 bp, Artificial Sequence
  Description of Artificial Sequence: Synthetic oligonucleotide
cgtgtgcttacttctaatgcg

SEQ ID NO: 39566 - DNA, 21 bp, Artificial Sequence
  Description of Artificial Sequence: Synthetic oligonucleotide
ctgattaggtcttcgtctatt

SEQ ID NO: 39567 - DNA, 21 bp, Artificial Sequence
  Description of Artificial Sequence: Synthetic oligonucleotide
aatattaagggtgcttcgacg

SEQ ID NO: 39568 - DNA, 21 bp, Artificial Sequence
  Description of Artificial Sequence: Synthetic oligonucleotide
tctgataggtcggttgatggg

SEQ ID NO: 39569 - DNA, 21 bp, Artificial Sequence
  Description of Artificial Sequence: Synthetic oligonucleotide
cgtaatgtttcgcagccgatt

SEQ ID NO: 39570 - DNA, 21 bp, Artificial Sequence
  Description of Artificial Sequence: Synthetic oligonucleotide
catggggtgggtagtatggtg

SEQ ID NO: 39571 - DNA, 21 bp, Artificial Sequence
  Description of Artificial Sequence: Synthetic oligonucleotide
gcctacagcaacatccaaaac

SEQ ID NO: 39572 - DNA, 21 bp, Artificial Sequence
  Description of Artificial Sequence: Synthetic oligonucleotide
accctccccaccaaatacccc

SEQ ID NO: 39573 - DNA, 21 bp, Artificial Sequence
  Description of Artificial Sequence: Synthetic oligonucleotide
gccgaatacaccggcatggcc

SEQ ID NO: 39574 - DNA, 21 bp, Artificial Sequence
  Description of Artificial Sequence: Synthetic oligonucleotide
tatgggtttagttctgttaat

SEQ ID NO: 39575 - DNA, 21 bp, Artificial Sequence
  Description of Artificial Sequence: Synthetic oligonucleotide
tttaggtataaggagacgctg

SEQ ID NO: 39576 - DNA, 21 bp, Artificial Sequence
  Description of Artificial Sequence: Synthetic oligonucleotide
cctcggactggtacgttgatg

SEQ ID NO: 39577 - DNA, 21 bp, Artificial Sequence
  Description of Artificial Sequence: Synthetic oligonucleotide
tgtattactaagaatcttgcg

SEQ ID NO: 39578 - DNA, 21 bp, Artificial Sequence
  Description of Artificial Sequence: Synthetic oligonucleotide
agcagcagcttcaccaacaaa

SEQ ID NO: 39579 - DNA, 21 bp, Artificial Sequence
  Description of Artificial Sequence: Synthetic oligonucleotide
catacggatattaatcatcag

SEQ ID NO: 39580 - DNA, 21 bp, Artificial Sequence
  Description of Artificial Sequence: Synthetic oligonucleotide
gctgggcgggcgtctaatact

SEQ ID NO: 39581 - DNA, 21 bp, Artificial Sequence
  Description of Artificial Sequence: Synthetic oligonucleotide
tctatttcgcatgctcgtgag

SEQ ID NO: 39582 - DNA, 21 bp, Artificial Sequence
  Description of Artificial Sequence: Synthetic oligonucleotide
cccgtcaacagcgtcagcaaa

SEQ ID NO: 39583 - DNA, 21 bp, Artificial Sequence
  Description of Artificial Sequence: Synthetic oligonucleotide
gacaaaaccaccagagtctac

SEQ ID NO: 39584 - DNA, 21 bp, Artificial Sequence
  Description of Artificial Sequence: Synthetic oligonucleotide
attacgccgggtgggcattcg

SEQ ID NO: 39585 - DNA, 21 bp, Artificial Sequence
  Description of Artificial Sequence: Synthetic oligonucleotide
gttcattcttcgagtacgaag

SEQ ID NO: 39586 - DNA, 21 bp, Artificial Sequence
  Description of Artificial Sequence: Synthetic oligonucleotide
ctcccccaaagaggcgtcagc

SEQ ID NO: 39587 - DNA, 21 bp, Artificial Sequence
  Description of Artificial Sequence: Synthetic oligonucleotide
ggccccatgagacccttccaa

SEQ ID NO: 39588 - DNA, 21 bp, Artificial Sequence
  Description of Artificial Sequence: Synthetic oligonucleotide
gatactacgatttctaagggt

SEQ ID NO: 39589 - DNA, 21 bp, Artificial Sequence
  Description of Artificial Sequence: Synthetic oligonucleotide
catgtgccgtcgaagcttgct

SEQ ID NO: 39590 - DNA, 21 bp, Artificial Sequence
  Description of Artificial Sequence: Synthetic oligonucleotide
ccgaatcatcagagtcttact

SEQ ID NO: 39591 - DNA, 21 bp, Artificial Sequence
  Description of Artificial Sequence: Synthetic oligonucleotide
ggtcaggtttctcagatgaag

SEQ ID NO: 39592 - DNA, 21 bp, Artificial Sequence
  Description of Artificial Sequence: Synthetic oligonucleotide
accagcaccagaaccgccccc

SEQ ID NO: 39593 - DNA, 21 bp, Artificial Sequence
  Description of Artificial Sequence: Synthetic oligonucleotide
ctcagcagcgacaaaaacgtc

SEQ ID NO: 39594 - DNA, 21 bp, Artificial Sequence
  Description of Artificial Sequence: Synthetic oligonucleotide
catcagcgtaatgttaattcg

SEQ ID NO: 39595 - DNA, 21 bp, Artificial Sequence
  Description of Artificial Sequence: Synthetic oligonucleotide
tctaagccggctaataatgtt

SEQ ID NO: 39596 - DNA, 21 bp, Artificial Sequence
  Description of Artificial Sequence: Synthetic oligonucleotide
caaaaaaccaccatcgacggc

SEQ ID NO: 39597 - DNA, 21 bp, Artificial Sequence
  Description of Artificial Sequence: Synthetic oligonucleotide
atgatggtgagttctcgttcg

SEQ ID NO: 39598 - DNA, 21 bp, Artificial Sequence
  Description of Artificial Sequence: Synthetic oligonucleotide
ccgcagactaataatcctgat

SEQ ID NO: 39599 - DNA, 21 bp, Artificial Sequence
  Description of Artificial Sequence: Synthetic oligonucleotide
cgggctgatcatttggggcgt

SEQ ID NO: 39600 - DNA, 21 bp, Artificial Sequence
  Description of Artificial Sequence: Synthetic oligonucleotide
cccagcaaaatcagcaacgcc

SEQ ID NO: 39601 - DNA, 21 bp, Artificial Sequence
  Description of Artificial Sequence: Synthetic oligonucleotide
ccccaacccttcggcaaatac

SEQ ID NO: 39602 - DNA, 21 bp, Artificial Sequence
  Description of Artificial Sequence: Synthetic oligonucleotide
agaagcaccctcggcagcggc

SEQ ID NO: 39603 - DNA, 21 bp, Artificial Sequence
  Description of Artificial Sequence: Synthetic oligonucleotide
gctaggactaagggtaatgtg

SEQ ID NO: 39604 - DNA, 21 bp, Artificial Sequence
  Description of Artificial Sequence: Synthetic oligonucleotide
gagccgcctcataagattttg

SEQ ID NO: 39605 - DNA, 21 bp, Artificial Sequence
  Description of Artificial Sequence: Synthetic oligonucleotide
gccaccggcaacggcagaggc

SEQ ID NO: 39606 - DNA, 21 bp, Artificial Sequence
  Description of Artificial Sequence: Synthetic oligonucleotide
ttcctcggcaaaagcggcgcc

SEQ ID NO: 39607 - DNA, 21 bp, Artificial Sequence
  Description of Artificial Sequence: Synthetic oligonucleotide
ggtagtacttcgggtctggat

SEQ ID NO: 39608 - DNA, 21 bp, Artificial Sequence
  Description of Artificial Sequence: Synthetic oligonucleotide
agaggcagcagcagccccagc

SEQ ID NO: 39609 - DNA, 21 bp, Artificial Sequence
  Description of Artificial Sequence: Synthetic oligonucleotide
cggcctattgctagttcgggt

SEQ ID NO: 39610 - DNA, 21 bp, Artificial Sequence
  Description of Artificial Sequence: Synthetic oligonucleotide
catgtgactaagtctacggct

SEQ ID NO: 39611 - DNA, 21 bp, Artificial Sequence
  Description of Artificial Sequence: Synthetic oligonucleotide
gccaccagccccagactcagc

SEQ ID NO: 39612 - DNA, 21 bp, Artificial Sequence
  Description of Artificial Sequence: Synthetic oligonucleotide
cgttctgggacttctcattcg

SEQ ID NO: 39613 - DNA, 21 bp, Artificial Sequence
  Description of Artificial Sequence: Synthetic oligonucleotide
aacggcagcggcctcaaccaa

SEQ ID NO: 39614 - DNA, 21 bp, Artificial Sequence
  Description of Artificial Sequence: Synthetic oligonucleotide
atgatggggggtgttaagaat

SEQ ID NO: 39615 - DNA, 21 bp, Artificial Sequence
  Description of Artificial Sequence: Synthetic oligonucleotide
aagaggccgtcgcctgatatc

SEQ ID NO: 39616 - DNA, 21 bp, Artificial Sequence
  Description of Artificial Sequence: Synthetic oligonucleotide
tcttatgcgaagttgactgcg

SEQ ID NO: 39617 - DNA, 21 bp, Artificial Sequence
  Description of Artificial Sequence: Synthetic oligonucleotide
agaatcaccctcaacagcgcc

SEQ ID NO: 39618 - DNA, 21 bp, Artificial Sequence
  Description of Artificial Sequence: Synthetic oligonucleotide
tatagtgggcttactggttcg

SEQ ID NO: 39619 - DNA, 21 bp, Artificial Sequence
  Description of Artificial Sequence: Synthetic oligonucleotide
ggtgctgggacgagtcttcat

SEQ ID NO: 39620 - DNA, 21 bp, Artificial Sequence
  Description of Artificial Sequence: Synthetic oligonucleotide
aatctgggtcggcaggttggg

SEQ ID NO: 39621 - DNA, 21 bp, Artificial Sequence
  Description of Artificial Sequence: Synthetic oligonucleotide
attaggtcgaaggagtctgcg

SEQ ID NO: 39622 - DNA, 21 bp, Artificial Sequence
  Description of Artificial Sequence: Synthetic oligonucleotide
ctccacgacggccaaaccaga

SEQ ID NO: 39623 - DNA, 21 bp, Artificial Sequence
  Description of Artificial Sequence: Synthetic oligonucleotide
aaagaaaaccccgtcagaagc

SEQ ID NO: 39624 - DNA, 21 bp, Artificial Sequence
  Description of Artificial Sequence: Synthetic oligonucleotide
agttcgaagggtattttggct

SEQ ID NO: 39625 - DNA, 21 bp, Artificial Sequence
  Description of Artificial Sequence: Synthetic oligonucleotide
agaaccctcagaagcgtcgac

SEQ ID NO: 39626 - DNA, 21 bp, Artificial Sequence
  Description of Artificial Sequence: Synthetic oligonucleotide
ggttatactgataagcatgtg

SEQ ID NO: 39627 - DNA, 21 bp, Artificial Sequence
  Description of Artificial Sequence: Synthetic oligonucleotide
ggccaaggcgtcaccgccaaa

SEQ ID NO: 39628 - DNA, 21 bp, Artificial Sequence
  Description of Artificial Sequence: Synthetic oligonucleotide
attcgggctgaggtgagtggg

SEQ ID NO: 39629 - DNA, 21 bp, Artificial Sequence
  Description of Artificial Sequence: Synthetic oligonucleotide
gggctgaggacttcgtctcat

SEQ ID NO: 39630 - DNA, 21 bp, Artificial Sequence
  Description of Artificial Sequence: Synthetic oligonucleotide
ggggtgcggggtctgaatgtt

SEQ ID NO: 39631 - DNA, 21 bp, Artificial Sequence
  Description of Artificial Sequence: Synthetic oligonucleotide
aaagtcggcagccccaccgcc

SEQ ID NO: 39632 - DNA, 21 bp, Artificial Sequence
  Description of Artificial Sequence: Synthetic oligonucleotide
cggggtagtcctcagtctcag

SEQ ID NO: 39633 - DNA, 21 bp, Artificial Sequence
  Description of Artificial Sequence: Synthetic oligonucleotide
gacagaaaacacaccagcacc

SEQ ID NO: 39634 - DNA, 21 bp, Artificial Sequence
  Description of Artificial Sequence: Synthetic oligonucleotide
gctccttcggcgcggccgagt

SEQ ID NO: 39635 - DNA, 21 bp, Artificial Sequence
  Description of Artificial Sequence: Synthetic oligonucleotide
ggcttcaccggcagccacgtc

SEQ ID NO: 39636 - DNA, 21 bp, Artificial Sequence
  Description of Artificial Sequence: Synthetic oligonucleotide
cagtctggtaatacgattcag

SEQ ID NO: 39637 - DNA, 21 bp, Artificial Sequence
  Description of Artificial Sequence: Synthetic oligonucleotide
agcaccctcagaaacagcacc

SEQ ID NO: 39638 - DNA, 21 bp, Artificial Sequence
  Description of Artificial Sequence: Synthetic oligonucleotide
agagtcgtcaacagaggcgac

SEQ ID NO: 39639 - DNA, 21 bp, Artificial Sequence
  Description of Artificial Sequence: Synthetic oligonucleotide
tggcagacgggttcgactatg

SEQ ID NO: 39640 - DNA, 21 bp, Artificial Sequence
  Description of Artificial Sequence: Synthetic oligonucleotide
gaaaacagaaccagcgtccaa

SEQ ID NO: 39641 - DNA, 21 bp, Artificial Sequence
  Description of Artificial Sequence: Synthetic oligonucleotide
catttgcctcagactcagagt

SEQ ID NO: 39642 - DNA, 21 bp, Artificial Sequence
  Description of Artificial Sequence: Synthetic oligonucleotide
accgcccccagccacaccaac

SEQ ID NO: 39643 - DNA, 21 bp, Artificial Sequence
  Description of Artificial Sequence: Synthetic oligonucleotide
gctaatatgggtctggttaag

SEQ ID NO: 39644 - DNA, 21 bp, Artificial Sequence
  Description of Artificial Sequence: Synthetic oligonucleotide
acgcatggtcctaatgtgcgt

SEQ ID NO: 39645 - DNA, 21 bp, Artificial Sequence
  Description of Artificial Sequence: Synthetic oligonucleotide
gatcgtcgttctgctccttct

SEQ ID NO: 39646 - DNA, 21 bp, Artificial Sequence
  Description of Artificial Sequence: Synthetic oligonucleotide
gcgaagactcagagtgtgaat

SEQ ID NO: 39647 - DNA, 21 bp, Artificial Sequence
  Description of Artificial Sequence: Synthetic oligonucleotide
gctcagcctactgggactgcg

SEQ ID NO: 39648 - DNA, 21 bp, Artificial Sequence
  Description of Artificial Sequence: Synthetic oligonucleotide
agcagaaacagcaaacccgtc

SEQ ID NO: 39649 - DNA, 21 bp, Artificial Sequence
  Description of Artificial Sequence: Synthetic oligonucleotide
cagcggggtacgaagttggct

SEQ ID NO: 39650 - DNA, 21 bp, Artificial Sequence
  Description of Artificial Sequence: Synthetic oligonucleotide
ggtgtgctgggttctaagaat

SEQ ID NO: 39651 - DNA, 21 bp, Artificial Sequence
  Description of Artificial Sequence: Synthetic oligonucleotide
actcctggggcttctttgtcg

SEQ ID NO: 39652 - DNA, 21 bp, Artificial Sequence
  Description of Artificial Sequence: Synthetic oligonucleotide
aagcctcaggggagtctggtt

SEQ ID NO: 39653 - DNA, 21 bp, Artificial Sequence
  Description of Artificial Sequence: Synthetic oligonucleotide
cctgggtctattggtcagcat

SEQ ID NO: 39654 - DNA, 21 bp, Artificial Sequence
  Description of Artificial Sequence: Synthetic oligonucleotide
ttttcgcttaagggtgggaat

SEQ ID NO: 39655 - DNA, 21 bp, Artificial Sequence
  Description of Artificial Sequence: Synthetic oligonucleotide
ctggcgcaggagcgtggtact

SEQ ID NO: 39656 - DNA, 21 bp, Artificial Sequence
  Description of Artificial Sequence: Synthetic oligonucleotide
gtccccagccaaagcctccac

SEQ ID NO: 39657 - DNA, 21 bp, Artificial Sequence
  Description of Artificial Sequence: Synthetic oligonucleotide
gcttttccggcttctaattgt

SEQ ID NO: 39658 - DNA, 21 bp, Artificial Sequence
  Description of Artificial Sequence: Synthetic oligonucleotide
tgtaggagtgctccgacgcgg

SEQ ID NO: 39659 - DNA, 21 bp, Artificial Sequence
  Description of Artificial Sequence: Synthetic oligonucleotide
ggcggcagcgccaccgccgtc

SEQ ID NO: 39660 - DNA, 21 bp, Artificial Sequence
  Description of Artificial Sequence: Synthetic oligonucleotide
aagattccgaagggtacgagt

SEQ ID NO: 39661 - DNA, 21 bp, Artificial Sequence
  Description of Artificial Sequence: Synthetic oligonucleotide
caaaaacaaatcaaagtcggc

SEQ ID NO: 39662 - DNA, 21 bp, Artificial Sequence
  Description of Artificial Sequence: Synthetic oligonucleotide
aacggcagcgccagaatgacc

SEQ ID NO: 39663 - DNA, 21 bp, Artificial Sequence
  Description of Artificial Sequence: Synthetic oligonucleotide
gtcgccgccagagccagcatg

SEQ ID NO: 39664 - DNA, 21 bp, Artificial Sequence
  Description of Artificial Sequence: Synthetic oligonucleotide
caagtcagccccgccagcaga

SEQ ID NO: 39665 - DNA, 21 bp, Artificial Sequence
  Description of Artificial Sequence: Synthetic oligonucleotide
gggattcagagtgggcttggt

SEQ ID NO: 39666 - DNA, 21 bp, Artificial Sequence
  Description of Artificial Sequence: Synthetic oligonucleotide
tataagccggggttgcagtct

SEQ ID NO: 39667 - DNA, 21 bp, Artificial Sequence
  Description of Artificial Sequence: Synthetic oligonucleotide
agaagcgtcggcaacagcatg

SEQ ID NO: 39668 - DNA, 21 bp, Artificial Sequence
  Description of Artificial Sequence: Synthetic oligonucleotide
tgcctcagcagcagcgccaaa

SEQ ID NO: 39669 - DNA, 21 bp, Artificial Sequence
  Description of Artificial Sequence: Synthetic oligonucleotide
gataatccgaggcaggcttat

SEQ ID NO: 39670 - DNA, 21 bp, Artificial Sequence
  Description of Artificial Sequence: Synthetic oligonucleotide
ttcaacggcctcagcacccaa

SEQ ID NO: 39671 - DNA, 21 bp, Artificial Sequence
  Description of Artificial Sequence: Synthetic oligonucleotide
agtgtttctactaagagtgct

SEQ ID NO: 39672 - DNA, 21 bp, Artificial Sequence
  Description of Artificial Sequence: Synthetic oligonucleotide
acgtctactagtccgatgaag

SEQ ID NO: 39673 - DNA, 21 bp, Artificial Sequence
  Description of Artificial Sequence: Synthetic oligonucleotide
gctaggaatccgcaggtttcg

SEQ ID NO: 39674 - DNA, 21 bp, Artificial Sequence
  Description of Artificial Sequence: Synthetic oligonucleotide
ctgcctacggttactcgttct

SEQ ID NO: 39675 - DNA, 21 bp, Artificial Sequence
  Description of Artificial Sequence: Synthetic oligonucleotide
cggtctcatgagagtatgcat

SEQ ID NO: 39676 - DNA, 21 bp, Artificial Sequence
  Description of Artificial Sequence: Synthetic oligonucleotide
atgagtacgcatagttcgggt

SEQ ID NO: 39677 - DNA, 21 bp, Artificial Sequence
  Description of Artificial Sequence: Synthetic oligonucleotide
cacagaaccagccccgtcagc

SEQ ID NO: 39678 - DNA, 21 bp, Artificial Sequence
  Description of Artificial Sequence: Synthetic oligonucleotide
atcaccagcgccagcccctgc

SEQ ID NO: 39679 - DNA, 21 bp, Artificial Sequence
  Description of Artificial Sequence: Synthetic oligonucleotide
tcgagtatgcgtgagtcgagt

SEQ ID NO: 39680 - DNA, 21 bp, Artificial Sequence
  Description of Artificial Sequence: Synthetic oligonucleotide
agcggcttccaacacaccaaa

SEQ ID NO: 39681 - DNA, 21 bp, Artificial Sequence
  Description of Artificial Sequence: Synthetic oligonucleotide
agcggcatgagcagacacgtc

SEQ ID NO: 39682 - DNA, 21 bp, Artificial Sequence
  Description of Artificial Sequence: Synthetic oligonucleotide
agtcggaatgggggtccgctg

SEQ ID NO: 39683 - DNA, 21 bp, Artificial Sequence
  Description of Artificial Sequence: Synthetic oligonucleotide
ggttcgaatagtgcttatacg

SEQ ID NO: 39684 - DNA, 21 bp, Artificial Sequence
  Description of Artificial Sequence: Synthetic oligonucleotide
gtgcaggggacgggtaatacg

SEQ ID NO: 39685 - DNA, 21 bp, Artificial Sequence
  Description of Artificial Sequence: Synthetic oligonucleotide
atggtttcgtctaagagtagt

SEQ ID NO: 39686 - DNA, 21 bp, Artificial Sequence
  Description of Artificial Sequence: Synthetic oligonucleotide
aggagtaatactccgccgaag

SEQ ID NO: 39687 - DNA, 21 bp, Artificial Sequence
  Description of Artificial Sequence: Synthetic oligonucleotide
gccatgagcagcaacaacggc

SEQ ID NO: 39688 - DNA, 21 bp, Artificial Sequence
  Description of Artificial Sequence: Synthetic oligonucleotide
gacaaagccagcagcgtcagc

SEQ ID NO: 39689 - DNA, 21 bp, Artificial Sequence
  Description of Artificial Sequence: Synthetic oligonucleotide
tgcagcccccccaccagaggc

SEQ ID NO: 39690 - DNA, 21 bp, Artificial Sequence
  Description of Artificial Sequence: Synthetic oligonucleotide
atgaatggtaaggatgtggtg

SEQ ID NO: 39691 - DNA, 21 bp, Artificial Sequence
  Description of Artificial Sequence: Synthetic oligonucleotide
agaacccaaagcctcaccgcc

SEQ ID NO: 39692 - DNA, 21 bp, Artificial Sequence
  Description of Artificial Sequence: Synthetic oligonucleotide
agaagcaccgacacccacggc

SEQ ID NO: 39693 - DNA, 21 bp, Artificial Sequence
  Description of Artificial Sequence: Synthetic oligonucleotide
ggttctgatcagcgtcgtatg

SEQ ID NO: 39694 - DNA, 21 bp, Artificial Sequence
  Description of Artificial Sequence: Synthetic oligonucleotide
gatcatcgtagtaaggttttg

SEQ ID NO: 39695 - DNA, 21 bp, Artificial Sequence
  Description of Artificial Sequence: Synthetic oligonucleotide
tcttcgcttactactccgcat

SEQ ID NO: 39696 - DNA, 21 bp, Artificial Sequence
  Description of Artificial Sequence: Synthetic oligonucleotide
cttgctagtggtactccttcg

SEQ ID NO: 39697 - DNA, 21 bp, Artificial Sequence
  Description of Artificial Sequence: Synthetic oligonucleotide
ctggttcggcagtcttctgct

SEQ ID NO: 39698 - DNA, 21 bp, Artificial Sequence
  Description of Artificial Sequence: Synthetic oligonucleotide
gctagtccgaatcggggtagt

SEQ ID NO: 39699 - DNA, 21 bp, Artificial Sequence
  Description of Artificial Sequence: Synthetic oligonucleotide
tctcctcatactcatcagaag

SEQ ID NO: 39700 - DNA, 21 bp, Artificial Sequence
  Description of Artificial Sequence: Synthetic oligonucleotide
gtcagaaccggcaccagcaac

SEQ ID NO: 39701 - DNA, 21 bp, Artificial Sequence
  Description of Artificial Sequence: Synthetic oligonucleotide
cccctcaacacccaccaaagc

SEQ ID NO: 39702 - DNA, 21 bp, Artificial Sequence
  Description of Artificial Sequence: Synthetic oligonucleotide
gggaatcatacgacgggtaag

SEQ ID NO: 39703 - DNA, 21 bp, Artificial Sequence
  Description of Artificial Sequence: Synthetic oligonucleotide
tcgcagcctgctggtcgtagt

SEQ ID NO: 39704 - DNA, 21 bp, Artificial Sequence
  Description of Artificial Sequence: Synthetic oligonucleotide
agcctccaaggcaacagaatg

SEQ ID NO: 39705 - DNA, 21 bp, Artificial Sequence
  Description of Artificial Sequence: Synthetic oligonucleotide
accccccacggcaccagagtc

SEQ ID NO: 39706 - DNA, 21 bp, Artificial Sequence
  Description of Artificial Sequence: Synthetic oligonucleotide
agccaacccatcggcgccaga

SEQ ID NO: 39707 - DNA, 21 bp, Artificial Sequence
  Description of Artificial Sequence: Synthetic oligonucleotide
gtcggcctcagaagcaacacc

SEQ ID NO: 39708 - DNA, 21 bp, Artificial Sequence
  Description of Artificial Sequence: Synthetic oligonucleotide
gccagaaaccccaccagcacc

SEQ ID NO: 39709 - DNA, 21 bp, Artificial Sequence
  Description of Artificial Sequence: Synthetic oligonucleotide
atcaccgccaccgccgaaagc

SEQ ID NO: 39710 - DNA, 21 bp, Artificial Sequence
  Description of Artificial Sequence: Synthetic oligonucleotide
gccagcaccaacagcatgcaa

SEQ ID NO: 39711 - DNA, 21 bp, Artificial Sequence
  Description of Artificial Sequence: Synthetic oligonucleotide
aatgaggctcggtcggcgaat

SEQ ID NO: 39712 - DNA, 21 bp, Artificial Sequence
  Description of Artificial Sequence: Synthetic oligonucleotide
agaagcagcgacagaagcgcc

SEQ ID NO: 39713 - DNA, 21 bp, Artificial Sequence
  Description of Artificial Sequence: Synthetic oligonucleotide
cgtggttctgcgaattttctt

SEQ ID NO: 39714 - DNA, 21 bp, Artificial Sequence
  Description of Artificial Sequence: Synthetic oligonucleotide
cttactccgaggggtcagatg

SEQ ID NO: 39715 - DNA, 21 bp, Artificial Sequence
  Description of Artificial Sequence: Synthetic oligonucleotide
aatgggaattcgcttacgagg

SEQ ID NO: 39716 - DNA, 21 bp, Artificial Sequence
  Description of Artificial Sequence: Synthetic oligonucleotide
gcctacagcgaaaccagaggc

SEQ ID NO: 39717 - DNA, 21 bp, Artificial Sequence
  Description of Artificial Sequence: Synthetic oligonucleotide
aacatcgcccaaaaagacctc

SEQ ID NO: 39718 - DNA, 21 bp, Artificial Sequence
  Description of Artificial Sequence: Synthetic oligonucleotide
tattcgacgagtgagtctaag

SEQ ID NO: 39719 - DNA, 21 bp, Artificial Sequence
  Description of Artificial Sequence: Synthetic oligonucleotide
atggggaatcctcgtcatgtt

SEQ ID NO: 39720 - DNA, 21 bp, Artificial Sequence
  Description of Artificial Sequence: Synthetic oligonucleotide
agtaggtcgaaggagtctgcg

SEQ ID NO: 39721 - DNA, 21 bp, Artificial Sequence
  Description of Artificial Sequence: Synthetic oligonucleotide
caagccaacaccatcggcaaa

SEQ ID NO: 39722 - DNA, 21 bp, Artificial Sequence
  Description of Artificial Sequence: Synthetic oligonucleotide
accagcgcccccagaagctgc

SEQ ID NO: 39723 - DNA, 21 bp, Artificial Sequence
  Description of Artificial Sequence: Synthetic oligonucleotide
tatattaatagtccttcgaat

SEQ ID NO: 39724 - DNA, 21 bp, Artificial Sequence
  Description of Artificial Sequence: Synthetic oligonucleotide
aataagtcgaatacgtttctt

SEQ ID NO: 39725 - DNA, 21 bp, Artificial Sequence
  Description of Artificial Sequence: Synthetic oligonucleotide
gctcgggatgagagggctttt

SEQ ID NO: 39726 - DNA, 21 bp, Artificial Sequence
  Description of Artificial Sequence: Synthetic oligonucleotide
aatcctggggagtcgcatcgt

SEQ ID NO: 39727 - DNA, 21 bp, Artificial Sequence
  Description of Artificial Sequence: Synthetic oligonucleotide
agccacagcagcccctacaaa

SEQ ID NO: 39728 - DNA, 21 bp, Artificial Sequence
  Description of Artificial Sequence: Synthetic oligonucleotide
agtacttctagttcggctagt

SEQ ID NO: 39729 - DNA, 21 bp, Artificial Sequence
  Description of Artificial Sequence: Synthetic oligonucleotide
atcggccaaagcaccaacggc

SEQ ID NO: 39730 - DNA, 21 bp, Artificial Sequence
  Description of Artificial Sequence: Synthetic oligonucleotide
actatgccggctcagaggagt

SEQ ID NO: 39731 - DNA, 21 bp, Artificial Sequence
  Description of Artificial Sequence: Synthetic oligonucleotide
tgcatcggcaacaaaaccaac

SEQ ID NO: 39732 - DNA, 21 bp, Artificial Sequence
  Description of Artificial Sequence: Synthetic oligonucleotide
ccggctgataatcataggccg

SEQ ID NO: 39733 - DNA, 21 bp, Artificial Sequence
  Description of Artificial Sequence: Synthetic oligonucleotide
aatagtaatctgtcgactcag

SEQ ID NO: 39734 - DNA, 21 bp, Artificial Sequence
  Description of Artificial Sequence: Synthetic oligonucleotide
gatggtgtgggtatgtatgct

SEQ ID NO: 39735 - DNA, 21 bp, Artificial Sequence
  Description of Artificial Sequence: Synthetic oligonucleotide
cacatgaaacacctccaagtc

SEQ ID NO: 39736 - DNA, 21 bp, Artificial Sequence
  Description of Artificial Sequence: Synthetic oligonucleotide
gctacggtgggtcatatgact

SEQ ID NO: 39737 - DNA, 21 bp, Artificial Sequence
  Description of Artificial Sequence: Synthetic oligonucleotide
gatcagggtaatggttatggg

SEQ ID NO: 39738 - DNA, 21 bp, Artificial Sequence
  Description of Artificial Sequence: Synthetic oligonucleotide
gacgtcgcccaagacagaagc

SEQ ID NO: 39739 - DNA, 21 bp, Artificial Sequence
  Description of Artificial Sequence: Synthetic oligonucleotide
cgtcttacgggtatttcgact

SEQ ID NO: 39740 - DNA, 21 bp, Artificial Sequence
  Description of Artificial Sequence: Synthetic oligonucleotide
ggtcggcttactagtagtatt

SEQ ID NO: 39741 - DNA, 21 bp, Artificial Sequence
  Description of Artificial Sequence: Synthetic oligonucleotide
agattccaaaacaacaccggc

SEQ ID NO: 39742 - DNA, 21 bp, Artificial Sequence
  Description of Artificial Sequence: Synthetic oligonucleotide
ggtccgtcgcagcaggtgatt

SEQ ID NO: 39743 - DNA, 21 bp, Artificial Sequence
  Description of Artificial Sequence: Synthetic oligonucleotide
ggcagaagccccaccgccagc

SEQ ID NO: 39744 - DNA, 21 bp, Artificial Sequence
  Description of Artificial Sequence: Synthetic oligonucleotide
gagaatgatcataatgttcgt

SEQ ID NO: 39745 - DNA, 21 bp, Artificial Sequence
  Description of Artificial Sequence: Synthetic oligonucleotide
cttggtcctcatcctacgcat

SEQ ID NO: 39746 - DNA, 21 bp, Artificial Sequence
  Description of Artificial Sequence: Synthetic oligonucleotide
gatgatcggtctgcgcggggg

SEQ ID NO: 39747 - DNA, 21 bp, Artificial Sequence
  Description of Artificial Sequence: Synthetic oligonucleotide
acgggtatgagtcatatgggt

SEQ ID NO: 39748 - DNA, 21 bp, Artificial Sequence
  Description of Artificial Sequence: Synthetic oligonucleotide
actggggcttcgcctctggct

SEQ ID NO: 39749 - DNA, 21 bp, Artificial Sequence
  Description of Artificial Sequence: Synthetic oligonucleotide
accagcaccagaagcagctgc

SEQ ID NO: 39750 - DNA, 21 bp, Artificial Sequence
  Description of Artificial Sequence: Synthetic oligonucleotide
tgtttggttcggcctatggct

SEQ ID NO: 39751 - DNA, 21 bp, Artificial Sequence
  Description of Artificial Sequence: Synthetic oligonucleotide
aaactcaacatgaaaggcccc

SEQ ID NO: 39752 - DNA, 21 bp, Artificial Sequence
  Description of Artificial Sequence: Synthetic oligonucleotide
tgtttgcctaatcattgtaat

SEQ ID NO: 39753 - DNA, 21 bp, Artificial Sequence
  Description of Artificial Sequence: Synthetic oligonucleotide
ggctggaaccacgaaaacgtc

SEQ ID NO: 39754 - DNA, 21 bp, Artificial Sequence
  Description of Artificial Sequence: Synthetic oligonucleotide
tttgctatgcctcgggagaat

SEQ ID NO: 39755 - DNA, 21 bp, Artificial Sequence
  Description of Artificial Sequence: Synthetic oligonucleotide
ggcctcagaaacgacaccgtc

SEQ ID NO: 39756 - DNA, 21 bp, Artificial Sequence
  Description of Artificial Sequence: Synthetic oligonucleotide
cagcagggtcggacggctggt

SEQ ID NO: 39757 - DNA, 21 bp, Artificial Sequence
  Description of Artificial Sequence: Synthetic oligonucleotide
gggcagggtgtgcgtgctatg

SEQ ID NO: 39758 - DNA, 21 bp, Artificial Sequence
  Description of Artificial Sequence: Synthetic oligonucleotide
tcgattagtacgcgtacgggg

SEQ ID NO: 39759 - DNA, 21 bp, Artificial Sequence
  Description of Artificial Sequence: Synthetic oligonucleotide
caaagcagcagaaccgtcacc

SEQ ID NO: 39760 - DNA, 21 bp, Artificial Sequence
  Description of Artificial Sequence: Synthetic oligonucleotide
cccagcacccacaaagcccaa

SEQ ID NO: 39761 - DNA, 21 bp, Artificial Sequence
  Description of Artificial Sequence: Synthetic oligonucleotide
gccaacaccagcggccaagcc

SEQ ID NO: 39762 - DNA, 21 bp, Artificial Sequence
  Description of Artificial Sequence: Synthetic oligonucleotide
gataagacgcagaagcagctg

SEQ ID NO: 39763 - DNA, 21 bp, Artificial Sequence
  Description of Artificial Sequence: Synthetic oligonucleotide
tcgggggcgtctcctgctcgg

SEQ ID NO: 39764 - DNA, 21 bp, Artificial Sequence
  Description of Artificial Sequence: Synthetic oligonucleotide
ggcaaacccacccaacaaggc

SEQ ID NO: 39765 - DNA, 21 bp, Artificial Sequence
  Description of Artificial Sequence: Synthetic oligonucleotide
agaggcgtcagcacccccacc

SEQ ID NO: 39766 - DNA, 21 bp, Artificial Sequence
  Description of Artificial Sequence: Synthetic oligonucleotide
tatgcttctagtagggatggt

SEQ ID NO: 39767 - DNA, 21 bp, Artificial Sequence
  Description of Artificial Sequence: Synthetic oligonucleotide
gcccccagcgccggcatgagc

SEQ ID NO: 39768 - DNA, 21 bp, Artificial Sequence
  Description of Artificial Sequence: Synthetic oligonucleotide
attggtagtaatgcgcggcag

SEQ ID NO: 39769 - DNA, 21 bp, Artificial Sequence
  Description of Artificial Sequence: Synthetic oligonucleotide
ggcggcagcaacctcagaacc

SEQ ID NO: 39770 - DNA, 21 bp, Artificial Sequence
  Description of Artificial Sequence: Synthetic oligonucleotide
actcagtcttcgagtaggacg

SEQ ID NO: 39771 - DNA, 21 bp, Artificial Sequence
  Description of Artificial Sequence: Synthetic oligonucleotide
ggcctccccctcagaagcgtc

SEQ ID NO: 39772 - DNA, 21 bp, Artificial Sequence
  Description of Artificial Sequence: Synthetic oligonucleotide
tcgagtgttgggaggctgaat

SEQ ID NO: 39773 - DNA, 21 bp, Artificial Sequence
  Description of Artificial Sequence: Synthetic oligonucleotide
gacatgggcagcagcctcagc

SEQ ID NO: 39774 - DNA, 21 bp, Artificial Sequence
  Description of Artificial Sequence: Synthetic oligonucleotide
gtgactaattctgctcctact

SEQ ID NO: 39775 - DNA, 21 bp, Artificial Sequence
  Description of Artificial Sequence: Synthetic oligonucleotide
gctatggggtcgaggctgtct

SEQ ID NO: 39776 - DNA, 21 bp, Artificial Sequence
  Description of Artificial Sequence: Synthetic oligonucleotide
actcctgcgcttaagaatgct

SEQ ID NO: 39777 - DNA, 21 bp, Artificial Sequence
  Description of Artificial Sequence: Synthetic oligonucleotide
agcggcggccaagccatgggc

SEQ ID NO: 39778 - DNA, 21 bp, Artificial Sequence
  Description of Artificial Sequence: Synthetic oligonucleotide
tcgcgtgagacggtgcctacg

SEQ ID NO: 39779 - DNA, 21 bp, Artificial Sequence
  Description of Artificial Sequence: Synthetic oligonucleotide
atcaaccaaagcacctacaaa

SEQ ID NO: 39780 - DNA, 21 bp, Artificial Sequence
  Description of Artificial Sequence: Synthetic oligonucleotide
cacgccagcagcccctgcatc

SEQ ID NO: 39781 - DNA, 21 bp, Artificial Sequence
  Description of Artificial Sequence: Synthetic oligonucleotide
tctaagaatgtttcttcgaag

SEQ ID NO: 39782 - DNA, 21 bp, Artificial Sequence
  Description of Artificial Sequence: Synthetic oligonucleotide
cacggcagcctcgaaagcgcc

SEQ ID NO: 39783 - DNA, 21 bp, Artificial Sequence
  Description of Artificial Sequence: Synthetic oligonucleotide
catcgtacggctcctgttagt

SEQ ID NO: 39784 - DNA, 21 bp, Artificial Sequence
  Description of Artificial Sequence: Synthetic oligonucleotide
aacatcagcaccatgagcaaa

SEQ ID NO: 39785 - DNA, 21 bp, Artificial Sequence
  Description of Artificial Sequence: Synthetic oligonucleotide
ctcggcatgagagacaacacc

SEQ ID NO: 39786 - DNA, 21 bp, Artificial Sequence
  Description of Artificial Sequence: Synthetic oligonucleotide
gatttgcagactagtgctaag

SEQ ID NO: 39787 - DNA, 21 bp, Artificial Sequence
  Description of Artificial Sequence: Synthetic oligonucleotide
cagagtaatccgcgtcctggt

SEQ ID NO: 39788 - DNA, 21 bp, Artificial Sequence
  Description of Artificial Sequence: Synthetic oligonucleotide
cacagcagcaaaagccacgac

SEQ ID NO: 39789 - DNA, 21 bp, Artificial Sequence
  Description of Artificial Sequence: Synthetic oligonucleotide
agttcgactagtcttggttcg

SEQ ID NO: 39790 - DNA, 21 bp, Artificial Sequence
  Description of Artificial Sequence: Synthetic oligonucleotide
ccgcgtcatactgttagtccg

SEQ ID NO: 39791 - DNA, 21 bp, Artificial Sequence
  Description of Artificial Sequence: Synthetic oligonucleotide
gttaatggtgctactgctgtt

SEQ ID NO: 39792 - DNA, 21 bp, Artificial Sequence
  Description of Artificial Sequence: Synthetic oligonucleotide
cccgtcatgaccagaaccccc

SEQ ID NO: 39793 - DNA, 21 bp, Artificial Sequence
  Description of Artificial Sequence: Synthetic oligonucleotide
tgtactacgcggcagggtaat

SEQ ID NO: 39794 - DNA, 21 bp, Artificial Sequence
  Description of Artificial Sequence: Synthetic oligonucleotide
gtcatgggcgccggcgccagc

SEQ ID NO: 39795 - DNA, 21 bp, Artificial Sequence
  Description of Artificial Sequence: Synthetic oligonucleotide
cccgccgcccacaacgccgtc

SEQ ID NO: 39796 - DNA, 21 bp, Artificial Sequence
  Description of Artificial Sequence: Synthetic oligonucleotide
ctgggtaagcctgctcagccg

SEQ ID NO: 39797 - DNA, 21 bp, Artificial Sequence
  Description of Artificial Sequence: Synthetic oligonucleotide
tttaggacgactgcttcgact

SEQ ID NO: 39798 - DNA, 21 bp, Artificial Sequence
  Description of Artificial Sequence: Synthetic oligonucleotide
attcggactaaggattctcgt

SEQ ID NO: 39799 - DNA, 21 bp, Artificial Sequence
  Description of Artificial Sequence: Synthetic oligonucleotide
tcgcatacgcctaagcttgtt

SEQ ID NO: 39800 - DNA, 21 bp, Artificial Sequence
  Description of Artificial Sequence: Synthetic oligonucleotide
cccgccggcagaagcagcaac

SEQ ID NO: 39801 - DNA, 21 bp, Artificial Sequence
  Description of Artificial Sequence: Synthetic oligonucleotide
agaagcctccccaacgtcgcc

SEQ ID NO: 39802 - DNA, 21 bp, Artificial Sequence
  Description of Artificial Sequence: Synthetic oligonucleotide
gttaggtctaatgtttcgggt

SEQ ID NO: 39803 - DNA, 21 bp, Artificial Sequence
  Description of Artificial Sequence: Synthetic oligonucleotide
tcggataagggtaatactcgg

SEQ ID NO: 39804 - DNA, 21 bp, Artificial Sequence
  Description of Artificial Sequence: Synthetic oligonucleotide
atgaatactcagggtcctatt

SEQ ID NO: 39805 - DNA, 21 bp, Artificial Sequence
  Description of Artificial Sequence: Synthetic oligonucleotide
tcttcgcagactcgtggtttg

SEQ ID NO: 39806 - DNA, 21 bp, Artificial Sequence
  Description of Artificial Sequence: Synthetic oligonucleotide
cctgataatcgtgtgcgggcg

SEQ ID NO: 39807 - DNA, 21 bp, Artificial Sequence
  Description of Artificial Sequence: Synthetic oligonucleotide
taccccagacaaagaaccgaa

SEQ ID NO: 39808 - DNA, 21 bp, Artificial Sequence
  Description of Artificial Sequence: Synthetic oligonucleotide
cttaagcctcagatgcatact

SEQ ID NO: 39809 - DNA, 21 bp, Artificial Sequence
  Description of Artificial Sequence: Synthetic oligonucleotide
gccctcaccggcaaactcagc

SEQ ID NO: 39810 - DNA, 21 bp, Artificial Sequence
  Description of Artificial Sequence: Synthetic oligonucleotide
cccacccaacaccaaagaggc

SEQ ID NO: 39811 - DNA, 21 bp, Artificial Sequence
  Description of Artificial Sequence: Synthetic oligonucleotide
agcagagtcgaccaatacaaa

SEQ ID NO: 39812 - DNA, 21 bp, Artificial Sequence
  Description of Artificial Sequence: Synthetic oligonucleotide
atcggcaccaccccccccaaa

SEQ ID NO: 39813 - DNA, 21 bp, Artificial Sequence
  Description of Artificial Sequence: Synthetic oligonucleotide
ggcagcaccaaacccagcccc

SEQ ID NO: 39814 - DNA, 21 bp, Artificial Sequence
  Description of Artificial Sequence: Synthetic oligonucleotide
tcgattccttctactgtgcgg

SEQ ID NO: 39815 - DNA, 21 bp, Artificial Sequence
  Description of Artificial Sequence: Synthetic oligonucleotide
agtagttcggttactgcgagg

SEQ ID NO: 39816 - DNA, 21 bp, Artificial Sequence
  Description of Artificial Sequence: Synthetic oligonucleotide
tcttctgggggtaatatgagt

SEQ ID NO: 39817 - DNA, 21 bp, Artificial Sequence
  Description of Artificial Sequence: Synthetic oligonucleotide
agcgtcggcgcccccaccctc

SEQ ID NO: 39818 - DNA, 21 bp, Artificial Sequence
  Description of Artificial Sequence: Synthetic oligonucleotide
attacgtctgtgaagactgcg

SEQ ID NO: 39819 - DNA, 21 bp, Artificial Sequence
  Description of Artificial Sequence: Synthetic oligonucleotide
cggtcttatgatccgaatcgg

SEQ ID NO: 39820 - DNA, 21 bp, Artificial Sequence
  Description of Artificial Sequence: Synthetic oligonucleotide
aacaaaatgaccagcgtcagc

SEQ ID NO: 39821 - DNA, 21 bp, Artificial Sequence
  Description of Artificial Sequence: Synthetic oligonucleotide
ctggcgatggagaggcagcgt

SEQ ID NO: 39822 - DNA, 21 bp, Artificial Sequence
  Description of Artificial Sequence: Synthetic oligonucleotide
ggtaagggtgttggtcagagg

SEQ ID NO: 39823 - DNA, 21 bp, Artificial Sequence
  Description of Artificial Sequence: Synthetic oligonucleotide
cccgtcgacaccagccacaaa

SEQ ID NO: 39824 - DNA, 21 bp, Artificial Sequence
  Description of Artificial Sequence: Synthetic oligonucleotide
cgtactacttcgtcgctggtg

SEQ ID NO: 39825 - DNA, 21 bp, Artificial Sequence
  Description of Artificial Sequence: Synthetic oligonucleotide
gtccccagcagagccgccacc

SEQ ID NO: 39826 - DNA, 21 bp, Artificial Sequence
  Description of Artificial Sequence: Synthetic oligonucleotide
gccgccaccaacagcctcacc

SEQ ID NO: 39827 - DNA, 21 bp, Artificial Sequence
  Description of Artificial Sequence: Synthetic oligonucleotide
agtgcgactgggtcgaggctg

SEQ ID NO: 39828 - DNA, 21 bp, Artificial Sequence
  Description of Artificial Sequence: Synthetic oligonucleotide
tcggttgtttctcataagtcg

SEQ ID NO: 39829 - DNA, 21 bp, Artificial Sequence
  Description of Artificial Sequence: Synthetic oligonucleotide
agcagaaccgccggcgtccaa

SEQ ID NO: 39830 - DNA, 21 bp, Artificial Sequence
  Description of Artificial Sequence: Synthetic oligonucleotide
accgtcaacaccagaagcgcc

SEQ ID NO: 39831 - DNA, 21 bp, Artificial Sequence
  Description of Artificial Sequence: Synthetic oligonucleotide
tggactgtgagtcggtctggt

SEQ ID NO: 39832 - DNA, 21 bp, Artificial Sequence
  Description of Artificial Sequence: Synthetic oligonucleotide
aacctcaccagcagcagcagc

SEQ ID NO: 39833 - DNA, 21 bp, Artificial Sequence
  Description of Artificial Sequence: Synthetic oligonucleotide
agagcccaccccaccctcggc

SEQ ID NO: 39834 - DNA, 21 bp, Artificial Sequence
  Description of Artificial Sequence: Synthetic oligonucleotide
ccgatgattaattcgagtgat

SEQ ID NO: 39835 - DNA, 21 bp, Artificial Sequence
  Description of Artificial Sequence: Synthetic oligonucleotide
agcaccgtcgccaccagcttc

SEQ ID NO: 39836 - DNA, 21 bp, Artificial Sequence
  Description of Artificial Sequence: Synthetic oligonucleotide
acttctgggtcggctcgtggg

SEQ ID NO: 39837 - DNA, 21 bp, Artificial Sequence
  Description of Artificial Sequence: Synthetic oligonucleotide
tctacgacgaataaggctcat

SEQ ID NO: 39838 - DNA, 21 bp, Artificial Sequence
  Description of Artificial Sequence: Synthetic oligonucleotide
aacctccacctcgccggcacc

SEQ ID NO: 39839 - DNA, 21 bp, Artificial Sequence
  Description of Artificial Sequence: Synthetic oligonucleotide
aggaatgtgtctcatccgggt

SEQ ID NO: 39840 - DNA, 21 bp, Artificial Sequence
  Description of Artificial Sequence: Synthetic oligonucleotide
agtactggtaaggctacttgt

SEQ ID NO: 39841 - DNA, 21 bp, Artificial Sequence
  Description of Artificial Sequence: Synthetic oligonucleotide
aaaaactacgacaacgccgtc

SEQ ID NO: 39842 - DNA, 21 bp, Artificial Sequence
  Description of Artificial Sequence: Synthetic oligonucleotide
actgaggctcggtcggcgaat

SEQ ID NO: 39843 - DNA, 21 bp, Artificial Sequence
  Description of Artificial Sequence: Synthetic oligonucleotide
cggactctttctaatcatggt

SEQ ID NO: 39844 - DNA, 21 bp, Artificial Sequence
  Description of Artificial Sequence: Synthetic oligonucleotide
tcttctgctccgagtctttct

SEQ ID NO: 39845 - DNA, 21 bp, Artificial Sequence
  Description of Artificial Sequence: Synthetic oligonucleotide
ggcaacatgagaaacctcgcc

SEQ ID NO: 39846 - DNA, 21 bp, Artificial Sequence
  Description of Artificial Sequence: Synthetic oligonucleotide
aatgtggttgggactggtgct

SEQ ID NO: 39847 - DNA, 21 bp, Artificial Sequence
  Description of Artificial Sequence: Synthetic oligonucleotide
gagactactgtgagggcttct

SEQ ID NO: 39848 - DNA, 21 bp, Artificial Sequence
  Description of Artificial Sequence: Synthetic oligonucleotide
acttcgtctacgacttctttg

SEQ ID NO: 39849 - DNA, 21 bp, Artificial Sequence
  Description of Artificial Sequence: Synthetic oligonucleotide
agacccagcaacgccagcggc

SEQ ID NO: 39850 - DNA, 21 bp, Artificial Sequence
  Description of Artificial Sequence: Synthetic oligonucleotide
ggcgaccacaacagaatgaac

SEQ ID NO: 39851 - DNA, 21 bp, Artificial Sequence
  Description of Artificial Sequence: Synthetic oligonucleotide
gacagaatgggcaccgcccac

SEQ ID NO: 39852 - DNA, 21 bp, Artificial Sequence
  Description of Artificial Sequence: Synthetic oligonucleotide
gttgcgtcttctccgcttcgt

SEQ ID NO: 39853 - DNA, 21 bp, Artificial Sequence
  Description of Artificial Sequence: Synthetic oligonucleotide
atggccaccagcaccgtcaaa

SEQ ID NO: 39854 - DNA, 21 bp, Artificial Sequence
  Description of Artificial Sequence: Synthetic oligonucleotide
cggactctttctaataatggt

SEQ ID NO: 39855 - DNA, 21 bp, Artificial Sequence
  Description of Artificial Sequence: Synthetic oligonucleotide
ggcatgatccccagcagcaga

SEQ ID NO: 39856 - DNA, 21 bp, Artificial Sequence
  Description of Artificial Sequence: Synthetic oligonucleotide
ccttctcatatggcttcggcg

SEQ ID NO: 39857 - DNA, 21 bp, Artificial Sequence
  Description of Artificial Sequence: Synthetic oligonucleotide
cattctcatgggaagtcgatt

SEQ ID NO: 39858 - DNA, 21 bp, Artificial Sequence
  Description of Artificial Sequence: Synthetic oligonucleotide
ggtaattctatggctgggact

SEQ ID NO: 39859 - DNA, 21 bp, Artificial Sequence
  Description of Artificial Sequence: Synthetic oligonucleotide
gtgtcgactaagagtgctcct

SEQ ID NO: 39860 - DNA, 21 bp, Artificial Sequence
  Description of Artificial Sequence: Synthetic oligonucleotide
ggtgtgaatattcatgcgact

SEQ ID NO: 39861 - DNA, 21 bp, Artificial Sequence
  Description of Artificial Sequence: Synthetic oligonucleotide
gacgtcctcagcaaaagacaa

SEQ ID NO: 39862 - DNA, 21 bp, Artificial Sequence
  Description of Artificial Sequence: Synthetic oligonucleotide
accgacaccaacagaatgtac

SEQ ID NO: 39863 - DNA, 21 bp, Artificial Sequence
  Description of Artificial Sequence: Synthetic oligonucleotide
gccaaccacagcatcagaagc

SEQ ID NO: 39864 - DNA, 21 bp, Artificial Sequence
  Description of Artificial Sequence: Synthetic oligonucleotide
cacggcgacagcggcaaagtc

SEQ ID NO: 39865 - DNA, 21 bp, Artificial Sequence
  Description of Artificial Sequence: Synthetic oligonucleotide
agaatgcaagtcagccccttc

SEQ ID NO: 39866 - DNA, 21 bp, Artificial Sequence
  Description of Artificial Sequence: Synthetic oligonucleotide
atgctgaatacttctcattat

SEQ ID NO: 39867 - DNA, 21 bp, Artificial Sequence
  Description of Artificial Sequence: Synthetic oligonucleotide
tctctgtcgactgggtcgggg

SEQ ID NO: 39868 - DNA, 21 bp, Artificial Sequence
  Description of Artificial Sequence: Synthetic oligonucleotide
aagtcgtcgtctcatgcgact

SEQ ID NO: 39869 - DNA, 21 bp, Artificial Sequence
  Description of Artificial Sequence: Synthetic oligonucleotide
atggttccgaatgggcgtgct

SEQ ID NO: 39870 - DNA, 21 bp, Artificial Sequence
  Description of Artificial Sequence: Synthetic oligonucleotide
ttgaatcagcattcgagtatt

SEQ ID NO: 39871 - DNA, 21 bp, Artificial Sequence
  Description of Artificial Sequence: Synthetic oligonucleotide
tataataagaatgctcagttg

SEQ ID NO: 39872 - DNA, 21 bp, Artificial Sequence
  Description of Artificial Sequence: Synthetic oligonucleotide
catccggagactgcttttaag

SEQ ID NO: 39873 - DNA, 21 bp, Artificial Sequence
  Description of Artificial Sequence: Synthetic oligonucleotide
tctcagcagactacggaggcg

SEQ ID NO: 39874 - DNA, 21 bp, Artificial Sequence
  Description of Artificial Sequence: Synthetic oligonucleotide
accctcggccaagaagtcaga

SEQ ID NO: 39875 - DNA, 21 bp, Artificial Sequence
  Description of Artificial Sequence: Synthetic oligonucleotide
agaggcgccaccagcaccagc

SEQ ID NO: 39876 - DNA, 21 bp, Artificial Sequence
  Description of Artificial Sequence: Synthetic oligonucleotide
agacacaccatcgacagcccc

SEQ ID NO: 39877 - DNA, 21 bp, Artificial Sequence
  Description of Artificial Sequence: Synthetic oligonucleotide
cgttctagtaatgggtatctt

SEQ ID NO: 39878 - DNA, 21 bp, Artificial Sequence
  Description of Artificial Sequence: Synthetic oligonucleotide
attttgcctcggggtgttgat

SEQ ID NO: 39879 - DNA, 21 bp, Artificial Sequence
  Description of Artificial Sequence: Synthetic oligonucleotide
accaacatgcaaagcgtcctc

SEQ ID NO: 39880 - DNA, 21 bp, Artificial Sequence
  Description of Artificial Sequence: Synthetic oligonucleotide
ggcgtctacggccaaagcctc

SEQ ID NO: 39881 - DNA, 21 bp, Artificial Sequence
  Description of Artificial Sequence: Synthetic oligonucleotide
ggttctaatcggattcttggt

SEQ ID NO: 39882 - DNA, 21 bp, Artificial Sequence
  Description of Artificial Sequence: Synthetic oligonucleotide
agttgtagtcgggattctact

SEQ ID NO: 39883 - DNA, 21 bp, Artificial Sequence
  Description of Artificial Sequence: Synthetic oligonucleotide
aacagcagacaaggcaccaac

SEQ ID NO: 39884 - DNA, 21 bp, Artificial Sequence
  Description of Artificial Sequence: Synthetic oligonucleotide
cagtctactgagcggttggcg

SEQ ID NO: 39885 - DNA, 21 bp, Artificial Sequence
  Description of Artificial Sequence: Synthetic oligonucleotide
ccttttacgcgtaatgctctt

SEQ ID NO: 39886 - DNA, 21 bp, Artificial Sequence
  Description of Artificial Sequence: Synthetic oligonucleotide
ggcagaagcatggaaagaagc

SEQ ID NO: 39887 - DNA, 21 bp, Artificial Sequence
  Description of Artificial Sequence: Synthetic oligonucleotide
ggcgacaaaacccaagccatg

SEQ ID NO: 39888 - DNA, 21 bp, Artificial Sequence
  Description of Artificial Sequence: Synthetic oligonucleotide
catggttctagttcttttacg

SEQ ID NO: 39889 - DNA, 21 bp, Artificial Sequence
  Description of Artificial Sequence: Synthetic oligonucleotide
aacagaggcaaagccagcagc

SEQ ID NO: 39890 - DNA, 21 bp, Artificial Sequence
  Description of Artificial Sequence: Synthetic oligonucleotide
tcttcgccgactcgtagtttg

SEQ ID NO: 39891 - DNA, 21 bp, Artificial Sequence
  Description of Artificial Sequence: Synthetic oligonucleotide
gcggatggtcgtaatagtagt

SEQ ID NO: 39892 - DNA, 21 bp, Artificial Sequence
  Description of Artificial Sequence: Synthetic oligonucleotide
tcgactcatcatccggctagt

SEQ ID NO: 39893 - DNA, 21 bp, Artificial Sequence
  Description of Artificial Sequence: Synthetic oligonucleotide
aacggttctggacaggatcaa

SEQ ID NO: 39894 - DNA, 21 bp, Artificial Sequence
  Description of Artificial Sequence: Synthetic oligonucleotide
aatccttcgcatacttctgtg

SEQ ID NO: 39895 - DNA, 21 bp, Artificial Sequence
  Description of Artificial Sequence: Synthetic oligonucleotide
actcggtcgaattctgcggtg

SEQ ID NO: 39896 - DNA, 21 bp, Artificial Sequence
  Description of Artificial Sequence: Synthetic oligonucleotide
atgagtactggtgtttctcct

SEQ ID NO: 39897 - DNA, 21 bp, Artificial Sequence
  Description of Artificial Sequence: Synthetic oligonucleotide
cccatggacgtcagaagcgac

SEQ ID NO: 39898 - DNA, 21 bp, Artificial Sequence
  Description of Artificial Sequence: Synthetic oligonucleotide
ccccaaaacctcgcccacgtc

SEQ ID NO: 39899 - DNA, 21 bp, Artificial Sequence
  Description of Artificial Sequence: Synthetic oligonucleotide
aagaatcctagttcggcgcct

SEQ ID NO: 39900 - DNA, 21 bp, Artificial Sequence
  Description of Artificial Sequence: Synthetic oligonucleotide
cctgttccgtatcgtgctgat

SEQ ID NO: 39901 - DNA, 21 bp, Artificial Sequence
  Description of Artificial Sequence: Synthetic oligonucleotide
gcccaaagaaacatcagcagc

SEQ ID NO: 39902 - DNA, 21 bp, Artificial Sequence
  Description of Artificial Sequence: Synthetic oligonucleotide
agccaaaacgtcagcagcaaa

SEQ ID NO: 39903 - DNA, 21 bp, Artificial Sequence
  Description of Artificial Sequence: Synthetic oligonucleotide
taccccagcagcgtccaacaa

SEQ ID NO: 39904 - DNA, 21 bp, Artificial Sequence
  Description of Artificial Sequence: Synthetic oligonucleotide
agcaccgcctacaacaccaac

SEQ ID NO: 39905 - DNA, 21 bp, Artificial Sequence
  Description of Artificial Sequence: Synthetic oligonucleotide
agaatgagagaaaaaccctac

SEQ ID NO: 39906 - DNA, 21 bp, Artificial Sequence
  Description of Artificial Sequence: Synthetic oligonucleotide
actctgcgtggtgggtcgagt

SEQ ID NO: 39907 - DNA, 21 bp, Artificial Sequence
  Description of Artificial Sequence: Synthetic oligonucleotide
gtcagcagcatgaaaagcggc

SEQ ID NO: 39908 - DNA, 21 bp, Artificial Sequence
  Description of Artificial Sequence: Synthetic oligonucleotide
ttgactcagagggatttttcg

SEQ ID NO: 39909 - DNA, 21 bp, Artificial Sequence
  Description of Artificial Sequence: Synthetic oligonucleotide
gacgtcctcagcaaaagccaa

SEQ ID NO: 39910 - DNA, 21 bp, Artificial Sequence
  Description of Artificial Sequence: Synthetic oligonucleotide
tgtgtgactggtggtcttact

SEQ ID NO: 39911 - DNA, 21 bp, Artificial Sequence
  Description of Artificial Sequence: Synthetic oligonucleotide
aaacaacccgccagcacccac

SEQ ID NO: 39912 - DNA, 21 bp, Artificial Sequence
  Description of Artificial Sequence: Synthetic oligonucleotide
catctgcgtggtgggtcgagt

SEQ ID NO: 39913 - DNA, 21 bp, Artificial Sequence
  Description of Artificial Sequence: Synthetic oligonucleotide
gacgacagaagcaacctcagc

SEQ ID NO: 39914 - DNA, 21 bp, Artificial Sequence
  Description of Artificial Sequence: Synthetic oligonucleotide
agcggcagccccctctgcggc

SEQ ID NO: 39915 - DNA, 21 bp, Artificial Sequence
  Description of Artificial Sequence: Synthetic oligonucleotide
catattgggactggtgctagg

SEQ ID NO: 39916 - DNA, 21 bp, Artificial Sequence
  Description of Artificial Sequence: Synthetic oligonucleotide
cccagaaccaacgtcatgccc

SEQ ID NO: 39917 - DNA, 21 bp, Artificial Sequence
  Description of Artificial Sequence: Synthetic oligonucleotide
cctggtgggggtagggcgatt

SEQ ID NO: 39918 - DNA, 21 bp, Artificial Sequence
  Description of Artificial Sequence: Synthetic oligonucleotide
taccaagtccccctcgccaaa

SEQ ID NO: 39919 - DNA, 21 bp, Artificial Sequence
  Description of Artificial Sequence: Synthetic oligonucleotide
atgactggtcatagttctgtt

SEQ ID NO: 39920 - DNA, 21 bp, Artificial Sequence
  Description of Artificial Sequence: Synthetic oligonucleotide
ctccaagtcaacatggccaga

SEQ ID NO: 39921 - DNA, 21 bp, Artificial Sequence
  Description of Artificial Sequence: Synthetic oligonucleotide
cacaccgcccacagcagcctc

SEQ ID NO: 39922 - DNA, 21 bp, Artificial Sequence
  Description of Artificial Sequence: Synthetic oligonucleotide
gggagttctccttctttaagg

SEQ ID NO: 39923 - DNA, 21 bp, Artificial Sequence
  Description of Artificial Sequence: Synthetic oligonucleotide
tctggtacgagtattcggacg

SEQ ID NO: 39924 - DNA, 21 bp, Artificial Sequence
  Description of Artificial Sequence: Synthetic oligonucleotide
cataggtctaatagtacgacg

SEQ ID NO: 39925 - DNA, 21 bp, Artificial Sequence
  Description of Artificial Sequence: Synthetic oligonucleotide
actacgaatacggtgtctcgg

SEQ ID NO: 39926 - DNA, 21 bp, Artificial Sequence
  Description of Artificial Sequence: Synthetic oligonucleotide
ggttattcgaatcagatgact

SEQ ID NO: 39927 - DNA, 21 bp, Artificial Sequence
  Description of Artificial Sequence: Synthetic oligonucleotide
aaacaacccgacagcacccac

SEQ ID NO: 39928 - DNA, 21 bp, Artificial Sequence
  Description of Artificial Sequence: Synthetic oligonucleotide
cgttctaatggttcggcggct

SEQ ID NO: 39929 - DNA, 21 bp, Artificial Sequence
  Description of Artificial Sequence: Synthetic oligonucleotide
acgacttcgaataaggatagt

SEQ ID NO: 39930 - DNA, 21 bp, Artificial Sequence
  Description of Artificial Sequence: Synthetic oligonucleotide
aacggcctccccggcgccatg

SEQ ID NO: 39931 - DNA, 21 bp, Artificial Sequence
  Description of Artificial Sequence: Synthetic oligonucleotide
cgtgctggggggaatgctgtg

SEQ ID NO: 39932 - DNA, 21 bp, Artificial Sequence
  Description of Artificial Sequence: Synthetic oligonucleotide
atgggtccgaatcatcttcct

SEQ ID NO: 39933 - DNA, 21 bp, Artificial Sequence
  Description of Artificial Sequence: Synthetic oligonucleotide
agcctcagcaaacaagccgcc

SEQ ID NO: 39934 - DNA, 21 bp, Artificial Sequence
  Description of Artificial Sequence: Synthetic oligonucleotide
attggtaatttgccgtcgcgg

SEQ ID NO: 39935 - DNA, 21 bp, Artificial Sequence
  Description of Artificial Sequence: Synthetic oligonucleotide
aatcagatggcgcatcttaag

SEQ ID NO: 39936 - DNA, 21 bp, Artificial Sequence
  Description of Artificial Sequence: Synthetic oligonucleotide
agcgtcgaaaaagcccaaagc

SEQ ID NO: 39937 - DNA, 21 bp, Artificial Sequence
  Description of Artificial Sequence: Synthetic oligonucleotide
gccatgagcgccagcagaaac

SEQ ID NO: 39938 - DNA, 21 bp, Artificial Sequence
  Description of Artificial Sequence: Synthetic oligonucleotide
cgtactaatcatgtggaggct

SEQ ID NO: 39939 - DNA, 21 bp, Artificial Sequence
  Description of Artificial Sequence: Synthetic oligonucleotide
agtttttcgtcgactatgggt

SEQ ID NO: 39940 - DNA, 21 bp, Artificial Sequence
  Description of Artificial Sequence: Synthetic oligonucleotide
gggcgggttaattcgggtatt

SEQ ID NO: 39941 - DNA, 21 bp, Artificial Sequence
  Description of Artificial Sequence: Synthetic oligonucleotide
agtcttgtgtctaggtctacg

SEQ ID NO: 39942 - DNA, 21 bp, Artificial Sequence
  Description of Artificial Sequence: Synthetic oligonucleotide
ctcggcctcagagacaacacc

SEQ ID NO: 39943 - DNA, 21 bp, Artificial Sequence
  Description of Artificial Sequence: Synthetic oligonucleotide
catactatgcgtagttctgtt

SEQ ID NO: 39944 - DNA, 21 bp, Artificial Sequence
  Description of Artificial Sequence: Synthetic oligonucleotide
tggggcaccggcatcggcagc

SEQ ID NO: 39945 - DNA, 21 bp, Artificial Sequence
  Description of Artificial Sequence: Synthetic oligonucleotide
cagactcgtagtaatggtaat

SEQ ID NO: 39946 - DNA, 21 bp, Artificial Sequence
  Description of Artificial Sequence: Synthetic oligonucleotide
cggatggcgcgtcctgctgtt

SEQ ID NO: 39947 - DNA, 21 bp, Artificial Sequence
  Description of Artificial Sequence: Synthetic oligonucleotide
ggcaacaccaacagcttcctc

SEQ ID NO: 39948 - DNA, 21 bp, Artificial Sequence
  Description of Artificial Sequence: Synthetic oligonucleotide
gcccccgtccaacccttcaga

SEQ ID NO: 39949 - DNA, 21 bp, Artificial Sequence
  Description of Artificial Sequence: Synthetic oligonucleotide
atcagcgtcggcaacaccagc

SEQ ID NO: 39950 - DNA, 21 bp, Artificial Sequence
  Description of Artificial Sequence: Synthetic oligonucleotide
agagacgtcagaatgagcgac

SEQ ID NO: 39951 - DNA, 21 bp, Artificial Sequence
  Description of Artificial Sequence: Synthetic oligonucleotide
tcgcgtgagtcgagtccgctt

SEQ ID NO: 39952 - DNA, 21 bp, Artificial Sequence
  Description of Artificial Sequence: Synthetic oligonucleotide
gggtctctgactcctaaggct

SEQ ID NO: 39953 - DNA, 21 bp, Artificial Sequence
  Description of Artificial Sequence: Synthetic oligonucleotide
aacggttctggacagaatcca

SEQ ID NO: 39954 - DNA, 21 bp, Artificial Sequence
  Description of Artificial Sequence: Synthetic oligonucleotide
aaaagcacccacggcatgacc

SEQ ID NO: 39955 - DNA, 21 bp, Artificial Sequence
  Description of Artificial Sequence: Synthetic oligonucleotide
gagcaggttccgaagcatcgt

SEQ ID NO: 39956 - DNA, 21 bp, Artificial Sequence
  Description of Artificial Sequence: Synthetic oligonucleotide
acccaaaacagcagcctcagc

SEQ ID NO: 39957 - DNA, 21 bp, Artificial Sequence
  Description of Artificial Sequence: Synthetic oligonucleotide
accagcaacacccccagcatc

SEQ ID NO: 39958 - DNA, 21 bp, Artificial Sequence
  Description of Artificial Sequence: Synthetic oligonucleotide
ccggtttcgacgcattcgtct

SEQ ID NO: 39959 - DNA, 21 bp, Artificial Sequence
  Description of Artificial Sequence: Synthetic oligonucleotide
actcggcctaatcttcagacg

SEQ ID NO: 39960 - DNA, 21 bp, Artificial Sequence
  Description of Artificial Sequence: Synthetic oligonucleotide
ctcgccagcagcagaagcggc

SEQ ID NO: 39961 - DNA, 21 bp, Artificial Sequence
  Description of Artificial Sequence: Synthetic oligonucleotide
caaggccaaaccgccatgaga

SEQ ID NO: 39962 - DNA, 21 bp, Artificial Sequence
  Description of Artificial Sequence: Synthetic oligonucleotide
gtgcgtaatgcgtctagtgat

SEQ ID NO: 39963 - DNA, 21 bp, Artificial Sequence
  Description of Artificial Sequence: Synthetic oligonucleotide
actatgtcgactaggcagagt

SEQ ID NO: 39964 - DNA, 21 bp, Artificial Sequence
  Description of Artificial Sequence: Synthetic oligonucleotide
ggcagcagcagaagcctcggc

SEQ ID NO: 39965 - DNA, 21 bp, Artificial Sequence
  Description of Artificial Sequence: Synthetic oligonucleotide
cccgcccaccaaaaactcagc

SEQ ID NO: 39966 - DNA, 21 bp, Artificial Sequence
  Description of Artificial Sequence: Synthetic oligonucleotide
ggtacggtgaatgcgaagggg

SEQ ID NO: 39967 - DNA, 21 bp, Artificial Sequence
  Description of Artificial Sequence: Synthetic oligonucleotide
ggccaagtcaaagccctcggc

SEQ ID NO: 39968 - DNA, 21 bp, Artificial Sequence
  Description of Artificial Sequence: Synthetic oligonucleotide
ggtgataggccttctgctaag

SEQ ID NO: 39969 - DNA, 21 bp, Artificial Sequence
  Description of Artificial Sequence: Synthetic oligonucleotide
agcacctaccccaaaagcagc

SEQ ID NO: 39970 - DNA, 21 bp, Artificial Sequence
  Description of Artificial Sequence: Synthetic oligonucleotide
ggccaagccggcggcagcaaa

SEQ ID NO: 39971 - DNA, 21 bp, Artificial Sequence
  Description of Artificial Sequence: Synthetic oligonucleotide
actggtactaagtcggataat

SEQ ID NO: 39972 - DNA, 21 bp, Artificial Sequence
  Description of Artificial Sequence: Synthetic oligonucleotide
atgctcggcagcagcaacaaa

SEQ ID NO: 39973 - DNA, 21 bp, Artificial Sequence
  Description of Artificial Sequence: Synthetic oligonucleotide
ctccaacaacacaacaccaaa

SEQ ID NO: 39974 - DNA, 21 bp, Artificial Sequence
  Description of Artificial Sequence: Synthetic oligonucleotide
gatagtaagcatactagtacg

SEQ ID NO: 39975 - DNA, 21 bp, Artificial Sequence
  Description of Artificial Sequence: Synthetic oligonucleotide
agcgcccacggcagaaccaac

SEQ ID NO: 39976 - DNA, 21 bp, Artificial Sequence
  Description of Artificial Sequence: Synthetic oligonucleotide
actcctcagatgacgccggtt

SEQ ID NO: 39977 - DNA, 21 bp, Artificial Sequence
  Description of Artificial Sequence: Synthetic oligonucleotide
atgaccggcagactcaccacc

SEQ ID NO: 39978 - DNA, 21 bp, Artificial Sequence
  Description of Artificial Sequence: Synthetic oligonucleotide
atgagcatgaaacaagtcacc

SEQ ID NO: 39979 - DNA, 21 bp, Artificial Sequence
  Description of Artificial Sequence: Synthetic oligonucleotide
gttcatgtgacgagtcagact

SEQ ID NO: 39980 - DNA, 21 bp, Artificial Sequence
  Description of Artificial Sequence: Synthetic oligonucleotide
ctgatgtctgcggcgactact

SEQ ID NO: 39981 - DNA, 21 bp, Artificial Sequence
  Description of Artificial Sequence: Synthetic oligonucleotide
aaggttattaatccggcgcag

SEQ ID NO: 39982 - DNA, 21 bp, Artificial Sequence
  Description of Artificial Sequence: Synthetic oligonucleotide
atcaaactcgacaaacaaatc

SEQ ID NO: 39983 - DNA, 21 bp, Artificial Sequence
  Description of Artificial Sequence: Synthetic oligonucleotide
ttcggcgaaagcaccatgaga

SEQ ID NO: 39984 - DNA, 21 bp, Artificial Sequence
  Description of Artificial Sequence: Synthetic oligonucleotide
gaccccctcagaagcatgcac

SEQ ID NO: 39985 - DNA, 21 bp, Artificial Sequence
  Description of Artificial Sequence: Synthetic oligonucleotide
tgtgtttctaatgtgactaat

SEQ ID NO: 39986 - DNA, 21 bp, Artificial Sequence
  Description of Artificial Sequence: Synthetic oligonucleotide
aacggcagcggcaccaaccaa

SEQ ID NO: 39987 - DNA, 21 bp, Artificial Sequence
  Description of Artificial Sequence: Synthetic oligonucleotide
ttgcttagtcagcattcggat

SEQ ID NO: 39988 - DNA, 21 bp, Artificial Sequence
  Description of Artificial Sequence: Synthetic oligonucleotide
ggcggcctccacggcagcggc

SEQ ID NO: 39989 - DNA, 21 bp, Artificial Sequence
  Description of Artificial Sequence: Synthetic oligonucleotide
cctgttaataatgtgggtctt

SEQ ID NO: 39990 - DNA, 21 bp, Artificial Sequence
  Description of Artificial Sequence: Synthetic oligonucleotide
gctgttactactaaggcgctt

SEQ ID NO: 39991 - DNA, 21 bp, Artificial Sequence
  Description of Artificial Sequence: Synthetic oligonucleotide
agcagctacacccccagcggc

SEQ ID NO: 39992 - DNA, 21 bp, Artificial Sequence
  Description of Artificial Sequence: Synthetic oligonucleotide
agtagtacgaagtctagtctg

SEQ ID NO: 39993 - DNA, 21 bp, Artificial Sequence
  Description of Artificial Sequence: Synthetic oligonucleotide
cgtaattctgagtatactggg

SEQ ID NO: 39994 - DNA, 21 bp, Artificial Sequence
  Description of Artificial Sequence: Synthetic oligonucleotide
gaagtcagaagacaaagcacc

SEQ ID NO: 39995 - DNA, 21 bp, Artificial Sequence
  Description of Artificial Sequence: Synthetic oligonucleotide
atgaattcgaatcatcggaat

SEQ ID NO: 39996 - DNA, 21 bp, Artificial Sequence
  Description of Artificial Sequence: Synthetic oligonucleotide
ccgcattctgggaatcgtcat

SEQ ID NO: 39997 - DNA, 21 bp, Artificial Sequence
  Description of Artificial Sequence: Synthetic oligonucleotide
agcctcgccagccacaccaga

SEQ ID NO: 39998 - DNA, 21 bp, Artificial Sequence
  Description of Artificial Sequence: Synthetic oligonucleotide
gccgaacaccaaagcggcaaa

SEQ ID NO: 39999 - DNA, 21 bp, Artificial Sequence
  Description of Artificial Sequence: Synthetic oligonucleotide
tcgagtaaggctgctattact

SEQ ID NO: 40000 - DNA, 21 bp, Artificial Sequence
  Description of Artificial Sequence: Synthetic oligonucleotide
ccccaatacggcgacaaagaa

SEQ ID NO: 40001 - DNA, 21 bp, Artificial Sequence
  Description of Artificial Sequence: Synthetic oligonucleotide
ttcggcaaccccggcatcaga

SEQ ID NO: 40002 - DNA, 21 bp, Artificial Sequence
  Description of Artificial Sequence: Synthetic oligonucleotide
gacagcggcttcaaaagcccc

SEQ ID NO: 40003 - DNA, 21 bp, Artificial Sequence
  Description of Artificial Sequence: Synthetic oligonucleotide
agagccctcagcaaaggcggc

SEQ ID NO: 40004 - DNA, 21 bp, Artificial Sequence
  Description of Artificial Sequence: Synthetic oligonucleotide
agtattagggggggtaaggat

SEQ ID NO: 40005 - DNA, 21 bp, Artificial Sequence
  Description of Artificial Sequence: Synthetic oligonucleotide
gtcaacgccaacaaagcctgc

SEQ ID NO: 40006 - DNA, 21 bp, Artificial Sequence
  Description of Artificial Sequence: Synthetic oligonucleotide
cccgacatcggcaaacaaaga

SEQ ID NO: 40007 - DNA, 21 bp, Artificial Sequence
  Description of Artificial Sequence: Synthetic oligonucleotide
cccagagaaaacaaattcagc

SEQ ID NO: 40008 - DNA, 21 bp, Artificial Sequence
  Description of Artificial Sequence: Synthetic oligonucleotide
ggcagagcccacaacgtcatc

SEQ ID NO: 40009 - DNA, 21 bp, Artificial Sequence
  Description of Artificial Sequence: Synthetic oligonucleotide
tcgtcgtggcagaatagtttg

SEQ ID NO: 40010 - DNA, 21 bp, Artificial Sequence
  Description of Artificial Sequence: Synthetic oligonucleotide
catgcgaagcatgtggtgggt

SEQ ID NO: 40011 - DNA, 21 bp, Artificial Sequence
  Description of Artificial Sequence: Synthetic oligonucleotide
cctccgcgtcagaagctgggt

SEQ ID NO: 40012 - DNA, 21 bp, Artificial Sequence
  Description of Artificial Sequence: Synthetic oligonucleotide
tgcgccggccccgaaaacgtc

SEQ ID NO: 40013 - DNA, 21 bp, Artificial Sequence
  Description of Artificial Sequence: Synthetic oligonucleotide
tacaaacacagcgtcgtcctc

SEQ ID NO: 40014 - DNA, 21 bp, Artificial Sequence
  Description of Artificial Sequence: Synthetic oligonucleotide
ccgggttctgagggtaggtgt

SEQ ID NO: 40015 - DNA, 21 bp, Artificial Sequence
  Description of Artificial Sequence: Synthetic oligonucleotide
gttactccggctaggattatt

SEQ ID NO: 40016 - DNA, 21 bp, Artificial Sequence
  Description of Artificial Sequence: Synthetic oligonucleotide
ccgtgggtgcagattgatggg

SEQ ID NO: 40017 - DNA, 21 bp, Artificial Sequence
  Description of Artificial Sequence: Synthetic oligonucleotide
agaggcaccaaacccgccgcc

SEQ ID NO: 40018 - DNA, 21 bp, Artificial Sequence
  Description of Artificial Sequence: Synthetic oligonucleotide
gggcgtcatggtgctccgact

SEQ ID NO: 40019 - DNA, 21 bp, Artificial Sequence
  Description of Artificial Sequence: Synthetic oligonucleotide
actccgtctatgcgtaatact

SEQ ID NO: 40020 - DNA, 21 bp, Artificial Sequence
  Description of Artificial Sequence: Synthetic oligonucleotide
ctcggcctcggcggcagaggc

SEQ ID NO: 40021 - DNA, 21 bp, Artificial Sequence
  Description of Artificial Sequence: Synthetic oligonucleotide
ggcgccctcgaaagacacagc

SEQ ID NO: 40022 - DNA, 21 bp, Artificial Sequence
  Description of Artificial Sequence: Synthetic oligonucleotide
cgttctgttggtgctaaggcg

SEQ ID NO: 40023 - DNA, 21 bp, Artificial Sequence
  Description of Artificial Sequence: Synthetic oligonucleotide
aacagcaccagcaccagccaa

SEQ ID NO: 40024 - DNA, 21 bp, Artificial Sequence
  Description of Artificial Sequence: Synthetic oligonucleotide
accacccacaacatcaaaggc

SEQ ID NO: 40025 - DNA, 21 bp, Artificial Sequence
  Description of Artificial Sequence: Synthetic oligonucleotide
ccgacggcttcgaataggagt

SEQ ID NO: 40026 - DNA, 21 bp, Artificial Sequence
  Description of Artificial Sequence: Synthetic oligonucleotide
aggacgagtactgcgcctcag

SEQ ID NO: 40027 - DNA, 21 bp, Artificial Sequence
  Description of Artificial Sequence: Synthetic oligonucleotide
catgctaataatcgttcggtg

SEQ ID NO: 40028 - DNA, 21 bp, Artificial Sequence
  Description of Artificial Sequence: Synthetic oligonucleotide
gagcggtatactactagtaag

SEQ ID NO: 40029 - DNA, 21 bp, Artificial Sequence
  Description of Artificial Sequence: Synthetic oligonucleotide
agtgggtctctttcttctgct

SEQ ID NO: 40030 - DNA, 21 bp, Artificial Sequence
  Description of Artificial Sequence: Synthetic oligonucleotide
tcgagtagtacgtcgcataag

SEQ ID NO: 40031 - DNA, 21 bp, Artificial Sequence
  Description of Artificial Sequence: Synthetic oligonucleotide
ggtggtcttgatcatcatgct

SEQ ID NO: 40032 - DNA, 21 bp, Artificial Sequence
  Description of Artificial Sequence: Synthetic oligonucleotide
atgaacaccagcatcaacaac

SEQ ID NO: 40033 - DNA, 21 bp, Artificial Sequence
  Description of Artificial Sequence: Synthetic oligonucleotide
actgagtttagtcggacgaat

SEQ ID NO: 40034 - DNA, 21 bp, Artificial Sequence
  Description of Artificial Sequence: Synthetic oligonucleotide
agtccgaatgcgaatcgtgtt

SEQ ID NO: 40035 - DNA, 21 bp, Artificial Sequence
  Description of Artificial Sequence: Synthetic oligonucleotide
accccccaccaaagaagcagc

SEQ ID NO: 40036 - DNA, 21 bp, Artificial Sequence
  Description of Artificial Sequence: Synthetic oligonucleotide
cggactaatcctgggtatgcg

SEQ ID NO: 40037 - DNA, 21 bp, Artificial Sequence
  Description of Artificial Sequence: Synthetic oligonucleotide
cggtcgggtaatggttctttg

SEQ ID NO: 40038 - DNA, 21 bp, Artificial Sequence
  Description of Artificial Sequence: Synthetic oligonucleotide
tacgaccccacccccagaggc

SEQ ID NO: 40039 - DNA, 21 bp, Artificial Sequence
  Description of Artificial Sequence: Synthetic oligonucleotide
tcgtatggtcatcctggtgct

SEQ ID NO: 40040 - DNA, 21 bp, Artificial Sequence
  Description of Artificial Sequence: Synthetic oligonucleotide
gacaccgtcagcagacacgtc

SEQ ID NO: 40041 - DNA, 21 bp, Artificial Sequence
  Description of Artificial Sequence: Synthetic oligonucleotide
accagagacagcagcctccac

SEQ ID NO: 40042 - DNA, 21 bp, Artificial Sequence
  Description of Artificial Sequence: Synthetic oligonucleotide
cccggcagcggcagcaaacac

SEQ ID NO: 40043 - DNA, 21 bp, Artificial Sequence
  Description of Artificial Sequence: Synthetic oligonucleotide
aagatgacgccgcagtctact

SEQ ID NO: 40044 - DNA, 21 bp, Artificial Sequence
  Description of Artificial Sequence: Synthetic oligonucleotide
agacaccaaggcaccctccaa

SEQ ID NO: 40045 - DNA, 21 bp, Artificial Sequence
  Description of Artificial Sequence: Synthetic oligonucleotide
gacgccagaaccatggccgcc

SEQ ID NO: 40046 - DNA, 21 bp, Artificial Sequence
  Description of Artificial Sequence: Synthetic oligonucleotide
aagtctccttctagtattttg

SEQ ID NO: 40047 - DNA, 21 bp, Artificial Sequence
  Description of Artificial Sequence: Synthetic oligonucleotide
cacctcagccacgccagcagc

SEQ ID NO: 40048 - DNA, 21 bp, Artificial Sequence
  Description of Artificial Sequence: Synthetic oligonucleotide
tgtccgcctcttccggttaat

SEQ ID NO: 40049 - DNA, 21 bp, Artificial Sequence
  Description of Artificial Sequence: Synthetic oligonucleotide
tctacgcctgtgacgatgaat

SEQ ID NO: 40050 - DNA, 21 bp, Artificial Sequence
  Description of Artificial Sequence: Synthetic oligonucleotide
agtggtcctaatagtcgtgtt

SEQ ID NO: 40051 - DNA, 21 bp, Artificial Sequence
  Description of Artificial Sequence: Synthetic oligonucleotide
agtcggggggtgtcgtctgcg

SEQ ID NO: 40052 - DNA, 21 bp, Artificial Sequence
  Description of Artificial Sequence: Synthetic oligonucleotide
ggtaatccttcgcctttggtt

SEQ ID NO: 40053 - DNA, 21 bp, Artificial Sequence
  Description of Artificial Sequence: Synthetic oligonucleotide
agcaccagaccccccgccaac

SEQ ID NO: 40054 - DNA, 21 bp, Artificial Sequence
  Description of Artificial Sequence: Synthetic oligonucleotide
actcatcgtacgcagaattcg

SEQ ID NO: 40055 - DNA, 21 bp, Artificial Sequence
  Description of Artificial Sequence: Synthetic oligonucleotide
atgagtcatactaagtcgaat

SEQ ID NO: 40056 - DNA, 21 bp, Artificial Sequence
  Description of Artificial Sequence: Synthetic oligonucleotide
gggcgtgcgaatggtcagacg

SEQ ID NO: 40057 - DNA, 21 bp, Artificial Sequence
  Description of Artificial Sequence: Synthetic oligonucleotide
catagttctcgttcgacggtt

SEQ ID NO: 40058 - DNA, 21 bp, Artificial Sequence
  Description of Artificial Sequence: Synthetic oligonucleotide
agcgcccacaacgccagcaga

SEQ ID NO: 40059 - DNA, 21 bp, Artificial Sequence
  Description of Artificial Sequence: Synthetic oligonucleotide
gggcaggctgttaatactgct

SEQ ID NO: 40060 - DNA, 21 bp, Artificial Sequence
  Description of Artificial Sequence: Synthetic oligonucleotide
cgtgatgctacgtctattggg

SEQ ID NO: 40061 - DNA, 21 bp, Artificial Sequence
  Description of Artificial Sequence: Synthetic oligonucleotide
tacaacatcaaacaaggcagc

SEQ ID NO: 40062 - DNA, 21 bp, Artificial Sequence
  Description of Artificial Sequence: Synthetic oligonucleotide
ggcgccgtcagcggcaaactc

SEQ ID NO: 40063 - DNA, 21 bp, Artificial Sequence
  Description of Artificial Sequence: Synthetic oligonucleotide
cccaaccccctccaaaaagac

SEQ ID NO: 40064 - DNA, 21 bp, Artificial Sequence
  Description of Artificial Sequence: Synthetic oligonucleotide
ggtaatgatgttcggattagt

SEQ ID NO: 40065 - DNA, 21 bp, Artificial Sequence
  Description of Artificial Sequence: Synthetic oligonucleotide
tcgattcctcatggggtgagg

SEQ ID NO: 40066 - DNA, 21 bp, Artificial Sequence
  Description of Artificial Sequence: Synthetic oligonucleotide
actgctatgggggatgtgtct

SEQ ID NO: 40067 - DNA, 21 bp, Artificial Sequence
  Description of Artificial Sequence: Synthetic oligonucleotide
ggcagcaccaccagcggcaga

SEQ ID NO: 40068 - DNA, 21 bp, Artificial Sequence
  Description of Artificial Sequence: Synthetic oligonucleotide
gctgtgtcgagtaaggtgggg

SEQ ID NO: 40069 - DNA, 21 bp, Artificial Sequence
  Description of Artificial Sequence: Synthetic oligonucleotide
acccccagcgtcaccaacatg

SEQ ID NO: 40070 - DNA, 21 bp, Artificial Sequence
  Description of Artificial Sequence: Synthetic oligonucleotide
gctcctcagcttaaggggtat

SEQ ID NO: 40071 - DNA, 21 bp, Artificial Sequence
  Description of Artificial Sequence: Synthetic oligonucleotide
accgacaccagcagaagacaa

SEQ ID NO: 40072 - DNA, 21 bp, Artificial Sequence
  Description of Artificial Sequence: Synthetic oligonucleotide
ccggggtctgggagtaatcat

SEQ ID NO: 40073 - DNA, 21 bp, Artificial Sequence
  Description of Artificial Sequence: Synthetic oligonucleotide
aatacgggtatgtctgtgaat

SEQ ID NO: 40074 - DNA, 21 bp, Artificial Sequence
  Description of Artificial Sequence: Synthetic oligonucleotide
atggctcatgatggttatcgg

SEQ ID NO: 40075 - DNA, 21 bp, Artificial Sequence
  Description of Artificial Sequence: Synthetic oligonucleotide
tctcctggtaataagagtact

SEQ ID NO: 40076 - DNA, 21 bp, Artificial Sequence
  Description of Artificial Sequence: Synthetic oligonucleotide
atgggcgtccacagcatcgcc

SEQ ID NO: 40077 - DNA, 21 bp, Artificial Sequence
  Description of Artificial Sequence: Synthetic oligonucleotide
cagaagggtaataatttgccg

SEQ ID NO: 40078 - DNA, 21 bp, Artificial Sequence
  Description of Artificial Sequence: Synthetic oligonucleotide
ggtcttcataggtctaatggt

SEQ ID NO: 40079 - DNA, 21 bp, Artificial Sequence
  Description of Artificial Sequence: Synthetic oligonucleotide
agcctctaccccagcaaaggc

SEQ ID NO: 40080 - DNA, 21 bp, Artificial Sequence
  Description of Artificial Sequence: Synthetic oligonucleotide
gcgccgaatggtatgcaggct

SEQ ID NO: 40081 - DNA, 21 bp, Artificial Sequence
  Description of Artificial Sequence: Synthetic oligonucleotide
gttgggcatgggtctgatatg

SEQ ID NO: 40082 - DNA, 21 bp, Artificial Sequence
  Description of Artificial Sequence: Synthetic oligonucleotide
aacggcttcaacagcaacaac

SEQ ID NO: 40083 - DNA, 21 bp, Artificial Sequence
  Description of Artificial Sequence: Synthetic oligonucleotide
cagggtttgtctactaagagt

SEQ ID NO: 40084 - DNA, 21 bp, Artificial Sequence
  Description of Artificial Sequence: Synthetic oligonucleotide
cccggcatcgccaccggcaga

SEQ ID NO: 40085 - DNA, 21 bp, Artificial Sequence
  Description of Artificial Sequence: Synthetic oligonucleotide
gctacgatgcgttcgaatgag

SEQ ID NO: 40086 - DNA, 21 bp, Artificial Sequence
  Description of Artificial Sequence: Synthetic oligonucleotide
cctacgcatgagagggctaag

SEQ ID NO: 40087 - DNA, 21 bp, Artificial Sequence
  Description of Artificial Sequence: Synthetic oligonucleotide
gggactggtgttccggggaag

SEQ ID NO: 40088 - DNA, 21 bp, Artificial Sequence
  Description of Artificial Sequence: Synthetic oligonucleotide
ccggattctactttttcgagt

SEQ ID NO: 40089 - DNA, 21 bp, Artificial Sequence
  Description of Artificial Sequence: Synthetic oligonucleotide
ctcggcaccaaaatgtgcgcc

SEQ ID NO: 40090 - DNA, 21 bp, Artificial Sequence
  Description of Artificial Sequence: Synthetic oligonucleotide
gttaggatttcgactcaggcg

SEQ ID NO: 40091 - DNA, 21 bp, Artificial Sequence
  Description of Artificial Sequence: Synthetic oligonucleotide
actaatcctactggttatcgt

SEQ ID NO: 40092 - DNA, 21 bp, Artificial Sequence
  Description of Artificial Sequence: Synthetic oligonucleotide
ctcggcgacagaagcttcatc

SEQ ID NO: 40093 - DNA, 21 bp, Artificial Sequence
  Description of Artificial Sequence: Synthetic oligonucleotide
attcttgattcgcataatcgg

SEQ ID NO: 40094 - DNA, 21 bp, Artificial Sequence
  Description of Artificial Sequence: Synthetic oligonucleotide
ggccacgccgccggcgtcagc

SEQ ID NO: 40095 - DNA, 21 bp, Artificial Sequence
  Description of Artificial Sequence: Synthetic oligonucleotide
aacagcagcggccaaaacccc

SEQ ID NO: 40096 - DNA, 21 bp, Artificial Sequence
  Description of Artificial Sequence: Synthetic oligonucleotide
tctgttcatcagaatcgggcg

SEQ ID NO: 40097 - DNA, 21 bp, Artificial Sequence
  Description of Artificial Sequence: Synthetic oligonucleotide
gttagtacgactcctgctttg

SEQ ID NO: 40098 - DNA, 21 bp, Artificial Sequence
  Description of Artificial Sequence: Synthetic oligonucleotide
atcaccaccagaagcagcatg

SEQ ID NO: 40099 - DNA, 21 bp, Artificial Sequence
  Description of Artificial Sequence: Synthetic oligonucleotide
ggggttgagcgtatgaggggt

SEQ ID NO: 40100 - DNA, 21 bp, Artificial Sequence
  Description of Artificial Sequence: Synthetic oligonucleotide
cccagcaacaaagccggcacc

SEQ ID NO: 40101 - DNA, 21 bp, Artificial Sequence
  Description of Artificial Sequence: Synthetic oligonucleotide
cattatggtgagactcggaat

SEQ ID NO: 40102 - DNA, 21 bp, Artificial Sequence
  Description of Artificial Sequence: Synthetic oligonucleotide
gttggtcataagggggggcct

SEQ ID NO: 40103 - DNA, 21 bp, Artificial Sequence
  Description of Artificial Sequence: Synthetic oligonucleotide
cacgtcgcccaactcggcagc

SEQ ID NO: 40104 - DNA, 21 bp, Artificial Sequence
  Description of Artificial Sequence: Synthetic oligonucleotide
ttcaccatccccagagccgac

SEQ ID NO: 40105 - DNA, 21 bp, Artificial Sequence
  Description of Artificial Sequence: Synthetic oligonucleotide
ggccaaacccacgccgtcaga

SEQ ID NO: 40106 - DNA, 21 bp, Artificial Sequence
  Description of Artificial Sequence: Synthetic oligonucleotide
gagatttcgcagcagggtact

SEQ ID NO: 40107 - DNA, 21 bp, Artificial Sequence
  Description of Artificial Sequence: Synthetic oligonucleotide
atccaaagcagcgacagactc

SEQ ID NO: 40108 - DNA, 21 bp, Artificial Sequence
  Description of Artificial Sequence: Synthetic oligonucleotide
agcctcagcagcaaccccagc

SEQ ID NO: 40109 - DNA, 21 bp, Artificial Sequence
  Description of Artificial Sequence: Synthetic oligonucleotide
gcttcgagggatagggctggt

SEQ ID NO: 40110 - DNA, 21 bp, Artificial Sequence
  Description of Artificial Sequence: Synthetic oligonucleotide
ccgattagtccgcgtatgagt

SEQ ID NO: 40111 - DNA, 21 bp, Artificial Sequence
  Description of Artificial Sequence: Synthetic oligonucleotide
ggtcctgctgttacgaatcgt

SEQ ID NO: 40112 - DNA, 21 bp, Artificial Sequence
  Description of Artificial Sequence: Synthetic oligonucleotide
gcgactcatacgtctgttagt

SEQ ID NO: 40113 - DNA, 21 bp, Artificial Sequence
  Description of Artificial Sequence: Synthetic oligonucleotide
acgcattcgaagagttttgtg

SEQ ID NO: 40114 - DNA, 21 bp, Artificial Sequence
  Description of Artificial Sequence: Synthetic oligonucleotide
cgggtgtctcatgctcaggat

SEQ ID NO: 40115 - DNA, 21 bp, Artificial Sequence
  Description of Artificial Sequence: Synthetic oligonucleotide
gtcagcaacagccaaagcctc

SEQ ID NO: 40116 - DNA, 21 bp, Artificial Sequence
  Description of Artificial Sequence: Synthetic oligonucleotide
gggactatgagtaatgggcat

SEQ ID NO: 40117 - DNA, 21 bp, Artificial Sequence
  Description of Artificial Sequence: Synthetic oligonucleotide
tttacgattccgcgtgcggtt

SEQ ID NO: 40118 - DNA, 21 bp, Artificial Sequence
  Description of Artificial Sequence: Synthetic oligonucleotide
agcaccaccctcagaaacagc

SEQ ID NO: 40119 - DNA, 21 bp, Artificial Sequence
  Description of Artificial Sequence: Synthetic oligonucleotide
atgatcagcggcgccaccaga

SEQ ID NO: 40120 - DNA, 21 bp, Artificial Sequence
  Description of Artificial Sequence: Synthetic oligonucleotide
accggcccccacatcaaagcc

SEQ ID NO: 40121 - DNA, 21 bp, Artificial Sequence
  Description of Artificial Sequence: Synthetic oligonucleotide
cacgtccacgacggcagaacc

SEQ ID NO: 40122 - DNA, 21 bp, Artificial Sequence
  Description of Artificial Sequence: Synthetic oligonucleotide
tcgaataatagtggttcgtgt

SEQ ID NO: 40123 - DNA, 21 bp, Artificial Sequence
  Description of Artificial Sequence: Synthetic oligonucleotide
cagacgatgcctaagcttgct

SEQ ID NO: 40124 - DNA, 21 bp, Artificial Sequence
  Description of Artificial Sequence: Synthetic oligonucleotide
ttgggtcggtcgccgcctgct

SEQ ID NO: 40125 - DNA, 21 bp, Artificial Sequence
  Description of Artificial Sequence: Synthetic oligonucleotide
cacagagccagcaccgacgcc

SEQ ID NO: 40126 - DNA, 21 bp, Artificial Sequence
  Description of Artificial Sequence: Synthetic oligonucleotide
agtcgttctgttaattttggt

SEQ ID NO: 40127 - DNA, 21 bp, Artificial Sequence
  Description of Artificial Sequence: Synthetic oligonucleotide
gcgtcggggaatggtcgtcct

SEQ ID NO: 40128 - DNA, 21 bp, Artificial Sequence
  Description of Artificial Sequence: Synthetic oligonucleotide
gggcatagtactgtgggtagt

SEQ ID NO: 40129 - DNA, 21 bp, Artificial Sequence
  Description of Artificial Sequence: Synthetic oligonucleotide
gaaagacacgtccccagcagc

SEQ ID NO: 40130 - DNA, 21 bp, Artificial Sequence
  Description of Artificial Sequence: Synthetic oligonucleotide
agacccgccaccagcaccccc

SEQ ID NO: 40131 - DNA, 21 bp, Artificial Sequence
  Description of Artificial Sequence: Synthetic oligonucleotide
gttaaggttgatgggcagatt

SEQ ID NO: 40132 - DNA, 21 bp, Artificial Sequence
  Description of Artificial Sequence: Synthetic oligonucleotide
caaggcaaaaccgccccctac

SEQ ID NO: 40133 - DNA, 21 bp, Artificial Sequence
  Description of Artificial Sequence: Synthetic oligonucleotide
gccagaaacagagtcggcatc

SEQ ID NO: 40134 - DNA, 21 bp, Artificial Sequence
  Description of Artificial Sequence: Synthetic oligonucleotide
ctccccaccagcagcgtcgcc

SEQ ID NO: 40135 - DNA, 21 bp, Artificial Sequence
  Description of Artificial Sequence: Synthetic oligonucleotide
agtgggaaggatcggctgcat

SEQ ID NO: 40136 - DNA, 21 bp, Artificial Sequence
  Description of Artificial Sequence: Synthetic oligonucleotide
cgtctgcataatatgtcggct

SEQ ID NO: 40137 - DNA, 21 bp, Artificial Sequence
  Description of Artificial Sequence: Synthetic oligonucleotide
agtgataataagggttcggtg

SEQ ID NO: 40138 - DNA, 21 bp, Artificial Sequence
  Description of Artificial Sequence: Synthetic oligonucleotide
accaacaccgccggctggagc

SEQ ID NO: 40139 - DNA, 21 bp, Artificial Sequence
  Description of Artificial Sequence: Synthetic oligonucleotide
cgtactgggcatagtgcgggt

SEQ ID NO: 40140 - DNA, 21 bp, Artificial Sequence
  Description of Artificial Sequence: Synthetic oligonucleotide
gccctcaaacaaaccgccgcc

SEQ ID NO: 40141 - DNA, 21 bp, Artificial Sequence
  Description of Artificial Sequence: Synthetic oligonucleotide
atgaacggcagccccagaatc

SEQ ID NO: 40142 - DNA, 21 bp, Artificial Sequence
  Description of Artificial Sequence: Synthetic oligonucleotide
gcctacagcaccaccaacaga

SEQ ID NO: 40143 - DNA, 21 bp, Artificial Sequence
  Description of Artificial Sequence: Synthetic oligonucleotide
atcagaaccaacagcaccctc

SEQ ID NO: 40144 - DNA, 21 bp, Artificial Sequence
  Description of Artificial Sequence: Synthetic oligonucleotide
ggtaatgggactcgtcatgtg

SEQ ID NO: 40145 - DNA, 21 bp, Artificial Sequence
  Description of Artificial Sequence: Synthetic oligonucleotide
agctacgccgacaaacaaggc

SEQ ID NO: 40146 - DNA, 21 bp, Artificial Sequence
  Description of Artificial Sequence: Synthetic oligonucleotide
ggcacccaagccgcccacgtc

SEQ ID NO: 40147 - DNA, 21 bp, Artificial Sequence
  Description of Artificial Sequence: Synthetic oligonucleotide
ctcaacggcagcgccaccgcc

SEQ ID NO: 40148 - DNA, 21 bp, Artificial Sequence
  Description of Artificial Sequence: Synthetic oligonucleotide
ttggttcgggcgactcatgag

SEQ ID NO: 40149 - DNA, 21 bp, Artificial Sequence
  Description of Artificial Sequence: Synthetic oligonucleotide
cgtttgggtaatagtcatgcg

SEQ ID NO: 40150 - DNA, 21 bp, Artificial Sequence
  Description of Artificial Sequence: Synthetic oligonucleotide
cctatgcgggggactttggcg

SEQ ID NO: 40151 - DNA, 21 bp, Artificial Sequence
  Description of Artificial Sequence: Synthetic oligonucleotide
gtcggcagcagaaacgtcggc

SEQ ID NO: 40152 - DNA, 21 bp, Artificial Sequence
  Description of Artificial Sequence: Synthetic oligonucleotide
cccagacacgtccccctcctc

SEQ ID NO: 40153 - DNA, 21 bp, Artificial Sequence
  Description of Artificial Sequence: Synthetic oligonucleotide
agcagccacagcaacagcgaa

SEQ ID NO: 40154 - DNA, 21 bp, Artificial Sequence
  Description of Artificial Sequence: Synthetic oligonucleotide
tctctgaggactccttctggt

SEQ ID NO: 40155 - DNA, 21 bp, Artificial Sequence
  Description of Artificial Sequence: Synthetic oligonucleotide
ctccccaccaccgccagcagc

SEQ ID NO: 40156 - DNA, 21 bp, Artificial Sequence
  Description of Artificial Sequence: Synthetic oligonucleotide
ggtgcgggtactagttatcat

SEQ ID NO: 40157 - DNA, 21 bp, Artificial Sequence
  Description of Artificial Sequence: Synthetic oligonucleotide
agtacgtctgggattcgttct

SEQ ID NO: 40158 - DNA, 21 bp, Artificial Sequence
  Description of Artificial Sequence: Synthetic oligonucleotide
attgggctgaatcgtactggg

SEQ ID NO: 40159 - DNA, 21 bp, Artificial Sequence
  Description of Artificial Sequence: Synthetic oligonucleotide
gctaatcgtactcggcaggat

SEQ ID NO: 40160 - DNA, 21 bp, Artificial Sequence
  Description of Artificial Sequence: Synthetic oligonucleotide
cccgtcagagaaggcagcatc

SEQ ID NO: 40161 - DNA, 21 bp, Artificial Sequence
  Description of Artificial Sequence: Synthetic oligonucleotide
cctggtaatgagattggtagg

SEQ ID NO: 40162 - DNA, 21 bp, Artificial Sequence
  Description of Artificial Sequence: Synthetic oligonucleotide
agtccttttcagtcttctcat

SEQ ID NO: 40163 - DNA, 21 bp, Artificial Sequence
  Description of Artificial Sequence: Synthetic oligonucleotide
gctatgtctgagcatctgaag

SEQ ID NO: 40164 - DNA, 21 bp, Artificial Sequence
  Description of Artificial Sequence: Synthetic oligonucleotide
catctggataggctgtctaag

SEQ ID NO: 40165 - DNA, 21 bp, Artificial Sequence
  Description of Artificial Sequence: Synthetic oligonucleotide
gaagtcaccaacgcccccaaa

SEQ ID NO: 40166 - DNA, 21 bp, Artificial Sequence
  Description of Artificial Sequence: Synthetic oligonucleotide
tcttcgaatgagaaggatagg

SEQ ID NO: 40167 - DNA, 21 bp, Artificial Sequence
  Description of Artificial Sequence: Synthetic oligonucleotide
tctttgtcgcggcttagtggg

SEQ ID NO: 40168 - DNA, 21 bp, Artificial Sequence
  Description of Artificial Sequence: Synthetic oligonucleotide
ggcctccccctcagacccaac

SEQ ID NO: 40169 - DNA, 21 bp, Artificial Sequence
  Description of Artificial Sequence: Synthetic oligonucleotide
gaaaccagacccgccatctgc

SEQ ID NO: 40170 - DNA, 21 bp, Artificial Sequence
  Description of Artificial Sequence: Synthetic oligonucleotide
aacagttctggacagaatcaa

SEQ ID NO: 40171 - DNA, 21 bp, Artificial Sequence
  Description of Artificial Sequence: Synthetic oligonucleotide
agcagaagcgcccccagactc

SEQ ID NO: 40172 - DNA, 21 bp, Artificial Sequence
  Description of Artificial Sequence: Synthetic oligonucleotide
gccaccggcagaagccccaac

SEQ ID NO: 40173 - DNA, 21 bp, Artificial Sequence
  Description of Artificial Sequence: Synthetic oligonucleotide
tgccaacccagaagcgccaac

SEQ ID NO: 40174 - DNA, 21 bp, Artificial Sequence
  Description of Artificial Sequence: Synthetic oligonucleotide
gcgacgtctgcgactaggatg

SEQ ID NO: 40175 - DNA, 21 bp, Artificial Sequence
  Description of Artificial Sequence: Synthetic oligonucleotide
ctcaccgtcagaagccaaagc

SEQ ID NO: 40176 - DNA, 21 bp, Artificial Sequence
  Description of Artificial Sequence: Synthetic oligonucleotide
tctaatactcattcgcctagt

SEQ ID NO: 40177 - DNA, 21 bp, Artificial Sequence
  Description of Artificial Sequence: Synthetic oligonucleotide
attcgttcgacttctggtggg

SEQ ID NO: 40178 - DNA, 21 bp, Artificial Sequence
  Description of Artificial Sequence: Synthetic oligonucleotide
acggctactaaggctgatagg

SEQ ID NO: 40179 - DNA, 21 bp, Artificial Sequence
  Description of Artificial Sequence: Synthetic oligonucleotide
agtcagagtactcagtttggg

SEQ ID NO: 40180 - DNA, 21 bp, Artificial Sequence
  Description of Artificial Sequence: Synthetic oligonucleotide
gcgcaggctagtaggactact

SEQ ID NO: 40181 - DNA, 21 bp, Artificial Sequence
  Description of Artificial Sequence: Synthetic oligonucleotide
ggcggcagaagcgtcggcctc

SEQ ID NO: 40182 - DNA, 21 bp, Artificial Sequence
  Description of Artificial Sequence: Synthetic oligonucleotide
actcatgctgctcattcttct

SEQ ID NO: 40183 - DNA, 21 bp, Artificial Sequence
  Description of Artificial Sequence: Synthetic oligonucleotide
atgggtcatgctaagacggct

SEQ ID NO: 40184 - DNA, 21 bp, Artificial Sequence
  Description of Artificial Sequence: Synthetic oligonucleotide
ggcatgcacagcgtcgccaaa

SEQ ID NO: 40185 - DNA, 21 bp, Artificial Sequence
  Description of Artificial Sequence: Synthetic oligonucleotide
ccttattcgcgtcctgctcag

SEQ ID NO: 40186 - DNA, 21 bp, Artificial Sequence
  Description of Artificial Sequence: Synthetic oligonucleotide
caggtgtcgcctttgattttg

SEQ ID NO: 40187 - DNA, 21 bp, Artificial Sequence
  Description of Artificial Sequence: Synthetic oligonucleotide
agatacccccccgccacccac

SEQ ID NO: 40188 - DNA, 21 bp, Artificial Sequence
  Description of Artificial Sequence: Synthetic oligonucleotide
aatttggggacgaatgttctg

SEQ ID NO: 40189 - DNA, 21 bp, Artificial Sequence
  Description of Artificial Sequence: Synthetic oligonucleotide
aacggtgctggacagaatcaa

SEQ ID NO: 40190 - DNA, 21 bp, Artificial Sequence
  Description of Artificial Sequence: Synthetic oligonucleotide
aatatttcgactaggcagagt

SEQ ID NO: 40191 - DNA, 21 bp, Artificial Sequence
  Description of Artificial Sequence: Synthetic oligonucleotide
ggcaccgtcgacaaagccagc

SEQ ID NO: 40192 - DNA, 21 bp, Artificial Sequence
  Description of Artificial Sequence: Synthetic oligonucleotide
aatgctatgaatactcggggt

SEQ ID NO: 40193 - DNA, 21 bp, Artificial Sequence
  Description of Artificial Sequence: Synthetic oligonucleotide
cacctcagaggcagcaacacc

SEQ ID NO: 40194 - DNA, 21 bp, Artificial Sequence
  Description of Artificial Sequence: Synthetic oligonucleotide
tcgcatcagcgtcctattcag

SEQ ID NO: 40195 - DNA, 21 bp, Artificial Sequence
  Description of Artificial Sequence: Synthetic oligonucleotide
agacccagcggcagcgaaccc

SEQ ID NO: 40196 - DNA, 21 bp, Artificial Sequence
  Description of Artificial Sequence: Synthetic oligonucleotide
agtgcgagtccgtctcttagt

SEQ ID NO: 40197 - DNA, 21 bp, Artificial Sequence
  Description of Artificial Sequence: Synthetic oligonucleotide
catcagtctggtagtacgtgt

SEQ ID NO: 40198 - DNA, 21 bp, Artificial Sequence
  Description of Artificial Sequence: Synthetic oligonucleotide
tctagtgttagtcgttctcat

SEQ ID NO: 40199 - DNA, 21 bp, Artificial Sequence
  Description of Artificial Sequence: Synthetic oligonucleotide
agagccggcaacgcccccacc

SEQ ID NO: 40200 - DNA, 21 bp, Artificial Sequence
  Description of Artificial Sequence: Synthetic oligonucleotide
tggctttctcagcagtctagt

SEQ ID NO: 40201 - DNA, 21 bp, Artificial Sequence
  Description of Artificial Sequence: Synthetic oligonucleotide
aaagccaacatgagcaaccaa

SEQ ID NO: 40202 - DNA, 21 bp, Artificial Sequence
  Description of Artificial Sequence: Synthetic oligonucleotide
ctcgaaaacagagccctcagc

SEQ ID NO: 40203 - DNA, 21 bp, Artificial Sequence
  Description of Artificial Sequence: Synthetic oligonucleotide
tctactacgggtgatcgtctt

SEQ ID NO: 40204 - DNA, 21 bp, Artificial Sequence
  Description of Artificial Sequence: Synthetic oligonucleotide
tttattgggacgaggagtgcg

SEQ ID NO: 40205 - DNA, 21 bp, Artificial Sequence
  Description of Artificial Sequence: Synthetic oligonucleotide
gatgttcgggctcgtacggcg

SEQ ID NO: 40206 - DNA, 21 bp, Artificial Sequence
  Description of Artificial Sequence: Synthetic oligonucleotide
cagtcgcgggtttctgttaat

SEQ ID NO: 40207 - DNA, 21 bp, Artificial Sequence
  Description of Artificial Sequence: Synthetic oligonucleotide
cgggcgaggttgggtgatagt

SEQ ID NO: 40208 - DNA, 21 bp, Artificial Sequence
  Description of Artificial Sequence: Synthetic oligonucleotide
accctctacagcaacaaaggc

SEQ ID NO: 40209 - DNA, 21 bp, Artificial Sequence
  Description of Artificial Sequence: Synthetic oligonucleotide
gccctcgtcaccagacccacc

SEQ ID NO: 40210 - DNA, 21 bp, Artificial Sequence
  Description of Artificial Sequence: Synthetic oligonucleotide
cacaccgacaccagagccgtc

SEQ ID NO: 40211 - DNA, 21 bp, Artificial Sequence
  Description of Artificial Sequence: Synthetic oligonucleotide
ggtgggagtcgtccttttctt

SEQ ID NO: 40212 - DNA, 21 bp, Artificial Sequence
  Description of Artificial Sequence: Synthetic oligonucleotide
tgtaattctcataatgcggct

SEQ ID NO: 40213 - DNA, 21 bp, Artificial Sequence
  Description of Artificial Sequence: Synthetic oligonucleotide
ttggggtctaatcgttattct

SEQ ID NO: 40214 - DNA, 21 bp, Artificial Sequence
  Description of Artificial Sequence: Synthetic oligonucleotide
tttgggtctagtactattttg

SEQ ID NO: 40215 - DNA, 21 bp, Artificial Sequence
  Description of Artificial Sequence: Synthetic oligonucleotide
ggtacttctccttccacgatg

SEQ ID NO: 40216 - DNA, 21 bp, Artificial Sequence
  Description of Artificial Sequence: Synthetic oligonucleotide
tcggtgcagggggagcggatg

SEQ ID NO: 40217 - DNA, 21 bp, Artificial Sequence
  Description of Artificial Sequence: Synthetic oligonucleotide
ggggctcttcatacgagggat

SEQ ID NO: 40218 - DNA, 21 bp, Artificial Sequence
  Description of Artificial Sequence: Synthetic oligonucleotide
ggcatgggcaacgaccccaga

SEQ ID NO: 40219 - DNA, 21 bp, Artificial Sequence
  Description of Artificial Sequence: Synthetic oligonucleotide
ggtacggctttgattgctgct

SEQ ID NO: 40220 - DNA, 21 bp, Artificial Sequence
  Description of Artificial Sequence: Synthetic oligonucleotide
ctgcagaataagttggtggtg

SEQ ID NO: 40221 - DNA, 21 bp, Artificial Sequence
  Description of Artificial Sequence: Synthetic oligonucleotide
caagccaaaaacatccacagc

SEQ ID NO: 40222 - DNA, 21 bp, Artificial Sequence
  Description of Artificial Sequence: Synthetic oligonucleotide
gttacgccgtcgaggggtttt

SEQ ID NO: 40223 - DNA, 21 bp, Artificial Sequence
  Description of Artificial Sequence: Synthetic oligonucleotide
atgcaagccaaaagcggccac

SEQ ID NO: 40224 - DNA, 21 bp, Artificial Sequence
  Description of Artificial Sequence: Synthetic oligonucleotide
agtctttcgggggtgatgact

SEQ ID NO: 40225 - DNA, 21 bp, Artificial Sequence
  Description of Artificial Sequence: Synthetic oligonucleotide
tgtatgtctactaggttgact

SEQ ID NO: 40226 - DNA, 21 bp, Artificial Sequence
  Description of Artificial Sequence: Synthetic oligonucleotide
gtccccagaggccccggcatg

SEQ ID NO: 40227 - DNA, 21 bp, Artificial Sequence
  Description of Artificial Sequence: Synthetic oligonucleotide
agcatccaaagaaccagcagc

SEQ ID NO: 40228 - DNA, 21 bp, Artificial Sequence
  Description of Artificial Sequence: Synthetic oligonucleotide
gccgccaccaacagcttcggc

SEQ ID NO: 40229 - DNA, 21 bp, Artificial Sequence
  Description of Artificial Sequence: Synthetic oligonucleotide
catattcagggtcctcataat

SEQ ID NO: 40230 - DNA, 21 bp, Artificial Sequence
  Description of Artificial Sequence: Synthetic oligonucleotide
attaatactagtagtgattcg

SEQ ID NO: 40231 - DNA, 21 bp, Artificial Sequence
  Description of Artificial Sequence: Synthetic oligonucleotide
gagcgtgctcgtcctgttctt

SEQ ID NO: 40232 - DNA, 21 bp, Artificial Sequence
  Description of Artificial Sequence: Synthetic oligonucleotide
catcctagtcgtcctgtgctt

SEQ ID NO: 40233 - DNA, 21 bp, Artificial Sequence
  Description of Artificial Sequence: Synthetic oligonucleotide
agaaccagccccaccctcgtc

SEQ ID NO: 40234 - DNA, 21 bp, Artificial Sequence
  Description of Artificial Sequence: Synthetic oligonucleotide
agcagaagcaccggcaccctc

SEQ ID NO: 40235 - DNA, 21 bp, Artificial Sequence
  Description of Artificial Sequence: Synthetic oligonucleotide
accagaggcagccccctcatg

SEQ ID NO: 40236 - DNA, 21 bp, Artificial Sequence
  Description of Artificial Sequence: Synthetic oligonucleotide
agtacgtcgacggttcattcg

SEQ ID NO: 40237 - DNA, 21 bp, Artificial Sequence
  Description of Artificial Sequence: Synthetic oligonucleotide
ccttctaagggtacgtatcct

SEQ ID NO: 40238 - DNA, 21 bp, Artificial Sequence
  Description of Artificial Sequence: Synthetic oligonucleotide
cacctcagccacagccccacc

SEQ ID NO: 40239 - DNA, 21 bp, Artificial Sequence
  Description of Artificial Sequence: Synthetic oligonucleotide
ccccccagcaaacccaacacc

SEQ ID NO: 40240 - DNA, 21 bp, Artificial Sequence
  Description of Artificial Sequence: Synthetic oligonucleotide
agtgttgttcctaagactaat

SEQ ID NO: 40241 - DNA, 21 bp, Artificial Sequence
  Description of Artificial Sequence: Synthetic oligonucleotide
atcgccagccaacccctcaga

SEQ ID NO: 40242 - DNA, 21 bp, Artificial Sequence
  Description of Artificial Sequence: Synthetic oligonucleotide
gacagagccagaaacgtccac

SEQ ID NO: 40243 - DNA, 21 bp, Artificial Sequence
  Description of Artificial Sequence: Synthetic oligonucleotide
tattctaattcgcgtgtgggt

SEQ ID NO: 40244 - DNA, 21 bp, Artificial Sequence
  Description of Artificial Sequence: Synthetic oligonucleotide
gaccccctcagacaaagcgtc

SEQ ID NO: 40245 - DNA, 21 bp, Artificial Sequence
  Description of Artificial Sequence: Synthetic oligonucleotide
ggcagccaccaccccagcggc

SEQ ID NO: 40246 - DNA, 21 bp, Artificial Sequence
  Description of Artificial Sequence: Synthetic oligonucleotide
accggcatcggcagccacctc

SEQ ID NO: 40247 - DNA, 21 bp, Artificial Sequence
  Description of Artificial Sequence: Synthetic oligonucleotide
aatactaatgggagtcagcgt

SEQ ID NO: 40248 - DNA, 21 bp, Artificial Sequence
  Description of Artificial Sequence: Synthetic oligonucleotide
agcagcaacaccagaatcgtc

SEQ ID NO: 40249 - DNA, 21 bp, Artificial Sequence
  Description of Artificial Sequence: Synthetic oligonucleotide
ggtcctcaggtgtctcggact

SEQ ID NO: 40250 - DNA, 21 bp, Artificial Sequence
  Description of Artificial Sequence: Synthetic oligonucleotide
aacaacaccagcacccacctc

SEQ ID NO: 40251 - DNA, 21 bp, Artificial Sequence
  Description of Artificial Sequence: Synthetic oligonucleotide
ggcaccggcacccccagaacc

SEQ ID NO: 40252 - DNA, 21 bp, Artificial Sequence
  Description of Artificial Sequence: Synthetic oligonucleotide
caagtccccgtcagacccgtc

SEQ ID NO: 40253 - DNA, 21 bp, Artificial Sequence
  Description of Artificial Sequence: Synthetic oligonucleotide
attaatggtactcagacgctg

SEQ ID NO: 40254 - DNA, 21 bp, Artificial Sequence
  Description of Artificial Sequence: Synthetic oligonucleotide
gaaagccccaacctccacagc

SEQ ID NO: 40255 - DNA, 21 bp, Artificial Sequence
  Description of Artificial Sequence: Synthetic oligonucleotide
gttccgcataatcattcgttg

SEQ ID NO: 40256 - DNA, 21 bp, Artificial Sequence
  Description of Artificial Sequence: Synthetic oligonucleotide
cccaaactcgccgccgacctc

SEQ ID NO: 40257 - DNA, 21 bp, Artificial Sequence
  Description of Artificial Sequence: Synthetic oligonucleotide
aaaggcaaaagcggcgaacaa

SEQ ID NO: 40258 - DNA, 21 bp, Artificial Sequence
  Description of Artificial Sequence: Synthetic oligonucleotide
tcgaaggttactgcgcagtct

SEQ ID NO: 40259 - DNA, 21 bp, Artificial Sequence
  Description of Artificial Sequence: Synthetic oligonucleotide
gagacgaattctcgtttgggt

SEQ ID NO: 40260 - DNA, 21 bp, Artificial Sequence
  Description of Artificial Sequence: Synthetic oligonucleotide
ggcagaaccaacagctacagc

SEQ ID NO: 40261 - DNA, 21 bp, Artificial Sequence
  Description of Artificial Sequence: Synthetic oligonucleotide
cgtactccgactgctagtggg

SEQ ID NO: 40262 - DNA, 21 bp, Artificial Sequence
  Description of Artificial Sequence: Synthetic oligonucleotide
tttcctctgactaagcctgct

SEQ ID NO: 40263 - DNA, 21 bp, Artificial Sequence
  Description of Artificial Sequence: Synthetic oligonucleotide
tgcggcagcaccaaaaccagc

SEQ ID NO: 40264 - DNA, 21 bp, Artificial Sequence
  Description of Artificial Sequence: Synthetic oligonucleotide
ccggcgactgtgactggtgtt

SEQ ID NO: 40265 - DNA, 21 bp, Artificial Sequence
  Description of Artificial Sequence: Synthetic oligonucleotide
ggcttccccgtcagcagcatg

SEQ ID NO: 40266 - DNA, 21 bp, Artificial Sequence
  Description of Artificial Sequence: Synthetic oligonucleotide
ttggggattgctaatattggg

SEQ ID NO: 40267 - DNA, 21 bp, Artificial Sequence
  Description of Artificial Sequence: Synthetic oligonucleotide
cacgtcagactcagcggcagc

SEQ ID NO: 40268 - DNA, 21 bp, Artificial Sequence
  Description of Artificial Sequence: Synthetic oligonucleotide
gatattatgtctcctttgaag

SEQ ID NO: 40269 - DNA, 21 bp, Artificial Sequence
  Description of Artificial Sequence: Synthetic oligonucleotide
gccgtcagagtcgaaagaccc

SEQ ID NO: 40270 - DNA, 21 bp, Artificial Sequence
  Description of Artificial Sequence: Synthetic oligonucleotide
tctaagggtaggcctactatt

SEQ ID NO: 40271 - DNA, 21 bp, Artificial Sequence
  Description of Artificial Sequence: Synthetic oligonucleotide
cttaatgctggtcgttctacg

SEQ ID NO: 40272 - DNA, 21 bp, Artificial Sequence
  Description of Artificial Sequence: Synthetic oligonucleotide
accacccacaacatgcaaggc

SEQ ID NO: 40273 - DNA, 21 bp, Artificial Sequence
  Description of Artificial Sequence: Synthetic oligonucleotide
tcgattccgtcgactagtcag

SEQ ID NO: 40274 - DNA, 21 bp, Artificial Sequence
  Description of Artificial Sequence: Synthetic oligonucleotide
accagcaacatggtcggcaaa

SEQ ID NO: 40275 - DNA, 21 bp, Artificial Sequence
  Description of Artificial Sequence: Synthetic oligonucleotide
actggtaataaggggggggtg

SEQ ID NO: 40276 - DNA, 21 bp, Artificial Sequence
  Description of Artificial Sequence: Synthetic oligonucleotide
gtcagcggcagcaacagcctc

SEQ ID NO: 40277 - DNA, 21 bp, Artificial Sequence
  Description of Artificial Sequence: Synthetic oligonucleotide
cggatgttggatggtcattcg

SEQ ID NO: 40278 - DNA, 21 bp, Artificial Sequence
  Description of Artificial Sequence: Synthetic oligonucleotide
aatgatcgtggtcagaatggg

SEQ ID NO: 40279 - DNA, 21 bp, Artificial Sequence
  Description of Artificial Sequence: Synthetic oligonucleotide
agccaaagcaacagcttcctc

SEQ ID NO: 40280 - DNA, 21 bp, Artificial Sequence
  Description of Artificial Sequence: Synthetic oligonucleotide
agtgatggtggtggtaggatg

SEQ ID NO: 40281 - DNA, 21 bp, Artificial Sequence
  Description of Artificial Sequence: Synthetic oligonucleotide
agagtcgccaccagcgtcagc

SEQ ID NO: 40282 - DNA, 21 bp, Artificial Sequence
  Description of Artificial Sequence: Synthetic oligonucleotide
agactcgcccaaagcggcctc

SEQ ID NO: 40283 - DNA, 21 bp, Artificial Sequence
  Description of Artificial Sequence: Synthetic oligonucleotide
agcgtcgccgacaccagactc

SEQ ID NO: 40284 - DNA, 21 bp, Artificial Sequence
  Description of Artificial Sequence: Synthetic oligonucleotide
aatgctaatgtgcagactcgg

SEQ ID NO: 40285 - DNA, 21 bp, Artificial Sequence
  Description of Artificial Sequence: Synthetic oligonucleotide
tacagcggcgccagcggcaga

SEQ ID NO: 40286 - DNA, 21 bp, Artificial Sequence
  Description of Artificial Sequence: Synthetic oligonucleotide
tctcggcagcctcttatgacg

SEQ ID NO: 40287 - DNA, 21 bp, Artificial Sequence
  Description of Artificial Sequence: Synthetic oligonucleotide
caccacagcaccctccaaacc

SEQ ID NO: 40288 - DNA, 21 bp, Artificial Sequence
  Description of Artificial Sequence: Synthetic oligonucleotide
accgtcaccaacgccgccaga

SEQ ID NO: 40289 - DNA, 21 bp, Artificial Sequence
  Description of Artificial Sequence: Synthetic oligonucleotide
agcgtcaacagccaccacggc

SEQ ID NO: 40290 - DNA, 21 bp, Artificial Sequence
  Description of Artificial Sequence: Synthetic oligonucleotide
ggggatctgaatcctccttct

SEQ ID NO: 40291 - DNA, 21 bp, Artificial Sequence
  Description of Artificial Sequence: Synthetic oligonucleotide
aattctcatagtgggcatcgt

SEQ ID NO: 40292 - DNA, 21 bp, Artificial Sequence
  Description of Artificial Sequence: Synthetic oligonucleotide
cctggtgctgatccgaatctt

SEQ ID NO: 40293 - DNA, 21 bp, Artificial Sequence
  Description of Artificial Sequence: Synthetic oligonucleotide
catgcgaataataagctgatg

SEQ ID NO: 40294 - DNA, 21 bp, Artificial Sequence
  Description of Artificial Sequence: Synthetic oligonucleotide
tatggttctcctgtgcatcag

SEQ ID NO: 40295 - DNA, 21 bp, Artificial Sequence
  Description of Artificial Sequence: Synthetic oligonucleotide
gttagttcgaatgctagtatg

SEQ ID NO: 40296 - DNA, 21 bp, Artificial Sequence
  Description of Artificial Sequence: Synthetic oligonucleotide
gggtttcatggtcagggttcg

SEQ ID NO: 40297 - DNA, 21 bp, Artificial Sequence
  Description of Artificial Sequence: Synthetic oligonucleotide
agtctgactcggactttgggt

SEQ ID NO: 40298 - DNA, 21 bp, Artificial Sequence
  Description of Artificial Sequence: Synthetic oligonucleotide
ctcagaagcgacagatgggac

SEQ ID NO: 40299 - DNA, 21 bp, Artificial Sequence
  Description of Artificial Sequence: Synthetic oligonucleotide
actcagcggcctgctcagatg

SEQ ID NO: 40300 - DNA, 21 bp, Artificial Sequence
  Description of Artificial Sequence: Synthetic oligonucleotide
ctggcgagtacttattctggt

SEQ ID NO: 40301 - DNA, 21 bp, Artificial Sequence
  Description of Artificial Sequence: Synthetic oligonucleotide
ttcgccctcagcaacagcacc

SEQ ID NO: 40302 - DNA, 21 bp, Artificial Sequence
  Description of Artificial Sequence: Synthetic oligonucleotide
gactacagcagcgacagcagc

SEQ ID NO: 40303 - DNA, 21 bp, Artificial Sequence
  Description of Artificial Sequence: Synthetic oligonucleotide
gcctaccccaccaccggcagc

SEQ ID NO: 40304 - DNA, 21 bp, Artificial Sequence
  Description of Artificial Sequence: Synthetic oligonucleotide
agaaacgtcagccacctcgaa

SEQ ID NO: 40305 - DNA, 21 bp, Artificial Sequence
  Description of Artificial Sequence: Synthetic oligonucleotide
tctacggtgggtcatatgaat

SEQ ID NO: 40306 - DNA, 21 bp, Artificial Sequence
  Description of Artificial Sequence: Synthetic oligonucleotide
gtcgaagccagacccacctgc

SEQ ID NO: 40307 - DNA, 21 bp, Artificial Sequence
  Description of Artificial Sequence: Synthetic oligonucleotide
gaagtccaaagcagcagaaga

SEQ ID NO: 40308 - DNA, 21 bp, Artificial Sequence
  Description of Artificial Sequence: Synthetic oligonucleotide
catagtcgtgattcgcctcat

SEQ ID NO: 40309 - DNA, 21 bp, Artificial Sequence
  Description of Artificial Sequence: Synthetic oligonucleotide
cccgtcgtcggcaaaatgagc

SEQ ID NO: 40310 - DNA, 21 bp, Artificial Sequence
  Description of Artificial Sequence: Synthetic oligonucleotide
agcgccgccagcaacggcaga

SEQ ID NO: 40311 - DNA, 21 bp, Artificial Sequence
  Description of Artificial Sequence: Synthetic oligonucleotide
cgtactaatgctagtctttcg

SEQ ID NO: 40312 - DNA, 21 bp, Artificial Sequence
  Description of Artificial Sequence: Synthetic oligonucleotide
ggggagccgactaggtatggg

SEQ ID NO: 40313 - DNA, 21 bp, Artificial Sequence
  Description of Artificial Sequence: Synthetic oligonucleotide
gatattagtgttcggccgggt

SEQ ID NO: 40314 - DNA, 21 bp, Artificial Sequence
  Description of Artificial Sequence: Synthetic oligonucleotide
caggcgcatacgcctccgacg

SEQ ID NO: 40315 - DNA, 21 bp, Artificial Sequence
  Description of Artificial Sequence: Synthetic oligonucleotide
cctacgttgggtacgactaag

SEQ ID NO: 40316 - DNA, 21 bp, Artificial Sequence
  Description of Artificial Sequence: Synthetic oligonucleotide
aacctcagcggcagcagatac

SEQ ID NO: 40317 - DNA, 21 bp, Artificial Sequence
  Description of Artificial Sequence: Synthetic oligonucleotide
caggcgtatactaatgcggat

SEQ ID NO: 40318 - DNA, 21 bp, Artificial Sequence
  Description of Artificial Sequence: Synthetic oligonucleotide
cacacccccgacgtcggcaaa

SEQ ID NO: 40319 - DNA, 21 bp, Artificial Sequence
  Description of Artificial Sequence: Synthetic oligonucleotide
gtcaccagagtcgccggcaac

SEQ ID NO: 40320 - DNA, 21 bp, Artificial Sequence
  Description of Artificial Sequence: Synthetic oligonucleotide
acgacgagtcatatgctgaag

SEQ ID NO: 40321 - DNA, 21 bp, Artificial Sequence
  Description of Artificial Sequence: Synthetic oligonucleotide
ggcgcccccgactggagcaac

SEQ ID NO: 40322 - DNA, 21 bp, Artificial Sequence
  Description of Artificial Sequence: Synthetic oligonucleotide
aacagcagaacccactacacc

SEQ ID NO: 40323 - DNA, 21 bp, Artificial Sequence
  Description of Artificial Sequence: Synthetic oligonucleotide
gagagtgctcggattggttct

SEQ ID NO: 40324 - DNA, 21 bp, Artificial Sequence
  Description of Artificial Sequence: Synthetic oligonucleotide
ttccccagcgtcagcaccacc

SEQ ID NO: 40325 - DNA, 21 bp, Artificial Sequence
  Description of Artificial Sequence: Synthetic oligonucleotide
tcgtataagggtgcgctgtcg

SEQ ID NO: 40326 - DNA, 21 bp, Artificial Sequence
  Description of Artificial Sequence: Synthetic oligonucleotide
ggttctggtggggatcgtaat

SEQ ID NO: 40327 - DNA, 21 bp, Artificial Sequence
  Description of Artificial Sequence: Synthetic oligonucleotide
aacagcagaatcagccccagc

SEQ ID NO: 40328 - DNA, 21 bp, Artificial Sequence
  Description of Artificial Sequence: Synthetic oligonucleotide
gcttttgggactacgttgagg

SEQ ID NO: 40329 - DNA, 21 bp, Artificial Sequence
  Description of Artificial Sequence: Synthetic oligonucleotide
cccagaaacaccggcaacacc

SEQ ID NO: 40330 - DNA, 21 bp, Artificial Sequence
  Description of Artificial Sequence: Synthetic oligonucleotide
tttaatcgtgatcggattggg

SEQ ID NO: 40331 - DNA, 21 bp, Artificial Sequence
  Description of Artificial Sequence: Synthetic oligonucleotide
tctaggtctcatgcgatgact

SEQ ID NO: 40332 - DNA, 21 bp, Artificial Sequence
  Description of Artificial Sequence: Synthetic oligonucleotide
tgtagtctgggtaaggttcag

SEQ ID NO: 40333 - DNA, 21 bp, Artificial Sequence
  Description of Artificial Sequence: Synthetic oligonucleotide
cggaatttgcatatgcatgag

SEQ ID NO: 40334 - DNA, 21 bp, Artificial Sequence
  Description of Artificial Sequence: Synthetic oligonucleotide
catcagagtgcggtgcagggg

SEQ ID NO: 40335 - DNA, 21 bp, Artificial Sequence
  Description of Artificial Sequence: Synthetic oligonucleotide
cccatcagcgaaagcaccaga

SEQ ID NO: 40336 - DNA, 21 bp, Artificial Sequence
  Description of Artificial Sequence: Synthetic oligonucleotide
gtgtcgggtcatggtgttcgg

SEQ ID NO: 40337 - DNA, 21 bp, Artificial Sequence
  Description of Artificial Sequence: Synthetic oligonucleotide
agactcgacaaccaccccagc

SEQ ID NO: 40338 - DNA, 21 bp, Artificial Sequence
  Description of Artificial Sequence: Synthetic oligonucleotide
ttccccaccagccccaccaga

SEQ ID NO: 40339 - DNA, 21 bp, Artificial Sequence
  Description of Artificial Sequence: Synthetic oligonucleotide
tatacgaatagtagtacttgt

SEQ ID NO: 40340 - DNA, 21 bp, Artificial Sequence
  Description of Artificial Sequence: Synthetic oligonucleotide
ggcgaaggcaccaaaagacac

SEQ ID NO: 40341 - DNA, 21 bp, Artificial Sequence
  Description of Artificial Sequence: Synthetic oligonucleotide
gtcagaaccaacctcgacaaa

SEQ ID NO: 40342 - DNA, 21 bp, Artificial Sequence
  Description of Artificial Sequence: Synthetic oligonucleotide
gtcagagacggcgtcagaagc

SEQ ID NO: 40343 - DNA, 21 bp, Artificial Sequence
  Description of Artificial Sequence: Synthetic oligonucleotide
aacagcggcacccacttcaaa

SEQ ID NO: 40344 - DNA, 21 bp, Artificial Sequence
  Description of Artificial Sequence: Synthetic oligonucleotide
ggtaattctacggcgaatagg

SEQ ID NO: 40345 - DNA, 21 bp, Artificial Sequence
  Description of Artificial Sequence: Synthetic oligonucleotide
tatacggctgcgtcgcatcgg

SEQ ID NO: 40346 - DNA, 21 bp, Artificial Sequence
  Description of Artificial Sequence: Synthetic oligonucleotide
agcatgaacagcaaacccacc

SEQ ID NO: 40347 - DNA, 21 bp, Artificial Sequence
  Description of Artificial Sequence: Synthetic oligonucleotide
cccagaagccccagcaaactc

SEQ ID NO: 40348 - DNA, 21 bp, Artificial Sequence
  Description of Artificial Sequence: Synthetic oligonucleotide
gggcgtgtggtgtctatgcag

SEQ ID NO: 40349 - DNA, 21 bp, Artificial Sequence
  Description of Artificial Sequence: Synthetic oligonucleotide
tatcctagtccgacggttact

SEQ ID NO: 40350 - DNA, 21 bp, Artificial Sequence
  Description of Artificial Sequence: Synthetic oligonucleotide
tcgggggttgggcatcgtggg

SEQ ID NO: 40351 - DNA, 21 bp, Artificial Sequence
  Description of Artificial Sequence: Synthetic oligonucleotide
agcaccagcaaccacagagtc

SEQ ID NO: 40352 - DNA, 21 bp, Artificial Sequence
  Description of Artificial Sequence: Synthetic oligonucleotide
ggcagaaccgccgaaggcaga

SEQ ID NO: 40353 - DNA, 21 bp, Artificial Sequence
  Description of Artificial Sequence: Synthetic oligonucleotide
gacaacgtcccccacctcgcc

SEQ ID NO: 40354 - DNA, 21 bp, Artificial Sequence
  Description of Artificial Sequence: Synthetic oligonucleotide
aataattctactggggtggct

SEQ ID NO: 40355 - DNA, 21 bp, Artificial Sequence
  Description of Artificial Sequence: Synthetic oligonucleotide
tgtgggtttaagaatccgtct

SEQ ID NO: 40356 - DNA, 21 bp, Artificial Sequence
  Description of Artificial Sequence: Synthetic oligonucleotide
ctcaccagcagaagcatggcc

SEQ ID NO: 40357 - DNA, 21 bp, Artificial Sequence
  Description of Artificial Sequence: Synthetic oligonucleotide
agtagggagaagaataatgcg

SEQ ID NO: 40358 - DNA, 21 bp, Artificial Sequence
  Description of Artificial Sequence: Synthetic oligonucleotide
tcgaataataaggctaatgtt

SEQ ID NO: 40359 - DNA, 21 bp, Artificial Sequence
  Description of Artificial Sequence: Synthetic oligonucleotide
cccatgaccaacctcggcacc

SEQ ID NO: 40360 - DNA, 21 bp, Artificial Sequence
  Description of Artificial Sequence: Synthetic oligonucleotide
attattgcgccgcagactcag

SEQ ID NO: 40361 - DNA, 21 bp, Artificial Sequence
  Description of Artificial Sequence: Synthetic oligonucleotide
gttagtcagaatgggtctatg

SEQ ID NO: 40362 - DNA, 21 bp, Artificial Sequence
  Description of Artificial Sequence: Synthetic oligonucleotide
tcgaatcagcgtggtgagggt

SEQ ID NO: 40363 - DNA, 21 bp, Artificial Sequence
  Description of Artificial Sequence: Synthetic oligonucleotide
ccccacaacaccagcaaaggc

SEQ ID NO: 40364 - DNA, 21 bp, Artificial Sequence
  Description of Artificial Sequence: Synthetic oligonucleotide
gccttcggcgaaatcagacaa

SEQ ID NO: 40365 - DNA, 21 bp, Artificial Sequence
  Description of Artificial Sequence: Synthetic oligonucleotide
taccacgtcagcaaaccccaa

SEQ ID NO: 40366 - DNA, 21 bp, Artificial Sequence
  Description of Artificial Sequence: Synthetic oligonucleotide
aaaaacatgggcagcagcaga

SEQ ID NO: 40367 - DNA, 21 bp, Artificial Sequence
  Description of Artificial Sequence: Synthetic oligonucleotide
gaggggatgggtgttcatggg

SEQ ID NO: 40368 - DNA, 21 bp, Artificial Sequence
  Description of Artificial Sequence: Synthetic oligonucleotide
tctaagtttagtgagactaag

SEQ ID NO: 40369 - DNA, 21 bp, Artificial Sequence
  Description of Artificial Sequence: Synthetic oligonucleotide
tacgtccccagaagcagcctc

SEQ ID NO: 40370 - DNA, 21 bp, Artificial Sequence
  Description of Artificial Sequence: Synthetic oligonucleotide
aattctaagtcggttctttcg

SEQ ID NO: 40371 - DNA, 21 bp, Artificial Sequence
  Description of Artificial Sequence: Synthetic oligonucleotide
tgtttgggttcgaataatttg

SEQ ID NO: 40372 - DNA, 21 bp, Artificial Sequence
  Description of Artificial Sequence: Synthetic oligonucleotide
agcaactacaaaagcagcaac

SEQ ID NO: 40373 - DNA, 21 bp, Artificial Sequence
  Description of Artificial Sequence: Synthetic oligonucleotide
gggctggttcctaatttgatt

SEQ ID NO: 40374 - DNA, 21 bp, Artificial Sequence
  Description of Artificial Sequence: Synthetic oligonucleotide
tgcagcttcggcaaccaactc

SEQ ID NO: 40375 - DNA, 21 bp, Artificial Sequence
  Description of Artificial Sequence: Synthetic oligonucleotide
ggcagagcccaactcgccagc

SEQ ID NO: 40376 - DNA, 21 bp, Artificial Sequence
  Description of Artificial Sequence: Synthetic oligonucleotide
agcagcagaaccggcagcatc

SEQ ID NO: 40377 - DNA, 21 bp, Artificial Sequence
  Description of Artificial Sequence: Synthetic oligonucleotide
caacccaccaccagcgccctc

SEQ ID NO: 40378 - DNA, 21 bp, Artificial Sequence
  Description of Artificial Sequence: Synthetic oligonucleotide
ctcggcggcggcaccctcaga

SEQ ID NO: 40379 - DNA, 21 bp, Artificial Sequence
  Description of Artificial Sequence: Synthetic oligonucleotide
agtggtacttcgtcgtataag

SEQ ID NO: 40380 - DNA, 21 bp, Artificial Sequence
  Description of Artificial Sequence: Synthetic oligonucleotide
acgttgggtgggcggaatctg

SEQ ID NO: 40381 - DNA, 21 bp, Artificial Sequence
  Description of Artificial Sequence: Synthetic oligonucleotide
actggtgtgacgggtcctctt

SEQ ID NO: 40382 - DNA, 21 bp, Artificial Sequence
  Description of Artificial Sequence: Synthetic oligonucleotide
ctcaccgccgtcagccccaaa

SEQ ID NO: 40383 - DNA, 21 bp, Artificial Sequence
  Description of Artificial Sequence: Synthetic oligonucleotide
tatgatgctagtgcgcgggct

SEQ ID NO: 40384 - DNA, 21 bp, Artificial Sequence
  Description of Artificial Sequence: Synthetic oligonucleotide
ggcgtcagcgccagcctcgcc

SEQ ID NO: 40385 - DNA, 21 bp, Artificial Sequence
  Description of Artificial Sequence: Synthetic oligonucleotide
agcgccagcaacaccagcgtc

SEQ ID NO: 40386 - DNA, 21 bp, Artificial Sequence
  Description of Artificial Sequence: Synthetic oligonucleotide
cctgttacgttgcggggtatt

SEQ ID NO: 40387 - DNA, 21 bp, Artificial Sequence
  Description of Artificial Sequence: Synthetic oligonucleotide
catcagcttaagaatagtgtg

SEQ ID NO: 40388 - DNA, 21 bp, Artificial Sequence
  Description of Artificial Sequence: Synthetic oligonucleotide
acgtctaattctattcagggg

SEQ ID NO: 40389 - DNA, 21 bp, Artificial Sequence
  Description of Artificial Sequence: Synthetic oligonucleotide
ccgattcctaagtatcatgat

SEQ ID NO: 40390 - DNA, 21 bp, Artificial Sequence
  Description of Artificial Sequence: Synthetic oligonucleotide
aaaggccaaaacaccatcagc

SEQ ID NO: 40391 - DNA, 21 bp, Artificial Sequence
  Description of Artificial Sequence: Synthetic oligonucleotide
catcctactctggtgagtaag

SEQ ID NO: 40392 - DNA, 21 bp, Artificial Sequence
  Description of Artificial Sequence: Synthetic oligonucleotide
tctaggcaggctacgtcgtct

SEQ ID NO: 40393 - DNA, 21 bp, Artificial Sequence
  Description of Artificial Sequence: Synthetic oligonucleotide
ggcgccagcaccgtcggcaga

SEQ ID NO: 40394 - DNA, 21 bp, Artificial Sequence
  Description of Artificial Sequence: Synthetic oligonucleotide
gtccccagcagcagaagcaac

SEQ ID NO: 40395 - DNA, 21 bp, Artificial Sequence
  Description of Artificial Sequence: Synthetic oligonucleotide
agtaagtctacgcatcaggcg

SEQ ID NO: 40396 - DNA, 21 bp, Artificial Sequence
  Description of Artificial Sequence: Synthetic oligonucleotide
aacggttctggacagaatcga

SEQ ID NO: 40397 - DNA, 21 bp, Artificial Sequence
  Description of Artificial Sequence: Synthetic oligonucleotide
agcatcgccagacccttcacc

SEQ ID NO: 40398 - DNA, 21 bp, Artificial Sequence
  Description of Artificial Sequence: Synthetic oligonucleotide
actaggacggcgggggttgat

SEQ ID NO: 40399 - DNA, 21 bp, Artificial Sequence
  Description of Artificial Sequence: Synthetic oligonucleotide
cctagtgattttaagcatggt

SEQ ID NO: 40400 - DNA, 21 bp, Artificial Sequence
  Description of Artificial Sequence: Synthetic oligonucleotide
cctatttctactcgttctgct

SEQ ID NO: 40401 - DNA, 21 bp, Artificial Sequence
  Description of Artificial Sequence: Synthetic oligonucleotide
actggtatgcagagtttgtcg

SEQ ID NO: 40402 - DNA, 21 bp, Artificial Sequence
  Description of Artificial Sequence: Synthetic oligonucleotide
tcgagtccggctaatatggcg

SEQ ID NO: 40403 - DNA, 21 bp, Artificial Sequence
  Description of Artificial Sequence: Synthetic oligonucleotide
ctcaaccaccacagcagcctc

SEQ ID NO: 40404 - DNA, 21 bp, Artificial Sequence
  Description of Artificial Sequence: Synthetic oligonucleotide
gatcgtgttacggggaagatg

SEQ ID NO: 40405 - DNA, 21 bp, Artificial Sequence
  Description of Artificial Sequence: Synthetic oligonucleotide
agcacccccatgagcaacaga

SEQ ID NO: 40406 - DNA, 21 bp, Artificial Sequence
  Description of Artificial Sequence: Synthetic oligonucleotide
tatacggcttcagctcttcgg

SEQ ID NO: 40407 - DNA, 21 bp, Artificial Sequence
  Description of Artificial Sequence: Synthetic oligonucleotide
attaatctttctcattctacg

SEQ ID NO: 40408 - DNA, 21 bp, Artificial Sequence
  Description of Artificial Sequence: Synthetic oligonucleotide
gtgaatttgaggtctaatacg

SEQ ID NO: 40409 - DNA, 21 bp, Artificial Sequence
  Description of Artificial Sequence: Synthetic oligonucleotide
ttgcatcgggctggggatgct

SEQ ID NO: 40410 - DNA, 21 bp, Artificial Sequence
  Description of Artificial Sequence: Synthetic oligonucleotide
caacacagcagcgccagagtc

SEQ ID NO: 40411 - DNA, 21 bp, Artificial Sequence
  Description of Artificial Sequence: Synthetic oligonucleotide
agagtcagcgaccaactcagc

SEQ ID NO: 40412 - DNA, 21 bp, Artificial Sequence
  Description of Artificial Sequence: Synthetic oligonucleotide
cgggatcttggtcatgataat

SEQ ID NO: 40413 - DNA, 21 bp, Artificial Sequence
  Description of Artificial Sequence: Synthetic oligonucleotide
cctcctgtgacgactcgtcct

SEQ ID NO: 40414 - DNA, 21 bp, Artificial Sequence
  Description of Artificial Sequence: Synthetic oligonucleotide
ggcaccaaaagcgccttcagc

SEQ ID NO: 40415 - DNA, 21 bp, Artificial Sequence
  Description of Artificial Sequence: Synthetic oligonucleotide
gatcgtaatcatgcggctgag

SEQ ID NO: 40416 - DNA, 21 bp, Artificial Sequence
  Description of Artificial Sequence: Synthetic oligonucleotide
catcgtacgtctactgttagt

SEQ ID NO: 40417 - DNA, 21 bp, Artificial Sequence
  Description of Artificial Sequence: Synthetic oligonucleotide
aatcggatgactccggttatg

SEQ ID NO: 40418 - DNA, 21 bp, Artificial Sequence
  Description of Artificial Sequence: Synthetic oligonucleotide
agcggcccccaacccgtcgcc

SEQ ID NO: 40419 - DNA, 21 bp, Artificial Sequence
  Description of Artificial Sequence: Synthetic oligonucleotide
tgtcggcctactccttcgctg

SEQ ID NO: 40420 - DNA, 21 bp, Artificial Sequence
  Description of Artificial Sequence: Synthetic oligonucleotide
agcagagaaagcaccagcgcc

SEQ ID NO: 40421 - DNA, 21 bp, Artificial Sequence
  Description of Artificial Sequence: Synthetic oligonucleotide
cacatcagacccagcatgagc

SEQ ID NO: 40422 - DNA, 21 bp, Artificial Sequence
  Description of Artificial Sequence: Synthetic oligonucleotide
gctggttctcataagggtgtg

SEQ ID NO: 40423 - DNA, 21 bp, Artificial Sequence
  Description of Artificial Sequence: Synthetic oligonucleotide
gacagccaccccagaagcatc

SEQ ID NO: 40424 - DNA, 21 bp, Artificial Sequence
  Description of Artificial Sequence: Synthetic oligonucleotide
agcggcagcaacaccatcggc

SEQ ID NO: 40425 - DNA, 21 bp, Artificial Sequence
  Description of Artificial Sequence: Synthetic oligonucleotide
ggtgttgaggcgatgcggaat

SEQ ID NO: 40426 - DNA, 21 bp, Artificial Sequence
  Description of Artificial Sequence: Synthetic oligonucleotide
actaatcgtgtgggttatggt

SEQ ID NO: 40427 - DNA, 21 bp, Artificial Sequence
  Description of Artificial Sequence: Synthetic oligonucleotide
cataagaatggtgggcgggat

SEQ ID NO: 40428 - DNA, 21 bp, Artificial Sequence
  Description of Artificial Sequence: Synthetic oligonucleotide
tatctgaagacgggtgataat

SEQ ID NO: 40429 - DNA, 21 bp, Artificial Sequence
  Description of Artificial Sequence: Synthetic oligonucleotide
actgggactgattcgcggtcg

SEQ ID NO: 40430 - DNA, 21 bp, Artificial Sequence
  Description of Artificial Sequence: Synthetic oligonucleotide
cctccttctgcggttatgggt

SEQ ID NO: 40431 - DNA, 21 bp, Artificial Sequence
  Description of Artificial Sequence: Synthetic oligonucleotide
tgcatgaccagagacaccagc

SEQ ID NO: 40432 - DNA, 21 bp, Artificial Sequence
  Description of Artificial Sequence: Synthetic oligonucleotide
cctacggcgagtccgtcgact

SEQ ID NO: 40433 - DNA, 21 bp, Artificial Sequence
  Description of Artificial Sequence: Synthetic oligonucleotide
caggatagttctattcggaat

SEQ ID NO: 40434 - DNA, 21 bp, Artificial Sequence
  Description of Artificial Sequence: Synthetic oligonucleotide
gttccggttactgggctgagt

SEQ ID NO: 40435 - DNA, 21 bp, Artificial Sequence
  Description of Artificial Sequence: Synthetic oligonucleotide
tatcctggggctttgcagaag

SEQ ID NO: 40436 - DNA, 21 bp, Artificial Sequence
  Description of Artificial Sequence: Synthetic oligonucleotide
cacgccagcagagaacccctc

SEQ ID NO: 40437 - DNA, 21 bp, Artificial Sequence
  Description of Artificial Sequence: Synthetic oligonucleotide
ggcagacacacccccaccgcc

SEQ ID NO: 40438 - DNA, 21 bp, Artificial Sequence
  Description of Artificial Sequence: Synthetic oligonucleotide
cctcggtctcagccggtgccg

SEQ ID NO: 40439 - DNA, 21 bp, Artificial Sequence
  Description of Artificial Sequence: Synthetic oligonucleotide
tatcagccttcgttgtctaag

SEQ ID NO: 40440 - DNA, 21 bp, Artificial Sequence
  Description of Artificial Sequence: Synthetic oligonucleotide
agacaaacccaccaacccagc

SEQ ID NO: 40441 - DNA, 21 bp, Artificial Sequence
  Description of Artificial Sequence: Synthetic oligonucleotide
caacacaacaccctcggccaa

SEQ ID NO: 40442 - DNA, 21 bp, Artificial Sequence
  Description of Artificial Sequence: Synthetic oligonucleotide
tggggcaacgaactcagaaga

SEQ ID NO: 40443 - DNA, 21 bp, Artificial Sequence
  Description of Artificial Sequence: Synthetic oligonucleotide
gtgcatagtacggttcatagt

SEQ ID NO: 40444 - DNA, 21 bp, Artificial Sequence
  Description of Artificial Sequence: Synthetic oligonucleotide
aagcttactgggcagcggagt

SEQ ID NO: 40445 - DNA, 21 bp, Artificial Sequence
  Description of Artificial Sequence: Synthetic oligonucleotide
gagagtgttcgttcttcgagt

SEQ ID NO: 40446 - DNA, 21 bp, Artificial Sequence
  Description of Artificial Sequence: Synthetic oligonucleotide
tctcctcatggtgctggttat

SEQ ID NO: 40447 - DNA, 21 bp, Artificial Sequence
  Description of Artificial Sequence: Synthetic oligonucleotide
agcgccgccaaacccggcccc

SEQ ID NO: 40448 - DNA, 21 bp, Artificial Sequence
  Description of Artificial Sequence: Synthetic oligonucleotide
gacaacatgcacagaagcaac

SEQ ID NO: 40449 - DNA, 21 bp, Artificial Sequence
  Description of Artificial Sequence: Synthetic oligonucleotide
agtgggggtcggggtacttcg

SEQ ID NO: 40450 - DNA, 21 bp, Artificial Sequence
  Description of Artificial Sequence: Synthetic oligonucleotide
aaaaccagcaccccctacagc

SEQ ID NO: 40451 - DNA, 21 bp, Artificial Sequence
  Description of Artificial Sequence: Synthetic oligonucleotide
aatactcataatattcagggg

SEQ ID NO: 40452 - DNA, 21 bp, Artificial Sequence
  Description of Artificial Sequence: Synthetic oligonucleotide
accggttctgaacagaatcaa

SEQ ID NO: 40453 - DNA, 21 bp, Artificial Sequence
  Description of Artificial Sequence: Synthetic oligonucleotide
gccgccaccatgagaaacagc

SEQ ID NO: 40454 - DNA, 21 bp, Artificial Sequence
  Description of Artificial Sequence: Synthetic oligonucleotide
ggtattaatcttagtcctggt

SEQ ID NO: 40455 - DNA, 21 bp, Artificial Sequence
  Description of Artificial Sequence: Synthetic oligonucleotide
catacgcatgatgtgggtaag

SEQ ID NO: 40456 - DNA, 21 bp, Artificial Sequence
  Description of Artificial Sequence: Synthetic oligonucleotide
tctggtagtcatcgtactcag

SEQ ID NO: 40457 - DNA, 21 bp, Artificial Sequence
  Description of Artificial Sequence: Synthetic oligonucleotide
gtcagcagccacagaaacatg

SEQ ID NO: 40458 - DNA, 21 bp, Artificial Sequence
  Description of Artificial Sequence: Synthetic oligonucleotide
gggcgtactactaaggctttt

SEQ ID NO: 40459 - DNA, 21 bp, Artificial Sequence
  Description of Artificial Sequence: Synthetic oligonucleotide
caaatgctcggcagaggcggc

SEQ ID NO: 40460 - DNA, 21 bp, Artificial Sequence
  Description of Artificial Sequence: Synthetic oligonucleotide
gccaccctcagcagcggcgaa

SEQ ID NO: 40461 - DNA, 21 bp, Artificial Sequence
  Description of Artificial Sequence: Synthetic oligonucleotide
aatggtcgtcaggggcatacg

SEQ ID NO: 40462 - DNA, 21 bp, Artificial Sequence
  Description of Artificial Sequence: Synthetic oligonucleotide
agttcgttgcagccttttact

SEQ ID NO: 40463 - DNA, 21 bp, Artificial Sequence
  Description of Artificial Sequence: Synthetic oligonucleotide
gcttctcggtctacgaatcct

SEQ ID NO: 40464 - DNA, 21 bp, Artificial Sequence
  Description of Artificial Sequence: Synthetic oligonucleotide
atgcccaacagcagcagcctc

SEQ ID NO: 40465 - DNA, 21 bp, Artificial Sequence
  Description of Artificial Sequence: Synthetic oligonucleotide
cggaataataatcgtcttgag

SEQ ID NO: 40466 - DNA, 21 bp, Artificial Sequence
  Description of Artificial Sequence: Synthetic oligonucleotide
aacagcgccgccctcaacagc

SEQ ID NO: 40467 - DNA, 21 bp, Artificial Sequence
  Description of Artificial Sequence: Synthetic oligonucleotide
agcagcctccccagatacaac

SEQ ID NO: 40468 - DNA, 21 bp, Artificial Sequence
  Description of Artificial Sequence: Synthetic oligonucleotide
cctcttcaggattcgcttcgt

SEQ ID NO: 40469 - DNA, 21 bp, Artificial Sequence
  Description of Artificial Sequence: Synthetic oligonucleotide
gatcgtcttgatcattctagg

SEQ ID NO: 40470 - DNA, 21 bp, Artificial Sequence
  Description of Artificial Sequence: Synthetic oligonucleotide
tcgattcagagggctgctgct

SEQ ID NO: 40471 - DNA, 21 bp, Artificial Sequence
  Description of Artificial Sequence: Synthetic oligonucleotide
aggggtaatgggacgcatggt

SEQ ID NO: 40472 - DNA, 21 bp, Artificial Sequence
  Description of Artificial Sequence: Synthetic oligonucleotide
agggtgaatcttaatgagttg

SEQ ID NO: 40473 - DNA, 21 bp, Artificial Sequence
  Description of Artificial Sequence: Synthetic oligonucleotide
agccaacccggcagcaaccac

SEQ ID NO: 40474 - DNA, 21 bp, Artificial Sequence
  Description of Artificial Sequence: Synthetic oligonucleotide
gacagcagacaaaccagcctc

SEQ ID NO: 40475 - DNA, 21 bp, Artificial Sequence
  Description of Artificial Sequence: Synthetic oligonucleotide
agaatgaccagaggcgccgac

SEQ ID NO: 40476 - DNA, 21 bp, Artificial Sequence
  Description of Artificial Sequence: Synthetic oligonucleotide
agtagtatttctcgtacttcg

SEQ ID NO: 40477 - DNA, 21 bp, Artificial Sequence
  Description of Artificial Sequence: Synthetic oligonucleotide
gcgtctcttcgggagtcgcgt

SEQ ID NO: 40478 - DNA, 21 bp, Artificial Sequence
  Description of Artificial Sequence: Synthetic oligonucleotide
cctagggatttgcgtgcgtcg

SEQ ID NO: 40479 - DNA, 21 bp, Artificial Sequence
  Description of Artificial Sequence: Synthetic oligonucleotide
cagggtagttcgttgcgtact

SEQ ID NO: 40480 - DNA, 21 bp, Artificial Sequence
  Description of Artificial Sequence: Synthetic oligonucleotide
agtctttatactaatgcggtt

SEQ ID NO: 40481 - DNA, 21 bp, Artificial Sequence
  Description of Artificial Sequence: Synthetic oligonucleotide
gggtcgaatctggggcagatg

SEQ ID NO: 40482 - DNA, 21 bp, Artificial Sequence
  Description of Artificial Sequence: Synthetic oligonucleotide
ctcaccaccagcaacatcggc

SEQ ID NO: 40483 - DNA, 21 bp, Artificial Sequence
  Description of Artificial Sequence: Synthetic oligonucleotide
agtgcggggacttcggttggt

SEQ ID NO: 40484 - DNA, 21 bp, Artificial Sequence
  Description of Artificial Sequence: Synthetic oligonucleotide
ctttcttctgggcggggtggt

SEQ ID NO: 40485 - DNA, 21 bp, Artificial Sequence
  Description of Artificial Sequence: Synthetic oligonucleotide
ctttcgccgacttctactaat

SEQ ID NO: 40486 - DNA, 21 bp, Artificial Sequence
  Description of Artificial Sequence: Synthetic oligonucleotide
attggtactagtccgatgaag

SEQ ID NO: 40487 - DNA, 21 bp, Artificial Sequence
  Description of Artificial Sequence: Synthetic oligonucleotide
ggcgacagcaaaagcacctgg

SEQ ID NO: 40488 - DNA, 21 bp, Artificial Sequence
  Description of Artificial Sequence: Synthetic oligonucleotide
caggtgacgggtgcgagtcat

SEQ ID NO: 40489 - DNA, 21 bp, Artificial Sequence
  Description of Artificial Sequence: Synthetic oligonucleotide
tcgctggagaggcttaagact

SEQ ID NO: 40490 - DNA, 21 bp, Artificial Sequence
  Description of Artificial Sequence: Synthetic oligonucleotide
accctccccagagtccccgcc

SEQ ID NO: 40491 - DNA, 21 bp, Artificial Sequence
  Description of Artificial Sequence: Synthetic oligonucleotide
ccttctgtggcgaatgttatg

SEQ ID NO: 40492 - DNA, 21 bp, Artificial Sequence
  Description of Artificial Sequence: Synthetic oligonucleotide
ggtacggctcgtacgttgcat

SEQ ID NO: 40493 - DNA, 21 bp, Artificial Sequence
  Description of Artificial Sequence: Synthetic oligonucleotide
acttcggtgtcgaatcgtacg

SEQ ID NO: 40494 - DNA, 21 bp, Artificial Sequence
  Description of Artificial Sequence: Synthetic oligonucleotide
cacatcggcagcccccacacc

SEQ ID NO: 40495 - DNA, 21 bp, Artificial Sequence
  Description of Artificial Sequence: Synthetic oligonucleotide
ctcatgcacagcgccgtcagc

SEQ ID NO: 40496 - DNA, 21 bp, Artificial Sequence
  Description of Artificial Sequence: Synthetic oligonucleotide
agtcgttctggtggtcaggtt

SEQ ID NO: 40497 - DNA, 21 bp, Artificial Sequence
  Description of Artificial Sequence: Synthetic oligonucleotide
ttcaacatccaaggcatcggc

SEQ ID NO: 40498 - DNA, 21 bp, Artificial Sequence
  Description of Artificial Sequence: Synthetic oligonucleotide
cctttggctgcgggtggtacg

SEQ ID NO: 40499 - DNA, 21 bp, Artificial Sequence
  Description of Artificial Sequence: Synthetic oligonucleotide
acttcgctttctccttctgtt

SEQ ID NO: 40500 - DNA, 21 bp, Artificial Sequence
  Description of Artificial Sequence: Synthetic oligonucleotide
gtgagtacgcaggctatttcg

SEQ ID NO: 40501 - DNA, 21 bp, Artificial Sequence
  Description of Artificial Sequence: Synthetic oligonucleotide
acgaggcctaatggtggtggt

SEQ ID NO: 40502 - DNA, 21 bp, Artificial Sequence
  Description of Artificial Sequence: Synthetic oligonucleotide
gtgggttctagtaagggttgt

SEQ ID NO: 40503 - DNA, 21 bp, Artificial Sequence
  Description of Artificial Sequence: Synthetic oligonucleotide
gtgacgtatccgccggcgggg

SEQ ID NO: 40504 - DNA, 21 bp, Artificial Sequence
  Description of Artificial Sequence: Synthetic oligonucleotide
tacagcagcagaagcggcccc

SEQ ID NO: 40505 - DNA, 21 bp, Artificial Sequence
  Description of Artificial Sequence: Synthetic oligonucleotide
aggattcaggcgcctgggcgt

SEQ ID NO: 40506 - DNA, 21 bp, Artificial Sequence
  Description of Artificial Sequence: Synthetic oligonucleotide
atgtcttataaggctcatgat

SEQ ID NO: 40507 - DNA, 21 bp, Artificial Sequence
  Description of Artificial Sequence: Synthetic oligonucleotide
tggtctttggggcataatgat

SEQ ID NO: 40508 - DNA, 21 bp, Artificial Sequence
  Description of Artificial Sequence: Synthetic oligonucleotide
gttccgacttctcgtcttaat

SEQ ID NO: 40509 - DNA, 21 bp, Artificial Sequence
  Description of Artificial Sequence: Synthetic oligonucleotide
agatgcgaagccaccaccgcc

SEQ ID NO: 40510 - DNA, 21 bp, Artificial Sequence
  Description of Artificial Sequence: Synthetic oligonucleotide
acccaaagcagcaccagaagc

SEQ ID NO: 40511 - DNA, 21 bp, Artificial Sequence
  Description of Artificial Sequence: Synthetic oligonucleotide
ctcaccggcaccgcccaccaa

SEQ ID NO: 40512 - DNA, 21 bp, Artificial Sequence
  Description of Artificial Sequence: Synthetic oligonucleotide
acgtcttcggctaatactgtg

SEQ ID NO: 40513 - DNA, 21 bp, Artificial Sequence
  Description of Artificial Sequence: Synthetic oligonucleotide
agcgccagcggcaaaccctgc

SEQ ID NO: 40514 - DNA, 21 bp, Artificial Sequence
  Description of Artificial Sequence: Synthetic oligonucleotide
cggtctgatcctactcgtggg

SEQ ID NO: 40515 - DNA, 21 bp, Artificial Sequence
  Description of Artificial Sequence: Synthetic oligonucleotide
aagactcctcagctgtctcag

SEQ ID NO: 40516 - DNA, 21 bp, Artificial Sequence
  Description of Artificial Sequence: Synthetic oligonucleotide
agcgccaccagcgtccccatc

SEQ ID NO: 40517 - DNA, 21 bp, Artificial Sequence
  Description of Artificial Sequence: Synthetic oligonucleotide
atgaagtcgaaggagcgtccg

SEQ ID NO: 40518 - DNA, 21 bp, Artificial Sequence
  Description of Artificial Sequence: Synthetic oligonucleotide
tttagtgcgagtggggcgagg

SEQ ID NO: 40519 - DNA, 21 bp, Artificial Sequence
  Description of Artificial Sequence: Synthetic oligonucleotide
tacaacaccctccccgccaga

SEQ ID NO: 40520 - DNA, 21 bp, Artificial Sequence
  Description of Artificial Sequence: Synthetic oligonucleotide
tatagtggttctgcggggcag

SEQ ID NO: 40521 - DNA, 21 bp, Artificial Sequence
  Description of Artificial Sequence: Synthetic oligonucleotide
tcgtttactgctgatcggtct

SEQ ID NO: 40522 - DNA, 21 bp, Artificial Sequence
  Description of Artificial Sequence: Synthetic oligonucleotide
gctccgagtcatgcttctctt

SEQ ID NO: 40523 - DNA, 21 bp, Artificial Sequence
  Description of Artificial Sequence: Synthetic oligonucleotide
gccaaaaccaacctcagcagc

SEQ ID NO: 40524 - DNA, 21 bp, Artificial Sequence
  Description of Artificial Sequence: Synthetic oligonucleotide
tcgtcgcattctgatacgcgt

SEQ ID NO: 40525 - DNA, 21 bp, Artificial Sequence
  Description of Artificial Sequence: Synthetic oligonucleotide
acgcgggctcagcattcgggt

SEQ ID NO: 40526 - DNA, 21 bp, Artificial Sequence
  Description of Artificial Sequence: Synthetic oligonucleotide
ggggttccggctgggcatact

SEQ ID NO: 40527 - DNA, 21 bp, Artificial Sequence
  Description of Artificial Sequence: Synthetic oligonucleotide
gatactagtcgtgctccgggt

SEQ ID NO: 40528 - DNA, 21 bp, Artificial Sequence
  Description of Artificial Sequence: Synthetic oligonucleotide
catgttaaggcgaatgggtct

SEQ ID NO: 40529 - DNA, 21 bp, Artificial Sequence
  Description of Artificial Sequence: Synthetic oligonucleotide
agcagagacagcggcggcgcc

SEQ ID NO: 40530 - DNA, 21 bp, Artificial Sequence
  Description of Artificial Sequence: Synthetic oligonucleotide
ggtgttacttctagtgggcct

SEQ ID NO: 40531 - DNA, 21 bp, Artificial Sequence
  Description of Artificial Sequence: Synthetic oligonucleotide
agcagcatcaacaccgccgcc

SEQ ID NO: 40532 - DNA, 21 bp, Artificial Sequence
  Description of Artificial Sequence: Synthetic oligonucleotide
agtggtatggcttcggttacg

SEQ ID NO: 40533 - DNA, 21 bp, Artificial Sequence
  Description of Artificial Sequence: Synthetic oligonucleotide
ggcggcacccccacccacaga

SEQ ID NO: 40534 - DNA, 21 bp, Artificial Sequence
  Description of Artificial Sequence: Synthetic oligonucleotide
cacagagaagccagactcctc

SEQ ID NO: 40535 - DNA, 21 bp, Artificial Sequence
  Description of Artificial Sequence: Synthetic oligonucleotide
aacagcagaagccaccacgaa

SEQ ID NO: 40536 - DNA, 21 bp, Artificial Sequence
  Description of Artificial Sequence: Synthetic oligonucleotide
ggtccgaggaattcgctgaat

SEQ ID NO: 40537 - DNA, 21 bp, Artificial Sequence
  Description of Artificial Sequence: Synthetic oligonucleotide
accagaagccaagactaccaa

SEQ ID NO: 40538 - DNA, 21 bp, Artificial Sequence
  Description of Artificial Sequence: Synthetic oligonucleotide
agaggcctcgacagcatcaac

SEQ ID NO: 40539 - DNA, 21 bp, Artificial Sequence
  Description of Artificial Sequence: Synthetic oligonucleotide
agcgaccaccaaagcgtcaga

SEQ ID NO: 40540 - DNA, 21 bp, Artificial Sequence
  Description of Artificial Sequence: Synthetic oligonucleotide
ccctacgcccaaggcagcttc

SEQ ID NO: 40541 - DNA, 21 bp, Artificial Sequence
  Description of Artificial Sequence: Synthetic oligonucleotide
cccaccagcatcggcagagac

SEQ ID NO: 40542 - DNA, 21 bp, Artificial Sequence
  Description of Artificial Sequence: Synthetic oligonucleotide
tcgttgagtcttgtgaagggt

SEQ ID NO: 40543 - DNA, 21 bp, Artificial Sequence
  Description of Artificial Sequence: Synthetic oligonucleotide
cttgagaggaatggtttgaag

SEQ ID NO: 40544 - DNA, 21 bp, Artificial Sequence
  Description of Artificial Sequence: Synthetic oligonucleotide
accgccttcagcaccaacaga

SEQ ID NO: 40545 - DNA, 21 bp, Artificial Sequence
  Description of Artificial Sequence: Synthetic oligonucleotide
gatcatcgtaatatttcttcg

SEQ ID NO: 40546 - DNA, 21 bp, Artificial Sequence
  Description of Artificial Sequence: Synthetic oligonucleotide
gttcggcagtcgcaggttatg

SEQ ID NO: 40547 - DNA, 21 bp, Artificial Sequence
  Description of Artificial Sequence: Synthetic oligonucleotide
cgtgatcggggtgctgagcat

SEQ ID NO: 40548 - DNA, 21 bp, Artificial Sequence
  Description of Artificial Sequence: Synthetic oligonucleotide
tcgaggggggatggtgtgacg

SEQ ID NO: 40549 - DNA, 21 bp, Artificial Sequence
  Description of Artificial Sequence: Synthetic oligonucleotide
gatacgattacttcgaggggt

SEQ ID NO: 40550 - DNA, 21 bp, Artificial Sequence
  Description of Artificial Sequence: Synthetic oligonucleotide
cccaacggccacgaagtcctc

SEQ ID NO: 40551 - DNA, 21 bp, Artificial Sequence
  Description of Artificial Sequence: Synthetic oligonucleotide
tctgggaatagtcataatggg

SEQ ID NO: 40552 - DNA, 21 bp, Artificial Sequence
  Description of Artificial Sequence: Synthetic oligonucleotide
aacaccgacaccagcgccgtc

SEQ ID NO: 40553 - DNA, 21 bp, Artificial Sequence
  Description of Artificial Sequence: Synthetic oligonucleotide
ccccgtgatcgtgattatcat

SEQ ID NO: 40554 - DNA, 21 bp, Artificial Sequence
  Description of Artificial Sequence: Synthetic oligonucleotide
ccggcgaatcagcttaggtct

SEQ ID NO: 40555 - DNA, 21 bp, Artificial Sequence
  Description of Artificial Sequence: Synthetic oligonucleotide
aatattcatttggctggtact

SEQ ID NO: 40556 - DNA, 21 bp, Artificial Sequence
  Description of Artificial Sequence: Synthetic oligonucleotide
atgagtgggagtggtacggag

SEQ ID NO: 40557 - DNA, 21 bp, Artificial Sequence
  Description of Artificial Sequence: Synthetic oligonucleotide
cttaggggtacggttcctaag

SEQ ID NO: 40558 - DNA, 21 bp, Artificial Sequence
  Description of Artificial Sequence: Synthetic oligonucleotide
actggttctagttcttcgcag

SEQ ID NO: 40559 - DNA, 21 bp, Artificial Sequence
  Description of Artificial Sequence: Synthetic oligonucleotide
agcgccagagacagagccagc

SEQ ID NO: 40560 - DNA, 21 bp, Artificial Sequence
  Description of Artificial Sequence: Synthetic oligonucleotide
agcaacagcagaatgggcacc

SEQ ID NO: 40561 - DNA, 21 bp, Artificial Sequence
  Description of Artificial Sequence: Synthetic oligonucleotide
tacggcagcgacaaaagcatc

SEQ ID NO: 40562 - DNA, 21 bp, Artificial Sequence
  Description of Artificial Sequence: Synthetic oligonucleotide
ggcctcagcaaaacctaccac

SEQ ID NO: 40563 - DNA, 21 bp, Artificial Sequence
  Description of Artificial Sequence: Synthetic oligonucleotide
gttgctcggcgtgatgctttg

SEQ ID NO: 40564 - DNA, 21 bp, Artificial Sequence
  Description of Artificial Sequence: Synthetic oligonucleotide
accggcccccacaccagcaga

SEQ ID NO: 40565 - DNA, 21 bp, Artificial Sequence
  Description of Artificial Sequence: Synthetic oligonucleotide
ttgatgccttctagttcttcg

SEQ ID NO: 40566 - DNA, 21 bp, Artificial Sequence
  Description of Artificial Sequence: Synthetic oligonucleotide
ctcccccccgccagccccaga

SEQ ID NO: 40567 - DNA, 21 bp, Artificial Sequence
  Description of Artificial Sequence: Synthetic oligonucleotide
atggtcagccacacccacggc

SEQ ID NO: 40568 - DNA, 21 bp, Artificial Sequence
  Description of Artificial Sequence: Synthetic oligonucleotide
agctacggccccaccccccaa

SEQ ID NO: 40569 - DNA, 21 bp, Artificial Sequence
  Description of Artificial Sequence: Synthetic oligonucleotide
acggggccgggggcgcatgcg

SEQ ID NO: 40570 - DNA, 21 bp, Artificial Sequence
  Description of Artificial Sequence: Synthetic oligonucleotide
gacagcagacaagccatgagc

SEQ ID NO: 40571 - DNA, 21 bp, Artificial Sequence
  Description of Artificial Sequence: Synthetic oligonucleotide
agcagcatgagccaccaaaaa

SEQ ID NO: 40572 - DNA, 21 bp, Artificial Sequence
  Description of Artificial Sequence: Synthetic oligonucleotide
ccttctcttcggagtatgacg

SEQ ID NO: 40573 - DNA, 21 bp, Artificial Sequence
  Description of Artificial Sequence: Synthetic oligonucleotide
actaagtttaagactacgctg

SEQ ID NO: 40574 - DNA, 21 bp, Artificial Sequence
  Description of Artificial Sequence: Synthetic oligonucleotide
gtcagcgccagcaacagcctc

SEQ ID NO: 40575 - DNA, 21 bp, Artificial Sequence
  Description of Artificial Sequence: Synthetic oligonucleotide
gcgtcgacgggtcctaatgct

SEQ ID NO: 40576 - DNA, 21 bp, Artificial Sequence
  Description of Artificial Sequence: Synthetic oligonucleotide
ggtagtaggtcttctacgact

SEQ ID NO: 40577 - DNA, 21 bp, Artificial Sequence
  Description of Artificial Sequence: Synthetic oligonucleotide
agcggcggcacccccggcaga

SEQ ID NO: 40578 - DNA, 21 bp, Artificial Sequence
  Description of Artificial Sequence: Synthetic oligonucleotide
gtgcatcaggctggggctaat

SEQ ID NO: 40579 - DNA, 21 bp, Artificial Sequence
  Description of Artificial Sequence: Synthetic oligonucleotide
cccgaaatcagcgccagcaga

SEQ ID NO: 40580 - DNA, 21 bp, Artificial Sequence
  Description of Artificial Sequence: Synthetic oligonucleotide
cacagacacgtcaaaagcgaa

SEQ ID NO: 40581 - DNA, 21 bp, Artificial Sequence
  Description of Artificial Sequence: Synthetic oligonucleotide
cttggggctgggcagagggag

SEQ ID NO: 40582 - DNA, 21 bp, Artificial Sequence
  Description of Artificial Sequence: Synthetic oligonucleotide
catatggctgcttcgacgggt

SEQ ID NO: 40583 - DNA, 21 bp, Artificial Sequence
  Description of Artificial Sequence: Synthetic oligonucleotide
ggtaaggctggggcggggggt

SEQ ID NO: 40584 - DNA, 21 bp, Artificial Sequence
  Description of Artificial Sequence: Synthetic oligonucleotide
tcttctagggtgtctcattct

SEQ ID NO: 40585 - DNA, 21 bp, Artificial Sequence
  Description of Artificial Sequence: Synthetic oligonucleotide
acgggtgcgggtggttattgt

SEQ ID NO: 40586 - DNA, 21 bp, Artificial Sequence
  Description of Artificial Sequence: Synthetic oligonucleotide
gccgtcctcaaccccagagtc

SEQ ID NO: 40587 - DNA, 21 bp, Artificial Sequence
  Description of Artificial Sequence: Synthetic oligonucleotide
gttgcttcttcggctcatgtt

SEQ ID NO: 40588 - DNA, 21 bp, Artificial Sequence
  Description of Artificial Sequence: Synthetic oligonucleotide
tcgtataagaatactggtgtt

SEQ ID NO: 40589 - DNA, 21 bp, Artificial Sequence
  Description of Artificial Sequence: Synthetic oligonucleotide
ggcaacagcaacaccctcgcc

SEQ ID NO: 40590 - DNA, 21 bp, Artificial Sequence
  Description of Artificial Sequence: Synthetic oligonucleotide
acccaaggccacaaagccctc

SEQ ID NO: 40591 - DNA, 21 bp, Artificial Sequence
  Description of Artificial Sequence: Synthetic oligonucleotide
actattggtcctcctagtacg

SEQ ID NO: 40592 - DNA, 21 bp, Artificial Sequence
  Description of Artificial Sequence: Synthetic oligonucleotide
tgctacggcgacagacacaac

SEQ ID NO: 40593 - DNA, 21 bp, Artificial Sequence
  Description of Artificial Sequence: Synthetic oligonucleotide
cccgccagcagaatccccagc

SEQ ID NO: 40594 - DNA, 21 bp, Artificial Sequence
  Description of Artificial Sequence: Synthetic oligonucleotide
agtgcgcataggtctggtgtg

SEQ ID NO: 40595 - DNA, 21 bp, Artificial Sequence
  Description of Artificial Sequence: Synthetic oligonucleotide
caacccaacagagccgacaac

SEQ ID NO: 40596 - DNA, 21 bp, Artificial Sequence
  Description of Artificial Sequence: Synthetic oligonucleotide
cgtcctgcttcgacgcatacg

SEQ ID NO: 40597 - DNA, 21 bp, Artificial Sequence
  Description of Artificial Sequence: Synthetic oligonucleotide
agaggcaccggcatcggcagc

SEQ ID NO: 40598 - DNA, 21 bp, Artificial Sequence
  Description of Artificial Sequence: Synthetic oligonucleotide
cagactagttctcgtgagatg

SEQ ID NO: 40599 - DNA, 21 bp, Artificial Sequence
  Description of Artificial Sequence: Synthetic oligonucleotide
ggcaaagccggcgaaggcggc

SEQ ID NO: 40600 - DNA, 21 bp, Artificial Sequence
  Description of Artificial Sequence: Synthetic oligonucleotide
tctagtcctgtgagtgctgtt

SEQ ID NO: 40601 - DNA, 21 bp, Artificial Sequence
  Description of Artificial Sequence: Synthetic oligonucleotide
cccaccaccaccgccaaaccc

SEQ ID NO: 40602 - DNA, 21 bp, Artificial Sequence
  Description of Artificial Sequence: Synthetic oligonucleotide
tctagtactaataggcctacg

SEQ ID NO: 40603 - DNA, 21 bp, Artificial Sequence
  Description of Artificial Sequence: Synthetic oligonucleotide
caaatcggcagcctcagcggc

SEQ ID NO: 40604 - DNA, 21 bp, Artificial Sequence
  Description of Artificial Sequence: Synthetic oligonucleotide
ggcatgcacgtcagcaacccc

SEQ ID NO: 40605 - DNA, 21 bp, Artificial Sequence
  Description of Artificial Sequence: Synthetic oligonucleotide
aacttcggcccccaagccgac

SEQ ID NO: 40606 - DNA, 21 bp, Artificial Sequence
  Description of Artificial Sequence: Synthetic oligonucleotide
aacagaaccagccccgtcagc

SEQ ID NO: 40607 - DNA, 21 bp, Artificial Sequence
  Description of Artificial Sequence: Synthetic oligonucleotide
catacgcatgtgagtaatcgg

SEQ ID NO: 40608 - DNA, 21 bp, Artificial Sequence
  Description of Artificial Sequence: Synthetic oligonucleotide
tctccggcttatgatacgagg

SEQ ID NO: 40609 - DNA, 21 bp, Artificial Sequence
  Description of Artificial Sequence: Synthetic oligonucleotide
aaactcagcaacgacaacctc

SEQ ID NO: 40610 - DNA, 21 bp, Artificial Sequence
  Description of Artificial Sequence: Synthetic oligonucleotide
ggcgaactccccgacagaaga

SEQ ID NO: 40611 - DNA, 21 bp, Artificial Sequence
  Description of Artificial Sequence: Synthetic oligonucleotide
tatagtcgtccgactacgact

SEQ ID NO: 40612 - DNA, 21 bp, Artificial Sequence
  Description of Artificial Sequence: Synthetic oligonucleotide
agcgtcgtcgcccacggcccc

SEQ ID NO: 40613 - DNA, 21 bp, Artificial Sequence
  Description of Artificial Sequence: Synthetic oligonucleotide
gcgtcgtctttgttgaatgtg

SEQ ID NO: 40614 - DNA, 21 bp, Artificial Sequence
  Description of Artificial Sequence: Synthetic oligonucleotide
actcagggtgcgaggaatttg

SEQ ID NO: 40615 - DNA, 21 bp, Artificial Sequence
  Description of Artificial Sequence: Synthetic oligonucleotide
gtctacagcagccccagcgcc

SEQ ID NO: 40616 - DNA, 21 bp, Artificial Sequence
  Description of Artificial Sequence: Synthetic oligonucleotide
ggcgtcagcaacctcgccagc

SEQ ID NO: 40617 - DNA, 21 bp, Artificial Sequence
  Description of Artificial Sequence: Synthetic oligonucleotide
atgagacccaacagcggcatg

SEQ ID NO: 40618 - DNA, 21 bp, Artificial Sequence
  Description of Artificial Sequence: Synthetic oligonucleotide
tgtgcggggactagtcgtgtg

SEQ ID NO: 40619 - DNA, 21 bp, Artificial Sequence
  Description of Artificial Sequence: Synthetic oligonucleotide
tgtcgtgcgggtactattatg

SEQ ID NO: 40620 - DNA, 21 bp, Artificial Sequence
  Description of Artificial Sequence: Synthetic oligonucleotide
tctagggctcagtcgattccg

SEQ ID NO: 40621 - DNA, 21 bp, Artificial Sequence
  Description of Artificial Sequence: Synthetic oligonucleotide
tgtcatctgcatgctactacg

SEQ ID NO: 40622 - DNA, 21 bp, Artificial Sequence
  Description of Artificial Sequence: Synthetic oligonucleotide
atcagccccgtccccctcacc

SEQ ID NO: 40623 - DNA, 21 bp, Artificial Sequence
  Description of Artificial Sequence: Synthetic oligonucleotide
aaaagcaacagcagcctcggc

SEQ ID NO: 40624 - DNA, 21 bp, Artificial Sequence
  Description of Artificial Sequence: Synthetic oligonucleotide
agtccgaaggcgaatcgtgtt

SEQ ID NO: 40625 - DNA, 21 bp, Artificial Sequence
  Description of Artificial Sequence: Synthetic oligonucleotide
acccaaagcagcagagccggc

SEQ ID NO: 40626 - DNA, 21 bp, Artificial Sequence
  Description of Artificial Sequence: Synthetic oligonucleotide
aaacaccaagaattcgtcggc

SEQ ID NO: 40627 - DNA, 21 bp, Artificial Sequence
  Description of Artificial Sequence: Synthetic oligonucleotide
agtagtatttctagtgcggtg

SEQ ID NO: 40628 - DNA, 21 bp, Artificial Sequence
  Description of Artificial Sequence: Synthetic oligonucleotide
gccgtcgccagcagaaccaac

SEQ ID NO: 40629 - DNA, 21 bp, Artificial Sequence
  Description of Artificial Sequence: Synthetic oligonucleotide
gctcattctgttactcctggg

SEQ ID NO: 40630 - DNA, 21 bp, Artificial Sequence
  Description of Artificial Sequence: Synthetic oligonucleotide
ccgattagtactcatttgaag

SEQ ID NO: 40631 - DNA, 21 bp, Artificial Sequence
  Description of Artificial Sequence: Synthetic oligonucleotide
caaggcctcagcaaaagcggc

SEQ ID NO: 40632 - DNA, 21 bp, Artificial Sequence
  Description of Artificial Sequence: Synthetic oligonucleotide
cctaatcaggctcatcgttcg

SEQ ID NO: 40633 - DNA, 21 bp, Artificial Sequence
  Description of Artificial Sequence: Synthetic oligonucleotide
gctaggggtaagccggctctg

SEQ ID NO: 40634 - DNA, 21 bp, Artificial Sequence
  Description of Artificial Sequence: Synthetic oligonucleotide
cccagagccaacgcccccaga

SEQ ID NO: 40635 - DNA, 21 bp, Artificial Sequence
  Description of Artificial Sequence: Synthetic oligonucleotide
tgtcctccgattactaagggg

SEQ ID NO: 40636 - DNA, 21 bp, Artificial Sequence
  Description of Artificial Sequence: Synthetic oligonucleotide
gccaccaccaaagaaggcatc

SEQ ID NO: 40637 - DNA, 21 bp, Artificial Sequence
  Description of Artificial Sequence: Synthetic oligonucleotide
agtagtgataatcgtgggttg

SEQ ID NO: 40638 - DNA, 21 bp, Artificial Sequence
  Description of Artificial Sequence: Synthetic oligonucleotide
gccggcgacggcgtcgtcaga

SEQ ID NO: 40639 - DNA, 21 bp, Artificial Sequence
  Description of Artificial Sequence: Synthetic oligonucleotide
aacgcccacaccagacccgcc

SEQ ID NO: 40640 - DNA, 21 bp, Artificial Sequence
  Description of Artificial Sequence: Synthetic oligonucleotide
gctcatacttctgcgggtggg

SEQ ID NO: 40641 - DNA, 21 bp, Artificial Sequence
  Description of Artificial Sequence: Synthetic oligonucleotide
catacttctactaatacgatt

SEQ ID NO: 40642 - DNA, 21 bp, Artificial Sequence
  Description of Artificial Sequence: Synthetic oligonucleotide
cttaataggcctagtcttggt

SEQ ID NO: 40643 - DNA, 21 bp, Artificial Sequence
  Description of Artificial Sequence: Synthetic oligonucleotide
acgtcgggtaggactacgtat

SEQ ID NO: 40644 - DNA, 21 bp, Artificial Sequence
  Description of Artificial Sequence: Synthetic oligonucleotide
cgtaagactagtctgaatgat

SEQ ID NO: 40645 - DNA, 21 bp, Artificial Sequence
  Description of Artificial Sequence: Synthetic oligonucleotide
accaacagccacgtccccaga

SEQ ID NO: 40646 - DNA, 21 bp, Artificial Sequence
  Description of Artificial Sequence: Synthetic oligonucleotide
gccagcagcctccccaaaaga

SEQ ID NO: 40647 - DNA, 21 bp, Artificial Sequence
  Description of Artificial Sequence: Synthetic oligonucleotide
accgaaaccagaagcgccaac

SEQ ID NO: 40648 - DNA, 21 bp, Artificial Sequence
  Description of Artificial Sequence: Synthetic oligonucleotide
agtcgtgctcagtcgcagatt

SEQ ID NO: 40649 - DNA, 21 bp, Artificial Sequence
  Description of Artificial Sequence: Synthetic oligonucleotide
gtcagacacaccaccgacagc

SEQ ID NO: 40650 - DNA, 21 bp, Artificial Sequence
  Description of Artificial Sequence: Synthetic oligonucleotide
cccagaatgaacggcatcaaa

SEQ ID NO: 40651 - DNA, 21 bp, Artificial Sequence
  Description of Artificial Sequence: Synthetic oligonucleotide
gcgattcctgctgtgtctatg

SEQ ID NO: 40652 - DNA, 21 bp, Artificial Sequence
  Description of Artificial Sequence: Synthetic oligonucleotide
ggcagcaccggcagcagcatc

SEQ ID NO: 40653 - DNA, 21 bp, Artificial Sequence
  Description of Artificial Sequence: Synthetic oligonucleotide
gaaaacaacgccctcagcaga

SEQ ID NO: 40654 - DNA, 21 bp, Artificial Sequence
  Description of Artificial Sequence: Synthetic oligonucleotide
tatccgaattctgtgcctagt

SEQ ID NO: 40655 - DNA, 21 bp, Artificial Sequence
  Description of Artificial Sequence: Synthetic oligonucleotide
gttaatggtaagatttgttcg

SEQ ID NO: 40656 - DNA, 21 bp, Artificial Sequence
  Description of Artificial Sequence: Synthetic oligonucleotide
catccttcttctaggaatagt

SEQ ID NO: 40657 - DNA, 21 bp, Artificial Sequence
  Description of Artificial Sequence: Synthetic oligonucleotide
tctagggttacggtgagtcag

SEQ ID NO: 40658 - DNA, 21 bp, Artificial Sequence
  Description of Artificial Sequence: Synthetic oligonucleotide
atgggggcgggggagcttacg

SEQ ID NO: 40659 - DNA, 21 bp, Artificial Sequence
  Description of Artificial Sequence: Synthetic oligonucleotide
ggtcttgctgatcctcgtact

SEQ ID NO: 40660 - DNA, 21 bp, Artificial Sequence
  Description of Artificial Sequence: Synthetic oligonucleotide
accctcgacaaccacagaagc

SEQ ID NO: 40661 - DNA, 21 bp, Artificial Sequence
  Description of Artificial Sequence: Synthetic oligonucleotide
cttgatggtaggggttttagt

SEQ ID NO: 40662 - DNA, 21 bp, Artificial Sequence
  Description of Artificial Sequence: Synthetic oligonucleotide
gctgggacgctggggcagatt

SEQ ID NO: 40663 - DNA, 21 bp, Artificial Sequence
  Description of Artificial Sequence: Synthetic oligonucleotide
ggcgtctgcaaaccctacgcc

SEQ ID NO: 40664 - DNA, 21 bp, Artificial Sequence
  Description of Artificial Sequence: Synthetic oligonucleotide
atgcgtgctaatcatacttcg

SEQ ID NO: 40665 - DNA, 21 bp, Artificial Sequence
  Description of Artificial Sequence: Synthetic oligonucleotide
ggcctcaaaggcagcttcccc

SEQ ID NO: 40666 - DNA, 21 bp, Artificial Sequence
  Description of Artificial Sequence: Synthetic oligonucleotide
gtcagacacaccgacgtcagc

SEQ ID NO: 40667 - DNA, 21 bp, Artificial Sequence
  Description of Artificial Sequence: Synthetic oligonucleotide
cgtgtgcaggatacgcctcgt

SEQ ID NO: 40668 - DNA, 21 bp, Artificial Sequence
  Description of Artificial Sequence: Synthetic oligonucleotide
ggcatgcaaaaaatgagcagc

SEQ ID NO: 40669 - DNA, 21 bp, Artificial Sequence
  Description of Artificial Sequence: Synthetic oligonucleotide
cattcgcgggcgcaggctggg

SEQ ID NO: 40670 - DNA, 21 bp, Artificial Sequence
  Description of Artificial Sequence: Synthetic oligonucleotide
gggaatggtattagtgctagg

SEQ ID NO: 40671 - DNA, 21 bp, Artificial Sequence
  Description of Artificial Sequence: Synthetic oligonucleotide
attccggcttcgcataatccg

SEQ ID NO: 40672 - DNA, 21 bp, Artificial Sequence
  Description of Artificial Sequence: Synthetic oligonucleotide
ggccccaccgaccacaaactc

SEQ ID NO: 40673 - DNA, 21 bp, Artificial Sequence
  Description of Artificial Sequence: Synthetic oligonucleotide
tcgatgacttctcgtaattcg

SEQ ID NO: 40674 - DNA, 21 bp, Artificial Sequence
  Description of Artificial Sequence: Synthetic oligonucleotide
gacgtcaacaccagaagcaga

SEQ ID NO: 40675 - DNA, 21 bp, Artificial Sequence
  Description of Artificial Sequence: Synthetic oligonucleotide
caccacgacgccagccccaac

SEQ ID NO: 40676 - DNA, 21 bp, Artificial Sequence
  Description of Artificial Sequence: Synthetic oligonucleotide
tatgcgcaggtgggtagttcg

SEQ ID NO: 40677 - DNA, 21 bp, Artificial Sequence
  Description of Artificial Sequence: Synthetic oligonucleotide
gtcggcagcgacagcagcacc

SEQ ID NO: 40678 - DNA, 21 bp, Artificial Sequence
  Description of Artificial Sequence: Synthetic oligonucleotide
agggctactagtcgtgaggct

SEQ ID NO: 40679 - DNA, 21 bp, Artificial Sequence
  Description of Artificial Sequence: Synthetic oligonucleotide
ttggcgccgactaatgttaag

SEQ ID NO: 40680 - DNA, 21 bp, Artificial Sequence
  Description of Artificial Sequence: Synthetic oligonucleotide
tacaaccacggcagcgtcgac

SEQ ID NO: 40681 - DNA, 21 bp, Artificial Sequence
  Description of Artificial Sequence: Synthetic oligonucleotide
tgcagcaccaccgccatcaga

SEQ ID NO: 40682 - DNA, 21 bp, Artificial Sequence
  Description of Artificial Sequence: Synthetic oligonucleotide
gcgcttcctgggagtactagt

SEQ ID NO: 40683 - DNA, 21 bp, Artificial Sequence
  Description of Artificial Sequence: Synthetic oligonucleotide
actcagccttctcatgattcg

SEQ ID NO: 40684 - DNA, 21 bp, Artificial Sequence
  Description of Artificial Sequence: Synthetic oligonucleotide
agcagccccgacagacccgtc

SEQ ID NO: 40685 - DNA, 21 bp, Artificial Sequence
  Description of Artificial Sequence: Synthetic oligonucleotide
gcccacggcaccaccggcacc

SEQ ID NO: 40686 - DNA, 21 bp, Artificial Sequence
  Description of Artificial Sequence: Synthetic oligonucleotide
tcgtcggttcagcatactggg

SEQ ID NO: 40687 - DNA, 21 bp, Artificial Sequence
  Description of Artificial Sequence: Synthetic oligonucleotide
tcgacgtcgagtaggccgtcg

SEQ ID NO: 40688 - DNA, 21 bp, Artificial Sequence
  Description of Artificial Sequence: Synthetic oligonucleotide
ggccacgtcaacgcccacgtc

SEQ ID NO: 40689 - DNA, 21 bp, Artificial Sequence
  Description of Artificial Sequence: Synthetic oligonucleotide
cctaatcagcgtgttattggt

SEQ ID NO: 40690 - DNA, 21 bp, Artificial Sequence
  Description of Artificial Sequence: Synthetic oligonucleotide
agcctcggcagaagccaactc

SEQ ID NO: 40691 - DNA, 21 bp, Artificial Sequence
  Description of Artificial Sequence: Synthetic oligonucleotide
agcaacgccaacaacgtctgc

SEQ ID NO: 40692 - DNA, 21 bp, Artificial Sequence
  Description of Artificial Sequence: Synthetic oligonucleotide
tgtacttctaagagtagttct

SEQ ID NO: 40693 - DNA, 21 bp, Artificial Sequence
  Description of Artificial Sequence: Synthetic oligonucleotide
aggactttgagtgcttcgtcg

SEQ ID NO: 40694 - DNA, 21 bp, Artificial Sequence
  Description of Artificial Sequence: Synthetic oligonucleotide
ctcagagccgaacacgtcaga

SEQ ID NO: 40695 - DNA, 21 bp, Artificial Sequence
  Description of Artificial Sequence: Synthetic oligonucleotide
agcaacagacaacacggcctc

SEQ ID NO: 40696 - DNA, 21 bp, Artificial Sequence
  Description of Artificial Sequence: Synthetic oligonucleotide
tcgattcagagtgctgctgct

SEQ ID NO: 40697 - DNA, 21 bp, Artificial Sequence
  Description of Artificial Sequence: Synthetic oligonucleotide
cacaccagcaacaccagagtc

SEQ ID NO: 40698 - DNA, 21 bp, Artificial Sequence
  Description of Artificial Sequence: Synthetic oligonucleotide
tctagggtggagattaatcgt

SEQ ID NO: 40699 - DNA, 21 bp, Artificial Sequence
  Description of Artificial Sequence: Synthetic oligonucleotide
gctacttctacgaatggtatt

SEQ ID NO: 40700 - DNA, 21 bp, Artificial Sequence
  Description of Artificial Sequence: Synthetic oligonucleotide
cctctgcttagtagtagggtg

SEQ ID NO: 40701 - DNA, 21 bp, Artificial Sequence
  Description of Artificial Sequence: Synthetic oligonucleotide
ggcagcctcaccagccaaaaa

SEQ ID NO: 40702 - DNA, 21 bp, Artificial Sequence
  Description of Artificial Sequence: Synthetic oligonucleotide
ctcgtcaacagcgccgtccaa

SEQ ID NO: 40703 - DNA, 21 bp, Artificial Sequence
  Description of Artificial Sequence: Synthetic oligonucleotide
tctgctacgaatgggtctctg

SEQ ID NO: 40704 - DNA, 21 bp, Artificial Sequence
  Description of Artificial Sequence: Synthetic oligonucleotide
catgctaataatgggacgtct

SEQ ID NO: 40705 - DNA, 21 bp, Artificial Sequence
  Description of Artificial Sequence: Synthetic oligonucleotide
cagaatctgaattctttttcg

SEQ ID NO: 40706 - DNA, 21 bp, Artificial Sequence
  Description of Artificial Sequence: Synthetic oligonucleotide
actaatttgcctcgttctcat

SEQ ID NO: 40707 - DNA, 21 bp, Artificial Sequence
  Description of Artificial Sequence: Synthetic oligonucleotide
ggggttgggcatgatgatcgt

SEQ ID NO: 40708 - DNA, 21 bp, Artificial Sequence
  Description of Artificial Sequence: Synthetic oligonucleotide
agcgtccaccaaaaaagagcc

SEQ ID NO: 40709 - DNA, 21 bp, Artificial Sequence
  Description of Artificial Sequence: Synthetic oligonucleotide
acgcgtttggcgaatatgcat

SEQ ID NO: 40710 - DNA, 21 bp, Artificial Sequence
  Description of Artificial Sequence: Synthetic oligonucleotide
ctcgccttcggcagcagcacc

SEQ ID NO: 40711 - DNA, 21 bp, Artificial Sequence
  Description of Artificial Sequence: Synthetic oligonucleotide
cccagcctcgaaagaggcagc

SEQ ID NO: 40712 - DNA, 21 bp, Artificial Sequence
  Description of Artificial Sequence: Synthetic oligonucleotide
ctcaacagcggcagcttcagc

SEQ ID NO: 40713 - DNA, 21 bp, Artificial Sequence
  Description of Artificial Sequence: Synthetic oligonucleotide
cttattaggtcgggggagcgg

SEQ ID NO: 40714 - DNA, 21 bp, Artificial Sequence
  Description of Artificial Sequence: Synthetic oligonucleotide
tcgcttactagtacgggtaag

SEQ ID NO: 40715 - DNA, 21 bp, Artificial Sequence
  Description of Artificial Sequence: Synthetic oligonucleotide
gggcgtctgaatactaatggt

SEQ ID NO: 40716 - DNA, 21 bp, Artificial Sequence
  Description of Artificial Sequence: Synthetic oligonucleotide
agaagcatgagcagcgccgtc

SEQ ID NO: 40717 - DNA, 21 bp, Artificial Sequence
  Description of Artificial Sequence: Synthetic oligonucleotide
agcagacccggcatcagccaa

SEQ ID NO: 40718 - DNA, 21 bp, Artificial Sequence
  Description of Artificial Sequence: Synthetic oligonucleotide
cctactactcttaagcatgat

SEQ ID NO: 40719 - DNA, 21 bp, Artificial Sequence
  Description of Artificial Sequence: Synthetic oligonucleotide
agaagcaacatggccaccgcc

SEQ ID NO: 40720 - DNA, 21 bp, Artificial Sequence
  Description of Artificial Sequence: Synthetic oligonucleotide
ggtagggctcagctgtctcag

SEQ ID NO: 40721 - DNA, 21 bp, Artificial Sequence
  Description of Artificial Sequence: Synthetic oligonucleotide
gctctgcatgcttcgtataat

SEQ ID NO: 40722 - DNA, 21 bp, Artificial Sequence
  Description of Artificial Sequence: Synthetic oligonucleotide
aacagcaacggcctcaacaac

SEQ ID NO: 40723 - DNA, 21 bp, Artificial Sequence
  Description of Artificial Sequence: Synthetic oligonucleotide
ctcggcaccagacccatgaaa

SEQ ID NO: 40724 - DNA, 21 bp, Artificial Sequence
  Description of Artificial Sequence: Synthetic oligonucleotide
gaaagaaccccccccagaatc

SEQ ID NO: 40725 - DNA, 21 bp, Artificial Sequence
  Description of Artificial Sequence: Synthetic oligonucleotide
aacagccaccaaaaacccagc

SEQ ID NO: 40726 - DNA, 21 bp, Artificial Sequence
  Description of Artificial Sequence: Synthetic oligonucleotide
caaagcggcagcaaacccggc

SEQ ID NO: 40727 - DNA, 21 bp, Artificial Sequence
  Description of Artificial Sequence: Synthetic oligonucleotide
ggcaccgccagaaccaccggc

SEQ ID NO: 40728 - DNA, 21 bp, Artificial Sequence
  Description of Artificial Sequence: Synthetic oligonucleotide
tttttgtcttcgagggcttct

SEQ ID NO: 40729 - DNA, 21 bp, Artificial Sequence
  Description of Artificial Sequence: Synthetic oligonucleotide
aataatactcagaagaattct

SEQ ID NO: 40730 - DNA, 21 bp, Artificial Sequence
  Description of Artificial Sequence: Synthetic oligonucleotide
aacgattctggacagaatcaa

SEQ ID NO: 40731 - DNA, 21 bp, Artificial Sequence
  Description of Artificial Sequence: Synthetic oligonucleotide
gatcggtctagtaggggtgtg

SEQ ID NO: 40732 - DNA, 21 bp, Artificial Sequence
  Description of Artificial Sequence: Synthetic oligonucleotide
aatattccttctccgcgtctt

SEQ ID NO: 40733 - DNA, 21 bp, Artificial Sequence
  Description of Artificial Sequence: Synthetic oligonucleotide
ccggggctttctaattcgcgt

SEQ ID NO: 40734 - DNA, 21 bp, Artificial Sequence
  Description of Artificial Sequence: Synthetic oligonucleotide
atggtttcgggtaagagttat

SEQ ID NO: 40735 - DNA, 21 bp, Artificial Sequence
  Description of Artificial Sequence: Synthetic oligonucleotide
aattcggggaggaattctgtt

SEQ ID NO: 40736 - DNA, 21 bp, Artificial Sequence
  Description of Artificial Sequence: Synthetic oligonucleotide
tggatgagcggcaaaaacagc

SEQ ID NO: 40737 - DNA, 21 bp, Artificial Sequence
  Description of Artificial Sequence: Synthetic oligonucleotide
atcagaagcaccaaagcccaa

SEQ ID NO: 40738 - DNA, 21 bp, Artificial Sequence
  Description of Artificial Sequence: Synthetic oligonucleotide
gaagtcttcagcagccaaaaa

SEQ ID NO: 40739 - DNA, 21 bp, Artificial Sequence
  Description of Artificial Sequence: Synthetic oligonucleotide
agcttcaccaaaggcgccggc

SEQ ID NO: 40740 - DNA, 21 bp, Artificial Sequence
  Description of Artificial Sequence: Synthetic oligonucleotide
accggcatgagaccccccggc

SEQ ID NO: 40741 - DNA, 21 bp, Artificial Sequence
  Description of Artificial Sequence: Synthetic oligonucleotide
aataatagtaagagtcagatt

SEQ ID NO: 40742 - DNA, 21 bp, Artificial Sequence
  Description of Artificial Sequence: Synthetic oligonucleotide
cccaaactcagccacaccggc

SEQ ID NO: 40743 - DNA, 21 bp, Artificial Sequence
  Description of Artificial Sequence: Synthetic oligonucleotide
caaggccacaccagattcacc

SEQ ID NO: 40744 - DNA, 21 bp, Artificial Sequence
  Description of Artificial Sequence: Synthetic oligonucleotide
caacccagccaaggccacagc

SEQ ID NO: 40745 - DNA, 21 bp, Artificial Sequence
  Description of Artificial Sequence: Synthetic oligonucleotide
gacagaatcagaaccggccac

SEQ ID NO: 40746 - DNA, 21 bp, Artificial Sequence
  Description of Artificial Sequence: Synthetic oligonucleotide
gcttattcgaatattcagaat

SEQ ID NO: 40747 - DNA, 21 bp, Artificial Sequence
  Description of Artificial Sequence: Synthetic oligonucleotide
atcggcctcaacagaaccggc

SEQ ID NO: 40748 - DNA, 21 bp, Artificial Sequence
  Description of Artificial Sequence: Synthetic oligonucleotide
gtcagcggcagacccaccggc

SEQ ID NO: 40749 - DNA, 21 bp, Artificial Sequence
  Description of Artificial Sequence: Synthetic oligonucleotide
tacaccatcaccccccaaaaa

SEQ ID NO: 40750 - DNA, 21 bp, Artificial Sequence
  Description of Artificial Sequence: Synthetic oligonucleotide
gaaaccaccacccccagaaaa

SEQ ID NO: 40751 - DNA, 21 bp, Artificial Sequence
  Description of Artificial Sequence: Synthetic oligonucleotide
tcgcagagttctcgtagtggt

SEQ ID NO: 40752 - DNA, 21 bp, Artificial Sequence
  Description of Artificial Sequence: Synthetic oligonucleotide
tatggtcttcataatgcgcgt

SEQ ID NO: 40753 - DNA, 21 bp, Artificial Sequence
  Description of Artificial Sequence: Synthetic oligonucleotide
aaaaacgccccccaacaagcc

SEQ ID NO: 40754 - DNA, 21 bp, Artificial Sequence
  Description of Artificial Sequence: Synthetic oligonucleotide
aacggcagcggccaaaacaaa

SEQ ID NO: 40755 - DNA, 21 bp, Artificial Sequence
  Description of Artificial Sequence: Synthetic oligonucleotide
tctacggatcggtcgtttaat

SEQ ID NO: 40756 - DNA, 21 bp, Artificial Sequence
  Description of Artificial Sequence: Synthetic oligonucleotide
ttcagcgccagcggcgccaga

SEQ ID NO: 40757 - DNA, 21 bp, Artificial Sequence
  Description of Artificial Sequence: Synthetic oligonucleotide
ctttattctgggtcgcaggag

SEQ ID NO: 40758 - DNA, 21 bp, Artificial Sequence
  Description of Artificial Sequence: Synthetic oligonucleotide
aacagccacacccccgtcaga

SEQ ID NO: 40759 - DNA, 21 bp, Artificial Sequence
  Description of Artificial Sequence: Synthetic oligonucleotide
aaaagagacgcccacaccgcc

SEQ ID NO: 40760 - DNA, 21 bp, Artificial Sequence
  Description of Artificial Sequence: Synthetic oligonucleotide
catggttctaagccgtatatt

SEQ ID NO: 40761 - DNA, 21 bp, Artificial Sequence
  Description of Artificial Sequence: Synthetic oligonucleotide
aatccgggtaaggggtcgtct

SEQ ID NO: 40762 - DNA, 21 bp, Artificial Sequence
  Description of Artificial Sequence: Synthetic oligonucleotide
tctttttcgaagggttctagt

SEQ ID NO: 40763 - DNA, 21 bp, Artificial Sequence
  Description of Artificial Sequence: Synthetic oligonucleotide
aattctggtactcattttaag

SEQ ID NO: 40764 - DNA, 21 bp, Artificial Sequence
  Description of Artificial Sequence: Synthetic oligonucleotide
agcagcatgagccaccaaaaa

SEQ ID NO: 40765 - DNA, 21 bp, Artificial Sequence
  Description of Artificial Sequence: Synthetic oligonucleotide
tctattggtaaggggtataat

SEQ ID NO: 40766 - DNA, 21 bp, Artificial Sequence
  Description of Artificial Sequence: Synthetic oligonucleotide
caaagcagcatccacaccaaa

SEQ ID NO: 40767 - DNA, 21 bp, Artificial Sequence
  Description of Artificial Sequence: Synthetic oligonucleotide
tcttttagtggggctaataag

SEQ ID NO: 40768 - DNA, 21 bp, Artificial Sequence
  Description of Artificial Sequence: Synthetic oligonucleotide
ggtcagactcttcctatttgt

SEQ ID NO: 40769 - DNA, 21 bp, Artificial Sequence
  Description of Artificial Sequence: Synthetic oligonucleotide
gctcttttgaatattaatact

SEQ ID NO: 40770 - DNA, 21 bp, Artificial Sequence
  Description of Artificial Sequence: Synthetic oligonucleotide
atgctccaaagagcccccggc

SEQ ID NO: 40771 - DNA, 21 bp, Artificial Sequence
  Description of Artificial Sequence: Synthetic oligonucleotide
ggcaccggccaccaaagaagc

SEQ ID NO: 40772 - DNA, 21 bp, Artificial Sequence
  Description of Artificial Sequence: Synthetic oligonucleotide
agtttgactcctatgggtcgg

SEQ ID NO: 40773 - DNA, 21 bp, Artificial Sequence
  Description of Artificial Sequence: Synthetic oligonucleotide
ctcgtcgccagcggccaaaaa

SEQ ID NO: 40774 - DNA, 21 bp, Artificial Sequence
  Description of Artificial Sequence: Synthetic oligonucleotide
cccagaaccagagaaaaccaa

SEQ ID NO: 40775 - DNA, 21 bp, Artificial Sequence
  Description of Artificial Sequence: Synthetic oligonucleotide
aatatttcgtctaaggttgcg

SEQ ID NO: 40776 - DNA, 21 bp, Artificial Sequence
  Description of Artificial Sequence: Synthetic oligonucleotide
ctccaaagagccccccaaacc

SEQ ID NO: 40777 - DNA, 21 bp, Artificial Sequence
  Description of Artificial Sequence: Synthetic oligonucleotide
tctatttctaagactcaggct

SEQ ID NO: 40778 - DNA, 21 bp, Artificial Sequence
  Description of Artificial Sequence: Synthetic oligonucleotide
gtcaccggccaaaaccaaacc

SEQ ID NO: 40779 - DNA, 21 bp, Artificial Sequence
  Description of Artificial Sequence: Synthetic oligonucleotide
tttcttacgggtcgtcagtcg

SEQ ID NO: 40780 - DNA, 21 bp, Artificial Sequence
  Description of Artificial Sequence: Synthetic oligonucleotide
accatgagagccacccccccc

SEQ ID NO: 40781 - DNA, 21 bp, Artificial Sequence
  Description of Artificial Sequence: Synthetic oligonucleotide
aataatcttcctcggaatttg

SEQ ID NO: 40782 - DNA, 21 bp, Artificial Sequence
  Description of Artificial Sequence: Synthetic oligonucleotide
accagcgaaagacccacctgc

SEQ ID NO: 40783 - DNA, 21 bp, Artificial Sequence
  Description of Artificial Sequence: Synthetic oligonucleotide
ctccccaccggcaaaatgctc

SEQ ID NO: 40784 - DNA, 21 bp, Artificial Sequence
  Description of Artificial Sequence: Synthetic oligonucleotide
tataagccggggttgcagtct

SEQ ID NO: 40785 - DNA, 21 bp, Artificial Sequence
  Description of Artificial Sequence: Synthetic oligonucleotide
ggcagactcgaagcccaaaaa

SEQ ID NO: 40786 - DNA, 21 bp, Artificial Sequence
  Description of Artificial Sequence: Synthetic oligonucleotide
gttcatgtgacgagtcagact

SEQ ID NO: 40787 - DNA, 21 bp, Artificial Sequence
  Description of Artificial Sequence: Synthetic oligonucleotide
agaagccccagcaccaacccc

SEQ ID NO: 40788 - DNA, 21 bp, Artificial Sequence
  Description of Artificial Sequence: Synthetic oligonucleotide
tttatgggtcgtcctaatgtt

SEQ ID NO: 40789 - DNA, 21 bp, Artificial Sequence
  Description of Artificial Sequence: Synthetic oligonucleotide
caaggccccaaaaacgccgac

SEQ ID NO: 40790 - DNA, 21 bp, Artificial Sequence
  Description of Artificial Sequence: Synthetic oligonucleotide
tcgccggttaaggggtctgtt

SEQ ID NO: 40791 - DNA, 21 bp, Artificial Sequence
  Description of Artificial Sequence: Synthetic oligonucleotide
caccccagcaacaaacccctc

SEQ ID NO: 40792 - DNA, 21 bp, Artificial Sequence
  Description of Artificial Sequence: Synthetic oligonucleotide
gaacccgtccccaaaaccaga

SEQ ID NO: 40793 - DNA, 21 bp, Artificial Sequence
  Description of Artificial Sequence: Synthetic oligonucleotide
cacaacagcaaaagccaaatc

SEQ ID NO: 40794 - DNA, 21 bp, Artificial Sequence
  Description of Artificial Sequence: Synthetic oligonucleotide
tttagttctaagacttctccg

SEQ ID NO: 40795 - DNA, 21 bp, Artificial Sequence
  Description of Artificial Sequence: Synthetic oligonucleotide
cctaatcgggtgcctaatcat

SEQ ID NO: 40796 - DNA, 21 bp, Artificial Sequence
  Description of Artificial Sequence: Synthetic oligonucleotide
tattcggataataagactact

SEQ ID NO: 40797 - DNA, 21 bp, Artificial Sequence
  Description of Artificial Sequence: Synthetic oligonucleotide
agccccaccagacccatgaac

SEQ ID NO: 40798 - DNA, 21 bp, Artificial Sequence
  Description of Artificial Sequence: Synthetic oligonucleotide
ttttctgggaagcctagtagg

SEQ ID NO: 40799 - DNA, 21 bp, Artificial Sequence
  Description of Artificial Sequence: Synthetic oligonucleotide
cccagcgccggcagagaaaaa

SEQ ID NO: 40800 - DNA, 21 bp, Artificial Sequence
  Description of Artificial Sequence: Synthetic oligonucleotide
cccggcagagaaaaaaccgtc

SEQ ID NO: 40801 - DNA, 21 bp, Artificial Sequence
  Description of Artificial Sequence: Synthetic oligonucleotide
ttgcagcagcataatacgaag

SEQ ID NO: 40802 - DNA, 21 bp, Artificial Sequence
  Description of Artificial Sequence: Synthetic oligonucleotide
atgacccaacacaaacaagcc

SEQ ID NO: 40803 - DNA, 21 bp, Artificial Sequence
  Description of Artificial Sequence: Synthetic oligonucleotide
tacagcatgagacccaccgaa

SEQ ID NO: 40804 - DNA, 21 bp, Artificial Sequence
  Description of Artificial Sequence: Synthetic oligonucleotide
aagggttttaagactgagagt

SEQ ID NO: 40805 - DNA, 21 bp, Artificial Sequence
  Description of Artificial Sequence: Synthetic oligonucleotide
aacagagaaagcccccaaaga

SEQ ID NO: 40806 - DNA, 21 bp, Artificial Sequence
  Description of Artificial Sequence: Synthetic oligonucleotide
aatttgggtaattctctgaag

SEQ ID NO: 40807 - DNA, 21 bp, Artificial Sequence
  Description of Artificial Sequence: Synthetic oligonucleotide
caaaacctccccaaagccagc

SEQ ID NO: 40808 - DNA, 21 bp, Artificial Sequence
  Description of Artificial Sequence: Synthetic oligonucleotide
acccaaaacaccaaaagcatc

SEQ ID NO: 40809 - DNA, 21 bp, Artificial Sequence
  Description of Artificial Sequence: Synthetic oligonucleotide
ctcggccccggcaaaaacacc

SEQ ID NO: 40810 - DNA, 21 bp, Artificial Sequence
  Description of Artificial Sequence: Synthetic oligonucleotide
caagtcagcgccaaaagcgcc

SEQ ID NO: 40811 - DNA, 21 bp, Artificial Sequence
  Description of Artificial Sequence: Synthetic oligonucleotide
ctcaacggcaccccccaaagc

SEQ ID NO: 40812 - DNA, 21 bp, Artificial Sequence
  Description of Artificial Sequence: Synthetic oligonucleotide
cttggtactagtccgatgaag

SEQ ID NO: 40813 - DNA, 21 bp, Artificial Sequence
  Description of Artificial Sequence: Synthetic oligonucleotide
acgagggggtctcctttgatg

SEQ ID NO: 40814 - DNA, 21 bp, Artificial Sequence
  Description of Artificial Sequence: Synthetic oligonucleotide
tcttctgggggtaatatgagt

SEQ ID NO: 40815 - DNA, 21 bp, Artificial Sequence
  Description of Artificial Sequence: Synthetic oligonucleotide
cccggcaccggcagcaaccac

SEQ ID NO: 40816 - DNA, 21 bp, Artificial Sequence
  Description of Artificial Sequence: Synthetic oligonucleotide
caaaacacccccaaaagcacc

SEQ ID NO: 40817 - DNA, 21 bp, Artificial Sequence
  Description of Artificial Sequence: Synthetic oligonucleotide
ttcaacatgcaaagaagccaa

SEQ ID NO: 40818 - DNA, 21 bp, Artificial Sequence
  Description of Artificial Sequence: Synthetic oligonucleotide
agtaatcttccgcggaatctg

SEQ ID NO: 40819 - DNA, 21 bp, Artificial Sequence
  Description of Artificial Sequence: Synthetic oligonucleotide
agttcgggtaagtcgttttct

SEQ ID NO: 40820 - DNA, 21 bp, Artificial Sequence
  Description of Artificial Sequence: Synthetic oligonucleotide
aacggttctagacagaatcaa

SEQ ID NO: 40821 - DNA, 21 bp, Artificial Sequence
  Description of Artificial Sequence: Synthetic oligonucleotide
cccaccagcagcccccaaaga

SEQ ID NO: 40822 - DNA, 21 bp, Artificial Sequence
  Description of Artificial Sequence: Synthetic oligonucleotide
agcttcgacagcaaacccccc

SEQ ID NO: 40823 - DNA, 21 bp, Artificial Sequence
  Description of Artificial Sequence: Synthetic oligonucleotide
caaaccagcgccacccaaaga

SEQ ID NO: 40824 - DNA, 21 bp, Artificial Sequence
  Description of Artificial Sequence: Synthetic oligonucleotide
cccagcaacaaaaccaacagc

SEQ ID NO: 40825 - DNA, 21 bp, Artificial Sequence
  Description of Artificial Sequence: Synthetic oligonucleotide
actccgcagaattctgtgaag

SEQ ID NO: 40826 - DNA, 21 bp, Artificial Sequence
  Description of Artificial Sequence: Synthetic oligonucleotide
tctcatacgggtaatatggtt

SEQ ID NO: 40827 - DNA, 21 bp, Artificial Sequence
  Description of Artificial Sequence: Synthetic oligonucleotide
aatccttcggagaagatgttg

SEQ ID NO: 40828 - DNA, 21 bp, Artificial Sequence
  Description of Artificial Sequence: Synthetic oligonucleotide
ctcggcaccagccaaatgaaa

SEQ ID NO: 40829 - DNA, 21 bp, Artificial Sequence
  Description of Artificial Sequence: Synthetic oligonucleotide
ggcctccaaaccccccccaga

SEQ ID NO: 40830 - DNA, 21 bp, Artificial Sequence
  Description of Artificial Sequence: Synthetic oligonucleotide
caaaccggcagcaacaacaaa

SEQ ID NO: 40831 - DNA, 21 bp, Artificial Sequence
  Description of Artificial Sequence: Synthetic oligonucleotide
actccgattactcctatgact

SEQ ID NO: 40832 - DNA, 21 bp, Artificial Sequence
  Description of Artificial Sequence: Synthetic oligonucleotide
acgttttctaagggtactaat

SEQ ID NO: 40833 - DNA, 21 bp, Artificial Sequence
  Description of Artificial Sequence: Synthetic oligonucleotide
agccacagcagcccctacaaa

SEQ ID NO: 40834 - DNA, 21 bp, Artificial Sequence
  Description of Artificial Sequence: Synthetic oligonucleotide
agaagcgccagcggccaactc

SEQ ID NO: 40835 - DNA, 21 bp, Artificial Sequence
  Description of Artificial Sequence: Synthetic oligonucleotide
taccccagacaaagaaccgaa

SEQ ID NO: 40836 - DNA, 21 bp, Artificial Sequence
  Description of Artificial Sequence: Synthetic oligonucleotide
tacggccaaaccaaaacccaa

SEQ ID NO: 40837 - DNA, 21 bp, Artificial Sequence
  Description of Artificial Sequence: Synthetic oligonucleotide
caaatcagcgccagcaccaga

SEQ ID NO: 40838 - DNA, 21 bp, Artificial Sequence
  Description of Artificial Sequence: Synthetic oligonucleotide
agctacgccagcacccaacaa

SEQ ID NO: 40839 - DNA, 21 bp, Artificial Sequence
  Description of Artificial Sequence: Synthetic oligonucleotide
aaaggccaaaacaccatcagc

SEQ ID NO: 40840 - DNA, 21 bp, Artificial Sequence
  Description of Artificial Sequence: Synthetic oligonucleotide
cccaccaccggcccccaaaga

SEQ ID NO: 40841 - DNA, 21 bp, Artificial Sequence
  Description of Artificial Sequence: Synthetic oligonucleotide
agcaacaacggcacccaaaaa

SEQ ID NO: 40842 - DNA, 21 bp, Artificial Sequence
  Description of Artificial Sequence: Synthetic oligonucleotide
agtcgttctggtggtcaggtt

SEQ ID NO: 40843 - DNA, 21 bp, Artificial Sequence
  Description of Artificial Sequence: Synthetic oligonucleotide
gggaataatcggccggcttcg

SEQ ID NO: 40844 - DNA, 21 bp, Artificial Sequence
  Description of Artificial Sequence: Synthetic oligonucleotide
aaaaaccaagcccccctcctc

SEQ ID NO: 40845 - DNA, 21 bp, Artificial Sequence
  Description of Artificial Sequence: Synthetic oligonucleotide
aatggggctacgaagaatagt

SEQ ID NO: 40846 - DNA, 21 bp, Artificial Sequence
  Description of Artificial Sequence: Synthetic oligonucleotide
ggcacccaaaaacaaaccagc

SEQ ID NO: 40847 - DNA, 21 bp, Artificial Sequence
  Description of Artificial Sequence: Synthetic oligonucleotide
aaggtggataagaggactgat

SEQ ID NO: 40848 - DNA, 21 bp, Artificial Sequence
  Description of Artificial Sequence: Synthetic oligonucleotide
tctggtgttaaggctttttct

SEQ ID NO: 40849 - DNA, 21 bp, Artificial Sequence
  Description of Artificial Sequence: Synthetic oligonucleotide
tataataagaatgctcagttg

SEQ ID NO: 40850 - DNA, 21 bp, Artificial Sequence
  Description of Artificial Sequence: Synthetic oligonucleotide
acccaaagacccgcccaaatg

SEQ ID NO: 40851 - DNA, 21 bp, Artificial Sequence
  Description of Artificial Sequence: Synthetic oligonucleotide
caaacccaaggccaactcaaa

SEQ ID NO: 40852 - DNA, 21 bp, Artificial Sequence
  Description of Artificial Sequence: Synthetic oligonucleotide
tctaattctcataagatttat

SEQ ID NO: 40853 - DNA, 21 bp, Artificial Sequence
  Description of Artificial Sequence: Synthetic oligonucleotide
gccaacggccacccccaaagc

SEQ ID NO: 40854 - DNA, 21 bp, Artificial Sequence
  Description of Artificial Sequence: Synthetic oligonucleotide
aggccggtggggggtctggcg

SEQ ID NO: 40855 - DNA, 21 bp, Artificial Sequence
  Description of Artificial Sequence: Synthetic oligonucleotide
ccccaaagcagccaccaaacc

SEQ ID NO: 40856 - DNA, 21 bp, Artificial Sequence
  Description of Artificial Sequence: Synthetic oligonucleotide
acttataatagtagtcaggcg

SEQ ID NO: 40857 - DNA, 21 bp, Artificial Sequence
  Description of Artificial Sequence: Synthetic oligonucleotide
agtaatcaggttcgtcagatt

SEQ ID NO: 40858 - DNA, 21 bp, Artificial Sequence
  Description of Artificial Sequence: Synthetic oligonucleotide
agcctcaccaccaaagccaac

SEQ ID NO: 40859 - DNA, 21 bp, Artificial Sequence
  Description of Artificial Sequence: Synthetic oligonucleotide
agccccggcaacaaaagcacc

SEQ ID NO: 40860 - DNA, 21 bp, Artificial Sequence
  Description of Artificial Sequence: Synthetic oligonucleotide
tacggcaaccccagacaagcc

SEQ ID NO: 40861 - DNA, 21 bp, Artificial Sequence
  Description of Artificial Sequence: Synthetic oligonucleotide
agaagacaagacacccaagaa

SEQ ID NO: 40862 - DNA, 21 bp, Artificial Sequence
  Description of Artificial Sequence: Synthetic oligonucleotide
aataataggagtgggatgggt

SEQ ID NO: 40863 - DNA, 21 bp, Artificial Sequence
  Description of Artificial Sequence: Synthetic oligonucleotide
agcttcgccaaaagcgccagc

SEQ ID NO: 40864 - DNA, 21 bp, Artificial Sequence
  Description of Artificial Sequence: Synthetic oligonucleotide
ggccaaaacagaaacaacacc

SEQ ID NO: 40865 - DNA, 21 bp, Artificial Sequence
  Description of Artificial Sequence: Synthetic oligonucleotide
acccccgccggccccaacaaa

SEQ ID NO: 40866 - DNA, 21 bp, Artificial Sequence
  Description of Artificial Sequence: Synthetic oligonucleotide
aatatttcgactaggcagagt

SEQ ID NO: 40867 - DNA, 21 bp, Artificial Sequence
  Description of Artificial Sequence: Synthetic oligonucleotide
tatcatcttaattctcagtct

SEQ ID NO: 40868 - DNA, 21 bp, Artificial Sequence
  Description of Artificial Sequence: Synthetic oligonucleotide
agtcttagttcgaagcagatg

SEQ ID NO: 40869 - DNA, 21 bp, Artificial Sequence
  Description of Artificial Sequence: Synthetic oligonucleotide
aataatgggaggcctattgcg

SEQ ID NO: 40870 - DNA, 21 bp, Artificial Sequence
  Description of Artificial Sequence: Synthetic oligonucleotide
aaccaaaaaaccagaaccgac

SEQ ID NO: 40871 - DNA, 21 bp, Artificial Sequence
  Description of Artificial Sequence: Synthetic oligonucleotide
accagccaaaccaaaatcgtc

SEQ ID NO: 40872 - DNA, 21 bp, Artificial Sequence
  Description of Artificial Sequence: Synthetic oligonucleotide
gtcacccccaccaaacacccc

SEQ ID NO: 40873 - DNA, 21 bp, Artificial Sequence
  Description of Artificial Sequence: Synthetic oligonucleotide
cccggccaaagcaccagcaaa

SEQ ID NO: 40874 - DNA, 21 bp, Artificial Sequence
  Description of Artificial Sequence: Synthetic oligonucleotide
aaaaccagcaccccctacagc

SEQ ID NO: 40875 - DNA, 21 bp, Artificial Sequence
  Description of Artificial Sequence: Synthetic oligonucleotide
tctgggggtaagtcggcgctt

SEQ ID NO: 40876 - DNA, 21 bp, Artificial Sequence
  Description of Artificial Sequence: Synthetic oligonucleotide
aacggcaccagacaaaaccaa

SEQ ID NO: 40877 - DNA, 21 bp, Artificial Sequence
  Description of Artificial Sequence: Synthetic oligonucleotide
aacggccccggccaaaaccaa

SEQ ID NO: 40878 - DNA, 21 bp, Artificial Sequence
  Description of Artificial Sequence: Synthetic oligonucleotide
gccaccaacaaaaccaccaac

SEQ ID NO: 40879 - DNA, 21 bp, Artificial Sequence
  Description of Artificial Sequence: Synthetic oligonucleotide
accggcatgagaaacatcggc

SEQ ID NO: 40880 - DNA, 21 bp, Artificial Sequence
  Description of Artificial Sequence: Synthetic oligonucleotide
cccaccaccaccgccaaaccc

SEQ ID NO: 40881 - DNA, 21 bp, Artificial Sequence
  Description of Artificial Sequence: Synthetic oligonucleotide
ttccccaccagccccaccaga

SEQ ID NO: 40882 - DNA, 21 bp, Artificial Sequence
  Description of Artificial Sequence: Synthetic oligonucleotide
ccttataattctaaggcttcg

SEQ ID NO: 40883 - DNA, 21 bp, Artificial Sequence
  Description of Artificial Sequence: Synthetic oligonucleotide
ggcctccaaagcaaacaactc

SEQ ID NO: 40884 - DNA, 21 bp, Artificial Sequence
  Description of Artificial Sequence: Synthetic oligonucleotide
gccagcctcaaaacccaaatg

SEQ ID NO: 40885 - DNA, 21 bp, Artificial Sequence
  Description of Artificial Sequence: Synthetic oligonucleotide
agccccggcagaacccaaagc

SEQ ID NO: 40886 - DNA, 21 bp, Artificial Sequence
  Description of Artificial Sequence: Synthetic oligonucleotide
gaactcatgaacaaaagcaaa

SEQ ID NO: 40887 - DNA, 21 bp, Artificial Sequence
  Description of Artificial Sequence: Synthetic oligonucleotide
atcggcaacaaacaaagccaa

SEQ ID NO: 40888 - DNA, 21 bp, Artificial Sequence
  Description of Artificial Sequence: Synthetic oligonucleotide
ccggggcagaagcagggtatt

SEQ ID NO: 40889 - DNA, 21 bp, Artificial Sequence
  Description of Artificial Sequence: Synthetic oligonucleotide
gaacccacccaccccagaggc

SEQ ID NO: 40890 - DNA, 21 bp, Artificial Sequence
  Description of Artificial Sequence: Synthetic oligonucleotide
tttcgggcgcaggctaatgtt

SEQ ID NO: 40891 - DNA, 21 bp, Artificial Sequence
  Description of Artificial Sequence: Synthetic oligonucleotide
cccacccacgaaagagccaaa

SEQ ID NO: 40892 - DNA, 21 bp, Artificial Sequence
  Description of Artificial Sequence: Synthetic oligonucleotide
cctggtagttcgaataggaat

SEQ ID NO: 40893 - DNA, 21 bp, Artificial Sequence
  Description of Artificial Sequence: Synthetic oligonucleotide
gtccccctccaaaaacccagc

SEQ ID NO: 40894 - DNA, 21 bp, Artificial Sequence
  Description of Artificial Sequence: Synthetic oligonucleotide
tttacttctaataaggcgtcg

SEQ ID NO: 40895 - DNA, 21 bp, Artificial Sequence
  Description of Artificial Sequence: Synthetic oligonucleotide
gaaaacagcagcaaagccaaa

SEQ ID NO: 40896 - DNA, 21 bp, Artificial Sequence
  Description of Artificial Sequence: Synthetic oligonucleotide
agcggcgccggcagcgccggc

SEQ ID NO: 40897 - DNA, 21 bp, Artificial Sequence
  Description of Artificial Sequence: Synthetic oligonucleotide
ggcctcgccaaagaccaaaga

SEQ ID NO: 40898 - DNA, 21 bp, Artificial Sequence
  Description of Artificial Sequence: Synthetic oligonucleotide
accccccacgacggccaaaga

SEQ ID NO: 40899 - DNA, 21 bp, Artificial Sequence
  Description of Artificial Sequence: Synthetic oligonucleotide
tgtattgggaataagactaat

SEQ ID NO: 40900 - DNA, 21 bp, Artificial Sequence
  Description of Artificial Sequence: Synthetic oligonucleotide
tatattaagtctgttactaat

SEQ ID NO: 40901 - DNA, 21 bp, Artificial Sequence
  Description of Artificial Sequence: Synthetic oligonucleotide
accagcagcggccacagcgtc

SEQ ID NO: 40902 - DNA, 21 bp, Artificial Sequence
  Description of Artificial Sequence: Synthetic oligonucleotide
aatagtttttctcggaatagt

SEQ ID NO: 40903 - DNA, 21 bp, Artificial Sequence
  Description of Artificial Sequence: Synthetic oligonucleotide
tctgattctcgtaatacgaat

SEQ ID NO: 40904 - DNA, 21 bp, Artificial Sequence
  Description of Artificial Sequence: Synthetic oligonucleotide
aacacccaaagctacaccaga

SEQ ID NO: 40905 - DNA, 21 bp, Artificial Sequence
  Description of Artificial Sequence: Synthetic oligonucleotide
agcagaaacagccccccccaa

SEQ ID NO: 40906 - DNA, 21 bp, Artificial Sequence
  Description of Artificial Sequence: Synthetic oligonucleotide
actatttcgactagtcagagt

SEQ ID NO: 40907 - DNA, 21 bp, Artificial Sequence
  Description of Artificial Sequence: Synthetic oligonucleotide
aatggttttaatagtaataat

SEQ ID NO: 40908 - DNA, 21 bp, Artificial Sequence
  Description of Artificial Sequence: Synthetic oligonucleotide
ttcaccaaactcgccagcccc

SEQ ID NO: 40909 - DNA, 21 bp, Artificial Sequence
  Description of Artificial Sequence: Synthetic oligonucleotide
tggaggttgtctcggcagcag

SEQ ID NO: 40910 - DNA, 21 bp, Artificial Sequence
  Description of Artificial Sequence: Synthetic oligonucleotide
caaaccagccacagcgccaaa

SEQ ID NO: 40911 - DNA, 21 bp, Artificial Sequence
  Description of Artificial Sequence: Synthetic oligonucleotide
ccctacgccggcaaccaaaga

SEQ ID NO: 40912 - DNA, 21 bp, Artificial Sequence
  Description of Artificial Sequence: Synthetic oligonucleotide
gggtctggtaataaggttaat

SEQ ID NO: 40913 - DNA, 21 bp, Artificial Sequence
  Description of Artificial Sequence: Synthetic oligonucleotide
aatagtgggaagccgaatgcg

SEQ ID NO: 40914 - DNA, 21 bp, Artificial Sequence
  Description of Artificial Sequence: Synthetic oligonucleotide
cctggtagtgtgactgggtct

SEQ ID NO: 40915 - DNA, 21 bp, Artificial Sequence
  Description of Artificial Sequence: Synthetic oligonucleotide
aacggcatcaccaaaagcagc

SEQ ID NO: 40916 - DNA, 21 bp, Artificial Sequence
  Description of Artificial Sequence: Synthetic oligonucleotide
caggggtctgggagtaatcat

SEQ ID NO: 40917 - DNA, 21 bp, Artificial Sequence
  Description of Artificial Sequence: Synthetic oligonucleotide
ggtccgattcggccgattcag

SEQ ID NO: 40918 - DNA, 21 bp, Artificial Sequence
  Description of Artificial Sequence: Synthetic oligonucleotide
ttcgccagcagacccgtccaa

SEQ ID NO: 40919 - DNA, 21 bp, Artificial Sequence
  Description of Artificial Sequence: Synthetic oligonucleotide
agcaacgaaaccaaaagcagc

SEQ ID NO: 40920 - DNA, 21 bp, Artificial Sequence
  Description of Artificial Sequence: Synthetic oligonucleotide
attcctgcgaattcttttaag

SEQ ID NO: 40921 - DNA, 21 bp, Artificial Sequence
  Description of Artificial Sequence: Synthetic oligonucleotide
gcccaaaccaaaggcacccaa

SEQ ID NO: 40922 - DNA, 21 bp, Artificial Sequence
  Description of Artificial Sequence: Synthetic oligonucleotide
acttctatgaatggtaataag

SEQ ID NO: 40923 - DNA, 21 bp, Artificial Sequence
  Description of Artificial Sequence: Synthetic oligonucleotide
agccaagtcagcaaaccccaa

SEQ ID NO: 40924 - DNA, 21 bp, Artificial Sequence
  Description of Artificial Sequence: Synthetic oligonucleotide
cccaacaccaaacccgtcctc

SEQ ID NO: 40925 - DNA, 21 bp, Artificial Sequence
  Description of Artificial Sequence: Synthetic oligonucleotide
accccccaccaaagaagcagc

SEQ ID NO: 40926 - DNA, 21 bp, Artificial Sequence
  Description of Artificial Sequence: Synthetic oligonucleotide
aatcagtcgaggccgggggtg

SEQ ID NO: 40927 - DNA, 21 bp, Artificial Sequence
  Description of Artificial Sequence: Synthetic oligonucleotide
aataatagtaagagtcagatt

SEQ ID NO: 40928 - DNA, 21 bp, Artificial Sequence
  Description of Artificial Sequence: Synthetic oligonucleotide
gctatgtctgagcatctgaag

SEQ ID NO: 40929 - DNA, 21 bp, Artificial Sequence
  Description of Artificial Sequence: Synthetic oligonucleotide
cttattcttccgggtaataat

SEQ ID NO: 40930 - DNA, 21 bp, Artificial Sequence
  Description of Artificial Sequence: Synthetic oligonucleotide
ggcgtcagcgaacacagaaaa

SEQ ID NO: 40931 - DNA, 21 bp, Artificial Sequence
  Description of Artificial Sequence: Synthetic oligonucleotide
cattcggagaatgggaatcgt

SEQ ID NO: 40932 - DNA, 21 bp, Artificial Sequence
  Description of Artificial Sequence: Synthetic oligonucleotide
gatttgcagactagtgctaag

SEQ ID NO: 40933 - DNA, 21 bp, Artificial Sequence
  Description of Artificial Sequence: Synthetic oligonucleotide
cggtctttgcctaatgtggct

SEQ ID NO: 40934 - DNA, 21 bp, Artificial Sequence
  Description of Artificial Sequence: Synthetic oligonucleotide
tattcggataataagactact

SEQ ID NO: 40935 - DNA, 21 bp, Artificial Sequence
  Description of Artificial Sequence: Synthetic oligonucleotide
tcgcataataggacgaatgat

SEQ ID NO: 40936 - DNA, 21 bp, Artificial Sequence
  Description of Artificial Sequence: Synthetic oligonucleotide
gttagtaataagtctgtgctt

SEQ ID NO: 40937 - DNA, 21 bp, Artificial Sequence
  Description of Artificial Sequence: Synthetic oligonucleotide
cgggatcatagtggttcgagg

SEQ ID NO: 40938 - DNA, 21 bp, Artificial Sequence
  Description of Artificial Sequence: Synthetic oligonucleotide
aacgccaaccaaaaccaaatg

SEQ ID NO: 40939 - DNA, 21 bp, Artificial Sequence
  Description of Artificial Sequence: Synthetic oligonucleotide
acccaccaaagcagcaccagc

SEQ ID NO: 40940 - DNA, 21 bp, Artificial Sequence
  Description of Artificial Sequence: Synthetic oligonucleotide
actttgcctagggtgccggcg

SEQ ID NO: 40941 - DNA, 21 bp, Artificial Sequence
  Description of Artificial Sequence: Synthetic oligonucleotide
tcttattcgagttctcagctg

SEQ ID NO: 40942 - DNA, 21 bp, Artificial Sequence
  Description of Artificial Sequence: Synthetic oligonucleotide
ccgaaggtgagggatgggtat

SEQ ID NO: 40943 - DNA, 21 bp, Artificial Sequence
  Description of Artificial Sequence: Synthetic oligonucleotide
tacggccaaaccaaaacccaa

SEQ ID NO: 40944 - DNA, 21 bp, Artificial Sequence
  Description of Artificial Sequence: Synthetic oligonucleotide
tctgcgagtccgagtattaag

SEQ ID NO: 40945 - DNA, 21 bp, Artificial Sequence
  Description of Artificial Sequence: Synthetic oligonucleotide
cggtcgactgtgtctccgaat

SEQ ID NO: 40946 - DNA, 21 bp, Artificial Sequence
  Description of Artificial Sequence: Synthetic oligonucleotide
gtccaaagaagcagcaaccaa

SEQ ID NO: 40947 - DNA, 21 bp, Artificial Sequence
  Description of Artificial Sequence: Synthetic oligonucleotide
aacggttgtggacagaatcaa

SEQ ID NO: 40948 - DNA, 21 bp, Artificial Sequence
  Description of Artificial Sequence: Synthetic oligonucleotide
agcaacatgaccagcaccaga

SEQ ID NO: 40949 - DNA, 21 bp, Artificial Sequence
  Description of Artificial Sequence: Synthetic oligonucleotide
ccccccaacctcaaactcagc

SEQ ID NO: 40950 - DNA, 21 bp, Artificial Sequence
  Description of Artificial Sequence: Synthetic oligonucleotide
gattctattggtagttctaag

SEQ ID NO: 40951 - DNA, 21 bp, Artificial Sequence
  Description of Artificial Sequence: Synthetic oligonucleotide
atgcttgggtctagtaataag

SEQ ID NO: 40952 - DNA, 21 bp, Artificial Sequence
  Description of Artificial Sequence: Synthetic oligonucleotide
gacaacatgagcacccccaaa

SEQ ID NO: 40953 - DNA, 21 bp, Artificial Sequence
  Description of Artificial Sequence: Synthetic oligonucleotide
ctcggcagcagcaccatcctc

SEQ ID NO: 40954 - DNA, 21 bp, Artificial Sequence
  Description of Artificial Sequence: Synthetic oligonucleotide
agcagcatgagccaccaaaaa

SEQ ID NO: 40955 - DNA, 21 bp, Artificial Sequence
  Description of Artificial Sequence: Synthetic oligonucleotide
aaacaacccgccagcacccac

SEQ ID NO: 40956 - DNA, 21 bp, Artificial Sequence
  Description of Artificial Sequence: Synthetic oligonucleotide
gccctcaccggcaaactcagc

SEQ ID NO: 40957 - DNA, 21 bp, Artificial Sequence
  Description of Artificial Sequence: Synthetic oligonucleotide
ggcagcggccacggcaccaac

SEQ ID NO: 40958 - DNA, 21 bp, Artificial Sequence
  Description of Artificial Sequence: Synthetic oligonucleotide
ccgacgggggtgaataagatg

SEQ ID NO: 40959 - DNA, 21 bp, Artificial Sequence
  Description of Artificial Sequence: Synthetic oligonucleotide
acgagtagtgggggtctgact

SEQ ID NO: 40960 - DNA, 21 bp, Artificial Sequence
  Description of Artificial Sequence: Synthetic oligonucleotide
aacagcagaagccaccacgaa

SEQ ID NO: 40961 - DNA, 21 bp, Artificial Sequence
  Description of Artificial Sequence: Synthetic oligonucleotide
atggggggtgttacgtcttct

SEQ ID NO: 40962 - DNA, 21 bp, Artificial Sequence
  Description of Artificial Sequence: Synthetic oligonucleotide
gggtatcgggggaatggtaat

SEQ ID NO: 40963 - DNA, 21 bp, Artificial Sequence
  Description of Artificial Sequence: Synthetic oligonucleotide
actggtactgggagttttcat

SEQ ID NO: 40964 - DNA, 21 bp, Artificial Sequence
  Description of Artificial Sequence: Synthetic oligonucleotide
acgggtttgagtcatatgggt

SEQ ID NO: 40965 - DNA, 21 bp, Artificial Sequence
  Description of Artificial Sequence: Synthetic oligonucleotide
cttaggtcgaaggagtctgcg

SEQ ID NO: 40966 - DNA, 21 bp, Artificial Sequence
  Description of Artificial Sequence: Synthetic oligonucleotide
ccgactcatgcttcgagtctt

SEQ ID NO: 40967 - DNA, 21 bp, Artificial Sequence
  Description of Artificial Sequence: Synthetic oligonucleotide
aagattgcttcgaagtcggag

SEQ ID NO: 40968 - DNA, 21 bp, Artificial Sequence
  Description of Artificial Sequence: Synthetic oligonucleotide
aacgtcagcaccggcgccacc

SEQ ID NO: 40969 - DNA, 21 bp, Artificial Sequence
  Description of Artificial Sequence: Synthetic oligonucleotide
aacaggtctggacagaatcaa

SEQ ID NO: 40970 - DNA, 21 bp, Artificial Sequence
  Description of Artificial Sequence: Synthetic oligonucleotide
agccccaccagccccatgaac

SEQ ID NO: 40971 - DNA, 21 bp, Artificial Sequence
  Description of Artificial Sequence: Synthetic oligonucleotide
tataatcagccggttggtaag

SEQ ID NO: 40972 - DNA, 21 bp, Artificial Sequence
  Description of Artificial Sequence: Synthetic oligonucleotide
gctacgatgcgttcgaatgag

SEQ ID NO: 40973 - DNA, 21 bp, Artificial Sequence
  Description of Artificial Sequence: Synthetic oligonucleotide
aaaaaccccagcagcgccccc

SEQ ID NO: 40974 - DNA, 21 bp, Artificial Sequence
  Description of Artificial Sequence: Synthetic oligonucleotide
aataatctggcggggagtaag

SEQ ID NO: 40975 - DNA, 21 bp, Artificial Sequence
  Description of Artificial Sequence: Synthetic oligonucleotide
tctgattctcggtcgggtatg

SEQ ID NO: 40976 - DNA, 21 bp, Artificial Sequence
  Description of Artificial Sequence: Synthetic oligonucleotide
cccagcaacaaaaccaacagc

SEQ ID NO: 40977 - DNA, 21 bp, Artificial Sequence
  Description of Artificial Sequence: Synthetic oligonucleotide
gcccaagccagaatgatgaac

SEQ ID NO: 40978 - DNA, 21 bp, Artificial Sequence
  Description of Artificial Sequence: Synthetic oligonucleotide
cagaagactaataagctttat

SEQ ID NO: 40979 - DNA, 21 bp, Artificial Sequence
  Description of Artificial Sequence: Synthetic oligonucleotide
gtgactaggggtctgaatgtt

SEQ ID NO: 40980 - DNA, 21 bp, Artificial Sequence
  Description of Artificial Sequence: Synthetic oligonucleotide
ggcagactcaccagcagcatc

SEQ ID NO: 40981 - DNA, 21 bp, Artificial Sequence
  Description of Artificial Sequence: Synthetic oligonucleotide
tataatgtgaatcgtaatacg

SEQ ID NO: 40982 - DNA, 21 bp, Artificial Sequence
  Description of Artificial Sequence: Synthetic oligonucleotide
cctgcggctcataatgcggtt

SEQ ID NO: 40983 - DNA, 21 bp, Artificial Sequence
  Description of Artificial Sequence: Synthetic oligonucleotide
gtgtcgactaagagtgctcct

SEQ ID NO: 40984 - DNA, 21 bp, Artificial Sequence
  Description of Artificial Sequence: Synthetic oligonucleotide
acggctgggcaggcgtcggtt

SEQ ID NO: 40985 - DNA, 21 bp, Artificial Sequence
  Description of Artificial Sequence: Synthetic oligonucleotide
aatatttcgactaggcagagt

SEQ ID NO: 40986 - DNA, 21 bp, Artificial Sequence
  Description of Artificial Sequence: Synthetic oligonucleotide
agcagcagcggcggcgtcaaa

SEQ ID NO: 40987 - DNA, 21 bp, Artificial Sequence
  Description of Artificial Sequence: Synthetic oligonucleotide
aatagttatgatccgaagcgt

SEQ ID NO: 40988 - DNA, 21 bp, Artificial Sequence
  Description of Artificial Sequence: Synthetic oligonucleotide
ctggttcggcagtcttctgct

SEQ ID NO: 40989 - DNA, 21 bp, Artificial Sequence
  Description of Artificial Sequence: Synthetic oligonucleotide
aacgtcaacagccaaatgctc

SEQ ID NO: 40990 - DNA, 21 bp, Artificial Sequence
  Description of Artificial Sequence: Synthetic oligonucleotide
cctggtgataggggtaaggtt

SEQ ID NO: 40991 - DNA, 21 bp, Artificial Sequence
  Description of Artificial Sequence: Synthetic oligonucleotide
cccagcaccagcggcgccatg

SEQ ID NO: 40992 - DNA, 21 bp, Artificial Sequence
  Description of Artificial Sequence: Synthetic oligonucleotide
agcagactcgaaaaaagcaac

SEQ ID NO: 40993 - DNA, 21 bp, Artificial Sequence
  Description of Artificial Sequence: Synthetic oligonucleotide
gatacgaataatagggctaat

SEQ ID NO: 40994 - DNA, 21 bp, Artificial Sequence
  Description of Artificial Sequence: Synthetic oligonucleotide
gcttctactccgaataatact

SEQ ID NO: 40995 - DNA, 21 bp, Artificial Sequence
  Description of Artificial Sequence: Synthetic oligonucleotide
attgggactagtattaattct

SEQ ID NO: 40996 - DNA, 21 bp, Artificial Sequence
  Description of Artificial Sequence: Synthetic oligonucleotide
gtcagcaccagaagcatcagc

SEQ ID NO: 40997 - DNA, 21 bp, Artificial Sequence
  Description of Artificial Sequence: Synthetic oligonucleotide
ccgttgcctaagaatagtagt

SEQ ID NO: 40998 - DNA, 21 bp, Artificial Sequence
  Description of Artificial Sequence: Synthetic oligonucleotide
gtgagtggtcaggggaattct

SEQ ID NO: 40999 - DNA, 21 bp, Artificial Sequence
  Description of Artificial Sequence: Synthetic oligonucleotide
caagtcagcgccaaaagcgcc

SEQ ID NO: 41000 - DNA, 21 bp, Artificial Sequence
  Description of Artificial Sequence: Synthetic oligonucleotide
cctacgttgggtacgactaag

SEQ ID NO: 41001 - DNA, 21 bp, Artificial Sequence
  Description of Artificial Sequence: Synthetic oligonucleotide
ctccacgacggccaaaccaga

SEQ ID NO: 41002 - DNA, 21 bp, Artificial Sequence
  Description of Artificial Sequence: Synthetic oligonucleotide
ggtattgcgggggtgactcgt

SEQ ID NO: 41003 - DNA, 21 bp, Artificial Sequence
  Description of Artificial Sequence: Synthetic oligonucleotide
caaagaaccagcgaccaaacc

SEQ ID NO: 41004 - DNA, 21 bp, Artificial Sequence
  Description of Artificial Sequence: Synthetic oligonucleotide
agccaagtcagcaaaccccaa

SEQ ID NO: 41005 - DNA, 21 bp, Artificial Sequence
  Description of Artificial Sequence: Synthetic oligonucleotide
cccatcctcgacagaaaaagc

SEQ ID NO: 41006 - DNA, 21 bp, Artificial Sequence
  Description of Artificial Sequence: Synthetic oligonucleotide
caccccagcaacaaacccctc

SEQ ID NO: 41007 - DNA, 21 bp, Artificial Sequence
  Description of Artificial Sequence: Synthetic oligonucleotide
agcagcagcgccaaaagcatc

SEQ ID NO: 41008 - DNA, 21 bp, Artificial Sequence
  Description of Artificial Sequence: Synthetic oligonucleotide
actggtattgggtctcatctt

SEQ ID NO: 41009 - DNA, 21 bp, Artificial Sequence
  Description of Artificial Sequence: Synthetic oligonucleotide
gaccccgtcagaaaaaccagc

SEQ ID NO: 41010 - DNA, 21 bp, Artificial Sequence
  Description of Artificial Sequence: Synthetic oligonucleotide
gatcctcaggtgagggctctt

SEQ ID NO: 41011 - DNA, 21 bp, Artificial Sequence
  Description of Artificial Sequence: Synthetic oligonucleotide
agtgggtctctttcttctgct

SEQ ID NO: 41012 - DNA, 21 bp, Artificial Sequence
  Description of Artificial Sequence: Synthetic oligonucleotide
ggccacctcagccccagcagc

SEQ ID NO: 41013 - DNA, 21 bp, Artificial Sequence
  Description of Artificial Sequence: Synthetic oligonucleotide
agaaacgacaccaaactcttc

SEQ ID NO: 41014 - DNA, 21 bp, Artificial Sequence
  Description of Artificial Sequence: Synthetic oligonucleotide
taccaaaacaaaagcctcacc

SEQ ID NO: 41015 - DNA, 21 bp, Artificial Sequence
  Description of Artificial Sequence: Synthetic oligonucleotide
ggctacaccgacaaacacgtc

SEQ ID NO: 41016 - DNA, 21 bp, Artificial Sequence
  Description of Artificial Sequence: Synthetic oligonucleotide
cccggcggcaaaagccaactc

SEQ ID NO: 41017 - DNA, 21 bp, Artificial Sequence
  Description of Artificial Sequence: Synthetic oligonucleotide
agaagcgccagcggccaactc

SEQ ID NO: 41018 - DNA, 21 bp, Artificial Sequence
  Description of Artificial Sequence: Synthetic oligonucleotide
ggttctcataatgatagtagg

SEQ ID NO: 41019 - DNA, 21 bp, Artificial Sequence
  Description of Artificial Sequence: Synthetic oligonucleotide
aacggttctggacagaagcaa

SEQ ID NO: 41020 - DNA, 21 bp, Artificial Sequence
  Description of Artificial Sequence: Synthetic oligonucleotide
tatgctatggagagggttggg

SEQ ID NO: 41021 - DNA, 21 bp, Artificial Sequence
  Description of Artificial Sequence: Synthetic oligonucleotide
ggcctccacagcgtcgccaaa

SEQ ID NO: 41022 - DNA, 21 bp, Artificial Sequence
  Description of Artificial Sequence: Synthetic oligonucleotide
tctgttcatcagaatcgggcg

SEQ ID NO: 41023 - DNA, 21 bp, Artificial Sequence
  Description of Artificial Sequence: Synthetic oligonucleotide
cttgggcctgggaagaatact

SEQ ID NO: 41024 - DNA, 21 bp, Artificial Sequence
  Description of Artificial Sequence: Synthetic oligonucleotide
gaaagaaaagtccaaaactgc

SEQ ID NO: 41025 - DNA, 21 bp, Artificial Sequence
  Description of Artificial Sequence: Synthetic oligonucleotide
cccaccaaaggcgccaacgcc

SEQ ID NO: 41026 - DNA, 21 bp, Artificial Sequence
  Description of Artificial Sequence: Synthetic oligonucleotide
ggtaataggtcttctgggctt

SEQ ID NO: 41027 - DNA, 21 bp, Artificial Sequence
  Description of Artificial Sequence: Synthetic oligonucleotide
gtccaacaaagcaaagcctac

SEQ ID NO: 41028 - DNA, 21 bp, Artificial Sequence
  Description of Artificial Sequence: Synthetic oligonucleotide
gggcaggagcgtactaatatg

SEQ ID NO: 41029 - DNA, 21 bp, Artificial Sequence
  Description of Artificial Sequence: Synthetic oligonucleotide
gccaccgccaacacccacatg

SEQ ID NO: 41030 - DNA, 21 bp, Artificial Sequence
  Description of Artificial Sequence: Synthetic oligonucleotide
gttaatacgactcgtgctgag

SEQ ID NO: 41031 - DNA, 21 bp, Artificial Sequence
  Description of Artificial Sequence: Synthetic oligonucleotide
acccaacaacacggcagcaac

SEQ ID NO: 41032 - DNA, 21 bp, Artificial Sequence
  Description of Artificial Sequence: Synthetic oligonucleotide
ctcaacctcaaacccatcaac

SEQ ID NO: 41033 - DNA, 21 bp, Artificial Sequence
  Description of Artificial Sequence: Synthetic oligonucleotide
ggcgtcagcgccaccgtcaaa

SEQ ID NO: 41034 - DNA, 21 bp, Artificial Sequence
  Description of Artificial Sequence: Synthetic oligonucleotide
acccccacccccgtcaaccaa

SEQ ID NO: 41035 - DNA, 21 bp, Artificial Sequence
  Description of Artificial Sequence: Synthetic oligonucleotide
actactcataatatgcagggg

SEQ ID NO: 41036 - DNA, 21 bp, Artificial Sequence
  Description of Artificial Sequence: Synthetic oligonucleotide
aacgcccaacaagcccaaaga

SEQ ID NO: 41037 - DNA, 21 bp, Artificial Sequence
  Description of Artificial Sequence: Synthetic oligonucleotide
gttagtaagagtccgtctact

SEQ ID NO: 41038 - DNA, 21 bp, Artificial Sequence
  Description of Artificial Sequence: Synthetic oligonucleotide
gtgggtgatcgtagttggtcg

SEQ ID NO: 41039 - DNA, 21 bp, Artificial Sequence
  Description of Artificial Sequence: Synthetic oligonucleotide
catcgtgatcaggtttcgctt

SEQ ID NO: 41040 - DNA, 21 bp, Artificial Sequence
  Description of Artificial Sequence: Synthetic oligonucleotide
ccgaatggggcgcatgttacg

SEQ ID NO: 41041 - DNA, 21 bp, Artificial Sequence
  Description of Artificial Sequence: Synthetic oligonucleotide
actgtgcctggtcgttcgacg

SEQ ID NO: 41042 - DNA, 21 bp, Artificial Sequence
  Description of Artificial Sequence: Synthetic oligonucleotide
tatgttagtaattctaatgcg

SEQ ID NO: 41043 - DNA, 21 bp, Artificial Sequence
  Description of Artificial Sequence: Synthetic oligonucleotide
gctctttctagtcagaagggt

SEQ ID NO: 41044 - DNA, 21 bp, Artificial Sequence
  Description of Artificial Sequence: Synthetic oligonucleotide
aacggttctggacagaataaa

SEQ ID NO: 41045 - DNA, 21 bp, Artificial Sequence
  Description of Artificial Sequence: Synthetic oligonucleotide
ggtacggtgaatgcgaagggg

SEQ ID NO: 41046 - DNA, 21 bp, Artificial Sequence
  Description of Artificial Sequence: Synthetic oligonucleotide
agagacggcggccaagacaga

SEQ ID NO: 41047 - DNA, 21 bp, Artificial Sequence
  Description of Artificial Sequence: Synthetic oligonucleotide
cacagcagcagacccctcgaa

SEQ ID NO: 41048 - DNA, 21 bp, Artificial Sequence
  Description of Artificial Sequence: Synthetic oligonucleotide
agcagcagcgacaaactcaga

SEQ ID NO: 41049 - DNA, 21 bp, Artificial Sequence
  Description of Artificial Sequence: Synthetic oligonucleotide
gaccccctcagacaaagcgtc

SEQ ID NO: 41050 - DNA, 21 bp, Artificial Sequence
  Description of Artificial Sequence: Synthetic oligonucleotide
cccctccaagccaccggcaaa

SEQ ID NO: 41051 - DNA, 21 bp, Artificial Sequence
  Description of Artificial Sequence: Synthetic oligonucleotide
caggctaatactattggtaag

SEQ ID NO: 41052 - DNA, 21 bp, Artificial Sequence
  Description of Artificial Sequence: Synthetic oligonucleotide
agaaccaccagcagcctcgtc

SEQ ID NO: 41053 - DNA, 21 bp, Artificial Sequence
  Description of Artificial Sequence: Synthetic oligonucleotide
cggccttcgatgcctcatagt

SEQ ID NO: 41054 - DNA, 21 bp, Artificial Sequence
  Description of Artificial Sequence: Synthetic oligonucleotide
cttaataggggtaatggttcg

SEQ ID NO: 41055 - DNA, 21 bp, Artificial Sequence
  Description of Artificial Sequence: Synthetic oligonucleotide
aattctcataatggtgcttct

SEQ ID NO: 41056 - DNA, 21 bp, Artificial Sequence
  Description of Artificial Sequence: Synthetic oligonucleotide
ccgtatgctggtaatcagcgg

SEQ ID NO: 41057 - DNA, 21 bp, Artificial Sequence
  Description of Artificial Sequence: Synthetic oligonucleotide
agcgaaagcggccaacaaaga

SEQ ID NO: 41058 - DNA, 21 bp, Artificial Sequence
  Description of Artificial Sequence: Synthetic oligonucleotide
caaagcagcgaaaaaagacaa

SEQ ID NO: 41059 - DNA, 21 bp, Artificial Sequence
  Description of Artificial Sequence: Synthetic oligonucleotide
aggtcgactaatacggataat

SEQ ID NO: 41060 - DNA, 21 bp, Artificial Sequence
  Description of Artificial Sequence: Synthetic oligonucleotide
aacaacaaaagcgccagccaa

SEQ ID NO: 41061 - DNA, 21 bp, Artificial Sequence
  Description of Artificial Sequence: Synthetic oligonucleotide
agcatcagccacacccccgtc

SEQ ID NO: 41062 - DNA, 21 bp, Artificial Sequence
  Description of Artificial Sequence: Synthetic oligonucleotide
agcgtcagcaacaccaacacc

SEQ ID NO: 41063 - DNA, 21 bp, Artificial Sequence
  Description of Artificial Sequence: Synthetic oligonucleotide
tcgggtcagcagggtccgtgt

SEQ ID NO: 41064 - DNA, 21 bp, Artificial Sequence
  Description of Artificial Sequence: Synthetic oligonucleotide
gggattgctactactaatagg

SEQ ID NO: 41065 - DNA, 21 bp, Artificial Sequence
  Description of Artificial Sequence: Synthetic oligonucleotide
cccgccggcagaagcagcaac

SEQ ID NO: 41066 - DNA, 21 bp, Artificial Sequence
  Description of Artificial Sequence: Synthetic oligonucleotide
ccgaatcttaatagtcggggt

SEQ ID NO: 41067 - DNA, 21 bp, Artificial Sequence
  Description of Artificial Sequence: Synthetic oligonucleotide
cccatggcccaacaaagagcc

SEQ ID NO: 41068 - DNA, 21 bp, Artificial Sequence
  Description of Artificial Sequence: Synthetic oligonucleotide
aagagtgatgctcatacggct

SEQ ID NO: 41069 - DNA, 21 bp, Artificial Sequence
  Description of Artificial Sequence: Synthetic oligonucleotide
agcagcatcagcagaaccagc

SEQ ID NO: 41070 - DNA, 21 bp, Artificial Sequence
  Description of Artificial Sequence: Synthetic oligonucleotide
agtacgcttccgccgcggacc

SEQ ID NO: 41071 - DNA, 21 bp, Artificial Sequence
  Description of Artificial Sequence: Synthetic oligonucleotide
aataataggagtgggatgggt

SEQ ID NO: 41072 - DNA, 21 bp, Artificial Sequence
  Description of Artificial Sequence: Synthetic oligonucleotide
gtcagcaccggcaaaagcgtc

SEQ ID NO: 41073 - DNA, 21 bp, Artificial Sequence
  Description of Artificial Sequence: Synthetic oligonucleotide
aggcttcctagtgtgtctagt

SEQ ID NO: 41074 - DNA, 21 bp, Artificial Sequence
  Description of Artificial Sequence: Synthetic oligonucleotide
ggcagcaccaccagcggcaga

SEQ ID NO: 41075 - DNA, 21 bp, Artificial Sequence
  Description of Artificial Sequence: Synthetic oligonucleotide
actagtggtactaaggctcat

SEQ ID NO: 41076 - DNA, 21 bp, Artificial Sequence
  Description of Artificial Sequence: Synthetic oligonucleotide
gacccccacaacaccagcaga

SEQ ID NO: 41077 - DNA, 21 bp, Artificial Sequence
  Description of Artificial Sequence: Synthetic oligonucleotide
tttgtgaatactagtgcgcag

SEQ ID NO: 41078 - DNA, 21 bp, Artificial Sequence
  Description of Artificial Sequence: Synthetic oligonucleotide
agcttcagcggcgccaacaaa

SEQ ID NO: 41079 - DNA, 21 bp, Artificial Sequence
  Description of Artificial Sequence: Synthetic oligonucleotide
cagggttcttcgcctatggag

SEQ ID NO: 41080 - DNA, 21 bp, Artificial Sequence
  Description of Artificial Sequence: Synthetic oligonucleotide
actcctatgactaagaatcct

SEQ ID NO: 41081 - DNA, 21 bp, Artificial Sequence
  Description of Artificial Sequence: Synthetic oligonucleotide
agcagcgacctcggcaaaaga

SEQ ID NO: 41082 - DNA, 21 bp, Artificial Sequence
  Description of Artificial Sequence: Synthetic oligonucleotide
atggctacgtctactcgtaat

SEQ ID NO: 41083 - DNA, 21 bp, Artificial Sequence
  Description of Artificial Sequence: Synthetic oligonucleotide
ctcggcaccagcaccatgaaa

SEQ ID NO: 41084 - DNA, 21 bp, Artificial Sequence
  Description of Artificial Sequence: Synthetic oligonucleotide
tacaccatcaccccccaaaaa

SEQ ID NO: 41085 - DNA, 21 bp, Artificial Sequence
  Description of Artificial Sequence: Synthetic oligonucleotide
atcggcggcaacaaacccctc

SEQ ID NO: 41086 - DNA, 21 bp, Artificial Sequence
  Description of Artificial Sequence: Synthetic oligonucleotide
cacagcagcagcaaaatccac

SEQ ID NO: 41087 - DNA, 21 bp, Artificial Sequence
  Description of Artificial Sequence: Synthetic oligonucleotide
tcgaatactaatagtgcgaat

SEQ ID NO: 41088 - DNA, 21 bp, Artificial Sequence
  Description of Artificial Sequence: Synthetic oligonucleotide
caaagcagcaacgccagaaac

SEQ ID NO: 41089 - DNA, 21 bp, Artificial Sequence
  Description of Artificial Sequence: Synthetic oligonucleotide
gaactcatgaacaaaagcaaa

SEQ ID NO: 41090 - DNA, 21 bp, Artificial Sequence
  Description of Artificial Sequence: Synthetic oligonucleotide
cgttcgactaagactgagaat

SEQ ID NO: 41091 - DNA, 21 bp, Artificial Sequence
  Description of Artificial Sequence: Synthetic oligonucleotide
cccatgagccacgtcagcggc

SEQ ID NO: 41092 - DNA, 21 bp, Artificial Sequence
  Description of Artificial Sequence: Synthetic oligonucleotide
ccgagtagtccgaattctatt

SEQ ID NO: 41093 - DNA, 21 bp, Artificial Sequence
  Description of Artificial Sequence: Synthetic oligonucleotide
gaaacccccaacagaagccaa

SEQ ID NO: 41094 - DNA, 21 bp, Artificial Sequence
  Description of Artificial Sequence: Synthetic oligonucleotide
ggtgctgagcggacggttctt

SEQ ID NO: 41095 - DNA, 21 bp, Artificial Sequence
  Description of Artificial Sequence: Synthetic oligonucleotide
ctcgtcagcagcaaaagcagc

SEQ ID NO: 41096 - DNA, 21 bp, Artificial Sequence
  Description of Artificial Sequence: Synthetic oligonucleotide
attaatggtactcagacgctg

SEQ ID NO: 41097 - DNA, 21 bp, Artificial Sequence
  Description of Artificial Sequence: Synthetic oligonucleotide
cctggtcagagtacttctagt

SEQ ID NO: 41098 - DNA, 21 bp, Artificial Sequence
  Description of Artificial Sequence: Synthetic oligonucleotide
gctgtgtcgagtaaggtgggg

SEQ ID NO: 41099 - DNA, 21 bp, Artificial Sequence
  Description of Artificial Sequence: Synthetic oligonucleotide
ctgatttcgtctaagagtagt

SEQ ID NO: 41100 - DNA, 21 bp, Artificial Sequence
  Description of Artificial Sequence: Synthetic oligonucleotide
tttcatgcgaatagtactgtg

SEQ ID NO: 41101 - DNA, 21 bp, Artificial Sequence
  Description of Artificial Sequence: Synthetic oligonucleotide
ggtcagaatactcatcttact

SEQ ID NO: 41102 - DNA, 21 bp, Artificial Sequence
  Description of Artificial Sequence: Synthetic oligonucleotide
agaaacgtcagcggcatgaac

SEQ ID NO: 41103 - DNA, 21 bp, Artificial Sequence
  Description of Artificial Sequence: Synthetic oligonucleotide
agcagaccccacaccgacggc

SEQ ID NO: 41104 - DNA, 21 bp, Artificial Sequence
  Description of Artificial Sequence: Synthetic oligonucleotide
ctcaacaaaagcaccctcccc

SEQ ID NO: 41105 - DNA, 21 bp, Artificial Sequence
  Description of Artificial Sequence: Synthetic oligonucleotide
ggttatgaggctaataggggg

SEQ ID NO: 41106 - DNA, 21 bp, Artificial Sequence
  Description of Artificial Sequence: Synthetic oligonucleotide
cgtccgactcaggttggggct

SEQ ID NO: 41107 - DNA, 21 bp, Artificial Sequence
  Description of Artificial Sequence: Synthetic oligonucleotide
catacgtctccggggaagaat

SEQ ID NO: 41108 - DNA, 21 bp, Artificial Sequence
  Description of Artificial Sequence: Synthetic oligonucleotide
gttccttctcagagtcttcat

SEQ ID NO: 41109 - DNA, 21 bp, Artificial Sequence
  Description of Artificial Sequence: Synthetic oligonucleotide
tctcttagtaagcaggcggcg

SEQ ID NO: 41110 - DNA, 21 bp, Artificial Sequence
  Description of Artificial Sequence: Synthetic oligonucleotide
aatactgggattcctacgctg

SEQ ID NO: 41111 - DNA, 21 bp, Artificial Sequence
  Description of Artificial Sequence: Synthetic oligonucleotide
tctattccgacgtctgctagg

SEQ ID NO: 41112 - DNA, 21 bp, Artificial Sequence
  Description of Artificial Sequence: Synthetic oligonucleotide
gagaggtttactagttcttcg

SEQ ID NO: 41113 - DNA, 21 bp, Artificial Sequence
  Description of Artificial Sequence: Synthetic oligonucleotide
cagcaggtgaatactactcgg

SEQ ID NO: 41114 - DNA, 21 bp, Artificial Sequence
  Description of Artificial Sequence: Synthetic oligonucleotide
tacaccagcaaaagcaccgcc

SEQ ID NO: 41115 - DNA, 21 bp, Artificial Sequence
  Description of Artificial Sequence: Synthetic oligonucleotide
ggtcatgggaataatggggcg

SEQ ID NO: 41116 - DNA, 21 bp, Artificial Sequence
  Description of Artificial Sequence: Synthetic oligonucleotide
ggtcggagtccgacggcttct

SEQ ID NO: 41117 - DNA, 21 bp, Artificial Sequence
  Description of Artificial Sequence: Synthetic oligonucleotide
agcaccaccaacagcaaaaac

SEQ ID NO: 41118 - DNA, 21 bp, Artificial Sequence
  Description of Artificial Sequence: Synthetic oligonucleotide
cctggtcagtctacgtctaag

SEQ ID NO: 41119 - DNA, 21 bp, Artificial Sequence
  Description of Artificial Sequence: Synthetic oligonucleotide
attcctgggcatcctactgcg

SEQ ID NO: 41120 - DNA, 21 bp, Artificial Sequence
  Description of Artificial Sequence: Synthetic oligonucleotide
aacaccagcaacaacatccaa

SEQ ID NO: 41121 - DNA, 21 bp, Artificial Sequence
  Description of Artificial Sequence: Synthetic oligonucleotide
agcaccgacagaagcttcaac

SEQ ID NO: 41122 - DNA, 21 bp, Artificial Sequence
  Description of Artificial Sequence: Synthetic oligonucleotide
agcttcagcaaaggcagcagc

SEQ ID NO: 41123 - DNA, 21 bp, Artificial Sequence
  Description of Artificial Sequence: Synthetic oligonucleotide
aattcggctgctttgaatagt

SEQ ID NO: 41124 - DNA, 21 bp, Artificial Sequence
  Description of Artificial Sequence: Synthetic oligonucleotide
cccctccccaacagaaaccaa

SEQ ID NO: 41125 - DNA, 21 bp, Artificial Sequence
  Description of Artificial Sequence: Synthetic oligonucleotide
gaacacatgacccccagaagc

SEQ ID NO: 41126 - DNA, 21 bp, Artificial Sequence
  Description of Artificial Sequence: Synthetic oligonucleotide
actactcataatattaagggg

SEQ ID NO: 41127 - DNA, 21 bp, Artificial Sequence
  Description of Artificial Sequence: Synthetic oligonucleotide
gctgtgtctaagggtggtcct

SEQ ID NO: 41128 - DNA, 21 bp, Artificial Sequence
  Description of Artificial Sequence: Synthetic oligonucleotide
agccccgccagcctccccaaa

SEQ ID NO: 41129 - DNA, 21 bp, Artificial Sequence
  Description of Artificial Sequence: Synthetic oligonucleotide
ctcatcagaggcggcaacaac

SEQ ID NO: 41130 - DNA, 21 bp, Artificial Sequence
  Description of Artificial Sequence: Synthetic oligonucleotide
agcagccaacaaaaagccagc

SEQ ID NO: 41131 - DNA, 21 bp, Artificial Sequence
  Description of Artificial Sequence: Synthetic oligonucleotide
ccctacaacagcaaagccagc

SEQ ID NO: 41132 - DNA, 21 bp, Artificial Sequence
  Description of Artificial Sequence: Synthetic oligonucleotide
atgaatcgtaatggttcgctg

SEQ ID NO: 41133 - DNA, 21 bp, Artificial Sequence
  Description of Artificial Sequence: Synthetic oligonucleotide
actcgtaatcagtcggtgacg

SEQ ID NO: 41134 - DNA, 21 bp, Artificial Sequence
  Description of Artificial Sequence: Synthetic oligonucleotide
ctcggcggcggcaccctcaga

SEQ ID NO: 41135 - DNA, 21 bp, Artificial Sequence
  Description of Artificial Sequence: Synthetic oligonucleotide
aggacgggtgagtcttatatg

SEQ ID NO: 41136 - DNA, 21 bp, Artificial Sequence
  Description of Artificial Sequence: Synthetic oligonucleotide
gcggattctaatcgtccgggg

SEQ ID NO: 41137 - DNA, 21 bp, Artificial Sequence
  Description of Artificial Sequence: Synthetic oligonucleotide
gttatgggggcgggtgctagt

SEQ ID NO: 41138 - DNA, 21 bp, Artificial Sequence
  Description of Artificial Sequence: Synthetic oligonucleotide
aacggttctggacagactcaa

SEQ ID NO: 41139 - DNA, 21 bp, Artificial Sequence
  Description of Artificial Sequence: Synthetic oligonucleotide
tcgacgctgcctgggaattct

SEQ ID NO: 41140 - DNA, 21 bp, Artificial Sequence
  Description of Artificial Sequence: Synthetic oligonucleotide
tatgggaatcctaggcaggct

SEQ ID NO: 41141 - DNA, 21 bp, Artificial Sequence
  Description of Artificial Sequence: Synthetic oligonucleotide
cgttcgcagggttcgtatgcg

SEQ ID NO: 41142 - DNA, 21 bp, Artificial Sequence
  Description of Artificial Sequence: Synthetic oligonucleotide
agtcttcctaatactaatggg

SEQ ID NO: 41143 - DNA, 21 bp, Artificial Sequence
  Description of Artificial Sequence: Synthetic oligonucleotide
agaagcggcggcagcctcagc

SEQ ID NO: 41144 - DNA, 21 bp, Artificial Sequence
  Description of Artificial Sequence: Synthetic oligonucleotide
agccccgtcaaaggcagcgtc

SEQ ID NO: 41145 - DNA, 21 bp, Artificial Sequence
  Description of Artificial Sequence: Synthetic oligonucleotide
agcgtcagcaccaaaagcgcc

SEQ ID NO: 41146 - DNA, 21 bp, Artificial Sequence
  Description of Artificial Sequence: Synthetic oligonucleotide
gatcctcgtaattctacgtct

SEQ ID NO: 41147 - DNA, 21 bp, Artificial Sequence
  Description of Artificial Sequence: Synthetic oligonucleotide
tggagcgccagcagaagcgcc

SEQ ID NO: 41148 - DNA, 21 bp, Artificial Sequence
  Description of Artificial Sequence: Synthetic oligonucleotide
tacagcggcggcacccaacaa

SEQ ID NO: 41149 - DNA, 21 bp, Artificial Sequence
  Description of Artificial Sequence: Synthetic oligonucleotide
cccagccacaaccccaccaac

SEQ ID NO: 41150 - DNA, 21 bp, Artificial Sequence
  Description of Artificial Sequence: Synthetic oligonucleotide
gggtctgggattaagcgtgag

SEQ ID NO: 41151 - DNA, 21 bp, Artificial Sequence
  Description of Artificial Sequence: Synthetic oligonucleotide
aacggcatcagcaaaagcaac

SEQ ID NO: 41152 - DNA, 21 bp, Artificial Sequence
  Description of Artificial Sequence: Synthetic oligonucleotide
atgacccaacacaaacaagcc

SEQ ID NO: 41153 - DNA, 21 bp, Artificial Sequence
  Description of Artificial Sequence: Synthetic oligonucleotide
cagagtcatggtattacgaat

SEQ ID NO: 41154 - DNA, 21 bp, Artificial Sequence
  Description of Artificial Sequence: Synthetic oligonucleotide
agcagcgccggcacctacacc

SEQ ID NO: 41155 - DNA, 21 bp, Artificial Sequence
  Description of Artificial Sequence: Synthetic oligonucleotide
ggcagcagccccagcctcaga

SEQ ID NO: 41156 - DNA, 21 bp, Artificial Sequence
  Description of Artificial Sequence: Synthetic oligonucleotide
ggcatcaccaaaaacctcgcc

SEQ ID NO: 41157 - DNA, 21 bp, Artificial Sequence
  Description of Artificial Sequence: Synthetic oligonucleotide
tcgggtgcggggtcggctggg

SEQ ID NO: 41158 - DNA, 21 bp, Artificial Sequence
  Description of Artificial Sequence: Synthetic oligonucleotide
gcccaaagcacctaccaaagc

SEQ ID NO: 41159 - DNA, 21 bp, Artificial Sequence
  Description of Artificial Sequence: Synthetic oligonucleotide
ggcagcaacagaaaccccctc

SEQ ID NO: 41160 - DNA, 21 bp, Artificial Sequence
  Description of Artificial Sequence: Synthetic oligonucleotide
tcgtctcgttctacggcttcg

SEQ ID NO: 41161 - DNA, 21 bp, Artificial Sequence
  Description of Artificial Sequence: Synthetic oligonucleotide
agccacgacaccagctacaga

SEQ ID NO: 41162 - DNA, 21 bp, Artificial Sequence
  Description of Artificial Sequence: Synthetic oligonucleotide
agcagcgccagcacctacaaa

SEQ ID NO: 41163 - DNA, 21 bp, Artificial Sequence
  Description of Artificial Sequence: Synthetic oligonucleotide
aatcctaatcagtctcttggg

SEQ ID NO: 41164 - DNA, 21 bp, Artificial Sequence
  Description of Artificial Sequence: Synthetic oligonucleotide
gtggggtcgcggaatgttggt

SEQ ID NO: 41165 - DNA, 21 bp, Artificial Sequence
  Description of Artificial Sequence: Synthetic oligonucleotide
catgcgtctactccggctcgt

SEQ ID NO: 41166 - DNA, 21 bp, Artificial Sequence
  Description of Artificial Sequence: Synthetic oligonucleotide
gccagcagcagcaaaagcgtc

SEQ ID NO: 41167 - DNA, 21 bp, Artificial Sequence
  Description of Artificial Sequence: Synthetic oligonucleotide
aatctttcgcatagtgcgggg

SEQ ID NO: 41168 - DNA, 21 bp, Artificial Sequence
  Description of Artificial Sequence: Synthetic oligonucleotide
tctattactgggaataggact

SEQ ID NO: 41169 - DNA, 21 bp, Artificial Sequence
  Description of Artificial Sequence: Synthetic oligonucleotide
tcgactaatcctgcgaatcgg

SEQ ID NO: 41170 - DNA, 21 bp, Artificial Sequence
  Description of Artificial Sequence: Synthetic oligonucleotide
attaggacgaaggagtctgcg

SEQ ID NO: 41171 - DNA, 21 bp, Artificial Sequence
  Description of Artificial Sequence: Synthetic oligonucleotide
ggtattaatccgacttctgtg

SEQ ID NO: 41172 - DNA, 21 bp, Artificial Sequence
  Description of Artificial Sequence: Synthetic oligonucleotide
gatcagcgtaataggagtatt

SEQ ID NO: 41173 - DNA, 21 bp, Artificial Sequence
  Description of Artificial Sequence: Synthetic oligonucleotide
acggggagggctccgtcttcg

SEQ ID NO: 41174 - DNA, 21 bp, Artificial Sequence
  Description of Artificial Sequence: Synthetic oligonucleotide
aacacccacaacatccaaggc

SEQ ID NO: 41175 - DNA, 21 bp, Artificial Sequence
  Description of Artificial Sequence: Synthetic oligonucleotide
aaccaaagcagcagcgccaga

SEQ ID NO: 41176 - DNA, 21 bp, Artificial Sequence
  Description of Artificial Sequence: Synthetic oligonucleotide
tttaattcgaatcgtgatagt

SEQ ID NO: 41177 - DNA, 21 bp, Artificial Sequence
  Description of Artificial Sequence: Synthetic oligonucleotide
aacgattctggacagaatcaa

SEQ ID NO: 41178 - DNA, 21 bp, Artificial Sequence
  Description of Artificial Sequence: Synthetic oligonucleotide
catggtactagtcctcttcgt

SEQ ID NO: 41179 - DNA, 21 bp, Artificial Sequence
  Description of Artificial Sequence: Synthetic oligonucleotide
attacgtctggtagtactcgt

SEQ ID NO: 41180 - DNA, 21 bp, Artificial Sequence
  Description of Artificial Sequence: Synthetic oligonucleotide
agaatgaacggcggcggcccc

SEQ ID NO: 41181 - DNA, 21 bp, Artificial Sequence
  Description of Artificial Sequence: Synthetic oligonucleotide
gtcggcaccaaccacaccagc

SEQ ID NO: 41182 - DNA, 21 bp, Artificial Sequence
  Description of Artificial Sequence: Synthetic oligonucleotide
tcgtatgctgataagcagggg

SEQ ID NO: 41183 - DNA, 21 bp, Artificial Sequence
  Description of Artificial Sequence: Synthetic oligonucleotide
cttagggctgagcatgttagg

SEQ ID NO: 41184 - DNA, 21 bp, Artificial Sequence
  Description of Artificial Sequence: Synthetic oligonucleotide
gtcaccaccagcagaggcgtc

SEQ ID NO: 41185 - DNA, 21 bp, Artificial Sequence
  Description of Artificial Sequence: Synthetic oligonucleotide
aacgccaaccccagcctcaga

SEQ ID NO: 41186 - DNA, 21 bp, Artificial Sequence
  Description of Artificial Sequence: Synthetic oligonucleotide
tcttctgctccgagtctttct

SEQ ID NO: 41187 - DNA, 21 bp, Artificial Sequence
  Description of Artificial Sequence: Synthetic oligonucleotide
aacagcggcagaaacagcgtc

SEQ ID NO: 41188 - DNA, 21 bp, Artificial Sequence
  Description of Artificial Sequence: Synthetic oligonucleotide
agttttactaagggggcgggg

SEQ ID NO: 41189 - DNA, 21 bp, Artificial Sequence
  Description of Artificial Sequence: Synthetic oligonucleotide
accacccaaagcagaagcctc

SEQ ID NO: 41190 - DNA, 21 bp, Artificial Sequence
  Description of Artificial Sequence: Synthetic oligonucleotide
tatcgggctacgtcgggtcag

SEQ ID NO: 41191 - DNA, 21 bp, Artificial Sequence
  Description of Artificial Sequence: Synthetic oligonucleotide
ggcaaacacggcaccaacagc

SEQ ID NO: 41192 - DNA, 21 bp, Artificial Sequence
  Description of Artificial Sequence: Synthetic oligonucleotide
accggcggcaacagagtcctc

SEQ ID NO: 41193 - DNA, 21 bp, Artificial Sequence
  Description of Artificial Sequence: Synthetic oligonucleotide
caaagaaccgtcggcaccgcc

SEQ ID NO: 41194 - DNA, 21 bp, Artificial Sequence
  Description of Artificial Sequence: Synthetic oligonucleotide
accagcggcagccaagtcaga

SEQ ID NO: 41195 - DNA, 21 bp, Artificial Sequence
  Description of Artificial Sequence: Synthetic oligonucleotide
ggggctggtaatcttactggt

SEQ ID NO: 41196 - DNA, 21 bp, Artificial Sequence
  Description of Artificial Sequence: Synthetic oligonucleotide
ggcggcagcaacctcagaacc

SEQ ID NO: 41197 - DNA, 21 bp, Artificial Sequence
  Description of Artificial Sequence: Synthetic oligonucleotide
gctaggtctcctccttcgggg

SEQ ID NO: 41198 - DNA, 21 bp, Artificial Sequence
  Description of Artificial Sequence: Synthetic oligonucleotide
tcgtcggttcagcatactggg

SEQ ID NO: 41199 - DNA, 21 bp, Artificial Sequence
  Description of Artificial Sequence: Synthetic oligonucleotide
gctacggtttctaagacggct

SEQ ID NO: 41200 - DNA, 21 bp, Artificial Sequence
  Description of Artificial Sequence: Synthetic oligonucleotide
aacggttctggacagcatcaa

SEQ ID NO: 41201 - DNA, 21 bp, Artificial Sequence
  Description of Artificial Sequence: Synthetic oligonucleotide
gcgggtcattctgggagggat

SEQ ID NO: 41202 - DNA, 21 bp, Artificial Sequence
  Description of Artificial Sequence: Synthetic oligonucleotide
gaaggcaccagaggcgtcggc

SEQ ID NO: 41203 - DNA, 21 bp, Artificial Sequence
  Description of Artificial Sequence: Synthetic oligonucleotide
gggaatacgcagactagtcgt

SEQ ID NO: 41204 - DNA, 21 bp, Artificial Sequence
  Description of Artificial Sequence: Synthetic oligonucleotide
atgaatactagtcgttcttcg

SEQ ID NO: 41205 - DNA, 21 bp, Artificial Sequence
  Description of Artificial Sequence: Synthetic oligonucleotide
ggtactaattctactaggggt

SEQ ID NO: 41206 - DNA, 21 bp, Artificial Sequence
  Description of Artificial Sequence: Synthetic oligonucleotide
cccagagtccaccccctcgtc

SEQ ID NO: 41207 - DNA, 21 bp, Artificial Sequence
  Description of Artificial Sequence: Synthetic oligonucleotide
atgtcgggtggtaatatgcgg

SEQ ID NO: 41208 - DNA, 21 bp, Artificial Sequence
  Description of Artificial Sequence: Synthetic oligonucleotide
gctacgaataatggttcgaag

SEQ ID NO: 41209 - DNA, 21 bp, Artificial Sequence
  Description of Artificial Sequence: Synthetic oligonucleotide
gctaattctcgggatgctaag

SEQ ID NO: 41210 - DNA, 21 bp, Artificial Sequence
  Description of Artificial Sequence: Synthetic oligonucleotide
ccggttgctagggctgcgcag

SEQ ID NO: 41211 - DNA, 21 bp, Artificial Sequence
  Description of Artificial Sequence: Synthetic oligonucleotide
cagtctggtaatacgattcag

SEQ ID NO: 41212 - DNA, 21 bp, Artificial Sequence
  Description of Artificial Sequence: Synthetic oligonucleotide
agagccagccaaagcgtcggc

SEQ ID NO: 41213 - DNA, 21 bp, Artificial Sequence
  Description of Artificial Sequence: Synthetic oligonucleotide
cccaccctcagcggcagcaga

SEQ ID NO: 41214 - DNA, 21 bp, Artificial Sequence
  Description of Artificial Sequence: Synthetic oligonucleotide
atgcgtcagacggcttctctt

SEQ ID NO: 41215 - DNA, 21 bp, Artificial Sequence
  Description of Artificial Sequence: Synthetic oligonucleotide
aggagtacggatactcatggg

SEQ ID NO: 41216 - DNA, 21 bp, Artificial Sequence
  Description of Artificial Sequence: Synthetic oligonucleotide
gagtttactaaggttggtgct

SEQ ID NO: 41217 - DNA, 21 bp, Artificial Sequence
  Description of Artificial Sequence: Synthetic oligonucleotide
ccgatgggtcattcgcttctg

SEQ ID NO: 41218 - DNA, 21 bp, Artificial Sequence
  Description of Artificial Sequence: Synthetic oligonucleotide
gccagaaacccccaagtcagc

SEQ ID NO: 41219 - DNA, 21 bp, Artificial Sequence
  Description of Artificial Sequence: Synthetic oligonucleotide
ggcaccggcacccccagaacc

SEQ ID NO: 41220 - DNA, 21 bp, Artificial Sequence
  Description of Artificial Sequence: Synthetic oligonucleotide
accgcccccagccacaccaac

SEQ ID NO: 41221 - DNA, 21 bp, Artificial Sequence
  Description of Artificial Sequence: Synthetic oligonucleotide
tctgctacgaatgggtctctg

SEQ ID NO: 41222 - DNA, 21 bp, Artificial Sequence
  Description of Artificial Sequence: Synthetic oligonucleotide
gcgacgcataattcgtctcag

SEQ ID NO: 41223 - DNA, 21 bp, Artificial Sequence
  Description of Artificial Sequence: Synthetic oligonucleotide
ctcctcaccagccccaacagc

SEQ ID NO: 41224 - DNA, 21 bp, Artificial Sequence
  Description of Artificial Sequence: Synthetic oligonucleotide
cagtcggggtcgaagcctggg

SEQ ID NO: 41225 - DNA, 21 bp, Artificial Sequence
  Description of Artificial Sequence: Synthetic oligonucleotide
tggagaagccaacacaacagc

SEQ ID NO: 41226 - DNA, 21 bp, Artificial Sequence
  Description of Artificial Sequence: Synthetic oligonucleotide
cagcctactcagaggatgggt

SEQ ID NO: 41227 - DNA, 21 bp, Artificial Sequence
  Description of Artificial Sequence: Synthetic oligonucleotide
ggcatgacccaaggcggcaaa

SEQ ID NO: 41228 - DNA, 21 bp, Artificial Sequence
  Description of Artificial Sequence: Synthetic oligonucleotide
gtcagcatgaacaccaccaga

SEQ ID NO: 41229 - DNA, 21 bp, Artificial Sequence
  Description of Artificial Sequence: Synthetic oligonucleotide
agccccggcaacaaactcctc

SEQ ID NO: 41230 - DNA, 21 bp, Artificial Sequence
  Description of Artificial Sequence: Synthetic oligonucleotide
gctacgcattcgaaggctagt

SEQ ID NO: 41231 - DNA, 21 bp, Artificial Sequence
  Description of Artificial Sequence: Synthetic oligonucleotide
aacagcagccacaacgtcagc

SEQ ID NO: 41232 - DNA, 21 bp, Artificial Sequence
  Description of Artificial Sequence: Synthetic oligonucleotide
gtcaacaccaacagagccgcc

SEQ ID NO: 41233 - DNA, 21 bp, Artificial Sequence
  Description of Artificial Sequence: Synthetic oligonucleotide
cgttcgaatcctactttggtg

SEQ ID NO: 41234 - DNA, 21 bp, Artificial Sequence
  Description of Artificial Sequence: Synthetic oligonucleotide
cttcctacgagtagtgttgcg

SEQ ID NO: 41235 - DNA, 21 bp, Artificial Sequence
  Description of Artificial Sequence: Synthetic oligonucleotide
agtggtacttctcggtttagt

SEQ ID NO: 41236 - DNA, 21 bp, Artificial Sequence
  Description of Artificial Sequence: Synthetic oligonucleotide
gctagtccgaatcggggtagt

SEQ ID NO: 41237 - DNA, 21 bp, Artificial Sequence
  Description of Artificial Sequence: Synthetic oligonucleotide
ttcgtcagcggcaaagtccaa

SEQ ID NO: 41238 - DNA, 21 bp, Artificial Sequence
  Description of Artificial Sequence: Synthetic oligonucleotide
tcttcgtctacgtcgcctagg

SEQ ID NO: 41239 - DNA, 21 bp, Artificial Sequence
  Description of Artificial Sequence: Synthetic oligonucleotide
caaggcctcagcaaaagcggc

SEQ ID NO: 41240 - DNA, 21 bp, Artificial Sequence
  Description of Artificial Sequence: Synthetic oligonucleotide
agcagcgaacaaaccaccaga

SEQ ID NO: 41241 - DNA, 21 bp, Artificial Sequence
  Description of Artificial Sequence: Synthetic oligonucleotide
attggtactacgccgcctaag

SEQ ID NO: 41242 - DNA, 21 bp, Artificial Sequence
  Description of Artificial Sequence: Synthetic oligonucleotide
cccctcagcaaagacagactc

SEQ ID NO: 41243 - DNA, 21 bp, Artificial Sequence
  Description of Artificial Sequence: Synthetic oligonucleotide
accccccaaaacgtcagaaac

SEQ ID NO: 41244 - DNA, 21 bp, Artificial Sequence
  Description of Artificial Sequence: Synthetic oligonucleotide
ccctacgcccccagaaaagac

SEQ ID NO: 41245 - DNA, 21 bp, Artificial Sequence
  Description of Artificial Sequence: Synthetic oligonucleotide
tcttcgacgtctcctgggagg

SEQ ID NO: 41246 - DNA, 21 bp, Artificial Sequence
  Description of Artificial Sequence: Synthetic oligonucleotide
gggtctctgactcctaaggct

SEQ ID NO: 41247 - DNA, 21 bp, Artificial Sequence
  Description of Artificial Sequence: Synthetic oligonucleotide
atggccaccagcaccgtcaaa

SEQ ID NO: 41248 - DNA, 21 bp, Artificial Sequence
  Description of Artificial Sequence: Synthetic oligonucleotide
agcgccgtcggcaaagccagc

SEQ ID NO: 41249 - DNA, 21 bp, Artificial Sequence
  Description of Artificial Sequence: Synthetic oligonucleotide
agacccgtcggcggcctcgcc

SEQ ID NO: 41250 - DNA, 21 bp, Artificial Sequence
  Description of Artificial Sequence: Synthetic oligonucleotide
agcaacacccacagccccagc

SEQ ID NO: 41251 - DNA, 21 bp, Artificial Sequence
  Description of Artificial Sequence: Synthetic oligonucleotide
ggcgaccacaacagaatgaac

SEQ ID NO: 41252 - DNA, 21 bp, Artificial Sequence
  Description of Artificial Sequence: Synthetic oligonucleotide
agcagccccgtcagcgccgtc

SEQ ID NO: 41253 - DNA, 21 bp, Artificial Sequence
  Description of Artificial Sequence: Synthetic oligonucleotide
caaaacctccccaaagccagc

SEQ ID NO: 41254 - DNA, 21 bp, Artificial Sequence
  Description of Artificial Sequence: Synthetic oligonucleotide
actaatgctgctcgggattcg

SEQ ID NO: 41255 - DNA, 21 bp, Artificial Sequence
  Description of Artificial Sequence: Synthetic oligonucleotide
gaaaccaacagcagactcggc

SEQ ID NO: 41256 - DNA, 21 bp, Artificial Sequence
  Description of Artificial Sequence: Synthetic oligonucleotide
accagagacagcagcctccac

SEQ ID NO: 41257 - DNA, 21 bp, Artificial Sequence
  Description of Artificial Sequence: Synthetic oligonucleotide
gtgacgcagtcttcgagtaag

SEQ ID NO: 41258 - DNA, 21 bp, Artificial Sequence
  Description of Artificial Sequence: Synthetic oligonucleotide
gctcagacgaagggtactcag

SEQ ID NO: 41259 - DNA, 21 bp, Artificial Sequence
  Description of Artificial Sequence: Synthetic oligonucleotide
ttgttgagttcgaagacggct

SEQ ID NO: 41260 - DNA, 21 bp, Artificial Sequence
  Description of Artificial Sequence: Synthetic oligonucleotide
tctcctcatactcatcagaag

SEQ ID NO: 41261 - DNA, 21 bp, Artificial Sequence
  Description of Artificial Sequence: Synthetic oligonucleotide
cccagcaacaccggcaccatc

SEQ ID NO: 41262 - DNA, 21 bp, Artificial Sequence
  Description of Artificial Sequence: Synthetic oligonucleotide
caaaaccaaaacagcggcaga

SEQ ID NO: 41263 - DNA, 21 bp, Artificial Sequence
  Description of Artificial Sequence: Synthetic oligonucleotide
ccgacgtctcagcagcgtccg

SEQ ID NO: 41264 - DNA, 21 bp, Artificial Sequence
  Description of Artificial Sequence: Synthetic oligonucleotide
cggggtgctacgagtacgtct

SEQ ID NO: 41265 - DNA, 21 bp, Artificial Sequence
  Description of Artificial Sequence: Synthetic oligonucleotide
agcagcgtcggcagactcaac

SEQ ID NO: 41266 - DNA, 21 bp, Artificial Sequence
  Description of Artificial Sequence: Synthetic oligonucleotide
cagcctaattcgggtacgacg

SEQ ID NO: 41267 - DNA, 21 bp, Artificial Sequence
  Description of Artificial Sequence: Synthetic oligonucleotide
gcttatcctaagaattcgaat

SEQ ID NO: 41268 - DNA, 21 bp, Artificial Sequence
  Description of Artificial Sequence: Synthetic oligonucleotide
tcgcttactagtacgggtaag

SEQ ID NO: 41269 - DNA, 21 bp, Artificial Sequence
  Description of Artificial Sequence: Synthetic oligonucleotide
accagcggcagcgccagaggc

SEQ ID NO: 41270 - DNA, 21 bp, Artificial Sequence
  Description of Artificial Sequence: Synthetic oligonucleotide
ctcaacagacccagcctcggc

SEQ ID NO: 41271 - DNA, 21 bp, Artificial Sequence
  Description of Artificial Sequence: Synthetic oligonucleotide
aactgttctggacagaatcaa

SEQ ID NO: 41272 - DNA, 21 bp, Artificial Sequence
  Description of Artificial Sequence: Synthetic oligonucleotide
atgctcccccaaaacggcaga

SEQ ID NO: 41273 - DNA, 21 bp, Artificial Sequence
  Description of Artificial Sequence: Synthetic oligonucleotide
ggttatgggtctaaggttagt

SEQ ID NO: 41274 - DNA, 21 bp, Artificial Sequence
  Description of Artificial Sequence: Synthetic oligonucleotide
agcctcagcagcaaacaaatg

SEQ ID NO: 41275 - DNA, 21 bp, Artificial Sequence
  Description of Artificial Sequence: Synthetic oligonucleotide
aacggcgccaccaaaaacagc

SEQ ID NO: 41276 - DNA, 21 bp, Artificial Sequence
  Description of Artificial Sequence: Synthetic oligonucleotide
gggcctcgttctatgtctaat

SEQ ID NO: 41277 - DNA, 21 bp, Artificial Sequence
  Description of Artificial Sequence: Synthetic oligonucleotide
accagcgccgccccccacgcc

SEQ ID NO: 41278 - DNA, 21 bp, Artificial Sequence
  Description of Artificial Sequence: Synthetic oligonucleotide
agaagcagccccgccagcctc

SEQ ID NO: 41279 - DNA, 21 bp, Artificial Sequence
  Description of Artificial Sequence: Synthetic oligonucleotide
gggcaggtgaaggctcttggg

SEQ ID NO: 41280 - DNA, 21 bp, Artificial Sequence
  Description of Artificial Sequence: Synthetic oligonucleotide
tctgataatactgctcggagt

SEQ ID NO: 41281 - DNA, 21 bp, Artificial Sequence
  Description of Artificial Sequence: Synthetic oligonucleotide
agaagcaacggcagcgccgcc

SEQ ID NO: 41282 - DNA, 21 bp, Artificial Sequence
  Description of Artificial Sequence: Synthetic oligonucleotide
tacctcaccagcaccagcaac

SEQ ID NO: 41283 - DNA, 21 bp, Artificial Sequence
  Description of Artificial Sequence: Synthetic oligonucleotide
agctacaaaaacaccggcgtc

SEQ ID NO: 41284 - DNA, 21 bp, Artificial Sequence
  Description of Artificial Sequence: Synthetic oligonucleotide
accagaagccaaggcatcctc

SEQ ID NO: 41285 - DNA, 21 bp, Artificial Sequence
  Description of Artificial Sequence: Synthetic oligonucleotide
agtcagtctcctaatcggggg

SEQ ID NO: 41286 - DNA, 21 bp, Artificial Sequence
  Description of Artificial Sequence: Synthetic oligonucleotide
ttcagcagaagccccgccgtc

SEQ ID NO: 41287 - DNA, 21 bp, Artificial Sequence
  Description of Artificial Sequence: Synthetic oligonucleotide
tacggcaaaagcgtcaccccc

SEQ ID NO: 41288 - DNA, 21 bp, Artificial Sequence
  Description of Artificial Sequence: Synthetic oligonucleotide
acgcagatgggtaagtcgaat

SEQ ID NO: 41289 - DNA, 21 bp, Artificial Sequence
  Description of Artificial Sequence: Synthetic oligonucleotide
ttggcgactgcgaatagtcgt

SEQ ID NO: 41290 - DNA, 21 bp, Artificial Sequence
  Description of Artificial Sequence: Synthetic oligonucleotide
gtccccagcagagccgccacc

SEQ ID NO: 41291 - DNA, 21 bp, Artificial Sequence
  Description of Artificial Sequence: Synthetic oligonucleotide
gatagtcatcctcgttctatt

SEQ ID NO: 41292 - DNA, 21 bp, Artificial Sequence
  Description of Artificial Sequence: Synthetic oligonucleotide
agcggcagcggccaaaaccaa

SEQ ID NO: 41293 - DNA, 21 bp, Artificial Sequence
  Description of Artificial Sequence: Synthetic oligonucleotide
atgagtcatactaagtcgaat

SEQ ID NO: 41294 - DNA, 21 bp, Artificial Sequence
  Description of Artificial Sequence: Synthetic oligonucleotide
gggcgtgagactgtttctcgg

SEQ ID NO: 41295 - DNA, 21 bp, Artificial Sequence
  Description of Artificial Sequence: Synthetic oligonucleotide
ggcgtcctcggcagccccaaa

SEQ ID NO: 41296 - DNA, 21 bp, Artificial Sequence
  Description of Artificial Sequence: Synthetic oligonucleotide
cccggcatgaaagtcagcccc

SEQ ID NO: 41297 - DNA, 21 bp, Artificial Sequence
  Description of Artificial Sequence: Synthetic oligonucleotide
caggataagggtaatgcgggt

SEQ ID NO: 41298 - DNA, 21 bp, Artificial Sequence
  Description of Artificial Sequence: Synthetic oligonucleotide
ggcggcagcagcagaaccctc

SEQ ID NO: 41299 - DNA, 21 bp, Artificial Sequence
  Description of Artificial Sequence: Synthetic oligonucleotide
cccagcaacagacaaatcgcc

SEQ ID NO: 41300 - DNA, 21 bp, Artificial Sequence
  Description of Artificial Sequence: Synthetic oligonucleotide
gggacgactaattcgcgtaat

SEQ ID NO: 41301 - DNA, 21 bp, Artificial Sequence
  Description of Artificial Sequence: Synthetic oligonucleotide
cctctgcgtggtgggtcgagt

SEQ ID NO: 41302 - DNA, 21 bp, Artificial Sequence
  Description of Artificial Sequence: Synthetic oligonucleotide
agccccaacagccaccccagc

SEQ ID NO: 41303 - DNA, 21 bp, Artificial Sequence
  Description of Artificial Sequence: Synthetic oligonucleotide
cccagcaaaggcacctacccc

SEQ ID NO: 41304 - DNA, 21 bp, Artificial Sequence
  Description of Artificial Sequence: Synthetic oligonucleotide
gggaatggtattagtgctagg

SEQ ID NO: 41305 - DNA, 21 bp, Artificial Sequence
  Description of Artificial Sequence: Synthetic oligonucleotide
agcagcggcaacagaaccacc

SEQ ID NO: 41306 - DNA, 21 bp, Artificial Sequence
  Description of Artificial Sequence: Synthetic oligonucleotide
ggcaccatcaacggcatcacc

SEQ ID NO: 41307 - DNA, 21 bp, Artificial Sequence
  Description of Artificial Sequence: Synthetic oligonucleotide
cacaccgtccccagaagcgtc

SEQ ID NO: 41308 - DNA, 21 bp, Artificial Sequence
  Description of Artificial Sequence: Synthetic oligonucleotide
caaagcaaagccggcaacagc

SEQ ID NO: 41309 - DNA, 21 bp, Artificial Sequence
  Description of Artificial Sequence: Synthetic oligonucleotide
ggcctccccctcagaagcgtc

SEQ ID NO: 41310 - DNA, 21 bp, Artificial Sequence
  Description of Artificial Sequence: Synthetic oligonucleotide
atgccgagtcagagggatggt

SEQ ID NO: 41311 - DNA, 21 bp, Artificial Sequence
  Description of Artificial Sequence: Synthetic oligonucleotide
gggcgtgcgaatggtcagacg

SEQ ID NO: 41312 - DNA, 21 bp, Artificial Sequence
  Description of Artificial Sequence: Synthetic oligonucleotide
tttcgggcgcaggctaatgtt

SEQ ID NO: 41313 - DNA, 21 bp, Artificial Sequence
  Description of Artificial Sequence: Synthetic oligonucleotide
accgccagccccaacaacaga

SEQ ID NO: 41314 - DNA, 21 bp, Artificial Sequence
  Description of Artificial Sequence: Synthetic oligonucleotide
tctagtactaataggcctacg

SEQ ID NO: 41315 - DNA, 21 bp, Artificial Sequence
  Description of Artificial Sequence: Synthetic oligonucleotide
ggtagtgttaatcggtcgtct

SEQ ID NO: 41316 - DNA, 21 bp, Artificial Sequence
  Description of Artificial Sequence: Synthetic oligonucleotide
accatgcccgcccaaagaagc

SEQ ID NO: 41317 - DNA, 21 bp, Artificial Sequence
  Description of Artificial Sequence: Synthetic oligonucleotide
ggggtgactgggtctcggggt

SEQ ID NO: 41318 - DNA, 21 bp, Artificial Sequence
  Description of Artificial Sequence: Synthetic oligonucleotide
agcaccaccctcagaaacagc

SEQ ID NO: 41319 - DNA, 21 bp, Artificial Sequence
  Description of Artificial Sequence: Synthetic oligonucleotide
cccagaaccaacaaccccagc

SEQ ID NO: 41320 - DNA, 21 bp, Artificial Sequence
  Description of Artificial Sequence: Synthetic oligonucleotide
gagggttctgggaggcttact

SEQ ID NO: 41321 - DNA, 21 bp, Artificial Sequence
  Description of Artificial Sequence: Synthetic oligonucleotide
atgagaagcaaccccaccagc

SEQ ID NO: 41322 - DNA, 21 bp, Artificial Sequence
  Description of Artificial Sequence: Synthetic oligonucleotide
ttcctcggcaaaagcggcgcc

SEQ ID NO: 41323 - DNA, 21 bp, Artificial Sequence
  Description of Artificial Sequence: Synthetic oligonucleotide
gtcccccacaaccacagcctc

SEQ ID NO: 41324 - DNA, 21 bp, Artificial Sequence
  Description of Artificial Sequence: Synthetic oligonucleotide
caagtcagccccgccagcaga

SEQ ID NO: 41325 - DNA, 21 bp, Artificial Sequence
  Description of Artificial Sequence: Synthetic oligonucleotide
agtccgaatgcgaatcgtgtt

SEQ ID NO: 41326 - DNA, 21 bp, Artificial Sequence
  Description of Artificial Sequence: Synthetic oligonucleotide
agttcgccgtcgaggtctagt

SEQ ID NO: 41327 - DNA, 21 bp, Artificial Sequence
  Description of Artificial Sequence: Synthetic oligonucleotide
gagccgacgcatccgcggggt

SEQ ID NO: 41328 - DNA, 21 bp, Artificial Sequence
  Description of Artificial Sequence: Synthetic oligonucleotide
atgcaggcgaagtcggggcat

SEQ ID NO: 41329 - DNA, 21 bp, Artificial Sequence
  Description of Artificial Sequence: Synthetic oligonucleotide
aatgcggctcgtaataatgcg

SEQ ID NO: 41330 - DNA, 21 bp, Artificial Sequence
  Description of Artificial Sequence: Synthetic oligonucleotide
agcgccaacagacccagcgcc

SEQ ID NO: 41331 - DNA, 21 bp, Artificial Sequence
  Description of Artificial Sequence: Synthetic oligonucleotide
cggtctccgactagtcagtct

SEQ ID NO: 41332 - DNA, 21 bp, Artificial Sequence
  Description of Artificial Sequence: Synthetic oligonucleotide
gccctccccgccaaaagcgcc

SEQ ID NO: 41333 - DNA, 21 bp, Artificial Sequence
  Description of Artificial Sequence: Synthetic oligonucleotide
cccgtcatgaccagaaccccc

SEQ ID NO: 41334 - DNA, 21 bp, Artificial Sequence
  Description of Artificial Sequence: Synthetic oligonucleotide
ggcaaccccagccccctcgtc

SEQ ID NO: 41335 - DNA, 21 bp, Artificial Sequence
  Description of Artificial Sequence: Synthetic oligonucleotide
gccaacggcaccaaaagcagc

SEQ ID NO: 41336 - DNA, 21 bp, Artificial Sequence
  Description of Artificial Sequence: Synthetic oligonucleotide
cctagggatttgcgtgcgtcg

SEQ ID NO: 41337 - DNA, 21 bp, Artificial Sequence
  Description of Artificial Sequence: Synthetic oligonucleotide
cagcctggtgtgtcgggtcgt

SEQ ID NO: 41338 - DNA, 21 bp, Artificial Sequence
  Description of Artificial Sequence: Synthetic oligonucleotide
cccctcaccaccagacccagc

SEQ ID NO: 41339 - DNA, 21 bp, Artificial Sequence
  Description of Artificial Sequence: Synthetic oligonucleotide
ccccacagcaccggcagcatc

SEQ ID NO: 41340 - DNA, 21 bp, Artificial Sequence
  Description of Artificial Sequence: Synthetic oligonucleotide
ggcggccaaaacagcagcaaa

SEQ ID NO: 41341 - DNA, 21 bp, Artificial Sequence
  Description of Artificial Sequence: Synthetic oligonucleotide
gagccgtcgcgtagttcgacg

SEQ ID NO: 41342 - DNA, 21 bp, Artificial Sequence
  Description of Artificial Sequence: Synthetic oligonucleotide
gcttatcctagtggttcgtcg

SEQ ID NO: 41343 - DNA, 21 bp, Artificial Sequence
  Description of Artificial Sequence: Synthetic oligonucleotide
cagctgggttctacgactagg

SEQ ID NO: 41344 - DNA, 21 bp, Artificial Sequence
  Description of Artificial Sequence: Synthetic oligonucleotide
gctcgttctgagtctacggct

SEQ ID NO: 41345 - DNA, 21 bp, Artificial Sequence
  Description of Artificial Sequence: Synthetic oligonucleotide
gctccttcggcgcggccgagt

SEQ ID NO: 41346 - DNA, 21 bp, Artificial Sequence
  Description of Artificial Sequence: Synthetic oligonucleotide
acgtcgaatactaagtctgtt

SEQ ID NO: 41347 - DNA, 21 bp, Artificial Sequence
  Description of Artificial Sequence: Synthetic oligonucleotide
cctgggattgctacgggtcgg

SEQ ID NO: 41348 - DNA, 21 bp, Artificial Sequence
  Description of Artificial Sequence: Synthetic oligonucleotide
accagcacccaaaaaggccaa

SEQ ID NO: 41349 - DNA, 21 bp, Artificial Sequence
  Description of Artificial Sequence: Synthetic oligonucleotide
gataggatgggtactgcgcat

SEQ ID NO: 41350 - DNA, 21 bp, Artificial Sequence
  Description of Artificial Sequence: Synthetic oligonucleotide
agccacacccccaaactcgtc

SEQ ID NO: 41351 - DNA, 21 bp, Artificial Sequence
  Description of Artificial Sequence: Synthetic oligonucleotide
aggggtaatgggacgcatggt

SEQ ID NO: 41352 - DNA, 21 bp, Artificial Sequence
  Description of Artificial Sequence: Synthetic oligonucleotide
ccttctcatggtcagaatagg

SEQ ID NO: 41353 - DNA, 21 bp, Artificial Sequence
  Description of Artificial Sequence: Synthetic oligonucleotide
agcagccccaccagaggcctc

SEQ ID NO: 41354 - DNA, 21 bp, Artificial Sequence
  Description of Artificial Sequence: Synthetic oligonucleotide
actcgttttacgtcttcggct

SEQ ID NO: 41355 - DNA, 21 bp, Artificial Sequence
  Description of Artificial Sequence: Synthetic oligonucleotide
agccccttccaaagcagccac

SEQ ID NO: 41356 - DNA, 21 bp, Artificial Sequence
  Description of Artificial Sequence: Synthetic oligonucleotide
gggcatagtactgtgggtagt

SEQ ID NO: 41357 - DNA, 21 bp, Artificial Sequence
  Description of Artificial Sequence: Synthetic oligonucleotide
agcatgaacagcaaacccacc

SEQ ID NO: 41358 - DNA, 21 bp, Artificial Sequence
  Description of Artificial Sequence: Synthetic oligonucleotide
cctcatatttcgcctaagggg

SEQ ID NO: 41359 - DNA, 21 bp, Artificial Sequence
  Description of Artificial Sequence: Synthetic oligonucleotide
gcgggttctagtaggaatctt

SEQ ID NO: 41360 - DNA, 21 bp, Artificial Sequence
  Description of Artificial Sequence: Synthetic oligonucleotide
aatcgtcagagtagtccgacg

SEQ ID NO: 41361 - DNA, 21 bp, Artificial Sequence
  Description of Artificial Sequence: Synthetic oligonucleotide
atgagacccaacagcggcatg

SEQ ID NO: 41362 - DNA, 21 bp, Artificial Sequence
  Description of Artificial Sequence: Synthetic oligonucleotide
gggggtcaggcgtctggtcgg

SEQ ID NO: 41363 - DNA, 21 bp, Artificial Sequence
  Description of Artificial Sequence: Synthetic oligonucleotide
atgtctacggctcgttctgct

SEQ ID NO: 41364 - DNA, 21 bp, Artificial Sequence
  Description of Artificial Sequence: Synthetic oligonucleotide
aacctcggcaccaacgtcctc

SEQ ID NO: 41365 - DNA, 21 bp, Artificial Sequence
  Description of Artificial Sequence: Synthetic oligonucleotide
ggcacccccaacaacagaagc

SEQ ID NO: 41366 - DNA, 21 bp, Artificial Sequence
  Description of Artificial Sequence: Synthetic oligonucleotide
cccgtcggcagcagaggcggc

SEQ ID NO: 41367 - DNA, 21 bp, Artificial Sequence
  Description of Artificial Sequence: Synthetic oligonucleotide
caagtcggcagacccaacgcc

SEQ ID NO: 41368 - DNA, 21 bp, Artificial Sequence
  Description of Artificial Sequence: Synthetic oligonucleotide
agcgtcaacaccaaagccctc

SEQ ID NO: 41369 - DNA, 21 bp, Artificial Sequence
  Description of Artificial Sequence: Synthetic oligonucleotide
tcgccgatgcgttcgcaggtt

SEQ ID NO: 41370 - DNA, 21 bp, Artificial Sequence
  Description of Artificial Sequence: Synthetic oligonucleotide
tcgagtccgtctaagatggcg

SEQ ID NO: 41371 - DNA, 21 bp, Artificial Sequence
  Description of Artificial Sequence: Synthetic oligonucleotide
agccaacccatcggcgccaga

SEQ ID NO: 41372 - DNA, 21 bp, Artificial Sequence
  Description of Artificial Sequence: Synthetic oligonucleotide
agccacgtcaacagcaccaga

SEQ ID NO: 41373 - DNA, 21 bp, Artificial Sequence
  Description of Artificial Sequence: Synthetic oligonucleotide
acgacgactactcgtccgagt

SEQ ID NO: 41374 - DNA, 21 bp, Artificial Sequence
  Description of Artificial Sequence: Synthetic oligonucleotide
gacggttctggacagaatcaa

SEQ ID NO: 41375 - DNA, 21 bp, Artificial Sequence
  Description of Artificial Sequence: Synthetic oligonucleotide
aacggttctggagagaatcaa

SEQ ID NO: 41376 - DNA, 21 bp, Artificial Sequence
  Description of Artificial Sequence: Synthetic oligonucleotide
catgctgagactaatcttcgt

SEQ ID NO: 41377 - DNA, 21 bp, Artificial Sequence
  Description of Artificial Sequence: Synthetic oligonucleotide
aacggttctggacaggatcaa

SEQ ID NO: 41378 - DNA, 21 bp, Artificial Sequence
  Description of Artificial Sequence: Synthetic oligonucleotide
aacggccccggccaaaaccaa

SEQ ID NO: 41379 - DNA, 21 bp, Artificial Sequence
  Description of Artificial Sequence: Synthetic oligonucleotide
cagggtacgactgctaggtcg

SEQ ID NO: 41380 - DNA, 21 bp, Artificial Sequence
  Description of Artificial Sequence: Synthetic oligonucleotide
caacccaacagcgccagccac

SEQ ID NO: 41381 - DNA, 21 bp, Artificial Sequence
  Description of Artificial Sequence: Synthetic oligonucleotide
aacggttctgaacagaatcaa

SEQ ID NO: 41382 - DNA, 21 bp, Artificial Sequence
  Description of Artificial Sequence: Synthetic oligonucleotide
cacggttctggacagaatcaa

SEQ ID NO: 41383 - DNA, 21 bp, Artificial Sequence
  Description of Artificial Sequence: Synthetic oligonucleotide
gtgggtccgtcgaagattcag

SEQ ID NO: 41384 - DNA, 21 bp, Artificial Sequence
  Description of Artificial Sequence: Synthetic oligonucleotide
atgaaaggcaacaacctcagc

SEQ ID NO: 41385 - DNA, 21 bp, Artificial Sequence
  Description of Artificial Sequence: Synthetic oligonucleotide
aacggttctggacagaatcca

SEQ ID NO: 41386 - DNA, 21 bp, Artificial Sequence
  Description of Artificial Sequence: Synthetic oligonucleotide
cacaacaccgcccacgccagc

SEQ ID NO: 41387 - DNA, 21 bp, Artificial Sequence
  Description of Artificial Sequence: Synthetic oligonucleotide
agcaaaaccggcaccagcctc

SEQ ID NO: 41388 - DNA, 21 bp, Artificial Sequence
  Description of Artificial Sequence: Synthetic oligonucleotide
cgtccgaatagtcttattgat

SEQ ID NO: 41389 - DNA, 21 bp, Artificial Sequence
  Description of Artificial Sequence: Synthetic oligonucleotide
aacggttatggacagaatcaa

SEQ ID NO: 41390 - DNA, 21 bp, Artificial Sequence
  Description of Artificial Sequence: Synthetic oligonucleotide
gatgctggttctcgttcttct

SEQ ID NO: 41391 - DNA, 21 bp, Artificial Sequence
  Description of Artificial Sequence: Synthetic oligonucleotide
aacggtactggacagaatcaa

SEQ ID NO: 41392 - DNA, 21 bp, Artificial Sequence
  Description of Artificial Sequence: Synthetic oligonucleotide
gggacggatagtaagaggcat

SEQ ID NO: 41393 - DNA, 21 bp, Artificial Sequence
  Description of Artificial Sequence: Synthetic oligonucleotide
actggtcagcagacggctact

SEQ ID NO: 41394 - DNA, 21 bp, Artificial Sequence
  Description of Artificial Sequence: Synthetic oligonucleotide
aactacagcggcgcccacacc

SEQ ID NO: 41395 - DNA, 21 bp, Artificial Sequence
  Description of Artificial Sequence: Synthetic oligonucleotide
aacggttctagacagaatcaa

SEQ ID NO: 41396 - DNA, 21 bp, Artificial Sequence
  Description of Artificial Sequence: Synthetic oligonucleotide
cgttcttcggatcggagtgcg

SEQ ID NO: 41397 - DNA, 21 bp, Artificial Sequence
  Description of Artificial Sequence: Synthetic oligonucleotide
gtcggcagcggcagagccaac

SEQ ID NO: 41398 - DNA, 21 bp, Artificial Sequence
  Description of Artificial Sequence: Synthetic oligonucleotide
acttcgaatatggtgggtaag

SEQ ID NO: 41399 - DNA, 21 bp, Artificial Sequence
  Description of Artificial Sequence: Synthetic oligonucleotide
aacggtgctggacagaatcaa

SEQ ID NO: 41400 - DNA, 21 bp, Artificial Sequence
  Description of Artificial Sequence: Synthetic oligonucleotide
aacggttctggacagagtcaa

SEQ ID NO: 41401 - DNA, 21 bp, Artificial Sequence
  Description of Artificial Sequence: Synthetic oligonucleotide
ctcgccaccagcggcagcgcc

SEQ ID NO: 41402 - DNA, 21 bp, Artificial Sequence
  Description of Artificial Sequence: Synthetic oligonucleotide
gagcgtcatagtgggtcgaag

SEQ ID NO: 41403 - DNA, 21 bp, Artificial Sequence
  Description of Artificial Sequence: Synthetic oligonucleotide
agtgctcataataggtctgtt

SEQ ID NO: 41404 - DNA, 21 bp, Artificial Sequence
  Description of Artificial Sequence: Synthetic oligonucleotide
gggcgtctgaatactaatggt

SEQ ID NO: 41405 - DNA, 21 bp, Artificial Sequence
  Description of Artificial Sequence: Synthetic oligonucleotide
cctccttctaagccgaatact

SEQ ID NO: 41406 - DNA, 21 bp, Artificial Sequence
  Description of Artificial Sequence: Synthetic oligonucleotide
catcagagtagttcgagttcg

SEQ ID NO: 41407 - DNA, 21 bp, Artificial Sequence
  Description of Artificial Sequence: Synthetic oligonucleotide
cctgcgcgtgatagtaagtcg

SEQ ID NO: 41408 - DNA, 21 bp, Artificial Sequence
  Description of Artificial Sequence: Synthetic oligonucleotide
agcgtcagcggcagacacatc

SEQ ID NO: 41409 - DNA, 21 bp, Artificial Sequence
  Description of Artificial Sequence: Synthetic oligonucleotide
cttgcgccggggcatggtaat

SEQ ID NO: 41410 - DNA, 21 bp, Artificial Sequence
  Description of Artificial Sequence: Synthetic oligonucleotide
catggttctaagccgtatatt

SEQ ID NO: 41411 - DNA, 21 bp, Artificial Sequence
  Description of Artificial Sequence: Synthetic oligonucleotide
gaggtgcatgctaagaataat

SEQ ID NO: 41412 - DNA, 21 bp, Artificial Sequence
  Description of Artificial Sequence: Synthetic oligonucleotide
agtaggacgaatgctacggct

SEQ ID NO: 41413 - DNA, 21 bp, Artificial Sequence
  Description of Artificial Sequence: Synthetic oligonucleotide
gttcagccggtgaagatgagt

SEQ ID NO: 41414 - DNA, 21 bp, Artificial Sequence
  Description of Artificial Sequence: Synthetic oligonucleotide
tctactccgatgtcgaatcgt

SEQ ID NO: 41415 - DNA, 21 bp, Artificial Sequence
  Description of Artificial Sequence: Synthetic oligonucleotide
ggttcgccgggggttttgcgt

SEQ ID NO: 41416 - DNA, 21 bp, Artificial Sequence
  Description of Artificial Sequence: Synthetic oligonucleotide
accggcatcgaaagacccatg

SEQ ID NO: 41417 - DNA, 21 bp, Artificial Sequence
  Description of Artificial Sequence: Synthetic oligonucleotide
atcagcaaagccagcacccac

SEQ ID NO: 41418 - DNA, 21 bp, Artificial Sequence
  Description of Artificial Sequence: Synthetic oligonucleotide
aggacgagtactgcgcctcag

SEQ ID NO: 41419 - DNA, 21 bp, Artificial Sequence
  Description of Artificial Sequence: Synthetic oligonucleotide
agggaggatactaagatgcat

SEQ ID NO: 41420 - DNA, 21 bp, Artificial Sequence
  Description of Artificial Sequence: Synthetic oligonucleotide
cctgctcatcttaagcatagt

SEQ ID NO: 41421 - DNA, 21 bp, Artificial Sequence
  Description of Artificial Sequence: Synthetic oligonucleotide
cacaccgacaccagagccgtc

SEQ ID NO: 41422 - DNA, 21 bp, Artificial Sequence
  Description of Artificial Sequence: Synthetic oligonucleotide
aataatactcagaagaattct

SEQ ID NO: 41423 - DNA, 21 bp, Artificial Sequence
  Description of Artificial Sequence: Synthetic oligonucleotide
cccctcgaaagaaccaccaaa

SEQ ID NO: 41424 - DNA, 21 bp, Artificial Sequence
  Description of Artificial Sequence: Synthetic oligonucleotide
gggactgcgattcctcgttct

SEQ ID NO: 41425 - DNA, 21 bp, Artificial Sequence
  Description of Artificial Sequence: Synthetic oligonucleotide
aacagagtcgaaagagccgtc

SEQ ID NO: 41426 - DNA, 21 bp, Artificial Sequence
  Description of Artificial Sequence: Synthetic oligonucleotide
caccacagcaccctccaaacc

SEQ ID NO: 41427 - DNA, 21 bp, Artificial Sequence
  Description of Artificial Sequence: Synthetic oligonucleotide
gccggcgccggcatgtacgcc

SEQ ID NO: 41428 - DNA, 21 bp, Artificial Sequence
  Description of Artificial Sequence: Synthetic oligonucleotide
ggtacttttcagagtgggacg

SEQ ID NO: 41429 - DNA, 21 bp, Artificial Sequence
  Description of Artificial Sequence: Synthetic oligonucleotide
caaggccaaaacagaaccgtc

SEQ ID NO: 41430 - DNA, 21 bp, Artificial Sequence
  Description of Artificial Sequence: Synthetic oligonucleotide
atcaacctcagccacagcacc

SEQ ID NO: 41431 - DNA, 21 bp, Artificial Sequence
  Description of Artificial Sequence: Synthetic oligonucleotide
ggtcatgtttcggctatgcgt

SEQ ID NO: 41432 - DNA, 21 bp, Artificial Sequence
  Description of Artificial Sequence: Synthetic oligonucleotide
agcctcaccaccaaagccaac

SEQ ID NO: 41433 - DNA, 21 bp, Artificial Sequence
  Description of Artificial Sequence: Synthetic oligonucleotide
gttaatcttagtccgaatcat

SEQ ID NO: 41434 - DNA, 21 bp, Artificial Sequence
  Description of Artificial Sequence: Synthetic oligonucleotide
gctgtgactagtcatgctagg

SEQ ID NO: 41435 - DNA, 21 bp, Artificial Sequence
  Description of Artificial Sequence: Synthetic oligonucleotide
aatatgcctatgaggagtggg

SEQ ID NO: 41436 - DNA, 21 bp, Artificial Sequence
  Description of Artificial Sequence: Synthetic oligonucleotide
attaggactaatagtactctt

SEQ ID NO: 41437 - DNA, 21 bp, Artificial Sequence
  Description of Artificial Sequence: Synthetic oligonucleotide
ccgtctactgagaggaatcgt

SEQ ID NO: 41438 - DNA, 21 bp, Artificial Sequence
  Description of Artificial Sequence: Synthetic oligonucleotide
cgtccggtggttgctagtacg

SEQ ID NO: 41439 - DNA, 21 bp, Artificial Sequence
  Description of Artificial Sequence: Synthetic oligonucleotide
tatgggctgccgagtagtcgt

SEQ ID NO: 41440 - DNA, 21 bp, Artificial Sequence
  Description of Artificial Sequence: Synthetic oligonucleotide
ggcagcagccccaaactcacc

SEQ ID NO: 41441 - DNA, 21 bp, Artificial Sequence
  Description of Artificial Sequence: Synthetic oligonucleotide
agagacagcaccgccgccaga

SEQ ID NO: 41442 - DNA, 21 bp, Artificial Sequence
  Description of Artificial Sequence: Synthetic oligonucleotide
aattgtcgtccgaataccacg

SEQ ID NO: 41443 - DNA, 21 bp, Artificial Sequence
  Description of Artificial Sequence: Synthetic oligonucleotide
catcctgggaagcctgctggt

SEQ ID NO: 41444 - DNA, 21 bp, Artificial Sequence
  Description of Artificial Sequence: Synthetic oligonucleotide
gagtctcctaatcttcattcg

SEQ ID NO: 41445 - DNA, 21 bp, Artificial Sequence
  Description of Artificial Sequence: Synthetic oligonucleotide
agcatccccagcaccgtcaga

SEQ ID NO: 41446 - DNA, 21 bp, Artificial Sequence
  Description of Artificial Sequence: Synthetic oligonucleotide
gtcagagccgccagcaacccc

SEQ ID NO: 41447 - DNA, 21 bp, Artificial Sequence
  Description of Artificial Sequence: Synthetic oligonucleotide
atgggcagcagcgtcagaagc

SEQ ID NO: 41448 - DNA, 21 bp, Artificial Sequence
  Description of Artificial Sequence: Synthetic oligonucleotide
tcggtgcttaatcgtaatggg

SEQ ID NO: 41449 - DNA, 21 bp, Artificial Sequence
  Description of Artificial Sequence: Synthetic oligonucleotide
gatagtaggcctcgtctggcg

SEQ ID NO: 41450 - DNA, 21 bp, Artificial Sequence
  Description of Artificial Sequence: Synthetic oligonucleotide
ggtgctgggacgagtcttcat

SEQ ID NO: 41451 - DNA, 21 bp, Artificial Sequence
  Description of Artificial Sequence: Synthetic oligonucleotide
cagccttctcaggggcatagt

SEQ ID NO: 41452 - DNA, 21 bp, Artificial Sequence
  Description of Artificial Sequence: Synthetic oligonucleotide
gccagcaccgccatcaaccaa

SEQ ID NO: 41453 - DNA, 21 bp, Artificial Sequence
  Description of Artificial Sequence: Synthetic oligonucleotide
aatcttgcttctagttcttat

SEQ ID NO: 41454 - DNA, 21 bp, Artificial Sequence
  Description of Artificial Sequence: Synthetic oligonucleotide
tcgaaggttactgcgcagtct

SEQ ID NO: 41455 - DNA, 21 bp, Artificial Sequence
  Description of Artificial Sequence: Synthetic oligonucleotide
cacatgaacagaaaactcgaa

SEQ ID NO: 41456 - DNA, 21 bp, Artificial Sequence
  Description of Artificial Sequence: Synthetic oligonucleotide
ggtgcgcgtccggtgcttcag

SEQ ID NO: 41457 - DNA, 21 bp, Artificial Sequence
  Description of Artificial Sequence: Synthetic oligonucleotide
gccgcccaacccagcctcaaa

SEQ ID NO: 41458 - DNA, 21 bp, Artificial Sequence
  Description of Artificial Sequence: Synthetic oligonucleotide
gactacagcgaaaccagaaga

SEQ ID NO: 41459 - DNA, 21 bp, Artificial Sequence
  Description of Artificial Sequence: Synthetic oligonucleotide
aacaacagcaaaagccaaatc

SEQ ID NO: 41460 - DNA, 21 bp, Artificial Sequence
  Description of Artificial Sequence: Synthetic oligonucleotide
cctctgccggctcatagtcct

SEQ ID NO: 41461 - DNA, 21 bp, Artificial Sequence
  Description of Artificial Sequence: Synthetic oligonucleotide
tcgccggttaaggggtctgtt

SEQ ID NO: 41462 - DNA, 21 bp, Artificial Sequence
  Description of Artificial Sequence: Synthetic oligonucleotide
tttggttcgacgaaggcttcg

SEQ ID NO: 41463 - DNA, 21 bp, Artificial Sequence
  Description of Artificial Sequence: Synthetic oligonucleotide
ccggggtctgggagtaataat

SEQ ID NO: 41464 - DNA, 21 bp, Artificial Sequence
  Description of Artificial Sequence: Synthetic oligonucleotide
tgtttgggttcgaataatttg

SEQ ID NO: 41465 - DNA, 21 bp, Artificial Sequence
  Description of Artificial Sequence: Synthetic oligonucleotide
aacggttctggacataatcaa

SEQ ID NO: 41466 - DNA, 21 bp, Artificial Sequence
  Description of Artificial Sequence: Synthetic oligonucleotide
cttaataagtctacgcttccg

SEQ ID NO: 41467 - DNA, 21 bp, Artificial Sequence
  Description of Artificial Sequence: Synthetic oligonucleotide
ggcgccgaaagaatcctcaga

SEQ ID NO: 41468 - DNA, 21 bp, Artificial Sequence
  Description of Artificial Sequence: Synthetic oligonucleotide
agccccgaaaaaaacatgaga

SEQ ID NO: 41469 - DNA, 21 bp, Artificial Sequence
  Description of Artificial Sequence: Synthetic oligonucleotide
gagagtgctcggattggttct

SEQ ID NO: 41470 - DNA, 21 bp, Artificial Sequence
  Description of Artificial Sequence: Synthetic oligonucleotide
gccgccaccaacagcttcggc

SEQ ID NO: 41471 - DNA, 21 bp, Artificial Sequence
  Description of Artificial Sequence: Synthetic oligonucleotide
cacatgaacagaaaactcgaa

SEQ ID NO: 41472 - DNA, 21 bp, Artificial Sequence
  Description of Artificial Sequence: Synthetic oligonucleotide
gccgcccaacccagcctcaaa

SEQ ID NO: 41473 - DNA, 21 bp, Artificial Sequence
  Description of Artificial Sequence: Synthetic oligonucleotide
ggcgccagacccgtcctccaa

SEQ ID NO: 41474 - DNA, 21 bp, Artificial Sequence
  Description of Artificial Sequence: Synthetic oligonucleotide
caagtcctcagcgtcgccggc

SEQ ID NO: 41475 - DNA, 21 bp, Artificial Sequence
  Description of Artificial Sequence: Synthetic oligonucleotide
aagcttaataagtctcaggcg

SEQ ID NO: 41476 - DNA, 21 bp, Artificial Sequence
  Description of Artificial Sequence: Synthetic oligonucleotide
aataatactcagaagaattct

SEQ ID NO: 41477 - DNA, 21 bp, Artificial Sequence
  Description of Artificial Sequence: Synthetic oligonucleotide
ggtgggactaataatcttaat

SEQ ID NO: 41478 - DNA, 21 bp, Artificial Sequence
  Description of Artificial Sequence: Synthetic oligonucleotide
ggcctcagccccgtcctcaaa

SEQ ID NO: 41479 - DNA, 21 bp, Artificial Sequence
  Description of Artificial Sequence: Synthetic oligonucleotide
agtactactgggggggctagt

SEQ ID NO: 41480 - DNA, 21 bp, Artificial Sequence
  Description of Artificial Sequence: Synthetic oligonucleotide
aatactcagagttatacgagt

SEQ ID NO: 41481 - DNA, 21 bp, Artificial Sequence
  Description of Artificial Sequence: Synthetic oligonucleotide
gaaaccaccacccccagaaaa

SEQ ID NO: 41482 - DNA, 21 bp, Artificial Sequence
  Description of Artificial Sequence: Synthetic oligonucleotide
tattcgcaggaggtttttcgg

SEQ ID NO: 41483 - DNA, 21 bp, Artificial Sequence
  Description of Artificial Sequence: Synthetic oligonucleotide
attattcaggatactgctcgt

SEQ ID NO: 41484 - DNA, 21 bp, Artificial Sequence
  Description of Artificial Sequence: Synthetic oligonucleotide
tatattaatagtccttcgaat

SEQ ID NO: 41485 - DNA, 21 bp, Artificial Sequence
  Description of Artificial Sequence: Synthetic oligonucleotide
catattactccggctacttcg

SEQ ID NO: 41486 - DNA, 21 bp, Artificial Sequence
  Description of Artificial Sequence: Synthetic oligonucleotide
gtcaaagtcgacggccaaatc

SEQ ID NO: 41487 - DNA, 21 bp, Artificial Sequence
  Description of Artificial Sequence: Synthetic oligonucleotide
aatagtaatgggattaataat

SEQ ID NO: 41488 - DNA, 21 bp, Artificial Sequence
  Description of Artificial Sequence: Synthetic oligonucleotide
agcggcgccggcagcgccggc

SEQ ID NO: 41489 - DNA, 21 bp, Artificial Sequence
  Description of Artificial Sequence: Synthetic oligonucleotide
cccagacaataccaaagcgac

SEQ ID NO: 41490 - DNA, 21 bp, Artificial Sequence
  Description of Artificial Sequence: Synthetic oligonucleotide
agtactacgaatagtaagaat

SEQ ID NO: 41491 - DNA, 21 bp, Artificial Sequence
  Description of Artificial Sequence: Synthetic oligonucleotide
tattctgggggtaatatgagt

SEQ ID NO: 41492 - DNA, 21 bp, Artificial Sequence
  Description of Artificial Sequence: Synthetic oligonucleotide
tctattaagtctgttactaat

SEQ ID NO: 41493 - DNA, 21 bp, Artificial Sequence
  Description of Artificial Sequence: Synthetic oligonucleotide
ctcagcagcacccacatgacc

SEQ ID NO: 41494 - DNA, 21 bp, Artificial Sequence
  Description of Artificial Sequence: Synthetic oligonucleotide
aattctattactcggagtagt

SEQ ID NO: 41495 - DNA, 21 bp, Artificial Sequence
  Description of Artificial Sequence: Synthetic oligonucleotide
gacagagtcggcagcatctac

SEQ ID NO: 41496 - DNA, 21 bp, Artificial Sequence
  Description of Artificial Sequence: Synthetic oligonucleotide
ccttataatgtgagtcagaat

SEQ ID NO: 41497 - DNA, 21 bp, Artificial Sequence
  Description of Artificial Sequence: Synthetic oligonucleotide
aacagagaaaaactcagctac

SEQ ID NO: 41498 - DNA, 21 bp, Artificial Sequence
  Description of Artificial Sequence: Synthetic oligonucleotide
cctggtagtgtgactgggtct

SEQ ID NO: 41499 - DNA, 21 bp, Artificial Sequence
  Description of Artificial Sequence: Synthetic oligonucleotide
gatcgggttttgagtcagggg

SEQ ID NO: 41500 - DNA, 21 bp, Artificial Sequence
  Description of Artificial Sequence: Synthetic oligonucleotide
aggactcttaatcttaatact

SEQ ID NO: 41501 - DNA, 21 bp, Artificial Sequence
  Description of Artificial Sequence: Synthetic oligonucleotide
gccagagacgaccaaagaaga

SEQ ID NO: 41502 - DNA, 21 bp, Artificial Sequence
  Description of Artificial Sequence: Synthetic oligonucleotide
aattatgatagtttgaagaag

SEQ ID NO: 41503 - DNA, 21 bp, Artificial Sequence
  Description of Artificial Sequence: Synthetic oligonucleotide
ctgtcgaatcagaataatcag

SEQ ID NO: 41504 - DNA, 21 bp, Artificial Sequence
  Description of Artificial Sequence: Synthetic oligonucleotide
tcttctgggggtaatatgagt

SEQ ID NO: 41505 - DNA, 21 bp, Artificial Sequence
  Description of Artificial Sequence: Synthetic oligonucleotide
tatgagaagaatagtctgatg

SEQ ID NO: 41506 - DNA, 21 bp, Artificial Sequence
  Description of Artificial Sequence: Synthetic oligonucleotide
tctactgggtcggtgagtaag

SEQ ID NO: 41507 - DNA, 21 bp, Artificial Sequence
  Description of Artificial Sequence: Synthetic oligonucleotide
gtcagcaaaagccccagcacc

SEQ ID NO: 41508 - DNA, 21 bp, Artificial Sequence
  Description of Artificial Sequence: Synthetic oligonucleotide
attaagctggataagcagatt

SEQ ID NO: 41509 - DNA, 21 bp, Artificial Sequence
  Description of Artificial Sequence: Synthetic oligonucleotide
tattcggataataagactact

SEQ ID NO: 41510 - DNA, 21 bp, Artificial Sequence
  Description of Artificial Sequence: Synthetic oligonucleotide
cctcagaataatcaggcgcat

SEQ ID NO: 41511 - DNA, 21 bp, Artificial Sequence
  Description of Artificial Sequence: Synthetic oligonucleotide
actacttatggtgggaatcgg

SEQ ID NO: 41512 - DNA, 21 bp, Artificial Sequence
  Description of Artificial Sequence: Synthetic oligonucleotide
tctccggcttatgatacgagg

SEQ ID NO: 41513 - DNA, 21 bp, Artificial Sequence
  Description of Artificial Sequence: Synthetic oligonucleotide
aacggcgccggccaaaaccaa

SEQ ID NO: 41514 - DNA, 21 bp, Artificial Sequence
  Description of Artificial Sequence: Synthetic oligonucleotide
gatcttactaatcatactaag

SEQ ID NO: 41515 - DNA, 21 bp, Artificial Sequence
  Description of Artificial Sequence: Synthetic oligonucleotide
attagggcgaaggagtctgcg

SEQ ID NO: 41516 - DNA, 21 bp, Artificial Sequence
  Description of Artificial Sequence: Synthetic oligonucleotide
ggccaaatcaaaaacctcggc

SEQ ID NO: 41517 - DNA, 21 bp, Artificial Sequence
  Description of Artificial Sequence: Synthetic oligonucleotide
atcggttctggacagaatcaa

SEQ ID NO: 41518 - DNA, 21 bp, Artificial Sequence
  Description of Artificial Sequence: Synthetic oligonucleotide
ggtactggtaattctaatctt

SEQ ID NO: 41519 - DNA, 21 bp, Artificial Sequence
  Description of Artificial Sequence: Synthetic oligonucleotide
gccagcacccccaacaacacc

SEQ ID NO: 41520 - DNA, 21 bp, Artificial Sequence
  Description of Artificial Sequence: Synthetic oligonucleotide
ggtattcagccggggtctaat

SEQ ID NO: 41521 - DNA, 21 bp, Artificial Sequence
  Description of Artificial Sequence: Synthetic oligonucleotide
gattctggttcttcgacgaag

SEQ ID NO: 41522 - DNA, 21 bp, Artificial Sequence
  Description of Artificial Sequence: Synthetic oligonucleotide
aagacgagtcttaatacgagt

SEQ ID NO: 41523 - DNA, 21 bp, Artificial Sequence
  Description of Artificial Sequence: Synthetic oligonucleotide
aaacaacccgacagcacccac

SEQ ID NO: 41524 - DNA, 21 bp, Artificial Sequence
  Description of Artificial Sequence: Synthetic oligonucleotide
aacatggacggcgccaccaga

SEQ ID NO: 41525 - DNA, 21 bp, Artificial Sequence
  Description of Artificial Sequence: Synthetic oligonucleotide
aaactcagcaacgacaacctc

SEQ ID NO: 41526 - DNA, 21 bp, Artificial Sequence
  Description of Artificial Sequence: Synthetic oligonucleotide
atgtttcagaagcaggggaat

SEQ ID NO: 41527 - DNA, 21 bp, Artificial Sequence
  Description of Artificial Sequence: Synthetic oligonucleotide
cgggtggatactattactaag

SEQ ID NO: 41528 - DNA, 21 bp, Artificial Sequence
  Description of Artificial Sequence: Synthetic oligonucleotide
tcgacgtcgattccggggatg

SEQ ID NO: 41529 - DNA, 21 bp, Artificial Sequence
  Description of Artificial Sequence: Synthetic oligonucleotide
aagactgataagactgttgat

SEQ ID NO: 41530 - DNA, 21 bp, Artificial Sequence
  Description of Artificial Sequence: Synthetic oligonucleotide
agtctttatactaatgcggtt

SEQ ID NO: 41531 - DNA, 21 bp, Artificial Sequence
  Description of Artificial Sequence: Synthetic oligonucleotide
atgagccacaccaacagaccc

SEQ ID NO: 41532 - DNA, 21 bp, Artificial Sequence
  Description of Artificial Sequence: Synthetic oligonucleotide
tcgaattctgatagggcgaat

SEQ ID NO: 41533 - DNA, 21 bp, Artificial Sequence
  Description of Artificial Sequence: Synthetic oligonucleotide
cacaccagccccggcaaaaac

SEQ ID NO: 41534 - DNA, 21 bp, Artificial Sequence
  Description of Artificial Sequence: Synthetic oligonucleotide
gaacccctccaaggcagcaga

SEQ ID NO: 41535 - DNA, 21 bp, Artificial Sequence
  Description of Artificial Sequence: Synthetic oligonucleotide
ccgggtaattcgcataagatt

SEQ ID NO: 41536 - DNA, 21 bp, Artificial Sequence
  Description of Artificial Sequence: Synthetic oligonucleotide
tcttctccgcaggctcataat

SEQ ID NO: 41537 - DNA, 21 bp, Artificial Sequence
  Description of Artificial Sequence: Synthetic oligonucleotide
accaccgacaaaaaaaccgaa

SEQ ID NO: 41538 - DNA, 21 bp, Artificial Sequence
  Description of Artificial Sequence: Synthetic oligonucleotide
gcgatgagttctaataatggt

SEQ ID NO: 41539 - DNA, 21 bp, Artificial Sequence
  Description of Artificial Sequence: Synthetic oligonucleotide
agcgacagcagaaacaccaac

SEQ ID NO: 41540 - DNA, 21 bp, Artificial Sequence
  Description of Artificial Sequence: Synthetic oligonucleotide
ttcaacatgcaaagaagccaa

SEQ ID NO: 41541 - DNA, 21 bp, Artificial Sequence
  Description of Artificial Sequence: Synthetic oligonucleotide
atggccctccaacccaacaga

SEQ ID NO: 41542 - DNA, 21 bp, Artificial Sequence
  Description of Artificial Sequence: Synthetic oligonucleotide
aatagtgaggcgaggcttagt

SEQ ID NO: 41543 - DNA, 21 bp, Artificial Sequence
  Description of Artificial Sequence: Synthetic oligonucleotide
ccgagtagtccgaattctatt

SEQ ID NO: 41544 - DNA, 21 bp, Artificial Sequence
  Description of Artificial Sequence: Synthetic oligonucleotide
ttgattaatcctgctggttct

SEQ ID NO: 41545 - DNA, 21 bp, Artificial Sequence
  Description of Artificial Sequence: Synthetic oligonucleotide
gaaatcagcagacccgccagc

SEQ ID NO: 41546 - DNA, 21 bp, Artificial Sequence
  Description of Artificial Sequence: Synthetic oligonucleotide
gaagtcttcagcagccaaaaa

SEQ ID NO: 41547 - DNA, 21 bp, Artificial Sequence
  Description of Artificial Sequence: Synthetic oligonucleotide
gagagtaattcgagtcggggg

SEQ ID NO: 41548 - DNA, 21 bp, Artificial Sequence
  Description of Artificial Sequence: Synthetic oligonucleotide
caactccaacccagagtcgcc

SEQ ID NO: 41549 - DNA, 21 bp, Artificial Sequence
  Description of Artificial Sequence: Synthetic oligonucleotide
cagagtgggccgggggttact

SEQ ID NO: 41550 - DNA, 21 bp, Artificial Sequence
  Description of Artificial Sequence: Synthetic oligonucleotide
aacagcgccgccgccatgaaa

SEQ ID NO: 41551 - DNA, 21 bp, Artificial Sequence
  Description of Artificial Sequence: Synthetic oligonucleotide
tttccgagtgtttcgacgact

SEQ ID NO: 41552 - DNA, 21 bp, Artificial Sequence
  Description of Artificial Sequence: Synthetic oligonucleotide
gagaataatagtcgtgctact

SEQ ID NO: 41553 - DNA, 21 bp, Artificial Sequence
  Description of Artificial Sequence: Synthetic oligonucleotide
ttgccttcgggtaatactagt

SEQ ID NO: 41554 - DNA, 21 bp, Artificial Sequence
  Description of Artificial Sequence: Synthetic oligonucleotide
aataagtcgaatacgtttctt

SEQ ID NO: 41555 - DNA, 21 bp, Artificial Sequence
  Description of Artificial Sequence: Synthetic oligonucleotide
cctggtcagagtacttctagt

SEQ ID NO: 41556 - DNA, 21 bp, Artificial Sequence
  Description of Artificial Sequence: Synthetic oligonucleotide
ctcagcggccacagcccccaa

SEQ ID NO: 41557 - DNA, 21 bp, Artificial Sequence
  Description of Artificial Sequence: Synthetic oligonucleotide
agtccgcttcagtctattgtt

SEQ ID NO: 41558 - DNA, 21 bp, Artificial Sequence
  Description of Artificial Sequence: Synthetic oligonucleotide
agaatcgccggccccaccgtc

SEQ ID NO: 41559 - DNA, 21 bp, Artificial Sequence
  Description of Artificial Sequence: Synthetic oligonucleotide
ggtgttgaggcgatgcggaat

SEQ ID NO: 41560 - DNA, 21 bp, Artificial Sequence
  Description of Artificial Sequence: Synthetic oligonucleotide
caggagactcgtgggaattct

SEQ ID NO: 41561 - DNA, 21 bp, Artificial Sequence
  Description of Artificial Sequence: Synthetic oligonucleotide
gctcgggatgagagggctttt

SEQ ID NO: 41562 - DNA, 21 bp, Artificial Sequence
  Description of Artificial Sequence: Synthetic oligonucleotide
tatattgatgcttctgcgcgg

SEQ ID NO: 41563 - DNA, 21 bp, Artificial Sequence
  Description of Artificial Sequence: Synthetic oligonucleotide
cctagtactggtaattcggtg

SEQ ID NO: 41564 - DNA, 21 bp, Artificial Sequence
  Description of Artificial Sequence: Synthetic oligonucleotide
agaatcaccagcagcaaccaa

SEQ ID NO: 41565 - DNA, 21 bp, Artificial Sequence
  Description of Artificial Sequence: Synthetic oligonucleotide
ggcagaagcatggaaagaagc

SEQ ID NO: 41566 - DNA, 21 bp, Artificial Sequence
  Description of Artificial Sequence: Synthetic oligonucleotide
gtgactaggggtctgaatgtt

SEQ ID NO: 41567 - DNA, 21 bp, Artificial Sequence
  Description of Artificial Sequence: Synthetic oligonucleotide
tttcatgcgaatagtactgtg

SEQ ID NO: 41568 - DNA, 21 bp, Artificial Sequence
  Description of Artificial Sequence: Synthetic oligonucleotide
atgcccctcaaaccccacctc

SEQ ID NO: 41569 - DNA, 21 bp, Artificial Sequence
  Description of Artificial Sequence: Synthetic oligonucleotide
gaagccaccagcagcaccaaa

SEQ ID NO: 41570 - DNA, 21 bp, Artificial Sequence
  Description of Artificial Sequence: Synthetic oligonucleotide
attaattttagtggtactagg

SEQ ID NO: 41571 - DNA, 21 bp, Artificial Sequence
  Description of Artificial Sequence: Synthetic oligonucleotide
aatccggctcatggtcttaat

SEQ ID NO: 41572 - DNA, 21 bp, Artificial Sequence
  Description of Artificial Sequence: Synthetic oligonucleotide
atggggtcgagtgtgaggtct

SEQ ID NO: 41573 - DNA, 21 bp, Artificial Sequence
  Description of Artificial Sequence: Synthetic oligonucleotide
gtcagctacgccagaaccgaa

SEQ ID NO: 41574 - DNA, 21 bp, Artificial Sequence
  Description of Artificial Sequence: Synthetic oligonucleotide
caaagcgaaatcgtcaacaaa

SEQ ID NO: 41575 - DNA, 21 bp, Artificial Sequence
  Description of Artificial Sequence: Synthetic oligonucleotide
tattctaattcgcgtgtgggt

SEQ ID NO: 41576 - DNA, 21 bp, Artificial Sequence
  Description of Artificial Sequence: Synthetic oligonucleotide
gtccaaagaagcagcaaccaa

SEQ ID NO: 41577 - DNA, 21 bp, Artificial Sequence
  Description of Artificial Sequence: Synthetic oligonucleotide
tcttatgtgggtactacggct

SEQ ID NO: 41578 - DNA, 21 bp, Artificial Sequence
  Description of Artificial Sequence: Synthetic oligonucleotide
accagccaaaccaaaatcgtc

SEQ ID NO: 41579 - DNA, 21 bp, Artificial Sequence
  Description of Artificial Sequence: Synthetic oligonucleotide
aatagggagcagcttcgggat

SEQ ID NO: 41580 - DNA, 21 bp, Artificial Sequence
  Description of Artificial Sequence: Synthetic oligonucleotide
cagtttcctgggactttgcgt

SEQ ID NO: 41581 - DNA, 21 bp, Artificial Sequence
  Description of Artificial Sequence: Synthetic oligonucleotide
gaactcatgaacaaaagcaaa

SEQ ID NO: 41582 - DNA, 21 bp, Artificial Sequence
  Description of Artificial Sequence: Synthetic oligonucleotide
attaggactaatagtactctt

SEQ ID NO: 41583 - DNA, 21 bp, Artificial Sequence
  Description of Artificial Sequence: Synthetic oligonucleotide
gaggtgactaatgctcctaag

SEQ ID NO: 41584 - DNA, 21 bp, Artificial Sequence
  Description of Artificial Sequence: Synthetic oligonucleotide
caacaaagccccagaaacggc

SEQ ID NO: 41585 - DNA, 21 bp, Artificial Sequence
  Description of Artificial Sequence: Synthetic oligonucleotide
cacaccagcccccccttcacc

SEQ ID NO: 41586 - DNA, 21 bp, Artificial Sequence
  Description of Artificial Sequence: Synthetic oligonucleotide
ggtcttgggcagcagacgaat

SEQ ID NO: 41587 - DNA, 21 bp, Artificial Sequence
  Description of Artificial Sequence: Synthetic oligonucleotide
aatagttatgatccgaagcgt

SEQ ID NO: 41588 - DNA, 21 bp, Artificial Sequence
  Description of Artificial Sequence: Synthetic oligonucleotide
gatcctagggctcagagtcat

SEQ ID NO: 41589 - DNA, 21 bp, Artificial Sequence
  Description of Artificial Sequence: Synthetic oligonucleotide
cacagagacaccaacggcaaa

SEQ ID NO: 41590 - DNA, 21 bp, Artificial Sequence
  Description of Artificial Sequence: Synthetic oligonucleotide
aataatctggcggggagtaag

SEQ ID NO: 41591 - DNA, 21 bp, Artificial Sequence
  Description of Artificial Sequence: Synthetic oligonucleotide
agagtcagcagccccagcaac

SEQ ID NO: 41592 - DNA, 21 bp, Artificial Sequence
  Description of Artificial Sequence: Synthetic oligonucleotide
attgcttcgagtggtatgcat

SEQ ID NO: 41593 - DNA, 21 bp, Artificial Sequence
  Description of Artificial Sequence: Synthetic oligonucleotide
agagccacccccctcagcggc

SEQ ID NO: 41594 - DNA, 21 bp, Artificial Sequence
  Description of Artificial Sequence: Synthetic oligonucleotide
aacagagtcgaacacacccaa

SEQ ID NO: 41595 - DNA, 21 bp, Artificial Sequence
  Description of Artificial Sequence: Synthetic oligonucleotide
atgcttgggtctagtaataag

SEQ ID NO: 41596 - DNA, 21 bp, Artificial Sequence
  Description of Artificial Sequence: Synthetic oligonucleotide
catggtatttctaatcagagt

SEQ ID NO: 41597 - DNA, 21 bp, Artificial Sequence
  Description of Artificial Sequence: Synthetic oligonucleotide
gctctttctagtcagaagggt

SEQ ID NO: 41598 - DNA, 21 bp, Artificial Sequence
  Description of Artificial Sequence: Synthetic oligonucleotide
actacggcttcgagtccgact

SEQ ID NO: 41599 - DNA, 21 bp, Artificial Sequence
  Description of Artificial Sequence: Synthetic oligonucleotide
agcctcagcaccggcagcggc

SEQ ID NO: 41600 - DNA, 21 bp, Artificial Sequence
  Description of Artificial Sequence: Synthetic oligonucleotide
aaaccccaaggcagcctcgtc

SEQ ID NO: 41601 - DNA, 21 bp, Artificial Sequence
  Description of Artificial Sequence: Synthetic oligonucleotide
ccccacctcccccaaagcgcc

SEQ ID NO: 41602 - DNA, 21 bp, Artificial Sequence
  Description of Artificial Sequence: Synthetic oligonucleotide
ggcgaactccccgacagaaga

SEQ ID NO: 41603 - DNA, 21 bp, Artificial Sequence
  Description of Artificial Sequence: Synthetic oligonucleotide
tctttgggttctggttttcag

SEQ ID NO: 41604 - DNA, 21 bp, Artificial Sequence
  Description of Artificial Sequence: Synthetic oligonucleotide
ccgaatggggcgcatgttacg

SEQ ID NO: 41605 - DNA, 21 bp, Artificial Sequence
  Description of Artificial Sequence: Synthetic oligonucleotide
gccaccaccagcagaatcagc

SEQ ID NO: 41606 - DNA, 21 bp, Artificial Sequence
  Description of Artificial Sequence: Synthetic oligonucleotide
agcaaagtcaccgcccaaagc

SEQ ID NO: 41607 - DNA, 21 bp, Artificial Sequence
  Description of Artificial Sequence: Synthetic oligonucleotide
tcgaattataagtcttcgaat

SEQ ID NO: 41608 - DNA, 21 bp, Artificial Sequence
  Description of Artificial Sequence: Synthetic oligonucleotide
aacttcagcaaccccaccgtc

SEQ ID NO: 41609 - DNA, 21 bp, Artificial Sequence
  Description of Artificial Sequence: Synthetic oligonucleotide
ccggggtatgggagtaatcat

SEQ ID NO: 41610 - DNA, 21 bp, Artificial Sequence
  Description of Artificial Sequence: Synthetic oligonucleotide
tttcagccgaggagttctacg

SEQ ID NO: 41611 - DNA, 21 bp, Artificial Sequence
  Description of Artificial Sequence: Synthetic oligonucleotide
ggcatcagagaatacaacaaa

SEQ ID NO: 41612 - DNA, 21 bp, Artificial Sequence
  Description of Artificial Sequence: Synthetic oligonucleotide
aataatcctaagaatgctgtt

SEQ ID NO: 41613 - DNA, 21 bp, Artificial Sequence
  Description of Artificial Sequence: Synthetic oligonucleotide
cttccttctaattctattcat

SEQ ID NO: 41614 - DNA, 21 bp, Artificial Sequence
  Description of Artificial Sequence: Synthetic oligonucleotide
agacccgaaagcagctacagc

SEQ ID NO: 41615 - DNA, 21 bp, Artificial Sequence
  Description of Artificial Sequence: Synthetic oligonucleotide
aaccccagcgaaaaaatgctc

SEQ ID NO: 41616 - DNA, 21 bp, Artificial Sequence
  Description of Artificial Sequence: Synthetic oligonucleotide
aacggttctagacagaatcaa

SEQ ID NO: 41617 - DNA, 21 bp, Artificial Sequence
  Description of Artificial Sequence: Synthetic oligonucleotide
tatgttactagttctgggggt

SEQ ID NO: 41618 - DNA, 21 bp, Artificial Sequence
  Description of Artificial Sequence: Synthetic oligonucleotide
tacaccgccagcagaatggaa

SEQ ID NO: 41619 - DNA, 21 bp, Artificial Sequence
  Description of Artificial Sequence: Synthetic oligonucleotide
ctctgcgccagcaaatgcgac

SEQ ID NO: 41620 - DNA, 21 bp, Artificial Sequence
  Description of Artificial Sequence: Synthetic oligonucleotide
ttcagcagcgccagcttcacc

SEQ ID NO: 41621 - DNA, 21 bp, Artificial Sequence
  Description of Artificial Sequence: Synthetic oligonucleotide
ctgatgtctgcggcgactact

SEQ ID NO: 41622 - DNA, 21 bp, Artificial Sequence
  Description of Artificial Sequence: Synthetic oligonucleotide
ggcctccccaccgaaaaaatg

SEQ ID NO: 41623 - DNA, 21 bp, Artificial Sequence
  Description of Artificial Sequence: Synthetic oligonucleotide
ttcgtcaaaacccacagcgcc

SEQ ID NO: 41624 - DNA, 21 bp, Artificial Sequence
  Description of Artificial Sequence: Synthetic oligonucleotide
ggtagtcttgataataggaag

SEQ ID NO: 41625 - DNA, 21 bp, Artificial Sequence
  Description of Artificial Sequence: Synthetic oligonucleotide
actggttctagttcttcgcag

SEQ ID NO: 41626 - DNA, 21 bp, Artificial Sequence
  Description of Artificial Sequence: Synthetic oligonucleotide
aatggggctacgaagaatagt

SEQ ID NO: 41627 - DNA, 21 bp, Artificial Sequence
  Description of Artificial Sequence: Synthetic oligonucleotide
agggaggatactaagatgcat

SEQ ID NO: 41628 - DNA, 21 bp, Artificial Sequence
  Description of Artificial Sequence: Synthetic oligonucleotide
agaaccgccagcagcctcccc

SEQ ID NO: 41629 - DNA, 21 bp, Artificial Sequence
  Description of Artificial Sequence: Synthetic oligonucleotide
cttagggatacgaatatgaat

SEQ ID NO: 41630 - DNA, 21 bp, Artificial Sequence
  Description of Artificial Sequence: Synthetic oligonucleotide
actcagtcgcataatcttgct

SEQ ID NO: 41631 - DNA, 21 bp, Artificial Sequence
  Description of Artificial Sequence: Synthetic oligonucleotide
cccttcagcgaaatgcaaaaa

SEQ ID NO: 41632 - DNA, 21 bp, Artificial Sequence
  Description of Artificial Sequence: Synthetic oligonucleotide
gggaagacgggtccgaatagt

SEQ ID NO: 41633 - DNA, 21 bp, Artificial Sequence
  Description of Artificial Sequence: Synthetic oligonucleotide
caagaagccagagtctacagc

SEQ ID NO: 41634 - DNA, 21 bp, Artificial Sequence
  Description of Artificial Sequence: Synthetic oligonucleotide
gttactacggggggttctaag

SEQ ID NO: 41635 - DNA, 21 bp, Artificial Sequence
  Description of Artificial Sequence: Synthetic oligonucleotide
actgcgcgtgggggtcctact

SEQ ID NO: 41636 - DNA, 21 bp, Artificial Sequence
  Description of Artificial Sequence: Synthetic oligonucleotide
aatttgggtaattctctgaag

SEQ ID NO: 41637 - DNA, 21 bp, Artificial Sequence
  Description of Artificial Sequence: Synthetic oligonucleotide
tctgtgagttctcctagggat

SEQ ID NO: 41638 - DNA, 21 bp, Artificial Sequence
  Description of Artificial Sequence: Synthetic oligonucleotide
gctatggggtcgagtctgtct

SEQ ID NO: 41639 - DNA, 21 bp, Artificial Sequence
  Description of Artificial Sequence: Synthetic oligonucleotide
ccggggtctgggagtaagcat

SEQ ID NO: 41640 - DNA, 21 bp, Artificial Sequence
  Description of Artificial Sequence: Synthetic oligonucleotide
caacccaacgccagccccacc

SEQ ID NO: 41641 - DNA, 21 bp, Artificial Sequence
  Description of Artificial Sequence: Synthetic oligonucleotide
gtgacgcagtcttcgagtaag

SEQ ID NO: 41642 - DNA, 21 bp, Artificial Sequence
  Description of Artificial Sequence: Synthetic oligonucleotide
gcttatcctagtggttcgtcg

SEQ ID NO: 41643 - DNA, 21 bp, Artificial Sequence
  Description of Artificial Sequence: Synthetic oligonucleotide
tttagttctaagacttctccg

SEQ ID NO: 41644 - DNA, 21 bp, Artificial Sequence
  Description of Artificial Sequence: Synthetic oligonucleotide
cccagccacaaccccaccaac

SEQ ID NO: 41645 - DNA, 21 bp, Artificial Sequence
  Description of Artificial Sequence: Synthetic oligonucleotide
accggcagcagcaaagtcggc

SEQ ID NO: 41646 - DNA, 21 bp, Artificial Sequence
  Description of Artificial Sequence: Synthetic oligonucleotide
gtcagcggcaccaaaatcgaa

SEQ ID NO: 41647 - DNA, 21 bp, Artificial Sequence
  Description of Artificial Sequence: Synthetic oligonucleotide
agccacagcagcccctacaaa

SEQ ID NO: 41648 - DNA, 21 bp, Artificial Sequence
  Description of Artificial Sequence: Synthetic oligonucleotide
cagaatcagaattctgggcgt

SEQ ID NO: 41649 - DNA, 21 bp, Artificial Sequence
  Description of Artificial Sequence: Synthetic oligonucleotide
ggcctccacagcgtcgccaaa

SEQ ID NO: 41650 - DNA, 21 bp, Artificial Sequence
  Description of Artificial Sequence: Synthetic oligonucleotide
agccccaccagccccatgaac

SEQ ID NO: 41651 - DNA, 21 bp, Artificial Sequence
  Description of Artificial Sequence: Synthetic oligonucleotide
agtattagtgataagcttggt

SEQ ID NO: 41652 - DNA, 21 bp, Artificial Sequence
  Description of Artificial Sequence: Synthetic oligonucleotide
gggcctaatccgggtaatcat

SEQ ID NO: 41653 - DNA, 21 bp, Artificial Sequence
  Description of Artificial Sequence: Synthetic oligonucleotide
ccgagtgggtcgccggtgagg

SEQ ID NO: 41654 - DNA, 21 bp, Artificial Sequence
  Description of Artificial Sequence: Synthetic oligonucleotide
ggtattactaagaatcttgcg

SEQ ID NO: 41655 - DNA, 21 bp, Artificial Sequence
  Description of Artificial Sequence: Synthetic oligonucleotide
gctggttctaatagtcagggt

SEQ ID NO: 41656 - DNA, 21 bp, Artificial Sequence
  Description of Artificial Sequence: Synthetic oligonucleotide
cctgctaggtcgactctttct

SEQ ID NO: 41657 - DNA, 21 bp, Artificial Sequence
  Description of Artificial Sequence: Synthetic oligonucleotide
gagagtgttcgttcttcgagt

SEQ ID NO: 41658 - DNA, 21 bp, Artificial Sequence
  Description of Artificial Sequence: Synthetic oligonucleotide
gtgaatacgtctcatacgaat

SEQ ID NO: 41659 - DNA, 21 bp, Artificial Sequence
  Description of Artificial Sequence: Synthetic oligonucleotide
tataatgggggtaatcgtagt

SEQ ID NO: 41660 - DNA, 21 bp, Artificial Sequence
  Description of Artificial Sequence: Synthetic oligonucleotide
ggggatcataataggcttaat

SEQ ID NO: 41661 - DNA, 21 bp, Artificial Sequence
  Description of Artificial Sequence: Synthetic oligonucleotide
gccagagtcggcagcatcagc

SEQ ID NO: 41662 - DNA, 21 bp, Artificial Sequence
  Description of Artificial Sequence: Synthetic oligonucleotide
aacaacgtcggcgtcagaggc

SEQ ID NO: 41663 - DNA, 21 bp, Artificial Sequence
  Description of Artificial Sequence: Synthetic oligonucleotide
acggggtctgggagtaatcat

SEQ ID NO: 41664 - DNA, 21 bp, Artificial Sequence
  Description of Artificial Sequence: Synthetic oligonucleotide
aacggcagcaccagcagcggc

SEQ ID NO: 41665 - DNA, 21 bp, Artificial Sequence
  Description of Artificial Sequence: Synthetic oligonucleotide
ggtgtgctgggttctaagaat

SEQ ID NO: 41666 - DNA, 21 bp, Artificial Sequence
  Description of Artificial Sequence: Synthetic oligonucleotide
attgtttctggtaagcttacg

SEQ ID NO: 41667 - DNA, 21 bp, Artificial Sequence
  Description of Artificial Sequence: Synthetic oligonucleotide
cctagtgctaggatgtctggt

SEQ ID NO: 41668 - DNA, 21 bp, Artificial Sequence
  Description of Artificial Sequence: Synthetic oligonucleotide
tttccggttaatgggctgagt

SEQ ID NO: 41669 - DNA, 21 bp, Artificial Sequence
  Description of Artificial Sequence: Synthetic oligonucleotide
cagggtcctaagaatgctgat

SEQ ID NO: 41670 - DNA, 21 bp, Artificial Sequence
  Description of Artificial Sequence: Synthetic oligonucleotide
cagtcgaatactagtcctacc

SEQ ID NO: 41671 - DNA, 21 bp, Artificial Sequence
  Description of Artificial Sequence: Synthetic oligonucleotide
gcgatttcgccgacttatatg

SEQ ID NO: 41672 - DNA, 21 bp, Artificial Sequence
  Description of Artificial Sequence: Synthetic oligonucleotide
aatccggtggctgcggctacg

SEQ ID NO: 41673 - DNA, 21 bp, Artificial Sequence
  Description of Artificial Sequence: Synthetic oligonucleotide
aacagcgccaacaaaaccccc

SEQ ID NO: 41674 - DNA, 21 bp, Artificial Sequence
  Description of Artificial Sequence: Synthetic oligonucleotide
cattcggttaatggtcatagt

SEQ ID NO: 41675 - DNA, 21 bp, Artificial Sequence
  Description of Artificial Sequence: Synthetic oligonucleotide
gctggtgtgacgactgttaat

SEQ ID NO: 41676 - DNA, 21 bp, Artificial Sequence
  Description of Artificial Sequence: Synthetic oligonucleotide
aacgccagcggccaaaaccaa

SEQ ID NO: 41677 - DNA, 21 bp, Artificial Sequence
  Description of Artificial Sequence: Synthetic oligonucleotide
aatctttcgcatagtgcgggg

SEQ ID NO: 41678 - DNA, 21 bp, Artificial Sequence
  Description of Artificial Sequence: Synthetic oligonucleotide
cacggccaaaccggcatgatc

SEQ ID NO: 41679 - DNA, 21 bp, Artificial Sequence
  Description of Artificial Sequence: Synthetic oligonucleotide
tggactgtgagtcggtctggt

SEQ ID NO: 41680 - DNA, 21 bp, Artificial Sequence
  Description of Artificial Sequence: Synthetic oligonucleotide
tcggtttcgaatactaatact

SEQ ID NO: 41681 - DNA, 21 bp, Artificial Sequence
  Description of Artificial Sequence: Synthetic oligonucleotide
caaagagaacaactcctcaaa

SEQ ID NO: 41682 - DNA, 21 bp, Artificial Sequence
  Description of Artificial Sequence: Synthetic oligonucleotide
aacgccgaacccaccagcagc

SEQ ID NO: 41683 - DNA, 21 bp, Artificial Sequence
  Description of Artificial Sequence: Synthetic oligonucleotide
cctcgggatactactgggtct

SEQ ID NO: 41684 - DNA, 21 bp, Artificial Sequence
  Description of Artificial Sequence: Synthetic oligonucleotide
atgagtagtaggtcgagtgtg

SEQ ID NO: 41685 - DNA, 21 bp, Artificial Sequence
  Description of Artificial Sequence: Synthetic oligonucleotide
actcagcagaatgggaggaat

SEQ ID NO: 41686 - DNA, 21 bp, Artificial Sequence
  Description of Artificial Sequence: Synthetic oligonucleotide
actactaataatattcagggg

SEQ ID NO: 41687 - DNA, 21 bp, Artificial Sequence
  Description of Artificial Sequence: Synthetic oligonucleotide
tctcagtctaatagttttctg

SEQ ID NO: 41688 - DNA, 21 bp, Artificial Sequence
  Description of Artificial Sequence: Synthetic oligonucleotide
ggtcctaagtctcctgggacg

SEQ ID NO: 41689 - DNA, 21 bp, Artificial Sequence
  Description of Artificial Sequence: Synthetic oligonucleotide
gccggcgaaaacaaactcagc

SEQ ID NO: 41690 - DNA, 21 bp, Artificial Sequence
  Description of Artificial Sequence: Synthetic oligonucleotide
accggcgaaagacaaagcagc

SEQ ID NO: 41691 - DNA, 21 bp, Artificial Sequence
  Description of Artificial Sequence: Synthetic oligonucleotide
ttgcatgatggtcagactcgt

SEQ ID NO: 41692 - DNA, 21 bp, Artificial Sequence
  Description of Artificial Sequence: Synthetic oligonucleotide
atgctcagcggcagcagaaac

SEQ ID NO: 41693 - DNA, 21 bp, Artificial Sequence
  Description of Artificial Sequence: Synthetic oligonucleotide
agttttagtcctgcttctaat

SEQ ID NO: 41694 - DNA, 21 bp, Artificial Sequence
  Description of Artificial Sequence: Synthetic oligonucleotide
actccgattactcctatgact

SEQ ID NO: 41695 - DNA, 21 bp, Artificial Sequence
  Description of Artificial Sequence: Synthetic oligonucleotide
caccaaccccaccaaaaccaa

SEQ ID NO: 41696 - DNA, 21 bp, Artificial Sequence
  Description of Artificial Sequence: Synthetic oligonucleotide
gccaccaacaacggcagcaaa

SEQ ID NO: 41697 - DNA, 21 bp, Artificial Sequence
  Description of Artificial Sequence: Synthetic oligonucleotide
aatagtatttcgcgggttacg

SEQ ID NO: 41698 - DNA, 21 bp, Artificial Sequence
  Description of Artificial Sequence: Synthetic oligonucleotide
tctaatgattcgaataagaag

SEQ ID NO: 41699 - DNA, 21 bp, Artificial Sequence
  Description of Artificial Sequence: Synthetic oligonucleotide
tcgccggttaaggggtctgtt

SEQ ID NO: 41700 - DNA, 21 bp, Artificial Sequence
  Description of Artificial Sequence: Synthetic oligonucleotide
agaagcagcaacagcgaccac

SEQ ID NO: 41701 - DNA, 21 bp, Artificial Sequence
  Description of Artificial Sequence: Synthetic oligonucleotide
ctgcaggtgaatatggctcgt

SEQ ID NO: 41702 - DNA, 21 bp, Artificial Sequence
  Description of Artificial Sequence: Synthetic oligonucleotide
gctggtactggtagttcgctt

SEQ ID NO: 41703 - DNA, 21 bp, Artificial Sequence
  Description of Artificial Sequence: Synthetic oligonucleotide
gggagtaatcttaatagtact

SEQ ID NO: 41704 - DNA, 21 bp, Artificial Sequence
  Description of Artificial Sequence: Synthetic oligonucleotide
ccgaatcatcagagtcttact

SEQ ID NO: 41705 - DNA, 21 bp, Artificial Sequence
  Description of Artificial Sequence: Synthetic oligonucleotide
accggttctggacagaatcaa

SEQ ID NO: 41706 - DNA, 21 bp, Artificial Sequence
  Description of Artificial Sequence: Synthetic oligonucleotide
gagacgcctaataggagtcag

SEQ ID NO: 41707 - DNA, 21 bp, Artificial Sequence
  Description of Artificial Sequence: Synthetic oligonucleotide
aataatagttctggggctcag

SEQ ID NO: 41708 - DNA, 21 bp, Artificial Sequence
  Description of Artificial Sequence: Synthetic oligonucleotide
agcagcagcggcggcgtcaaa

SEQ ID NO: 41709 - DNA, 21 bp, Artificial Sequence
  Description of Artificial Sequence: Synthetic oligonucleotide
tgtacttctaagagtagttct

SEQ ID NO: 41710 - DNA, 21 bp, Artificial Sequence
  Description of Artificial Sequence: Synthetic oligonucleotide
atttctccggtgccgctgact

SEQ ID NO: 41711 - DNA, 21 bp, Artificial Sequence
  Description of Artificial Sequence: Synthetic oligonucleotide
cagcggaatgtgagtgtggtt

SEQ ID NO: 41712 - DNA, 21 bp, Artificial Sequence
  Description of Artificial Sequence: Synthetic oligonucleotide
gacttcagcgaaaaaagactc

SEQ ID NO: 41713 - DNA, 21 bp, Artificial Sequence
  Description of Artificial Sequence: Synthetic oligonucleotide
agtaggccggggctttctcag

SEQ ID NO: 41714 - DNA, 21 bp, Artificial Sequence
  Description of Artificial Sequence: Synthetic oligonucleotide
tatggttcgaatacgccgact

SEQ ID NO: 41715 - DNA, 21 bp, Artificial Sequence
  Description of Artificial Sequence: Synthetic oligonucleotide
agaatcaccctcaacagcgcc

SEQ ID NO: 41716 - DNA, 21 bp, Artificial Sequence
  Description of Artificial Sequence: Synthetic oligonucleotide
cccctcaacacccaccaaagc

SEQ ID NO: 41717 - DNA, 21 bp, Artificial Sequence
  Description of Artificial Sequence: Synthetic oligonucleotide
tttcggaatacgcatagtgag

SEQ ID NO: 41718 - DNA, 21 bp, Artificial Sequence
  Description of Artificial Sequence: Synthetic oligonucleotide
agcagcgaccaacccagactc

SEQ ID NO: 41719 - DNA, 21 bp, Artificial Sequence
  Description of Artificial Sequence: Synthetic oligonucleotide
gaactcgccgcccccagcaaa

SEQ ID NO: 41720 - DNA, 21 bp, Artificial Sequence
  Description of Artificial Sequence: Synthetic oligonucleotide
gctactactaaggctggtatt

SEQ ID NO: 41721 - DNA, 21 bp, Artificial Sequence
  Description of Artificial Sequence: Synthetic oligonucleotide
gctgagcagaggccggggcag

SEQ ID NO: 41722 - DNA, 21 bp, Artificial Sequence
  Description of Artificial Sequence: Synthetic oligonucleotide
ggcatcgacaccaaaatgctc

SEQ ID NO: 41723 - DNA, 21 bp, Artificial Sequence
  Description of Artificial Sequence: Synthetic oligonucleotide
tctcctaataagacttctctt

SEQ ID NO: 41724 - DNA, 21 bp, Artificial Sequence
  Description of Artificial Sequence: Synthetic oligonucleotide
catacttcgagtaattctctt

SEQ ID NO: 41725 - DNA, 21 bp, Artificial Sequence
  Description of Artificial Sequence: Synthetic oligonucleotide
tctcagacggttaagactggt

SEQ ID NO: 41726 - DNA, 21 bp, Artificial Sequence
  Description of Artificial Sequence: Synthetic oligonucleotide
cccaacaaccaaagcaccaga

SEQ ID NO: 41727 - DNA, 21 bp, Artificial Sequence
  Description of Artificial Sequence: Synthetic oligonucleotide
gtcaaccaaagcggcttcagc

SEQ ID NO: 41728 - DNA, 21 bp, Artificial Sequence
  Description of Artificial Sequence: Synthetic oligonucleotide
gatgggaagagtcctcgtgtg

SEQ ID NO: 41729 - DNA, 21 bp, Artificial Sequence
  Description of Artificial Sequence: Synthetic oligonucleotide
tatgttagtaattctaatgcg

SEQ ID NO: 41730 - DNA, 21 bp, Artificial Sequence
  Description of Artificial Sequence: Synthetic oligonucleotide
gaatacccccaacaagccaaa

SEQ ID NO: 41731 - DNA, 21 bp, Artificial Sequence
  Description of Artificial Sequence: Synthetic oligonucleotide
ggcgtccaaaccaaactcctc

SEQ ID NO: 41732 - DNA, 21 bp, Artificial Sequence
  Description of Artificial Sequence: Synthetic oligonucleotide
ggccaaaccggcgacatgaga

SEQ ID NO: 41733 - DNA, 21 bp, Artificial Sequence
  Description of Artificial Sequence: Synthetic oligonucleotide
aacggcagcggcaccaaccaa

SEQ ID NO: 41734 - DNA, 21 bp, Artificial Sequence
  Description of Artificial Sequence: Synthetic oligonucleotide
cgtaatgttgataagtcgagt

SEQ ID NO: 41735 - DNA, 21 bp, Artificial Sequence
  Description of Artificial Sequence: Synthetic oligonucleotide
cgtccgtatgagacgcagttg

SEQ ID NO: 41736 - DNA, 21 bp, Artificial Sequence
  Description of Artificial Sequence: Synthetic oligonucleotide
cctgcgcgtgatagtaagtcg

SEQ ID NO: 41737 - DNA, 21 bp, Artificial Sequence
  Description of Artificial Sequence: Synthetic oligonucleotide
tataataggagtgagcgtcct

SEQ ID NO: 41738 - DNA, 21 bp, Artificial Sequence
  Description of Artificial Sequence: Synthetic oligonucleotide
gaccaagtcagccacaaactc

SEQ ID NO: 41739 - DNA, 21 bp, Artificial Sequence
  Description of Artificial Sequence: Synthetic oligonucleotide
tacatcaaaagcgtcaccaac

SEQ ID NO: 41740 - DNA, 21 bp, Artificial Sequence
  Description of Artificial Sequence: Synthetic oligonucleotide
agaagccccggcagcaacacc

SEQ ID NO: 41741 - DNA, 21 bp, Artificial Sequence
  Description of Artificial Sequence: Synthetic oligonucleotide
agcttcgacagcaaacccccc

SEQ ID NO: 41742 - DNA, 21 bp, Artificial Sequence
  Description of Artificial Sequence: Synthetic oligonucleotide
gtcaacaccaccagagccgaa

SEQ ID NO: 41743 - DNA, 21 bp, Artificial Sequence
  Description of Artificial Sequence: Synthetic oligonucleotide
tcgatggggaattcgattagt

SEQ ID NO: 41744 - DNA, 21 bp, Artificial Sequence
  Description of Artificial Sequence: Synthetic oligonucleotide
aacggttctggacagaataaa

SEQ ID NO: 41745 - DNA, 21 bp, Artificial Sequence
  Description of Artificial Sequence: Synthetic oligonucleotide
accggccaacaaaccgccacc

SEQ ID NO: 41746 - DNA, 21 bp, Artificial Sequence
  Description of Artificial Sequence: Synthetic oligonucleotide
cccagccaaaccaaacccagc

SEQ ID NO: 41747 - DNA, 21 bp, Artificial Sequence
  Description of Artificial Sequence: Synthetic oligonucleotide
cgtctggaggggagtatggcg

SEQ ID NO: 41748 - DNA, 21 bp, Artificial Sequence
  Description of Artificial Sequence: Synthetic oligonucleotide
cctacgaaggcgaatgttacg

SEQ ID NO: 41749 - DNA, 21 bp, Artificial Sequence
  Description of Artificial Sequence: Synthetic oligonucleotide
gggggttcgaatttgcgtact

SEQ ID NO: 41750 - DNA, 21 bp, Artificial Sequence
  Description of Artificial Sequence: Synthetic oligonucleotide
ggtccttctagtattaatagg

SEQ ID NO: 41751 - DNA, 21 bp, Artificial Sequence
  Description of Artificial Sequence: Synthetic oligonucleotide
tatagtggttctgcggggcag

SEQ ID NO: 41752 - DNA, 21 bp, Artificial Sequence
  Description of Artificial Sequence: Synthetic oligonucleotide
ggggttccggctgggcatact

SEQ ID NO: 41753 - DNA, 21 bp, Artificial Sequence
  Description of Artificial Sequence: Synthetic oligonucleotide
ccgacgagtagtccgcagagg

SEQ ID NO: 41754 - DNA, 21 bp, Artificial Sequence
  Description of Artificial Sequence: Synthetic oligonucleotide
tgtaataatgctcgtgtttcg

SEQ ID NO: 41755 - DNA, 21 bp, Artificial Sequence
  Description of Artificial Sequence: Synthetic oligonucleotide
gtttttaatcgtaatgcttct

SEQ ID NO: 41756 - DNA, 21 bp, Artificial Sequence
  Description of Artificial Sequence: Synthetic oligonucleotide
cctacgattagtgtggatagg

SEQ ID NO: 41757 - DNA, 21 bp, Artificial Sequence
  Description of Artificial Sequence: Synthetic oligonucleotide
ccggggtctgggagtaatcat

SEQ ID NO: 41758 - DNA, 21 bp, Artificial Sequence
  Description of Artificial Sequence: Synthetic oligonucleotide
ggtcctgctgttacgaatcgt

SEQ ID NO: 41759 - DNA, 21 bp, Artificial Sequence
  Description of Artificial Sequence: Synthetic oligonucleotide
atgaggcaggatacgagtaag

SEQ ID NO: 41760 - DNA, 21 bp, Artificial Sequence
  Description of Artificial Sequence: Synthetic oligonucleotide
tatacttcgaagtctactgcg

SEQ ID NO: 41761 - DNA, 21 bp, Artificial Sequence
  Description of Artificial Sequence: Synthetic oligonucleotide
aatgtgaatagtcagatgctg

SEQ ID NO: 41762 - DNA, 21 bp, Artificial Sequence
  Description of Artificial Sequence: Synthetic oligonucleotide
aaccccagaggcaccaccctc

SEQ ID NO: 41763 - DNA, 21 bp, Artificial Sequence
  Description of Artificial Sequence: Synthetic oligonucleotide
atgagcagcaccagaagcatc

SEQ ID NO: 41764 - DNA, 21 bp, Artificial Sequence
  Description of Artificial Sequence: Synthetic oligonucleotide
ccttctacgtcttctgcgggg

SEQ ID NO: 41765 - DNA, 21 bp, Artificial Sequence
  Description of Artificial Sequence: Synthetic oligonucleotide
gtgcctgtgactaagtcgagt

SEQ ID NO: 41766 - DNA, 21 bp, Artificial Sequence
  Description of Artificial Sequence: Synthetic oligonucleotide
ccgggtattaatactaatagt

SEQ ID NO: 41767 - DNA, 21 bp, Artificial Sequence
  Description of Artificial Sequence: Synthetic oligonucleotide
cgttctaatggttcggcggct

SEQ ID NO: 41768 - DNA, 21 bp, Artificial Sequence
  Description of Artificial Sequence: Synthetic oligonucleotide
gagcgggctggtctgaattct

SEQ ID NO: 41769 - DNA, 21 bp, Artificial Sequence
  Description of Artificial Sequence: Synthetic oligonucleotide
gagcggtatactactagtaag

SEQ ID NO: 41770 - DNA, 21 bp, Artificial Sequence
  Description of Artificial Sequence: Synthetic oligonucleotide
ctcagaaacagcaccagcgtc

SEQ ID NO: 41771 - DNA, 21 bp, Artificial Sequence
  Description of Artificial Sequence: Synthetic oligonucleotide
ggggatatggggatttcgaag

SEQ ID NO: 41772 - DNA, 21 bp, Artificial Sequence
  Description of Artificial Sequence: Synthetic oligonucleotide
aacctcaacagcgtcagcaaa

SEQ ID NO: 41773 - DNA, 21 bp, Artificial Sequence
  Description of Artificial Sequence: Synthetic oligonucleotide
ccgccgacccttgagcagagt

SEQ ID NO: 41774 - DNA, 21 bp, Artificial Sequence
  Description of Artificial Sequence: Synthetic oligonucleotide
tatcgtcttgatcattctagg

SEQ ID NO: 41775 - DNA, 21 bp, Artificial Sequence
  Description of Artificial Sequence: Synthetic oligonucleotide
cggaataatccgactacggtt

SEQ ID NO: 41776 - DNA, 21 bp, Artificial Sequence
  Description of Artificial Sequence: Synthetic oligonucleotide
tcttttagtggggctaataag

SEQ ID NO: 41777 - DNA, 21 bp, Artificial Sequence
  Description of Artificial Sequence: Synthetic oligonucleotide
catgtttctcatggtccgggg

SEQ ID NO: 41778 - DNA, 21 bp, Artificial Sequence
  Description of Artificial Sequence: Synthetic oligonucleotide
ccttataagggtaatgggctt

SEQ ID NO: 41779 - DNA, 21 bp, Artificial Sequence
  Description of Artificial Sequence: Synthetic oligonucleotide
ctggtttcgtctaagagtagt

SEQ ID NO: 41780 - DNA, 21 bp, Artificial Sequence
  Description of Artificial Sequence: Synthetic oligonucleotide
ggtagtgcgggtaatatgctt

SEQ ID NO: 41781 - DNA, 21 bp, Artificial Sequence
  Description of Artificial Sequence: Synthetic oligonucleotide
aatacgacgggtcatgctggg

SEQ ID NO: 41782 - DNA, 21 bp, Artificial Sequence
  Description of Artificial Sequence: Synthetic oligonucleotide
aatcctgttgctctgagggat

SEQ ID NO: 41783 - DNA, 21 bp, Artificial Sequence
  Description of Artificial Sequence: Synthetic oligonucleotide
agtgtttctactaagagtgct

SEQ ID NO: 41784 - DNA, 21 bp, Artificial Sequence
  Description of Artificial Sequence: Synthetic oligonucleotide
aggactttgagtgcttcgtcg

SEQ ID NO: 41785 - DNA, 21 bp, Artificial Sequence
  Description of Artificial Sequence: Synthetic oligonucleotide
actgggtcggggaggttgctt

SEQ ID NO: 41786 - DNA, 21 bp, Artificial Sequence
  Description of Artificial Sequence: Synthetic oligonucleotide
gtgggtggtggtcgtgataat

SEQ ID NO: 41787 - DNA, 21 bp, Artificial Sequence
  Description of Artificial Sequence: Synthetic oligonucleotide
agtacgtcgacggttcattcg

SEQ ID NO: 41788 - DNA, 21 bp, Artificial Sequence
  Description of Artificial Sequence: Synthetic oligonucleotide
cccctcatcaacagaaccatg

SEQ ID NO: 41789 - DNA, 21 bp, Artificial Sequence
  Description of Artificial Sequence: Synthetic oligonucleotide
catcagggtaatgttatttct

SEQ ID NO: 41790 - DNA, 21 bp, Artificial Sequence
  Description of Artificial Sequence: Synthetic oligonucleotide
agccaagtcagccacagcgtc

SEQ ID NO: 41791 - DNA, 21 bp, Artificial Sequence
  Description of Artificial Sequence: Synthetic oligonucleotide
tctgttactagtcctaataag

SEQ ID NO: 41792 - DNA, 21 bp, Artificial Sequence
  Description of Artificial Sequence: Synthetic oligonucleotide
cctagtcgggcgtcgattact

SEQ ID NO: 41793 - DNA, 21 bp, Artificial Sequence
  Description of Artificial Sequence: Synthetic oligonucleotide
tcgaaggataggagtactgtt

SEQ ID NO: 41794 - DNA, 21 bp, Artificial Sequence
  Description of Artificial Sequence: Synthetic oligonucleotide
cagacttcggctacgcagcgg

SEQ ID NO: 41795 - DNA, 21 bp, Artificial Sequence
  Description of Artificial Sequence: Synthetic oligonucleotide
tcgtcgagtcctaatgttaag

SEQ ID NO: 41796 - DNA, 21 bp, Artificial Sequence
  Description of Artificial Sequence: Synthetic oligonucleotide
tatagtgggcttactggttcg

SEQ ID NO: 41797 - DNA, 21 bp, Artificial Sequence
  Description of Artificial Sequence: Synthetic oligonucleotide
ctcggccccggcaaaaacacc

SEQ ID NO: 41798 - DNA, 21 bp, Artificial Sequence
  Description of Artificial Sequence: Synthetic oligonucleotide
cagacgggtactagttctact

SEQ ID NO: 41799 - DNA, 21 bp, Artificial Sequence
  Description of Artificial Sequence: Synthetic oligonucleotide
cctatttcgcatacgactggt

SEQ ID NO: 41800 - DNA, 21 bp, Artificial Sequence
  Description of Artificial Sequence: Synthetic oligonucleotide
gctcagacgaagggtactcag

SEQ ID NO: 41801 - DNA, 21 bp, Artificial Sequence
  Description of Artificial Sequence: Synthetic oligonucleotide
gtcctcgccggcagcaacacc

SEQ ID NO: 41802 - DNA, 21 bp, Artificial Sequence
  Description of Artificial Sequence: Synthetic oligonucleotide
caactcagcggcgccagaagc

SEQ ID NO: 41803 - DNA, 21 bp, Artificial Sequence
  Description of Artificial Sequence: Synthetic oligonucleotide
cctggtgataggggtaaggtt

SEQ ID NO: 41804 - DNA, 21 bp, Artificial Sequence
  Description of Artificial Sequence: Synthetic oligonucleotide
agttttactaagggggcgggg

SEQ ID NO: 41805 - DNA, 21 bp, Artificial Sequence
  Description of Artificial Sequence: Synthetic oligonucleotide
ccgtctggggagactagtaag

SEQ ID NO: 41806 - DNA, 21 bp, Artificial Sequence
  Description of Artificial Sequence: Synthetic oligonucleotide
cccagaaacatggaagaaatg

SEQ ID NO: 41807 - DNA, 21 bp, Artificial Sequence
  Description of Artificial Sequence: Synthetic oligonucleotide
ggtccgtcgcagcatgtgatt

SEQ ID NO: 41808 - DNA, 21 bp, Artificial Sequence
  Description of Artificial Sequence: Synthetic oligonucleotide
agtaagactgggactagtttg

SEQ ID NO: 41809 - DNA, 21 bp, Artificial Sequence
  Description of Artificial Sequence: Synthetic oligonucleotide
atgctgaatacttctcattat

SEQ ID NO: 41810 - DNA, 21 bp, Artificial Sequence
  Description of Artificial Sequence: Synthetic oligonucleotide
agaagcggcaccagccacagc

SEQ ID NO: 41811 - DNA, 21 bp, Artificial Sequence
  Description of Artificial Sequence: Synthetic oligonucleotide
agagccgaaatcaacaccaga

SEQ ID NO: 41812 - DNA, 21 bp, Artificial Sequence
  Description of Artificial Sequence: Synthetic oligonucleotide
agtgcttctaatgttagtagg

SEQ ID NO: 41813 - DNA, 21 bp, Artificial Sequence
  Description of Artificial Sequence: Synthetic oligonucleotide
atggaaatcaaacccaacaga

SEQ ID NO: 41814 - DNA, 21 bp, Artificial Sequence
  Description of Artificial Sequence: Synthetic oligonucleotide
ctcagcatgaacaccagcaaa

SEQ ID NO: 41815 - DNA, 21 bp, Artificial Sequence
  Description of Artificial Sequence: Synthetic oligonucleotide
taccaaaacaaaagcctcacc

SEQ ID NO: 41816 - DNA, 21 bp, Artificial Sequence
  Description of Artificial Sequence: Synthetic oligonucleotide
agaagcacccaaagcagcccc

SEQ ID NO: 41817 - DNA, 21 bp, Artificial Sequence
  Description of Artificial Sequence: Synthetic oligonucleotide
caagtcggcagacccaacgcc

SEQ ID NO: 41818 - DNA, 21 bp, Artificial Sequence
  Description of Artificial Sequence: Synthetic oligonucleotide
agcaccaacatggccgtcgtc

SEQ ID NO: 41819 - DNA, 21 bp, Artificial Sequence
  Description of Artificial Sequence: Synthetic oligonucleotide
tctactccgatgtcgaatcgt

SEQ ID NO: 41820 - DNA, 21 bp, Artificial Sequence
  Description of Artificial Sequence: Synthetic oligonucleotide
tctcgtgtgacttctggtggt

SEQ ID NO: 41821 - DNA, 21 bp, Artificial Sequence
  Description of Artificial Sequence: Synthetic oligonucleotide
gctacggtttctaagacggct

SEQ ID NO: 41822 - DNA, 21 bp, Artificial Sequence
  Description of Artificial Sequence: Synthetic oligonucleotide
acgacttcgaataaggatagt

SEQ ID NO: 41823 - DNA, 21 bp, Artificial Sequence
  Description of Artificial Sequence: Synthetic oligonucleotide
aatgtgactacgccgcttatt

SEQ ID NO: 41824 - DNA, 21 bp, Artificial Sequence
  Description of Artificial Sequence: Synthetic oligonucleotide
cataatacggctcatgcttcg

SEQ ID NO: 41825 - DNA, 21 bp, Artificial Sequence
  Description of Artificial Sequence: Synthetic oligonucleotide
aattctaatactcgtggtcct

SEQ ID NO: 41826 - DNA, 21 bp, Artificial Sequence
  Description of Artificial Sequence: Synthetic oligonucleotide
caggtttctccggcgtctcgg

SEQ ID NO: 41827 - DNA, 21 bp, Artificial Sequence
  Description of Artificial Sequence: Synthetic oligonucleotide
tacagcggcggcacccaacaa

SEQ ID NO: 41828 - DNA, 21 bp, Artificial Sequence
  Description of Artificial Sequence: Synthetic oligonucleotide
gctacgaatcattcgccgcag

SEQ ID NO: 41829 - DNA, 21 bp, Artificial Sequence
  Description of Artificial Sequence: Synthetic oligonucleotide
cccaacaacgccaccaaaaac

SEQ ID NO: 41830 - DNA, 21 bp, Artificial Sequence
  Description of Artificial Sequence: Synthetic oligonucleotide
agcagcgccagcacctacaaa

SEQ ID NO: 41831 - DNA, 21 bp, Artificial Sequence
  Description of Artificial Sequence: Synthetic oligonucleotide
ccggtgggttcggtgcggggg

SEQ ID NO: 41832 - DNA, 21 bp, Artificial Sequence
  Description of Artificial Sequence: Synthetic oligonucleotide
agccccgccagagccagcctc

SEQ ID NO: 41833 - DNA, 21 bp, Artificial Sequence
  Description of Artificial Sequence: Synthetic oligonucleotide
tctactccgcatcatacgact

SEQ ID NO: 41834 - DNA, 21 bp, Artificial Sequence
  Description of Artificial Sequence: Synthetic oligonucleotide
ccggttacgcgttctaaggat

SEQ ID NO: 41835 - DNA, 21 bp, Artificial Sequence
  Description of Artificial Sequence: Synthetic oligonucleotide
ccgacgcggacggcgagtaat

SEQ ID NO: 41836 - DNA, 21 bp, Artificial Sequence
  Description of Artificial Sequence: Synthetic oligonucleotide
agtccgaattctcatccttct

SEQ ID NO: 41837 - DNA, 21 bp, Artificial Sequence
  Description of Artificial Sequence: Synthetic oligonucleotide
cagaggacttcggatcagact

SEQ ID NO: 41838 - DNA, 21 bp, Artificial Sequence
  Description of Artificial Sequence: Synthetic oligonucleotide
aacaccagaagcagcagcggc

SEQ ID NO: 41839 - DNA, 21 bp, Artificial Sequence
  Description of Artificial Sequence: Synthetic oligonucleotide
gataggcataatacgacttct

SEQ ID NO: 41840 - DNA, 21 bp, Artificial Sequence
  Description of Artificial Sequence: Synthetic oligonucleotide
aacggcttcaacagcaacaac

SEQ ID NO: 41841 - DNA, 21 bp, Artificial Sequence
  Description of Artificial Sequence: Synthetic oligonucleotide
aaccccgtcaacaccaaaagc

SEQ ID NO: 41842 - DNA, 21 bp, Artificial Sequence
  Description of Artificial Sequence: Synthetic oligonucleotide
atgatgaacagaagcgccagc

SEQ ID NO: 41843 - DNA, 21 bp, Artificial Sequence
  Description of Artificial Sequence: Synthetic oligonucleotide
acttctcggcagtcttttgtg

SEQ ID NO: 41844 - DNA, 21 bp, Artificial Sequence
  Description of Artificial Sequence: Synthetic oligonucleotide
acccaagaccaccacgtcaaa

SEQ ID NO: 41845 - DNA, 21 bp, Artificial Sequence
  Description of Artificial Sequence: Synthetic oligonucleotide
gcgacgcataattcgtctcag

SEQ ID NO: 41846 - DNA, 21 bp, Artificial Sequence
  Description of Artificial Sequence: Synthetic oligonucleotide
ctcccccaaggcagcatcagc

SEQ ID NO: 41847 - DNA, 21 bp, Artificial Sequence
  Description of Artificial Sequence: Synthetic oligonucleotide
cttcttacgtcgcctaattcg

SEQ ID NO: 41848 - DNA, 21 bp, Artificial Sequence
  Description of Artificial Sequence: Synthetic oligonucleotide
aattctagtcataatgtttct

SEQ ID NO: 41849 - DNA, 21 bp, Artificial Sequence
  Description of Artificial Sequence: Synthetic oligonucleotide
tgcctcaccgacgccagagcc

SEQ ID NO: 41850 - DNA, 21 bp, Artificial Sequence
  Description of Artificial Sequence: Synthetic oligonucleotide
ccccaaagcagccaccaaacc

SEQ ID NO: 41851 - DNA, 21 bp, Artificial Sequence
  Description of Artificial Sequence: Synthetic oligonucleotide
ttgcatgctgatcagcatagt

SEQ ID NO: 41852 - DNA, 21 bp, Artificial Sequence
  Description of Artificial Sequence: Synthetic oligonucleotide
agacaactccccagcggcctc

SEQ ID NO: 41853 - DNA, 21 bp, Artificial Sequence
  Description of Artificial Sequence: Synthetic oligonucleotide
agttcggagcagactactcgt

SEQ ID NO: 41854 - DNA, 21 bp, Artificial Sequence
  Description of Artificial Sequence: Synthetic oligonucleotide
accgtcggcaccaccaccatc

SEQ ID NO: 41855 - DNA, 21 bp, Artificial Sequence
  Description of Artificial Sequence: Synthetic oligonucleotide
ctggttcagggtggtgttaat

SEQ ID NO: 41856 - DNA, 21 bp, Artificial Sequence
  Description of Artificial Sequence: Synthetic oligonucleotide
ggccaaagcggcagcagactc

SEQ ID NO: 41857 - DNA, 21 bp, Artificial Sequence
  Description of Artificial Sequence: Synthetic oligonucleotide
gacaccatcaccagcagaggc

SEQ ID NO: 41858 - DNA, 21 bp, Artificial Sequence
  Description of Artificial Sequence: Synthetic oligonucleotide
agttctggtagtaataggtct

SEQ ID NO: 41859 - DNA, 21 bp, Artificial Sequence
  Description of Artificial Sequence: Synthetic oligonucleotide
aatagtgggaagccgaatgcg

SEQ ID NO: 41860 - DNA, 21 bp, Artificial Sequence
  Description of Artificial Sequence: Synthetic oligonucleotide
ggcaacaccaaaaacggcatc

SEQ ID NO: 41861 - DNA, 21 bp, Artificial Sequence
  Description of Artificial Sequence: Synthetic oligonucleotide
attactggttctttgagtaag

SEQ ID NO: 41862 - DNA, 21 bp, Artificial Sequence
  Description of Artificial Sequence: Synthetic oligonucleotide
tctgctaatactaggattgct

SEQ ID NO: 41863 - DNA, 21 bp, Artificial Sequence
  Description of Artificial Sequence: Synthetic oligonucleotide
tcgaatgagactaagtcttcg

SEQ ID NO: 41864 - DNA, 21 bp, Artificial Sequence
  Description of Artificial Sequence: Synthetic oligonucleotide
tacagcatgagacccaccgaa

SEQ ID NO: 41865 - DNA, 21 bp, Artificial Sequence
  Description of Artificial Sequence: Synthetic oligonucleotide
ggccacgacggccaaagcaga

SEQ ID NO: 41866 - DNA, 21 bp, Artificial Sequence
  Description of Artificial Sequence: Synthetic oligonucleotide
aatgctaatagtcgtcctgtt

SEQ ID NO: 41867 - DNA, 21 bp, Artificial Sequence
  Description of Artificial Sequence: Synthetic oligonucleotide
agcaccgtcggccacatgacc

SEQ ID NO: 41868 - DNA, 21 bp, Artificial Sequence
  Description of Artificial Sequence: Synthetic oligonucleotide
cacgccaacagccccgccacc

SEQ ID NO: 41869 - DNA, 21 bp, Artificial Sequence
  Description of Artificial Sequence: Synthetic oligonucleotide
catgatagtcggtcgaatgcg

SEQ ID NO: 41870 - DNA, 21 bp, Artificial Sequence
  Description of Artificial Sequence: Synthetic oligonucleotide
ggcacccccaacaccaaagtc

SEQ ID NO: 41871 - DNA, 21 bp, Artificial Sequence
  Description of Artificial Sequence: Synthetic oligonucleotide
gcgggttctaagacgacgagt

SEQ ID NO: 41872 - DNA, 21 bp, Artificial Sequence
  Description of Artificial Sequence: Synthetic oligonucleotide
ctttcttctgggcggggtggt

SEQ ID NO: 41873 - DNA, 21 bp, Artificial Sequence
  Description of Artificial Sequence: Synthetic oligonucleotide
actaatccgaatccgcatagg

SEQ ID NO: 41874 - DNA, 21 bp, Artificial Sequence
  Description of Artificial Sequence: Synthetic oligonucleotide
gttgtgcctgagaggtctaag

SEQ ID NO: 41875 - DNA, 21 bp, Artificial Sequence
  Description of Artificial Sequence: Synthetic oligonucleotide
caagtcaccggcgccagccac

SEQ ID NO: 41876 - DNA, 21 bp, Artificial Sequence
  Description of Artificial Sequence: Synthetic oligonucleotide
gccgcccaacccagcctcaaa

SEQ ID NO: 41877 - DNA, 21 bp, Artificial Sequence
  Description of Artificial Sequence: Synthetic oligonucleotide
cacatgaacagaaaactcgaa

SEQ ID NO: 41878 - DNA, 21 bp, Artificial Sequence
  Description of Artificial Sequence: Synthetic oligonucleotide
ttgagttcggataagaatgtt

SEQ ID NO: 41879 - DNA, 21 bp, Artificial Sequence
  Description of Artificial Sequence: Synthetic oligonucleotide
ccggggactgggagtaatcat

SEQ ID NO: 41880 - DNA, 21 bp, Artificial Sequence
  Description of Artificial Sequence: Synthetic oligonucleotide
aatagtaatgggttgaataat

SEQ ID NO: 41881 - DNA, 21 bp, Artificial Sequence
  Description of Artificial Sequence: Synthetic oligonucleotide
ggtgcgcgtccggtgcttcag

SEQ ID NO: 41882 - DNA, 21 bp, Artificial Sequence
  Description of Artificial Sequence: Synthetic oligonucleotide
ttccccgtcaacgccggcgcc

SEQ ID NO: 41883 - DNA, 21 bp, Artificial Sequence
  Description of Artificial Sequence: Synthetic oligonucleotide
gacaacatgagcacccccaaa

SEQ ID NO: 41884 - DNA, 21 bp, Artificial Sequence
  Description of Artificial Sequence: Synthetic oligonucleotide
ctcctcgaccaacccagaaac

SEQ ID NO: 41885 - DNA, 21 bp, Artificial Sequence
  Description of Artificial Sequence: Synthetic oligonucleotide
gggcttagtcctgttcttaag

SEQ ID NO: 41886 - DNA, 21 bp, Artificial Sequence
  Description of Artificial Sequence: Synthetic oligonucleotide
ccgagtagtccgaattctatt

SEQ ID NO: 41887 - DNA, 21 bp, Artificial Sequence
  Description of Artificial Sequence: Synthetic oligonucleotide
gtcctcgccggcagcaacacc

SEQ ID NO: 41888 - DNA, 21 bp, Artificial Sequence
  Description of Artificial Sequence: Synthetic oligonucleotide
tattctcgtgttcagagtgag

SEQ ID NO: 41889 - DNA, 21 bp, Artificial Sequence
  Description of Artificial Sequence: Synthetic oligonucleotide
agaccctacgaaacccaactc

SEQ ID NO: 41890 - DNA, 21 bp, Artificial Sequence
  Description of Artificial Sequence: Synthetic oligonucleotide
tacggccaaaccaaaacccaa

SEQ ID NO: 41891 - DNA, 21 bp, Artificial Sequence
  Description of Artificial Sequence: Synthetic oligonucleotide
tctattactgggaataggact

SEQ ID NO: 41892 - DNA, 21 bp, Artificial Sequence
  Description of Artificial Sequence: Synthetic oligonucleotide
agcaaattcagcgaaaccaaa

SEQ ID NO: 41893 - DNA, 21 bp, Artificial Sequence
  Description of Artificial Sequence: Synthetic oligonucleotide
catcgggttgataatcagggg

SEQ ID NO: 41894 - DNA, 21 bp, Artificial Sequence
  Description of Artificial Sequence: Synthetic oligonucleotide
aaaccccaaggcagcctcgtc

SEQ ID NO: 41895 - DNA, 21 bp, Artificial Sequence
  Description of Artificial Sequence: Synthetic oligonucleotide
agcggcagacaagacgtcctc

SEQ ID NO: 41896 - DNA, 21 bp, Artificial Sequence
  Description of Artificial Sequence: Synthetic oligonucleotide
cccagcacccaaagcagcagc

SEQ ID NO: 41897 - DNA, 21 bp, Artificial Sequence
  Description of Artificial Sequence: Synthetic oligonucleotide
agtggtagtaatactattggg

SEQ ID NO: 41898 - DNA, 21 bp, Artificial Sequence
  Description of Artificial Sequence: Synthetic oligonucleotide
ggtacgaatactgggattgtt

SEQ ID NO: 41899 - DNA, 21 bp, Artificial Sequence
  Description of Artificial Sequence: Synthetic oligonucleotide
ggcccccacaccgccgtcggc

SEQ ID NO: 41900 - DNA, 21 bp, Artificial Sequence
  Description of Artificial Sequence: Synthetic oligonucleotide
ttcagcaacaacggcagccac

SEQ ID NO: 41901 - DNA, 21 bp, Artificial Sequence
  Description of Artificial Sequence: Synthetic oligonucleotide
aattctagtcataatgtttct

SEQ ID NO: 41902 - DNA, 21 bp, Artificial Sequence
  Description of Artificial Sequence: Synthetic oligonucleotide
agaatcaccagcagcaaccaa

SEQ ID NO: 41903 - DNA, 21 bp, Artificial Sequence
  Description of Artificial Sequence: Synthetic oligonucleotide
atgggtgggcatacgcatacg

SEQ ID NO: 41904 - DNA, 21 bp, Artificial Sequence
  Description of Artificial Sequence: Synthetic oligonucleotide
ctgcctcaggggtcgatttct

SEQ ID NO: 41905 - DNA, 21 bp, Artificial Sequence
  Description of Artificial Sequence: Synthetic oligonucleotide
ggtgatactcgtctgaatgcg

SEQ ID NO: 41906 - DNA, 21 bp, Artificial Sequence
  Description of Artificial Sequence: Synthetic oligonucleotide
ctgaggaatagtacgagtgtg

SEQ ID NO: 41907 - DNA, 21 bp, Artificial Sequence
  Description of Artificial Sequence: Synthetic oligonucleotide
agagaaagcagccccagcctc

SEQ ID NO: 41908 - DNA, 21 bp, Artificial Sequence
  Description of Artificial Sequence: Synthetic oligonucleotide
atcggccaaagcaccaacggc

SEQ ID NO: 41909 - DNA, 21 bp, Artificial Sequence
  Description of Artificial Sequence: Synthetic oligonucleotide
gttgtgcctgagaggtctaag

SEQ ID NO: 41910 - DNA, 21 bp, Artificial Sequence
  Description of Artificial Sequence: Synthetic oligonucleotide
aacttcagcaaccccaccgtc

SEQ ID NO: 41911 - DNA, 21 bp, Artificial Sequence
  Description of Artificial Sequence: Synthetic oligonucleotide
atcacccccagcaacatcggc

SEQ ID NO: 41912 - DNA, 21 bp, Artificial Sequence
  Description of Artificial Sequence: Synthetic oligonucleotide
cccaacaaccaaagcaccaga

SEQ ID NO: 41913 - DNA, 21 bp, Artificial Sequence
  Description of Artificial Sequence: Synthetic oligonucleotide
ggtagggctcagcttgcgtcg

SEQ ID NO: 41914 - DNA, 21 bp, Artificial Sequence
  Description of Artificial Sequence: Synthetic oligonucleotide
agttctactccgcggtctgtg

SEQ ID NO: 41915 - DNA, 21 bp, Artificial Sequence
  Description of Artificial Sequence: Synthetic oligonucleotide
gaaagacccggcggcaccccc

SEQ ID NO: 41916 - DNA, 21 bp, Artificial Sequence
  Description of Artificial Sequence: Synthetic oligonucleotide
gccggcgaaaacaaactcagc

SEQ ID NO: 41917 - DNA, 21 bp, Artificial Sequence
  Description of Artificial Sequence: Synthetic oligonucleotide
tgtcagcctcggtctgctaat

SEQ ID NO: 41918 - DNA, 21 bp, Artificial Sequence
  Description of Artificial Sequence: Synthetic oligonucleotide
caagtccccaccagaagcgac

SEQ ID NO: 41919 - DNA, 21 bp, Artificial Sequence
  Description of Artificial Sequence: Synthetic oligonucleotide
gatcatcgtaatacggttcgg

SEQ ID NO: 41920 - DNA, 21 bp, Artificial Sequence
  Description of Artificial Sequence: Synthetic oligonucleotide
gaaagcaacagaagccaagtc

SEQ ID NO: 41921 - DNA, 21 bp, Artificial Sequence
  Description of Artificial Sequence: Synthetic oligonucleotide
cttatgcagactcatgggtct

SEQ ID NO: 41922 - DNA, 21 bp, Artificial Sequence
  Description of Artificial Sequence: Synthetic oligonucleotide
tctactacgggtgattcgaag

SEQ ID NO: 41923 - DNA, 21 bp, Artificial Sequence
  Description of Artificial Sequence: Synthetic oligonucleotide
cccgtcagcacccacagcagc

SEQ ID NO: 41924 - DNA, 21 bp, Artificial Sequence
  Description of Artificial Sequence: Synthetic oligonucleotide
aatgaggctcggtcggcgaat

SEQ ID NO: 41925 - DNA, 21 bp, Artificial Sequence
  Description of Artificial Sequence: Synthetic oligonucleotide
gcctaccccaaaaacagcaac

SEQ ID NO: 41926 - DNA, 21 bp, Artificial Sequence
  Description of Artificial Sequence: Synthetic oligonucleotide
ggccaagtcaaccacaccacc

SEQ ID NO: 41927 - DNA, 21 bp, Artificial Sequence
  Description of Artificial Sequence: Synthetic oligonucleotide
caagcccaaggcagcatgcaa

SEQ ID NO: 41928 - DNA, 21 bp, Artificial Sequence
  Description of Artificial Sequence: Synthetic oligonucleotide
tcggtgacgccgcatgttacg

SEQ ID NO: 41929 - DNA, 21 bp, Artificial Sequence
  Description of Artificial Sequence: Synthetic oligonucleotide
aattcgagttcgtctaatcat

SEQ ID NO: 41930 - DNA, 21 bp, Artificial Sequence
  Description of Artificial Sequence: Synthetic oligonucleotide
tttagtgcgagtggggcgagg

SEQ ID NO: 41931 - DNA, 21 bp, Artificial Sequence
  Description of Artificial Sequence: Synthetic oligonucleotide
cccgtcggcaccaaaagcggc

SEQ ID NO: 41932 - DNA, 21 bp, Artificial Sequence
  Description of Artificial Sequence: Synthetic oligonucleotide
ccgcttaatgctcggggtagt

SEQ ID NO: 41933 - DNA, 21 bp, Artificial Sequence
  Description of Artificial Sequence: Synthetic oligonucleotide
agacccgtcgtcgccagcacc

SEQ ID NO: 41934 - DNA, 21 bp, Artificial Sequence
  Description of Artificial Sequence: Synthetic oligonucleotide
cctaatcttcagtcttcgaag

SEQ ID NO: 41935 - DNA, 21 bp, Artificial Sequence
  Description of Artificial Sequence: Synthetic oligonucleotide
ggcggcctcgaccaccacgcc

SEQ ID NO: 41936 - DNA, 21 bp, Artificial Sequence
  Description of Artificial Sequence: Synthetic oligonucleotide
ggccacggcaacaacggcgcc

SEQ ID NO: 41937 - DNA, 21 bp, Artificial Sequence
  Description of Artificial Sequence: Synthetic oligonucleotide
agaaccctcagcgccagcagc

SEQ ID NO: 41938 - DNA, 21 bp, Artificial Sequence
  Description of Artificial Sequence: Synthetic oligonucleotide
gctactgggaatgggcggggg

SEQ ID NO: 41939 - DNA, 21 bp, Artificial Sequence
  Description of Artificial Sequence: Synthetic oligonucleotide
gggtcggggcatggtacgaat

SEQ ID NO: 41940 - DNA, 21 bp, Artificial Sequence
  Description of Artificial Sequence: Synthetic oligonucleotide
tcgcctgggaataagctgctt

SEQ ID NO: 41941 - DNA, 21 bp, Artificial Sequence
  Description of Artificial Sequence: Synthetic oligonucleotide
tcgcataattcgaaggattct

SEQ ID NO: 41942 - DNA, 21 bp, Artificial Sequence
  Description of Artificial Sequence: Synthetic oligonucleotide
tacgtcagcaacagcaacgcc

SEQ ID NO: 41943 - DNA, 21 bp, Artificial Sequence
  Description of Artificial Sequence: Synthetic oligonucleotide
agcagcggcagcaacagaagc

SEQ ID NO: 41944 - DNA, 21 bp, Artificial Sequence
  Description of Artificial Sequence: Synthetic oligonucleotide
aacggttctggacagaataaa

SEQ ID NO: 41945 - DNA, 21 bp, Artificial Sequence
  Description of Artificial Sequence: Synthetic oligonucleotide
ccttctcagactaagccgagt

SEQ ID NO: 41946 - DNA, 21 bp, Artificial Sequence
  Description of Artificial Sequence: Synthetic oligonucleotide
ggtacttcgacgtctcttcgg

SEQ ID NO: 41947 - DNA, 21 bp, Artificial Sequence
  Description of Artificial Sequence: Synthetic oligonucleotide
aacggcagcggcctcaaccaa

SEQ ID NO: 41948 - DNA, 21 bp, Artificial Sequence
  Description of Artificial Sequence: Synthetic oligonucleotide
aatcgggttactcagagtagt

SEQ ID NO: 41949 - DNA, 21 bp, Artificial Sequence
  Description of Artificial Sequence: Synthetic oligonucleotide
cagactcgtagtaatggtaat

SEQ ID NO: 41950 - DNA, 21 bp, Artificial Sequence
  Description of Artificial Sequence: Synthetic oligonucleotide
agcggcagcaccaaaggccaa

SEQ ID NO: 41951 - DNA, 21 bp, Artificial Sequence
  Description of Artificial Sequence: Synthetic oligonucleotide
acgccttctgtgtcgactaag

SEQ ID NO: 41952 - DNA, 21 bp, Artificial Sequence
  Description of Artificial Sequence: Synthetic oligonucleotide
gcccaaatcaacacccccacc

SEQ ID NO: 41953 - DNA, 21 bp, Artificial Sequence
  Description of Artificial Sequence: Synthetic oligonucleotide
gggcatgtgtctcctgctttt

SEQ ID NO: 41954 - DNA, 21 bp, Artificial Sequence
  Description of Artificial Sequence: Synthetic oligonucleotide
gctccttcggcgcggccgagt

SEQ ID NO: 41955 - DNA, 21 bp, Artificial Sequence
  Description of Artificial Sequence: Synthetic oligonucleotide
cccaccagcttcagcggcacc

SEQ ID NO: 41956 - DNA, 21 bp, Artificial Sequence
  Description of Artificial Sequence: Synthetic oligonucleotide
cctaggttgaatgtgggtggt

SEQ ID NO: 41957 - DNA, 21 bp, Artificial Sequence
  Description of Artificial Sequence: Synthetic oligonucleotide
cggcataatactattgcgggt

SEQ ID NO: 41958 - DNA, 21 bp, Artificial Sequence
  Description of Artificial Sequence: Synthetic oligonucleotide
cgtggggtttcgactccgact

SEQ ID NO: 41959 - DNA, 21 bp, Artificial Sequence
  Description of Artificial Sequence: Synthetic oligonucleotide
cccagagtccaccccctcgtc

SEQ ID NO: 41960 - DNA, 21 bp, Artificial Sequence
  Description of Artificial Sequence: Synthetic oligonucleotide
caggataagcataatcctggt

SEQ ID NO: 41961 - DNA, 21 bp, Artificial Sequence
  Description of Artificial Sequence: Synthetic oligonucleotide
aataatgctcatagttcgtct

SEQ ID NO: 41962 - DNA, 21 bp, Artificial Sequence
  Description of Artificial Sequence: Synthetic oligonucleotide
gagtctcctaatcttcattcg

SEQ ID NO: 41963 - DNA, 21 bp, Artificial Sequence
  Description of Artificial Sequence: Synthetic oligonucleotide
agtagggagcagggggttggg

SEQ ID NO: 41964 - DNA, 21 bp, Artificial Sequence
  Description of Artificial Sequence: Synthetic oligonucleotide
aacgattctggacagaatcaa

SEQ ID NO: 41965 - DNA, 21 bp, Artificial Sequence
  Description of Artificial Sequence: Synthetic oligonucleotide
agtcttactaattcggctttg

SEQ ID NO: 41966 - DNA, 21 bp, Artificial Sequence
  Description of Artificial Sequence: Synthetic oligonucleotide
caaaccagaaccgacgtcacc

SEQ ID NO: 41967 - DNA, 21 bp, Artificial Sequence
  Description of Artificial Sequence: Synthetic oligonucleotide
atggctcatgatggttatcgg

SEQ ID NO: 41968 - DNA, 21 bp, Artificial Sequence
  Description of Artificial Sequence: Synthetic oligonucleotide
aactgttctggacagaatcaa

SEQ ID NO: 41969 - DNA, 21 bp, Artificial Sequence
  Description of Artificial Sequence: Synthetic oligonucleotide
tcgatggggaattcgattagt

SEQ ID NO: 41970 - DNA, 21 bp, Artificial Sequence
  Description of Artificial Sequence: Synthetic oligonucleotide
tttccggttactgggctgagt

SEQ ID NO: 41971 - DNA, 21 bp, Artificial Sequence
  Description of Artificial Sequence: Synthetic oligonucleotide
gcgattcctgctgtgtctatg

SEQ ID NO: 41972 - DNA, 21 bp, Artificial Sequence
  Description of Artificial Sequence: Synthetic oligonucleotide
ggtgttacttctagtgggcct

SEQ ID NO: 41973 - DNA, 21 bp, Artificial Sequence
  Description of Artificial Sequence: Synthetic oligonucleotide
tctatttcgcatgctcgtgag

SEQ ID NO: 41974 - DNA, 21 bp, Artificial Sequence
  Description of Artificial Sequence: Synthetic oligonucleotide
ctttcgccgacttctactaat

SEQ ID NO: 41975 - DNA, 21 bp, Artificial Sequence
  Description of Artificial Sequence: Synthetic oligonucleotide
aaaagcaacagcagcctcggc

SEQ ID NO: 41976 - DNA, 21 bp, Artificial Sequence
  Description of Artificial Sequence: Synthetic oligonucleotide
ggtattgatactaagatgttg

SEQ ID NO: 41977 - DNA, 21 bp, Artificial Sequence
  Description of Artificial Sequence: Synthetic oligonucleotide
aacggttctggacagactcaa

SEQ ID NO: 41978 - DNA, 21 bp, Artificial Sequence
  Description of Artificial Sequence: Synthetic oligonucleotide
gacggttctggacagaatcaa

SEQ ID NO: 41979 - DNA, 21 bp, Artificial Sequence
  Description of Artificial Sequence: Synthetic oligonucleotide
gatattatgtctcctttgaag

SEQ ID NO: 41980 - DNA, 21 bp, Artificial Sequence
  Description of Artificial Sequence: Synthetic oligonucleotide
aacggttctggacggaatcaa

SEQ ID NO: 41981 - DNA, 21 bp, Artificial Sequence
  Description of Artificial Sequence: Synthetic oligonucleotide
aacggttctggacagaatcca

SEQ ID NO: 41982 - DNA, 21 bp, Artificial Sequence
  Description of Artificial Sequence: Synthetic oligonucleotide
tcgccggcgagggcttctctt

SEQ ID NO: 41983 - DNA, 21 bp, Artificial Sequence
  Description of Artificial Sequence: Synthetic oligonucleotide
tctattacgtctgttactaat

SEQ ID NO: 41984 - DNA, 21 bp, Artificial Sequence
  Description of Artificial Sequence: Synthetic oligonucleotide
catacgtctccggggaagaat

SEQ ID NO: 41985 - DNA, 21 bp, Artificial Sequence
  Description of Artificial Sequence: Synthetic oligonucleotide
cttgctagtggtactccttcg

SEQ ID NO: 41986 - DNA, 21 bp, Artificial Sequence
  Description of Artificial Sequence: Synthetic oligonucleotide
aacggttctgaacagaatcaa

SEQ ID NO: 41987 - DNA, 21 bp, Artificial Sequence
  Description of Artificial Sequence: Synthetic oligonucleotide
aacggtactggacagaatcaa

SEQ ID NO: 41988 - DNA, 21 bp, Artificial Sequence
  Description of Artificial Sequence: Synthetic oligonucleotide
aacggcagcggccaaaaacaa

SEQ ID NO: 41989 - DNA, 21 bp, Artificial Sequence
  Description of Artificial Sequence: Synthetic oligonucleotide
aacggttctggagagaatcaa

SEQ ID NO: 41990 - DNA, 21 bp, Artificial Sequence
  Description of Artificial Sequence: Synthetic oligonucleotide
cgtgttacggatgctcatctt

SEQ ID NO: 41991 - DNA, 21 bp, Artificial Sequence
  Description of Artificial Sequence: Synthetic oligonucleotide
aacggttgtggacagaatcaa

SEQ ID NO: 41992 - DNA, 21 bp, Artificial Sequence
  Description of Artificial Sequence: Synthetic oligonucleotide
aacggttctggacagaatgaa

SEQ ID NO: 41993 - DNA, 21 bp, Artificial Sequence
  Description of Artificial Sequence: Synthetic oligonucleotide
cgtctggatatttctaataag

SEQ ID NO: 41994 - DNA, 21 bp, Artificial Sequence
  Description of Artificial Sequence: Synthetic oligonucleotide
catatgccttcgtgtgggggt

SEQ ID NO: 41995 - DNA, 21 bp, Artificial Sequence
  Description of Artificial Sequence: Synthetic oligonucleotide
aacggttctggacataatcaa

SEQ ID NO: 41996 - DNA, 21 bp, Artificial Sequence
  Description of Artificial Sequence: Synthetic oligonucleotide
aacggtgctggacagaatcaa

SEQ ID NO: 41997 - DNA, 21 bp, Artificial Sequence
  Description of Artificial Sequence: Synthetic oligonucleotide
catcttggttcggattcgcgg

SEQ ID NO: 41998 - DNA, 21 bp, Artificial Sequence
  Description of Artificial Sequence: Synthetic oligonucleotide
aacggttctggacaggatcaa

SEQ ID NO: 41999 - DNA, 21 bp, Artificial Sequence
  Description of Artificial Sequence: Synthetic oligonucleotide
aacggttctggacagcatcaa

SEQ ID NO: 42000 - DNA, 21 bp, Artificial Sequence
  Description of Artificial Sequence: Synthetic oligonucleotide
actattaagtctgttactaat

SEQ ID NO: 42001 - DNA, 21 bp, Artificial Sequence
  Description of Artificial Sequence: Synthetic oligonucleotide
aacggttctggacagaatcga

SEQ ID NO: 42002 - DNA, 21 bp, Artificial Sequence
  Description of Artificial Sequence: Synthetic oligonucleotide
aacggttctggacagagtcaa

SEQ ID NO: 42003 - DNA, 21 bp, Artificial Sequence
  Description of Artificial Sequence: Synthetic oligonucleotide
aacgtttctggacagaatcaa

SEQ ID NO: 42004 - DNA, 21 bp, Artificial Sequence
  Description of Artificial Sequence: Synthetic oligonucleotide
accggttctggacagaatcaa

SEQ ID NO: 42005 - DNA, 21 bp, Artificial Sequence
  Description of Artificial Sequence: Synthetic oligonucleotide
aacggttctggacagattcaa

SEQ ID NO: 42006 - DNA, 21 bp, Artificial Sequence
  Description of Artificial Sequence: Synthetic oligonucleotide
aactggtctggacagaatcaa

SEQ ID NO: 42007 - DNA, 21 bp, Artificial Sequence
  Description of Artificial Sequence: Synthetic oligonucleotide
agtgctgttgggaaggcgagt

SEQ ID NO: 42008 - DNA, 21 bp, Artificial Sequence
  Description of Artificial Sequence: Synthetic oligonucleotide
gccatctacagcgaatacaaa

SEQ ID NO: 42009 - DNA, 21 bp, Artificial Sequence
  Description of Artificial Sequence: Synthetic oligonucleotide
aacggttatggacagaatcaa

SEQ ID NO: 42010 - DNA, 21 bp, Artificial Sequence
  Description of Artificial Sequence: Synthetic oligonucleotide
aacggttctggaccgaatcaa

SEQ ID NO: 42011 - DNA, 21 bp, Artificial Sequence
  Description of Artificial Sequence: Synthetic oligonucleotide
aacggttttggacagaatcaa

SEQ ID NO: 42012 - DNA, 21 bp, Artificial Sequence
  Description of Artificial Sequence: Synthetic oligonucleotide
ccggggtctgggagtaataat

SEQ ID NO: 42013 - DNA, 21 bp, Artificial Sequence
  Description of Artificial Sequence: Synthetic oligonucleotide
aacggttctgcacagaatcaa

SEQ ID NO: 42014 - DNA, 21 bp, Artificial Sequence
  Description of Artificial Sequence: Synthetic oligonucleotide
tcgggtgcgactacgcctagg

SEQ ID NO: 42015 - DNA, 21 bp, Artificial Sequence
  Description of Artificial Sequence: Synthetic oligonucleotide
acgacttatggtagtctgggg

SEQ ID NO: 42016 - DNA, 21 bp, Artificial Sequence
  Description of Artificial Sequence: Synthetic oligonucleotide
atgccgagtcagagggatggt

SEQ ID NO: 42017 - DNA, 21 bp, Artificial Sequence
  Description of Artificial Sequence: Synthetic oligonucleotide
agcggttctggacagaatcaa

SEQ ID NO: 42018 - DNA, 21 bp, Artificial Sequence
  Description of Artificial Sequence: Synthetic oligonucleotide
aacgcttctggacagaatcaa

SEQ ID NO: 42019 - DNA, 21 bp, Artificial Sequence
  Description of Artificial Sequence: Synthetic oligonucleotide
aacagttctggacagaatcaa

SEQ ID NO: 42020 - DNA, 21 bp, Artificial Sequence
  Description of Artificial Sequence: Synthetic oligonucleotide
aacggtcctggacagaatcaa

SEQ ID NO: 42021 - DNA, 21 bp, Artificial Sequence
  Description of Artificial Sequence: Synthetic oligonucleotide
aacggttctagacagaatcaa

SEQ ID NO: 42022 - DNA, 21 bp, Artificial Sequence
  Description of Artificial Sequence: Synthetic oligonucleotide
acccccggcgccagcctcagc

SEQ ID NO: 42023 - DNA, 21 bp, Artificial Sequence
  Description of Artificial Sequence: Synthetic oligonucleotide
agccccaccagccccatgaac

SEQ ID NO: 42024 - DNA, 21 bp, Artificial Sequence
  Description of Artificial Sequence: Synthetic oligonucleotide
aaaggttctggacagaatcaa

SEQ ID NO: 42025 - DNA, 21 bp, Artificial Sequence
  Description of Artificial Sequence: Synthetic oligonucleotide
agtggtgttgagcgggttaat

SEQ ID NO: 42026 - DNA, 21 bp, Artificial Sequence
  Description of Artificial Sequence: Synthetic oligonucleotide
cgtgatacgagggagagtcag

SEQ ID NO: 42027 - DNA, 21 bp, Artificial Sequence
  Description of Artificial Sequence: Synthetic oligonucleotide
gctggtgagggtatgtatgct

SEQ ID NO: 42028 - DNA, 21 bp, Artificial Sequence
  Description of Artificial Sequence: Synthetic oligonucleotide
atcggcagcggccaaaaccaa

SEQ ID NO: 42029 - DNA, 21 bp, Artificial Sequence
  Description of Artificial Sequence: Synthetic oligonucleotide
attaatagtggtaatggttcg

SEQ ID NO: 42030 - DNA, 21 bp, Artificial Sequence
  Description of Artificial Sequence: Synthetic oligonucleotide
agcgtcagcaccaacttcagc

SEQ ID NO: 42031 - DNA, 21 bp, Artificial Sequence
  Description of Artificial Sequence: Synthetic oligonucleotide
cacggttctggacagaatcaa

SEQ ID NO: 42032 - DNA, 21 bp, Artificial Sequence
  Description of Artificial Sequence: Synthetic oligonucleotide
ccggggtctgggagtaatcat

SEQ ID NO: 42033 - DNA, 21 bp, Artificial Sequence
  Description of Artificial Sequence: Synthetic oligonucleotide
aacggttctgtacagaatcaa

SEQ ID NO: 42034 - DNA, 21 bp, Artificial Sequence
  Description of Artificial Sequence: Synthetic oligonucleotide
ttcagaagcaaagaaagcgcc

SEQ ID NO: 42035 - DNA, 21 bp, Artificial Sequence
  Description of Artificial Sequence: Synthetic oligonucleotide
cagtatatgggggctaattct

SEQ ID NO: 42036 - DNA, 21 bp, Artificial Sequence
  Description of Artificial Sequence: Synthetic oligonucleotide
cccttcggcagcagcgccaga

SEQ ID NO: 42037 - DNA, 21 bp, Artificial Sequence
  Description of Artificial Sequence: Synthetic oligonucleotide
tcgaatgagactaagtcttcg

SEQ ID NO: 42038 - DNA, 21 bp, Artificial Sequence
  Description of Artificial Sequence: Synthetic oligonucleotide
ccgggtattaatactaatagt

SEQ ID NO: 42039 - DNA, 21 bp, Artificial Sequence
  Description of Artificial Sequence: Synthetic oligonucleotide
agcagaaacagccccccccaa

SEQ ID NO: 42040 - DNA, 21 bp, Artificial Sequence
  Description of Artificial Sequence: Synthetic oligonucleotide
cggctggatggtctgtctcgt

SEQ ID NO: 42041 - DNA, 21 bp, Artificial Sequence
  Description of Artificial Sequence: Synthetic oligonucleotide
tcgtctcaggcgcagccgact

SEQ ID NO: 42042 - DNA, 21 bp, Artificial Sequence
  Description of Artificial Sequence: Synthetic oligonucleotide
catcttagtcattcgccgact

SEQ ID NO: 42043 - DNA, 21 bp, Artificial Sequence
  Description of Artificial Sequence: Synthetic oligonucleotide
agggctacgccgctttctggt

SEQ ID NO: 42044 - DNA, 21 bp, Artificial Sequence
  Description of Artificial Sequence: Synthetic oligonucleotide
atgggggcggtgtctgtgagt

SEQ ID NO: 42045 - DNA, 21 bp, Artificial Sequence
  Description of Artificial Sequence: Synthetic oligonucleotide
gattatcataatagtaagctg

SEQ ID NO: 42046 - DNA, 21 bp, Artificial Sequence
  Description of Artificial Sequence: Synthetic oligonucleotide
aaaaacgccaccggcatcctc

SEQ ID NO: 42047 - DNA, 21 bp, Artificial Sequence
  Description of Artificial Sequence: Synthetic oligonucleotide
tgcaacaacgccagagtcagc

SEQ ID NO: 42048 - DNA, 21 bp, Artificial Sequence
  Description of Artificial Sequence: Synthetic oligonucleotide
ggcaccgccagcggcgtcgcc

SEQ ID NO: 42049 - DNA, 21 bp, Artificial Sequence
  Description of Artificial Sequence: Synthetic oligonucleotide
ggccaaagcggcagcagactc

SEQ ID NO: 42050 - DNA, 21 bp, Artificial Sequence
  Description of Artificial Sequence: Synthetic oligonucleotide
aacaacgccgccacccacagc

SEQ ID NO: 42051 - DNA, 21 bp, Artificial Sequence
  Description of Artificial Sequence: Synthetic oligonucleotide
cccggcagcggcagcaaacac

SEQ ID NO: 42052 - DNA, 21 bp, Artificial Sequence
  Description of Artificial Sequence: Synthetic oligonucleotide
gcgcgggctagttctaattcg

SEQ ID NO: 42053 - DNA, 21 bp, Artificial Sequence
  Description of Artificial Sequence: Synthetic oligonucleotide
gaacccctcagcaaacaaagc

SEQ ID NO: 42054 - DNA, 21 bp, Artificial Sequence
  Description of Artificial Sequence: Synthetic oligonucleotide
tacagcagacccaccaccacc

SEQ ID NO: 42055 - DNA, 21 bp, Artificial Sequence
  Description of Artificial Sequence: Synthetic oligonucleotide
aacaggtctggacagaatcaa

SEQ ID NO: 42056 - DNA, 21 bp, Artificial Sequence
  Description of Artificial Sequence: Synthetic oligonucleotide
gaatacccccaacaagccaaa

SEQ ID NO: 42057 - DNA, 21 bp, Artificial Sequence
  Description of Artificial Sequence: Synthetic oligonucleotide
atggggggtgttacgtcttct

SEQ ID NO: 42058 - DNA, 21 bp, Artificial Sequence
  Description of Artificial Sequence: Synthetic oligonucleotide
cacaccgacatcaaccaccaa

SEQ ID NO: 42059 - DNA, 21 bp, Artificial Sequence
  Description of Artificial Sequence: Synthetic oligonucleotide
catgtgcatgatgggaggact

SEQ ID NO: 42060 - DNA, 21 bp, Artificial Sequence
  Description of Artificial Sequence: Synthetic oligonucleotide
gaaagcgccacccccatcaga

SEQ ID NO: 42061 - DNA, 21 bp, Artificial Sequence
  Description of Artificial Sequence: Synthetic oligonucleotide
tacggttctggacagaatcaa

SEQ ID NO: 42062 - DNA, 21 bp, Artificial Sequence
  Description of Artificial Sequence: Synthetic oligonucleotide
gttccttctcagagtcttcat

SEQ ID NO: 42063 - DNA, 21 bp, Artificial Sequence
  Description of Artificial Sequence: Synthetic oligonucleotide
agcaacacccacagccccagc

SEQ ID NO: 42064 - DNA, 21 bp, Artificial Sequence
  Description of Artificial Sequence: Synthetic oligonucleotide
ggtcagactcttcctatttgt

SEQ ID NO: 42065 - DNA, 21 bp, Artificial Sequence
  Description of Artificial Sequence: Synthetic oligonucleotide
aaggtggataagaggactgat

SEQ ID NO: 42066 - DNA, 21 bp, Artificial Sequence
  Description of Artificial Sequence: Synthetic oligonucleotide
cggacgggtagttatacgcag

SEQ ID NO: 42067 - DNA, 21 bp, Artificial Sequence
  Description of Artificial Sequence: Synthetic oligonucleotide
aacggcagaccccaattcaga

SEQ ID NO: 42068 - DNA, 21 bp, Artificial Sequence
  Description of Artificial Sequence: Synthetic oligonucleotide
gatccggttacgaggaagagg

SEQ ID NO: 42069 - DNA, 21 bp, Artificial Sequence
  Description of Artificial Sequence: Synthetic oligonucleotide
gccgacagcaacagacccggc

SEQ ID NO: 42070 - DNA, 21 bp, Artificial Sequence
  Description of Artificial Sequence: Synthetic oligonucleotide
atcacccccggcggccacagc

SEQ ID NO: 42071 - DNA, 21 bp, Artificial Sequence
  Description of Artificial Sequence: Synthetic oligonucleotide
aagcatgagggttataatgtg

SEQ ID NO: 42072 - DNA, 21 bp, Artificial Sequence
  Description of Artificial Sequence: Synthetic oligonucleotide
atcaaactcgacaaacaaatc

SEQ ID NO: 42073 - DNA, 21 bp, Artificial Sequence
  Description of Artificial Sequence: Synthetic oligonucleotide
cccagaagcaacaaatacccc

SEQ ID NO: 42074 - DNA, 21 bp, Artificial Sequence
  Description of Artificial Sequence: Synthetic oligonucleotide
aagattaatactcgtaatatg

SEQ ID NO: 42075 - DNA, 21 bp, Artificial Sequence
  Description of Artificial Sequence: Synthetic oligonucleotide
tttcattctagggatagttct

SEQ ID NO: 42076 - DNA, 21 bp, Artificial Sequence
  Description of Artificial Sequence: Synthetic oligonucleotide
tatattaagtctgttactaat

SEQ ID NO: 42077 - DNA, 21 bp, Artificial Sequence
  Description of Artificial Sequence: Synthetic oligonucleotide
aaccccggcagacaacaattc

SEQ ID NO: 42078 - DNA, 21 bp, Artificial Sequence
  Description of Artificial Sequence: Synthetic oligonucleotide
atcatccaaaaccaaagcaaa

SEQ ID NO: 42079 - DNA, 21 bp, Artificial Sequence
  Description of Artificial Sequence: Synthetic oligonucleotide
accagcagcggccacagcgtc

SEQ ID NO: 42080 - DNA, 21 bp, Artificial Sequence
  Description of Artificial Sequence: Synthetic oligonucleotide
tacagaaaacacaccagcacc

SEQ ID NO: 42081 - DNA, 21 bp, Artificial Sequence
  Description of Artificial Sequence: Synthetic oligonucleotide
agcatgaccagcagaaacagc

SEQ ID NO: 42082 - DNA, 21 bp, Artificial Sequence
  Description of Artificial Sequence: Synthetic oligonucleotide
gaccaaaaaaccgtcaacaga

SEQ ID NO: 42083 - DNA, 21 bp, Artificial Sequence
  Description of Artificial Sequence: Synthetic oligonucleotide
aattcggggaggaattctgtt

SEQ ID NO: 42084 - DNA, 21 bp, Artificial Sequence
  Description of Artificial Sequence: Synthetic oligonucleotide
cctgagattggtaagcagcgg

SEQ ID NO: 42085 - DNA, 21 bp, Artificial Sequence
  Description of Artificial Sequence: Synthetic oligonucleotide
cccatcagcagcagagccggc

SEQ ID NO: 42086 - DNA, 21 bp, Artificial Sequence
  Description of Artificial Sequence: Synthetic oligonucleotide
aatggttttaatagtaataat

SEQ ID NO: 42087 - DNA, 21 bp, Artificial Sequence
  Description of Artificial Sequence: Synthetic oligonucleotide
ttccccggcggcaaccacacc

SEQ ID NO: 42088 - DNA, 21 bp, Artificial Sequence
  Description of Artificial Sequence: Synthetic oligonucleotide
tcttctgggggtaatatgagt

SEQ ID NO: 42089 - DNA, 21 bp, Artificial Sequence
  Description of Artificial Sequence: Synthetic oligonucleotide
tataatcggacttctattgtg

SEQ ID NO: 42090 - DNA, 21 bp, Artificial Sequence
  Description of Artificial Sequence: Synthetic oligonucleotide
atgagcagaagcgaccccccc

SEQ ID NO: 42091 - DNA, 21 bp, Artificial Sequence
  Description of Artificial Sequence: Synthetic oligonucleotide
agtccgaatgcgaagcgtgtt

SEQ ID NO: 42092 - DNA, 21 bp, Artificial Sequence
  Description of Artificial Sequence: Synthetic oligonucleotide
agacaactccccagcggcctc

SEQ ID NO: 42093 - DNA, 21 bp, Artificial Sequence
  Description of Artificial Sequence: Synthetic oligonucleotide
ggcagctacagcaaccccacc

SEQ ID NO: 42094 - DNA, 21 bp, Artificial Sequence
  Description of Artificial Sequence: Synthetic oligonucleotide
ggccaaaacagaaacaacacc

SEQ ID NO: 42095 - DNA, 21 bp, Artificial Sequence
  Description of Artificial Sequence: Synthetic oligonucleotide
agcaactacaaaagcagcaac

SEQ ID NO: 42096 - DNA, 21 bp, Artificial Sequence
  Description of Artificial Sequence: Synthetic oligonucleotide
atgccccaccccagcagcaaa

SEQ ID NO: 42097 - DNA, 21 bp, Artificial Sequence
  Description of Artificial Sequence: Synthetic oligonucleotide
aagattccgaattatgatcgt

SEQ ID NO: 42098 - DNA, 21 bp, Artificial Sequence
  Description of Artificial Sequence: Synthetic oligonucleotide
agcagagaaaaaaacaacgcc

SEQ ID NO: 42099 - DNA, 21 bp, Artificial Sequence
  Description of Artificial Sequence: Synthetic oligonucleotide
atgagcctcagcaaaaaccac

SEQ ID NO: 42100 - DNA, 21 bp, Artificial Sequence
  Description of Artificial Sequence: Synthetic oligonucleotide
aaaatcagcagccccttcatc

SEQ ID NO: 42101 - DNA, 21 bp, Artificial Sequence
  Description of Artificial Sequence: Synthetic oligonucleotide
aatccttctatggctatgaag

SEQ ID NO: 42102 - DNA, 21 bp, Artificial Sequence
  Description of Artificial Sequence: Synthetic oligonucleotide
cgtgttagttctccgtctaat

SEQ ID NO: 42103 - DNA, 21 bp, Artificial Sequence
  Description of Artificial Sequence: Synthetic oligonucleotide
cggacttattctcctcagatt

SEQ ID NO: 42104 - DNA, 21 bp, Artificial Sequence
  Description of Artificial Sequence: Synthetic oligonucleotide
aggaatgataagcagaattcg

SEQ ID NO: 42105 - DNA, 21 bp, Artificial Sequence
  Description of Artificial Sequence: Synthetic oligonucleotide
gagcagggttcgggtaatcat

SEQ ID NO: 42106 - DNA, 21 bp, Artificial Sequence
  Description of Artificial Sequence: Synthetic oligonucleotide
gacccccccaaaggcagcaga

SEQ ID NO: 42107 - DNA, 21 bp, Artificial Sequence
  Description of Artificial Sequence: Synthetic oligonucleotide
actattaagtctgttactaat

SEQ ID NO: 42108 - DNA, 21 bp, Artificial Sequence
  Description of Artificial Sequence: Synthetic oligonucleotide
agcatcaaagaaaaaaccaga

SEQ ID NO: 42109 - DNA, 21 bp, Artificial Sequence
  Description of Artificial Sequence: Synthetic oligonucleotide
cagagttctattcatacgaag

SEQ ID NO: 42110 - DNA, 21 bp, Artificial Sequence
  Description of Artificial Sequence: Synthetic oligonucleotide
ttcggcagaaccaaccaaggc

SEQ ID NO: 42111 - DNA, 21 bp, Artificial Sequence
  Description of Artificial Sequence: Synthetic oligonucleotide
accaaaaacagcacccacggc

SEQ ID NO: 42112 - DNA, 21 bp, Artificial Sequence
  Description of Artificial Sequence: Synthetic oligonucleotide
gctcatcagtctcttgatagg

SEQ ID NO: 42113 - DNA, 21 bp, Artificial Sequence
  Description of Artificial Sequence: Synthetic oligonucleotide
aacagacacgaaagagtcatc

SEQ ID NO: 42114 - DNA, 21 bp, Artificial Sequence
  Description of Artificial Sequence: Synthetic oligonucleotide
tatagtagtcggagtgggccg

SEQ ID NO: 42115 - DNA, 21 bp, Artificial Sequence
  Description of Artificial Sequence: Synthetic oligonucleotide
cccagcagcggccacagcaga

SEQ ID NO: 42116 - DNA, 21 bp, Artificial Sequence
  Description of Artificial Sequence: Synthetic oligonucleotide
accggcagcggcagactcctc

SEQ ID NO: 42117 - DNA, 21 bp, Artificial Sequence
  Description of Artificial Sequence: Synthetic oligonucleotide
acgaagtctactagtcatgtt

SEQ ID NO: 42118 - DNA, 21 bp, Artificial Sequence
  Description of Artificial Sequence: Synthetic oligonucleotide
atcagaagcaccagcggcggc

SEQ ID NO: 42119 - DNA, 21 bp, Artificial Sequence
  Description of Artificial Sequence: Synthetic oligonucleotide
tatgtgaggcctggtactggt

SEQ ID NO: 42120 - DNA, 21 bp, Artificial Sequence
  Description of Artificial Sequence: Synthetic oligonucleotide
gttcatgtgacgagtcagact

SEQ ID NO: 42121 - DNA, 21 bp, Artificial Sequence
  Description of Artificial Sequence: Synthetic oligonucleotide
tgtgctgctaaggggattcgg

SEQ ID NO: 42122 - DNA, 21 bp, Artificial Sequence
  Description of Artificial Sequence: Synthetic oligonucleotide
agggcgcctaagagttcttct

SEQ ID NO: 42123 - DNA, 21 bp, Artificial Sequence
  Description of Artificial Sequence: Synthetic oligonucleotide
aatctgggtcggcaggttggg

SEQ ID NO: 42124 - DNA, 21 bp, Artificial Sequence
  Description of Artificial Sequence: Synthetic oligonucleotide
cctttggagcgtactactaag

SEQ ID NO: 42125 - DNA, 21 bp, Artificial Sequence
  Description of Artificial Sequence: Synthetic oligonucleotide
gacagcaccctcggccaaagc

SEQ ID NO: 42126 - DNA, 21 bp, Artificial Sequence
  Description of Artificial Sequence: Synthetic oligonucleotide
aacaacagaagcggcatgggc

SEQ ID NO: 42127 - DNA, 21 bp, Artificial Sequence
  Description of Artificial Sequence: Synthetic oligonucleotide
cccggcagagaaaaaaccgtc

SEQ ID NO: 42128 - DNA, 21 bp, Artificial Sequence
  Description of Artificial Sequence: Synthetic oligonucleotide
tataataagaatgctcagttg

SEQ ID NO: 42129 - DNA, 21 bp, Artificial Sequence
  Description of Artificial Sequence: Synthetic oligonucleotide
ttccccctcaaactcggcaga

SEQ ID NO: 42130 - DNA, 21 bp, Artificial Sequence
  Description of Artificial Sequence: Synthetic oligonucleotide
aagattgcttcgaagtcggag

SEQ ID NO: 42131 - DNA, 21 bp, Artificial Sequence
  Description of Artificial Sequence: Synthetic oligonucleotide
tcttatgggaaggggagttct

SEQ ID NO: 42132 - DNA, 21 bp, Artificial Sequence
  Description of Artificial Sequence: Synthetic oligonucleotide
tttcggcagactagtgggaat

SEQ ID NO: 42133 - DNA, 21 bp, Artificial Sequence
  Description of Artificial Sequence: Synthetic oligonucleotide
atgaatcggactgggattaag

SEQ ID NO: 42134 - DNA, 21 bp, Artificial Sequence
  Description of Artificial Sequence: Synthetic oligonucleotide
ggtccgaatcagtcgggtcgg

SEQ ID NO: 42135 - DNA, 21 bp, Artificial Sequence
  Description of Artificial Sequence: Synthetic oligonucleotide
attaggtcgaaggcgtctgcg

SEQ ID NO: 42136 - DNA, 21 bp, Artificial Sequence
  Description of Artificial Sequence: Synthetic oligonucleotide
gccagcagaagcaccaacccc

SEQ ID NO: 42137 - DNA, 21 bp, Artificial Sequence
  Description of Artificial Sequence: Synthetic oligonucleotide
gacagatacaacagacaactc

SEQ ID NO: 42138 - DNA, 21 bp, Artificial Sequence
  Description of Artificial Sequence: Synthetic oligonucleotide
cacatcaccggcagacaactc

SEQ ID NO: 42139 - DNA, 21 bp, Artificial Sequence
  Description of Artificial Sequence: Synthetic oligonucleotide
agagtcgaaagccccaccaac

SEQ ID NO: 42140 - DNA, 21 bp, Artificial Sequence
  Description of Artificial Sequence: Synthetic oligonucleotide
aatgcgcagggtactgctaag

SEQ ID NO: 42141 - DNA, 21 bp, Artificial Sequence
  Description of Artificial Sequence: Synthetic oligonucleotide
gccaaaaccaacctcagaagc

SEQ ID NO: 42142 - DNA, 21 bp, Artificial Sequence
  Description of Artificial Sequence: Synthetic oligonucleotide
ctcatcaacgccacccacaga

SEQ ID NO: 42143 - DNA, 21 bp, Artificial Sequence
  Description of Artificial Sequence: Synthetic oligonucleotide
catgcttcgagggttaatatt

SEQ ID NO: 42144 - DNA, 21 bp, Artificial Sequence
  Description of Artificial Sequence: Synthetic oligonucleotide
tttaatgggttgagtactcag

SEQ ID NO: 42145 - DNA, 21 bp, Artificial Sequence
  Description of Artificial Sequence: Synthetic oligonucleotide
attcagaatagttctaatact

SEQ ID NO: 42146 - DNA, 21 bp, Artificial Sequence
  Description of Artificial Sequence: Synthetic oligonucleotide
cattataatcagactggtttg

SEQ ID NO: 42147 - DNA, 21 bp, Artificial Sequence
  Description of Artificial Sequence: Synthetic oligonucleotide
aacgccaccagccccagaaaa

SEQ ID NO: 42148 - DNA, 21 bp, Artificial Sequence
  Description of Artificial Sequence: Synthetic oligonucleotide
catctgagggataagtattcg

SEQ ID NO: 42149 - DNA, 21 bp, Artificial Sequence
  Description of Artificial Sequence: Synthetic oligonucleotide
gaagtcaccaacagccccaga

SEQ ID NO: 42150 - DNA, 21 bp, Artificial Sequence
  Description of Artificial Sequence: Synthetic oligonucleotide
gggagtaatcgtaatcatgct

SEQ ID NO: 42151 - DNA, 21 bp, Artificial Sequence
  Description of Artificial Sequence: Synthetic oligonucleotide
ttcaacatgcaaagaagccaa

SEQ ID NO: 42152 - DNA, 21 bp, Artificial Sequence
  Description of Artificial Sequence: Synthetic oligonucleotide
agcgtctacacccacagcctc

SEQ ID NO: 42153 - DNA, 21 bp, Artificial Sequence
  Description of Artificial Sequence: Synthetic oligonucleotide
catgctgctaggccgttggtt

SEQ ID NO: 42154 - DNA, 21 bp, Artificial Sequence
  Description of Artificial Sequence: Synthetic oligonucleotide
agagccaccgaaggcgtcttc

SEQ ID NO: 42155 - DNA, 21 bp, Artificial Sequence
  Description of Artificial Sequence: Synthetic oligonucleotide
gcccacagaaacatcagcagc

SEQ ID NO: 42156 - DNA, 21 bp, Artificial Sequence
  Description of Artificial Sequence: Synthetic oligonucleotide
aatcggtcgacggattttaag

SEQ ID NO: 42157 - DNA, 21 bp, Artificial Sequence
  Description of Artificial Sequence: Synthetic oligonucleotide
agagccagcggccccttcgtc

SEQ ID NO: 42158 - DNA, 21 bp, Artificial Sequence
  Description of Artificial Sequence: Synthetic oligonucleotide
tgtattagggctggttcttgt

SEQ ID NO: 42159 - DNA, 21 bp, Artificial Sequence
  Description of Artificial Sequence: Synthetic oligonucleotide
atgcccctcaaaccccacctc

SEQ ID NO: 42160 - DNA, 21 bp, Artificial Sequence
  Description of Artificial Sequence: Synthetic oligonucleotide
tttacgtttaatgcggcgact

SEQ ID NO: 42161 - DNA, 21 bp, Artificial Sequence
  Description of Artificial Sequence: Synthetic oligonucleotide
atggtttcgggtaagagttat

SEQ ID NO: 42162 - DNA, 21 bp, Artificial Sequence
  Description of Artificial Sequence: Synthetic oligonucleotide
tcttcggcgggtcatagtaag

SEQ ID NO: 42163 - DNA, 21 bp, Artificial Sequence
  Description of Artificial Sequence: Synthetic oligonucleotide
ttcaacagcagcagcagcaaa

SEQ ID NO: 42164 - DNA, 21 bp, Artificial Sequence
  Description of Artificial Sequence: Synthetic oligonucleotide
cagattactccgcggagtggg

SEQ ID NO: 42165 - DNA, 21 bp, Artificial Sequence
  Description of Artificial Sequence: Synthetic oligonucleotide
aattctggtactcattttaag

SEQ ID NO: 42166 - DNA, 21 bp, Artificial Sequence
  Description of Artificial Sequence: Synthetic oligonucleotide
cttggtaatgcgcatcagctt

SEQ ID NO: 42167 - DNA, 21 bp, Artificial Sequence
  Description of Artificial Sequence: Synthetic oligonucleotide
cacgacagcaaagtcatcagc

SEQ ID NO: 42168 - DNA, 21 bp, Artificial Sequence
  Description of Artificial Sequence: Synthetic oligonucleotide
catcagcttaagaatagtgtg

SEQ ID NO: 42169 - DNA, 21 bp, Artificial Sequence
  Description of Artificial Sequence: Synthetic oligonucleotide
agcgcccacaacagaagcgtc

SEQ ID NO: 42170 - DNA, 21 bp, Artificial Sequence
  Description of Artificial Sequence: Synthetic oligonucleotide
tatgggaatcctaggcaggct

SEQ ID NO: 42171 - DNA, 21 bp, Artificial Sequence
  Description of Artificial Sequence: Synthetic oligonucleotide
tgcctcggcagacccatggcc

SEQ ID NO: 42172 - DNA, 21 bp, Artificial Sequence
  Description of Artificial Sequence: Synthetic oligonucleotide
tctgttcagaagtcggttaat

SEQ ID NO: 42173 - DNA, 21 bp, Artificial Sequence
  Description of Artificial Sequence: Synthetic oligonucleotide
cctgtgggttctggtgtgcct

SEQ ID NO: 42174 - DNA, 21 bp, Artificial Sequence
  Description of Artificial Sequence: Synthetic oligonucleotide
catggttctaagccgtatatt

SEQ ID NO: 42175 - DNA, 21 bp, Artificial Sequence
  Description of Artificial Sequence: Synthetic oligonucleotide
tctcctggtaataagagtact

SEQ ID NO: 42176 - DNA, 21 bp, Artificial Sequence
  Description of Artificial Sequence: Synthetic oligonucleotide
tctttgggttctggttttcag

SEQ ID NO: 42177 - DNA, 21 bp, Artificial Sequence
  Description of Artificial Sequence: Synthetic oligonucleotide
cccgacatcggcaaacaaaga

SEQ ID NO: 42178 - DNA, 21 bp, Artificial Sequence
  Description of Artificial Sequence: Synthetic oligonucleotide
agggtgactaatgcgcggaat

SEQ ID NO: 42179 - DNA, 21 bp, Artificial Sequence
  Description of Artificial Sequence: Synthetic oligonucleotide
tctttttcgaagggttctagt

SEQ ID NO: 42180 - DNA, 21 bp, Artificial Sequence
  Description of Artificial Sequence: Synthetic oligonucleotide
gtgcctggtaagtctgcgcag

SEQ ID NO: 42181 - DNA, 21 bp, Artificial Sequence
  Description of Artificial Sequence: Synthetic oligonucleotide
acgagtaagcctaattctccg

SEQ ID NO: 42182 - DNA, 21 bp, Artificial Sequence
  Description of Artificial Sequence: Synthetic oligonucleotide
tcgcctgagaagaatatgcgg

SEQ ID NO: 42183 - DNA, 21 bp, Artificial Sequence
  Description of Artificial Sequence: Synthetic oligonucleotide
caggggtctgggagtaatcat

SEQ ID NO: 42184 - DNA, 21 bp, Artificial Sequence
  Description of Artificial Sequence: Synthetic oligonucleotide
tgtcagtctcggtcgggtgcg

SEQ ID NO: 42185 - DNA, 21 bp, Artificial Sequence
  Description of Artificial Sequence: Synthetic oligonucleotide
cccagcaccgaaagaaacaga

SEQ ID NO: 42186 - DNA, 21 bp, Artificial Sequence
  Description of Artificial Sequence: Synthetic oligonucleotide
gccctcggccacaaccacaac

SEQ ID NO: 42187 - DNA, 21 bp, Artificial Sequence
  Description of Artificial Sequence: Synthetic oligonucleotide
cagcctattattagtcctacg

SEQ ID NO: 42188 - DNA, 21 bp, Artificial Sequence
  Description of Artificial Sequence: Synthetic oligonucleotide
gtgagtggtcaggggaattct

SEQ ID NO: 42189 - DNA, 21 bp, Artificial Sequence
  Description of Artificial Sequence: Synthetic oligonucleotide
gctgttaatactaaggcgctt

SEQ ID NO: 42190 - DNA, 21 bp, Artificial Sequence
  Description of Artificial Sequence: Synthetic oligonucleotide
cttaatgttggttctgtgagg

SEQ ID NO: 42191 - DNA, 21 bp, Artificial Sequence
  Description of Artificial Sequence: Synthetic oligonucleotide
ttgcatgatggtcagactcgt

SEQ ID NO: 42192 - DNA, 21 bp, Artificial Sequence
  Description of Artificial Sequence: Synthetic oligonucleotide
atcagaaccggcagcctccac

SEQ ID NO: 42193 - DNA, 21 bp, Artificial Sequence
  Description of Artificial Sequence: Synthetic oligonucleotide
ggtacgaagtcggcgtttagt

SEQ ID NO: 42194 - DNA, 21 bp, Artificial Sequence
  Description of Artificial Sequence: Synthetic oligonucleotide
ctcagcagcagcagaatgggc

SEQ ID NO: 42195 - DNA, 21 bp, Artificial Sequence
  Description of Artificial Sequence: Synthetic oligonucleotide
gccagagtcgtccccagactc

SEQ ID NO: 42196 - DNA, 21 bp, Artificial Sequence
  Description of Artificial Sequence: Synthetic oligonucleotide
gagagtaaggctgcttctaag

SEQ ID NO: 42197 - DNA, 21 bp, Artificial Sequence
  Description of Artificial Sequence: Synthetic oligonucleotide
ccttctaagggtacgtatcct

SEQ ID NO: 42198 - DNA, 21 bp, Artificial Sequence
  Description of Artificial Sequence: Synthetic oligonucleotide
catgtgagtagtacgtctgtg

SEQ ID NO: 42199 - DNA, 21 bp, Artificial Sequence
  Description of Artificial Sequence: Synthetic oligonucleotide
agggagaagcagcataatggg

SEQ ID NO: 42200 - DNA, 21 bp, Artificial Sequence
  Description of Artificial Sequence: Synthetic oligonucleotide
agaaacgacaccaaactcttc

SEQ ID NO: 42201 - DNA, 21 bp, Artificial Sequence
  Description of Artificial Sequence: Synthetic oligonucleotide
ctttcggctaatccgcataat

SEQ ID NO: 42202 - DNA, 21 bp, Artificial Sequence
  Description of Artificial Sequence: Synthetic oligonucleotide
aacagaagcaaagaaagcgcc

SEQ ID NO: 42203 - DNA, 21 bp, Artificial Sequence
  Description of Artificial Sequence: Synthetic oligonucleotide
atgaaaagccaaaaatacgcc

SEQ ID NO: 42204 - DNA, 21 bp, Artificial Sequence
  Description of Artificial Sequence: Synthetic oligonucleotide
gttcttcgtgatgggcatcgg

SEQ ID NO: 42205 - DNA, 21 bp, Artificial Sequence
  Description of Artificial Sequence: Synthetic oligonucleotide
accaaaggcggcagccaactc

SEQ ID NO: 42206 - DNA, 21 bp, Artificial Sequence
  Description of Artificial Sequence: Synthetic oligonucleotide
atcagcctcacccaaagcaga

SEQ ID NO: 42207 - DNA, 21 bp, Artificial Sequence
  Description of Artificial Sequence: Synthetic oligonucleotide
agagaactcaaaaacagcagc

SEQ ID NO: 42208 - DNA, 21 bp, Artificial Sequence
  Description of Artificial Sequence: Synthetic oligonucleotide
aggacgcaggcgcataatgtt

SEQ ID NO: 42209 - DNA, 21 bp, Artificial Sequence
  Description of Artificial Sequence: Synthetic oligonucleotide
agtccggggcgtacgcagagt

SEQ ID NO: 42210 - DNA, 21 bp, Artificial Sequence
  Description of Artificial Sequence: Synthetic oligonucleotide
tgtaagactcatgtgtctgtt

SEQ ID NO: 42211 - DNA, 21 bp, Artificial Sequence
  Description of Artificial Sequence: Synthetic oligonucleotide
tctcatgataatggtcagtcg

SEQ ID NO: 42212 - DNA, 21 bp, Artificial Sequence
  Description of Artificial Sequence: Synthetic oligonucleotide
agttctactccgcggtctgtg

SEQ ID NO: 42213 - DNA, 21 bp, Artificial Sequence
  Description of Artificial Sequence: Synthetic oligonucleotide
cctagtgctaggatgtctggt

SEQ ID NO: 42214 - DNA, 21 bp, Artificial Sequence
  Description of Artificial Sequence: Synthetic oligonucleotide
gatattgggaatcctactaat

SEQ ID NO: 42215 - DNA, 21 bp, Artificial Sequence
  Description of Artificial Sequence: Synthetic oligonucleotide
attgggccgtctggtgttttg

SEQ ID NO: 42216 - DNA, 21 bp, Artificial Sequence
  Description of Artificial Sequence: Synthetic oligonucleotide
tcgccggttaaggggtctgtt

SEQ ID NO: 42217 - DNA, 21 bp, Artificial Sequence
  Description of Artificial Sequence: Synthetic oligonucleotide
cttcgtgttaatgctactggg

SEQ ID NO: 42218 - DNA, 21 bp, Artificial Sequence
  Description of Artificial Sequence: Synthetic oligonucleotide
ggcaacggcaccagacaaaac

SEQ ID NO: 42219 - DNA, 21 bp, Artificial Sequence
  Description of Artificial Sequence: Synthetic oligonucleotide
gttcgggttggtcagcatctg

SEQ ID NO: 42220 - DNA, 21 bp, Artificial Sequence
  Description of Artificial Sequence: Synthetic oligonucleotide
ttcgaaacccacagcagaccc

SEQ ID NO: 42221 - DNA, 21 bp, Artificial Sequence
  Description of Artificial Sequence: Synthetic oligonucleotide
cgtatgggtgtgtcgaatacg

SEQ ID NO: 42222 - DNA, 21 bp, Artificial Sequence
  Description of Artificial Sequence: Synthetic oligonucleotide
tcttcgcgtaatcttgttacg

SEQ ID NO: 42223 - DNA, 21 bp, Artificial Sequence
  Description of Artificial Sequence: Synthetic oligonucleotide
agccccagcttcaaccaaggc

SEQ ID NO: 42224 - DNA, 21 bp, Artificial Sequence
  Description of Artificial Sequence: Synthetic oligonucleotide
cattctcatgggaagtcgatt

SEQ ID NO: 42225 - DNA, 21 bp, Artificial Sequence
  Description of Artificial Sequence: Synthetic oligonucleotide
ggtccggatacgcattctcag

SEQ ID NO: 42226 - DNA, 21 bp, Artificial Sequence
  Description of Artificial Sequence: Synthetic oligonucleotide
ggtgtgattaataatgagcgg

SEQ ID NO: 42227 - DNA, 21 bp, Artificial Sequence
  Description of Artificial Sequence: Synthetic oligonucleotide
tcgtctatgtcgcatcagaag

SEQ ID NO: 42228 - DNA, 21 bp, Artificial Sequence
  Description of Artificial Sequence: Synthetic oligonucleotide
tcgggggcttcgagtaattct

SEQ ID NO: 42229 - DNA, 21 bp, Artificial Sequence
  Description of Artificial Sequence: Synthetic oligonucleotide
aacaacagcaaaagccaaatc

SEQ ID NO: 42230 - DNA, 21 bp, Artificial Sequence
  Description of Artificial Sequence: Synthetic oligonucleotide
gccatcagaccccacagcggc

SEQ ID NO: 42231 - DNA, 21 bp, Artificial Sequence
  Description of Artificial Sequence: Synthetic oligonucleotide
aaactcaccggccaaagaagc

SEQ ID NO: 42232 - DNA, 21 bp, Artificial Sequence
  Description of Artificial Sequence: Synthetic oligonucleotide
agagtccaaaaaagcagcttc

SEQ ID NO: 42233 - DNA, 21 bp, Artificial Sequence
  Description of Artificial Sequence: Synthetic oligonucleotide
agaagcaaccccaccctcgtc

SEQ ID NO: 42234 - DNA, 21 bp, Artificial Sequence
  Description of Artificial Sequence: Synthetic oligonucleotide
cccaccggcaaactcagacaa

SEQ ID NO: 42235 - DNA, 21 bp, Artificial Sequence
  Description of Artificial Sequence: Synthetic oligonucleotide
ggtgcgggtactagttatcat

SEQ ID NO: 42236 - DNA, 21 bp, Artificial Sequence
  Description of Artificial Sequence: Synthetic oligonucleotide
tcttcgcaggcggtttttcgg

SEQ ID NO: 42237 - DNA, 21 bp, Artificial Sequence
  Description of Artificial Sequence: Synthetic oligonucleotide
ggccaagccgtcaacaccgcc

SEQ ID NO: 42238 - DNA, 21 bp, Artificial Sequence
  Description of Artificial Sequence: Synthetic oligonucleotide
ttcatcggcaccagaagcgcc

SEQ ID NO: 42239 - DNA, 21 bp, Artificial Sequence
  Description of Artificial Sequence: Synthetic oligonucleotide
actgggcgggggccggatgtg

SEQ ID NO: 42240 - DNA, 21 bp, Artificial Sequence
  Description of Artificial Sequence: Synthetic oligonucleotide
ctcaacaaccaaagaatcgcc

SEQ ID NO: 42241 - DNA, 21 bp, Artificial Sequence
  Description of Artificial Sequence: Synthetic oligonucleotide
actccgcagaattctgtgaag

SEQ ID NO: 42242 - DNA, 21 bp, Artificial Sequence
  Description of Artificial Sequence: Synthetic oligonucleotide
aatccttcggagaagatgttg

SEQ ID NO: 42243 - DNA, 21 bp, Artificial Sequence
  Description of Artificial Sequence: Synthetic oligonucleotide
gtttttaatcgtaatgcttct

SEQ ID NO: 42244 - DNA, 21 bp, Artificial Sequence
  Description of Artificial Sequence: Synthetic oligonucleotide
actccgacgccggttaatcag

SEQ ID NO: 42245 - DNA, 21 bp, Artificial Sequence
  Description of Artificial Sequence: Synthetic oligonucleotide
ttcaacagcggcagcggcaga

SEQ ID NO: 42246 - DNA, 21 bp, Artificial Sequence
  Description of Artificial Sequence: Synthetic oligonucleotide
catgtgactaagtctacggct

SEQ ID NO: 42247 - DNA, 21 bp, Artificial Sequence
  Description of Artificial Sequence: Synthetic oligonucleotide
tttgtttcggctcgtagtggt

SEQ ID NO: 42248 - DNA, 21 bp, Artificial Sequence
  Description of Artificial Sequence: Synthetic oligonucleotide
actcctgcggggccgaataag

SEQ ID NO: 42249 - DNA, 21 bp, Artificial Sequence
  Description of Artificial Sequence: Synthetic oligonucleotide
atgagttctaagcaggttagt

SEQ ID NO: 42250 - DNA, 21 bp, Artificial Sequence
  Description of Artificial Sequence: Synthetic oligonucleotide
tggatgtctggtaagaatagt

SEQ ID NO: 42251 - DNA, 21 bp, Artificial Sequence
  Description of Artificial Sequence: Synthetic oligonucleotide
atttcgactccgaagactgcg

SEQ ID NO: 42252 - DNA, 21 bp, Artificial Sequence
  Description of Artificial Sequence: Synthetic oligonucleotide
actaggaataataagagtgag

SEQ ID NO: 42253 - DNA, 21 bp, Artificial Sequence
  Description of Artificial Sequence: Synthetic oligonucleotide
gatcctgttctgaagccggct

SEQ ID NO: 42254 - DNA, 21 bp, Artificial Sequence
  Description of Artificial Sequence: Synthetic oligonucleotide
cctggtgctagtggtaaggtt

SEQ ID NO: 42255 - DNA, 21 bp, Artificial Sequence
  Description of Artificial Sequence: Synthetic oligonucleotide
aataatgttacgaaggctccg

SEQ ID NO: 42256 - DNA, 21 bp, Artificial Sequence
  Description of Artificial Sequence: Synthetic oligonucleotide
aatgctatgaatactcggggt

SEQ ID NO: 42257 - DNA, 21 bp, Artificial Sequence
  Description of Artificial Sequence: Synthetic oligonucleotide
catggtgttaataagactgag

SEQ ID NO: 42258 - DNA, 21 bp, Artificial Sequence
  Description of Artificial Sequence: Synthetic oligonucleotide
tataatcgtaagcctgctcag

SEQ ID NO: 42259 - DNA, 21 bp, Artificial Sequence
  Description of Artificial Sequence: Synthetic oligonucleotide
cccggcggcaaaagccaactc

SEQ ID NO: 42260 - DNA, 21 bp, Artificial Sequence
  Description of Artificial Sequence: Synthetic oligonucleotide
tacggccaaaccaaaacccaa

SEQ ID NO: 42261 - DNA, 21 bp, Artificial Sequence
  Description of Artificial Sequence: Synthetic oligonucleotide
ggtcagactcatgcggttcgg

SEQ ID NO: 42262 - DNA, 21 bp, Artificial Sequence
  Description of Artificial Sequence: Synthetic oligonucleotide
ttgactacgtcggtgtataag

SEQ ID NO: 42263 - DNA, 21 bp, Artificial Sequence
  Description of Artificial Sequence: Synthetic oligonucleotide
ttcggcaaccccggcatcaga

SEQ ID NO: 42264 - DNA, 21 bp, Artificial Sequence
  Description of Artificial Sequence: Synthetic oligonucleotide
agacccgacagaaccaccctc

SEQ ID NO: 42265 - DNA, 21 bp, Artificial Sequence
  Description of Artificial Sequence: Synthetic oligonucleotide
agcttcaccaaaggcgccggc

SEQ ID NO: 42266 - DNA, 21 bp, Artificial Sequence
  Description of Artificial Sequence: Synthetic oligonucleotide
actaatagggggggtactcct

SEQ ID NO: 42267 - DNA, 21 bp, Artificial Sequence
  Description of Artificial Sequence: Synthetic oligonucleotide
ctcaccgccaccaaccccaga

SEQ ID NO: 42268 - DNA, 21 bp, Artificial Sequence
  Description of Artificial Sequence: Synthetic oligonucleotide
cctgtgtctcgggggagtggg

SEQ ID NO: 42269 - DNA, 21 bp, Artificial Sequence
  Description of Artificial Sequence: Synthetic oligonucleotide
ggcctccacccccccagaacc

SEQ ID NO: 42270 - DNA, 21 bp, Artificial Sequence
  Description of Artificial Sequence: Synthetic oligonucleotide
agagtcgccaccagcgtcagc

SEQ ID NO: 42271 - DNA, 21 bp, Artificial Sequence
  Description of Artificial Sequence: Synthetic oligonucleotide
actcatgctgctcattcttct

SEQ ID NO: 42272 - DNA, 21 bp, Artificial Sequence
  Description of Artificial Sequence: Synthetic oligonucleotide
ggtacgaatcctgggacgttg

SEQ ID NO: 42273 - DNA, 21 bp, Artificial Sequence
  Description of Artificial Sequence: Synthetic oligonucleotide
acccaaaacaccaaaagcatc

SEQ ID NO: 42274 - DNA, 21 bp, Artificial Sequence
  Description of Artificial Sequence: Synthetic oligonucleotide
agccacggcgaaagccaaaga

SEQ ID NO: 42275 - DNA, 21 bp, Artificial Sequence
  Description of Artificial Sequence: Synthetic oligonucleotide
ctccacagagccggcgacgcc

SEQ ID NO: 42276 - DNA, 21 bp, Artificial Sequence
  Description of Artificial Sequence: Synthetic oligonucleotide
tctattggtaaggggtataat

SEQ ID NO: 42277 - DNA, 21 bp, Artificial Sequence
  Description of Artificial Sequence: Synthetic oligonucleotide
ccctacaaaaacaaacccagc

SEQ ID NO: 42278 - DNA, 21 bp, Artificial Sequence
  Description of Artificial Sequence: Synthetic oligonucleotide
cttaatagtatgtctcctagg

SEQ ID NO: 42279 - DNA, 21 bp, Artificial Sequence
  Description of Artificial Sequence: Synthetic oligonucleotide
aggtatgataagcagaattcg

SEQ ID NO: 42280 - DNA, 21 bp, Artificial Sequence
  Description of Artificial Sequence: Synthetic oligonucleotide
cacgtcaacagcggcaaactc

SEQ ID NO: 42281 - DNA, 21 bp, Artificial Sequence
  Description of Artificial Sequence: Synthetic oligonucleotide
gttcattcttcgagtacgaag

SEQ ID NO: 42282 - DNA, 21 bp, Artificial Sequence
  Description of Artificial Sequence: Synthetic oligonucleotide
agcaccggcagcgtcagcaaa

SEQ ID NO: 42283 - DNA, 21 bp, Artificial Sequence
  Description of Artificial Sequence: Synthetic oligonucleotide
accaccaccaccagacccagc

SEQ ID NO: 42284 - DNA, 21 bp, Artificial Sequence
  Description of Artificial Sequence: Synthetic oligonucleotide
tctgttgttagtgaggttcgg

SEQ ID NO: 42285 - DNA, 21 bp, Artificial Sequence
  Description of Artificial Sequence: Synthetic oligonucleotide
gccagcctcaaaacccaaatg

SEQ ID NO: 42286 - DNA, 21 bp, Artificial Sequence
  Description of Artificial Sequence: Synthetic oligonucleotide
ttcaccaccggcaactactgc

SEQ ID NO: 42287 - DNA, 21 bp, Artificial Sequence
  Description of Artificial Sequence: Synthetic oligonucleotide
ttttcgcgtagtccggcggtg

SEQ ID NO: 42288 - DNA, 21 bp, Artificial Sequence
  Description of Artificial Sequence: Synthetic oligonucleotide
tataatattaagcaggggagt

SEQ ID NO: 42289 - DNA, 21 bp, Artificial Sequence
  Description of Artificial Sequence: Synthetic oligonucleotide
gattgtgtttcgcggtgtaag

SEQ ID NO: 42290 - DNA, 21 bp, Artificial Sequence
  Description of Artificial Sequence: Synthetic oligonucleotide
agtattagggggggtaaggat

SEQ ID NO: 42291 - DNA, 21 bp, Artificial Sequence
  Description of Artificial Sequence: Synthetic oligonucleotide
gcgaagacggctaagaatgtg

SEQ ID NO: 42292 - DNA, 21 bp, Artificial Sequence
  Description of Artificial Sequence: Synthetic oligonucleotide
ttcagaacccaaagcaccaaa

SEQ ID NO: 42293 - DNA, 21 bp, Artificial Sequence
  Description of Artificial Sequence: Synthetic oligonucleotide
gacagcggcagcagcaccaaa

SEQ ID NO: 42294 - DNA, 21 bp, Artificial Sequence
  Description of Artificial Sequence: Synthetic oligonucleotide
ggtactgcgaggggggttgct

SEQ ID NO: 42295 - DNA, 21 bp, Artificial Sequence
  Description of Artificial Sequence: Synthetic oligonucleotide
agggctacgccgctttctggt

SEQ ID NO: 42296 - DNA, 21 bp, Artificial Sequence
  Description of Artificial Sequence: Synthetic oligonucleotide
agcagcagcggcggcgtcaaa

SEQ ID NO: 42297 - DNA, 21 bp, Artificial Sequence
  Description of Artificial Sequence: Synthetic oligonucleotide
tcggggagtacgaagggtcag

SEQ ID NO: 42298 - DNA, 21 bp, Artificial Sequence
  Description of Artificial Sequence: Synthetic oligonucleotide
gctaagactaatttgagttct

SEQ ID NO: 42299 - DNA, 21 bp, Artificial Sequence
  Description of Artificial Sequence: Synthetic oligonucleotide
aagaatccttcgagtgttaat

SEQ ID NO: 42300 - DNA, 21 bp, Artificial Sequence
  Description of Artificial Sequence: Synthetic oligonucleotide
atggctcctcgtccggttcct

SEQ ID NO: 42301 - DNA, 21 bp, Artificial Sequence
  Description of Artificial Sequence: Synthetic oligonucleotide
actcatcgtacgcagaattcg

SEQ ID NO: 42302 - DNA, 21 bp, Artificial Sequence
  Description of Artificial Sequence: Synthetic oligonucleotide
ctttcgcggaatgggattaat

SEQ ID NO: 42303 - DNA, 21 bp, Artificial Sequence
  Description of Artificial Sequence: Synthetic oligonucleotide
gccagaaaccccaccagcacc

SEQ ID NO: 42304 - DNA, 21 bp, Artificial Sequence
  Description of Artificial Sequence: Synthetic oligonucleotide
gggtctaggtcgtcttatgtt

SEQ ID NO: 42305 - DNA, 21 bp, Artificial Sequence
  Description of Artificial Sequence: Synthetic oligonucleotide
aacgcccaaagcagactcacc

SEQ ID NO: 42306 - DNA, 21 bp, Artificial Sequence
  Description of Artificial Sequence: Synthetic oligonucleotide
ttgggtgatcgttcttttatt

SEQ ID NO: 42307 - DNA, 21 bp, Artificial Sequence
  Description of Artificial Sequence: Synthetic oligonucleotide
ctgtgtgcgtctaagtgtgat

SEQ ID NO: 42308 - DNA, 21 bp, Artificial Sequence
  Description of Artificial Sequence: Synthetic oligonucleotide
ggcttcgaaagaaacagagaa

SEQ ID NO: 42309 - DNA, 21 bp, Artificial Sequence
  Description of Artificial Sequence: Synthetic oligonucleotide
ctttctattaagggtgcttcg

SEQ ID NO: 42310 - DNA, 21 bp, Artificial Sequence
  Description of Artificial Sequence: Synthetic oligonucleotide
gtcctcaaaagcaacggctac

SEQ ID NO: 42311 - DNA, 21 bp, Artificial Sequence
  Description of Artificial Sequence: Synthetic oligonucleotide
tttcgtccttctactgtggtg

SEQ ID NO: 42312 - DNA, 21 bp, Artificial Sequence
  Description of Artificial Sequence: Synthetic oligonucleotide
taccccagaagcggcgtccaa

SEQ ID NO: 42313 - DNA, 21 bp, Artificial Sequence
  Description of Artificial Sequence: Synthetic oligonucleotide
agagccaacaacagccaaatg

SEQ ID NO: 42314 - DNA, 21 bp, Artificial Sequence
  Description of Artificial Sequence: Synthetic oligonucleotide
atggaaagcaaagccaacagc

SEQ ID NO: 42315 - DNA, 21 bp, Artificial Sequence
  Description of Artificial Sequence: Synthetic oligonucleotide
gtccccctcgccggcagaccc

SEQ ID NO: 42316 - DNA, 21 bp, Artificial Sequence
  Description of Artificial Sequence: Synthetic oligonucleotide
gaccccgccaccagaaaaagc

SEQ ID NO: 42317 - DNA, 21 bp, Artificial Sequence
  Description of Artificial Sequence: Synthetic oligonucleotide
aatgtggataatcgggggttt

SEQ ID NO: 42318 - DNA, 21 bp, Artificial Sequence
  Description of Artificial Sequence: Synthetic oligonucleotide
cctagtgtgaataggactcct

SEQ ID NO: 42319 - DNA, 21 bp, Artificial Sequence
  Description of Artificial Sequence: Synthetic oligonucleotide
aattctcatcagaagccttct

SEQ ID NO: 42320 - DNA, 21 bp, Artificial Sequence
  Description of Artificial Sequence: Synthetic oligonucleotide
agaatgagcaacgaaggcaaa

SEQ ID NO: 42321 - DNA, 21 bp, Artificial Sequence
  Description of Artificial Sequence: Synthetic oligonucleotide
agcagacacggcagcgccacc

SEQ ID NO: 42322 - DNA, 21 bp, Artificial Sequence
  Description of Artificial Sequence: Synthetic oligonucleotide
ccggggactgggagtaatcat

SEQ ID NO: 42323 - DNA, 21 bp, Artificial Sequence
  Description of Artificial Sequence: Synthetic oligonucleotide
gccggccccctcgccggcccc

SEQ ID NO: 42324 - DNA, 21 bp, Artificial Sequence
  Description of Artificial Sequence: Synthetic oligonucleotide
aacgtttctggacagaatcaa

SEQ ID NO: 42325 - DNA, 21 bp, Artificial Sequence
  Description of Artificial Sequence: Synthetic oligonucleotide
tatcatgtgtcgaagccgcag

SEQ ID NO: 42326 - DNA, 21 bp, Artificial Sequence
  Description of Artificial Sequence: Synthetic oligonucleotide
tctggtggtgattatgcgaag

SEQ ID NO: 42327 - DNA, 21 bp, Artificial Sequence
  Description of Artificial Sequence: Synthetic oligonucleotide
atgagaagcaaagccagcatg

SEQ ID NO: 42328 - DNA, 21 bp, Artificial Sequence
  Description of Artificial Sequence: Synthetic oligonucleotide
cttggtactagtcagatgaag

SEQ ID NO: 42329 - DNA, 21 bp, Artificial Sequence
  Description of Artificial Sequence: Synthetic oligonucleotide
ctggctacgaataggagtaat

SEQ ID NO: 42330 - DNA, 21 bp, Artificial Sequence
  Description of Artificial Sequence: Synthetic oligonucleotide
tgtattgggaataagactaat

SEQ ID NO: 42331 - DNA, 21 bp, Artificial Sequence
  Description of Artificial Sequence: Synthetic oligonucleotide
gctgtgtcgagtaaggtgggg

SEQ ID NO: 42332 - DNA, 21 bp, Artificial Sequence
  Description of Artificial Sequence: Synthetic oligonucleotide
aatagtcggatttctccttcg

SEQ ID NO: 42333 - DNA, 21 bp, Artificial Sequence
  Description of Artificial Sequence: Synthetic oligonucleotide
gtttctggttctaaggttggt

SEQ ID NO: 42334 - DNA, 21 bp, Artificial Sequence
  Description of Artificial Sequence: Synthetic oligonucleotide
cgtgcttcgcagtctgtgggt

SEQ ID NO: 42335 - DNA, 21 bp, Artificial Sequence
  Description of Artificial Sequence: Synthetic oligonucleotide
cccagcaccagacaaagcaac

SEQ ID NO: 42336 - DNA, 21 bp, Artificial Sequence
  Description of Artificial Sequence: Synthetic oligonucleotide
accagatacaacagcagcctc

SEQ ID NO: 42337 - DNA, 21 bp, Artificial Sequence
  Description of Artificial Sequence: Synthetic oligonucleotide
aagacttcgactccttattcg

SEQ ID NO: 42338 - DNA, 21 bp, Artificial Sequence
  Description of Artificial Sequence: Synthetic oligonucleotide
aatgctaatagtcgtcctgtt

SEQ ID NO: 42339 - DNA, 21 bp, Artificial Sequence
  Description of Artificial Sequence: Synthetic oligonucleotide
aggagtacggatcctcatggg

SEQ ID NO: 42340 - DNA, 21 bp, Artificial Sequence
  Description of Artificial Sequence: Synthetic oligonucleotide
caactcggcgacagaaacaga

SEQ ID NO: 42341 - DNA, 21 bp, Artificial Sequence
  Description of Artificial Sequence: Synthetic oligonucleotide
agcggcggcaaaggccccacc

SEQ ID NO: 42342 - DNA, 21 bp, Artificial Sequence
  Description of Artificial Sequence: Synthetic oligonucleotide
atccaaacccacaccagcaac

SEQ ID NO: 42343 - DNA, 21 bp, Artificial Sequence
  Description of Artificial Sequence: Synthetic oligonucleotide
gcttttgggggtgagactaag

SEQ ID NO: 42344 - DNA, 21 bp, Artificial Sequence
  Description of Artificial Sequence: Synthetic oligonucleotide
agaggccccaccggcatgatg

SEQ ID NO: 42345 - DNA, 21 bp, Artificial Sequence
  Description of Artificial Sequence: Synthetic oligonucleotide
aatattgctagtaaggggccg

SEQ ID NO: 42346 - DNA, 21 bp, Artificial Sequence
  Description of Artificial Sequence: Synthetic oligonucleotide
gctgttgatagtactcgggcg

SEQ ID NO: 42347 - DNA, 21 bp, Artificial Sequence
  Description of Artificial Sequence: Synthetic oligonucleotide
caaatgaaacacctccaaggc

SEQ ID NO: 42348 - DNA, 21 bp, Artificial Sequence
  Description of Artificial Sequence: Synthetic oligonucleotide
gggaagtctcagatgcagttg

SEQ ID NO: 42349 - DNA, 21 bp, Artificial Sequence
  Description of Artificial Sequence: Synthetic oligonucleotide
gtgaataagattaatgggtcc

SEQ ID NO: 42350 - DNA, 21 bp, Artificial Sequence
  Description of Artificial Sequence: Synthetic oligonucleotide
gctagtcatcttcctgttaat

SEQ ID NO: 42351 - DNA, 21 bp, Artificial Sequence
  Description of Artificial Sequence: Synthetic oligonucleotide
acggggagggctccgtcttcg

SEQ ID NO: 42352 - DNA, 21 bp, Artificial Sequence
  Description of Artificial Sequence: Synthetic oligonucleotide
acgtcgggtaggactacgtat

SEQ ID NO: 42353 - DNA, 21 bp, Artificial Sequence
  Description of Artificial Sequence: Synthetic oligonucleotide
ccgaatcttaatagtcggggt

SEQ ID NO: 42354 - DNA, 21 bp, Artificial Sequence
  Description of Artificial Sequence: Synthetic oligonucleotide
gagactactacgcctcggaag

SEQ ID NO: 42355 - DNA, 21 bp, Artificial Sequence
  Description of Artificial Sequence: Synthetic oligonucleotide
tctgctacgaagagtagttgt

SEQ ID NO: 42356 - DNA, 21 bp, Artificial Sequence
  Description of Artificial Sequence: Synthetic oligonucleotide
agtaagacggatcatagtttg

SEQ ID NO: 42357 - DNA, 21 bp, Artificial Sequence
  Description of Artificial Sequence: Synthetic oligonucleotide
agaagcaccaacgacggcaga

SEQ ID NO: 42358 - DNA, 21 bp, Artificial Sequence
  Description of Artificial Sequence: Synthetic oligonucleotide
cagtctatttctcatacgcgt

SEQ ID NO: 42359 - DNA, 21 bp, Artificial Sequence
  Description of Artificial Sequence: Synthetic oligonucleotide
cgtacgaataagagtgttact

SEQ ID NO: 42360 - DNA, 21 bp, Artificial Sequence
  Description of Artificial Sequence: Synthetic oligonucleotide
aatacttctacgaatggtatt

SEQ ID NO: 42361 - DNA, 21 bp, Artificial Sequence
  Description of Artificial Sequence: Synthetic oligonucleotide
cctatgcagagtatgaatagg

SEQ ID NO: 42362 - DNA, 21 bp, Artificial Sequence
  Description of Artificial Sequence: Synthetic oligonucleotide
acgacggcgcctgggcttcgg

SEQ ID NO: 42363 - DNA, 21 bp, Artificial Sequence
  Description of Artificial Sequence: Synthetic oligonucleotide
tctcggaatgtgaatgcgatg

SEQ ID NO: 42364 - DNA, 21 bp, Artificial Sequence
  Description of Artificial Sequence: Synthetic oligonucleotide
atgagcagcagaagcagcgtc

SEQ ID NO: 42365 - DNA, 21 bp, Artificial Sequence
  Description of Artificial Sequence: Synthetic oligonucleotide
agtgggggtactcctgggcgt

SEQ ID NO: 42366 - DNA, 21 bp, Artificial Sequence
  Description of Artificial Sequence: Synthetic oligonucleotide
cctaagttgtcgcatacgggg

SEQ ID NO: 42367 - DNA, 21 bp, Artificial Sequence
  Description of Artificial Sequence: Synthetic oligonucleotide
ggcaacagcgccaacagaacc

SEQ ID NO: 42368 - DNA, 21 bp, Artificial Sequence
  Description of Artificial Sequence: Synthetic oligonucleotide
catcggcatgagaagtcggtt

SEQ ID NO: 42369 - DNA, 21 bp, Artificial Sequence
  Description of Artificial Sequence: Synthetic oligonucleotide
caaagcagcagccaacaaaga

SEQ ID NO: 42370 - DNA, 21 bp, Artificial Sequence
  Description of Artificial Sequence: Synthetic oligonucleotide
ccgactactgggccgcagcgg

SEQ ID NO: 42371 - DNA, 21 bp, Artificial Sequence
  Description of Artificial Sequence: Synthetic oligonucleotide
aacagcttcagcagaaacagc

SEQ ID NO: 42372 - DNA, 21 bp, Artificial Sequence
  Description of Artificial Sequence: Synthetic oligonucleotide
ttgactagtcggagtatggct

SEQ ID NO: 42373 - DNA, 21 bp, Artificial Sequence
  Description of Artificial Sequence: Synthetic oligonucleotide
ggtgttaatcgtattcctgct

SEQ ID NO: 42374 - DNA, 21 bp, Artificial Sequence
  Description of Artificial Sequence: Synthetic oligonucleotide
aagccggcgactcctaatggg

SEQ ID NO: 42375 - DNA, 21 bp, Artificial Sequence
  Description of Artificial Sequence: Synthetic oligonucleotide
agacccgccagcacccacacc

SEQ ID NO: 42376 - DNA, 21 bp, Artificial Sequence
  Description of Artificial Sequence: Synthetic oligonucleotide
aatctgaattctgttagtaag

SEQ ID NO: 42377 - DNA, 21 bp, Artificial Sequence
  Description of Artificial Sequence: Synthetic oligonucleotide
cacagaaccagccccgtcagc

SEQ ID NO: 42378 - DNA, 21 bp, Artificial Sequence
  Description of Artificial Sequence: Synthetic oligonucleotide
cccagaaccgacagaaacacc

SEQ ID NO: 42379 - DNA, 21 bp, Artificial Sequence
  Description of Artificial Sequence: Synthetic oligonucleotide
agaaccaaccccggctacgcc

SEQ ID NO: 42380 - DNA, 21 bp, Artificial Sequence
  Description of Artificial Sequence: Synthetic oligonucleotide
cattctacgaggtcttcgttg

SEQ ID NO: 42381 - DNA, 21 bp, Artificial Sequence
  Description of Artificial Sequence: Synthetic oligonucleotide
ccgttgtctaaggatcggctg

SEQ ID NO: 42382 - DNA, 21 bp, Artificial Sequence
  Description of Artificial Sequence: Synthetic oligonucleotide
aagaatcagagtcttatgtcg

SEQ ID NO: 42383 - DNA, 21 bp, Artificial Sequence
  Description of Artificial Sequence: Synthetic oligonucleotide
aatgctcagcaggctcagagg

SEQ ID NO: 42384 - DNA, 21 bp, Artificial Sequence
  Description of Artificial Sequence: Synthetic oligonucleotide
ccccccagcaacggcagactc

SEQ ID NO: 42385 - DNA, 21 bp, Artificial Sequence
  Description of Artificial Sequence: Synthetic oligonucleotide
gatcatcgtagtaaggttttg

SEQ ID NO: 42386 - DNA, 21 bp, Artificial Sequence
  Description of Artificial Sequence: Synthetic oligonucleotide
ggtcggcttactagtagtatt

SEQ ID NO: 42387 - DNA, 21 bp, Artificial Sequence
  Description of Artificial Sequence: Synthetic oligonucleotide
ggcagcgaccaaagaagaatg

SEQ ID NO: 42388 - DNA, 21 bp, Artificial Sequence
  Description of Artificial Sequence: Synthetic oligonucleotide
aatgctaatcagaatcagatg

SEQ ID NO: 42389 - DNA, 21 bp, Artificial Sequence
  Description of Artificial Sequence: Synthetic oligonucleotide
ttcagcaccagaagcgtcgtc

SEQ ID NO: 42390 - DNA, 21 bp, Artificial Sequence
  Description of Artificial Sequence: Synthetic oligonucleotide
gaatacccccaacaagccaaa

SEQ ID NO: 42391 - DNA, 21 bp, Artificial Sequence
  Description of Artificial Sequence: Synthetic oligonucleotide
caacccagccaaggccacagc

SEQ ID NO: 42392 - DNA, 21 bp, Artificial Sequence
  Description of Artificial Sequence: Synthetic oligonucleotide
cctacgttggcttcggggagg

SEQ ID NO: 42393 - DNA, 21 bp, Artificial Sequence
  Description of Artificial Sequence: Synthetic oligonucleotide
acgcgtgggcatccgttggtg

SEQ ID NO: 42394 - DNA, 21 bp, Artificial Sequence
  Description of Artificial Sequence: Synthetic oligonucleotide
cctactactcttaagcatgat

SEQ ID NO: 42395 - DNA, 21 bp, Artificial Sequence
  Description of Artificial Sequence: Synthetic oligonucleotide
gcttatcctaagaattcgaat

SEQ ID NO: 42396 - DNA, 21 bp, Artificial Sequence
  Description of Artificial Sequence: Synthetic oligonucleotide
atcaccagcggcagcaccaga

SEQ ID NO: 42397 - DNA, 21 bp, Artificial Sequence
  Description of Artificial Sequence: Synthetic oligonucleotide
cctcgtactaatgttatgcct

SEQ ID NO: 42398 - DNA, 21 bp, Artificial Sequence
  Description of Artificial Sequence: Synthetic oligonucleotide
caactcaaccacagcgccaaa

SEQ ID NO: 42399 - DNA, 21 bp, Artificial Sequence
  Description of Artificial Sequence: Synthetic oligonucleotide
acgggtagttcggggcgtatt

SEQ ID NO: 42400 - DNA, 21 bp, Artificial Sequence
  Description of Artificial Sequence: Synthetic oligonucleotide
aacatcaacagcagactcgcc

SEQ ID NO: 42401 - DNA, 21 bp, Artificial Sequence
  Description of Artificial Sequence: Synthetic oligonucleotide
aacggccccggccaaaaccaa

SEQ ID NO: 42402 - DNA, 21 bp, Artificial Sequence
  Description of Artificial Sequence: Synthetic oligonucleotide
cctgcggctcataatgcggtt

SEQ ID NO: 42403 - DNA, 21 bp, Artificial Sequence
  Description of Artificial Sequence: Synthetic oligonucleotide
caaagaaaaagcggcaccagc

SEQ ID NO: 42404 - DNA, 21 bp, Artificial Sequence
  Description of Artificial Sequence: Synthetic oligonucleotide
ggtggtcggagggtgggtctg

SEQ ID NO: 42405 - DNA, 21 bp, Artificial Sequence
  Description of Artificial Sequence: Synthetic oligonucleotide
accctcagccaaaccgtcaga

SEQ ID NO: 42406 - DNA, 21 bp, Artificial Sequence
  Description of Artificial Sequence: Synthetic oligonucleotide
tggggttcgggtcttaatcat

SEQ ID NO: 42407 - DNA, 21 bp, Artificial Sequence
  Description of Artificial Sequence: Synthetic oligonucleotide
aattctgtggagcgtactcgt

SEQ ID NO: 42408 - DNA, 21 bp, Artificial Sequence
  Description of Artificial Sequence: Synthetic oligonucleotide
gccagcgccctcagaagccac

SEQ ID NO: 42409 - DNA, 21 bp, Artificial Sequence
  Description of Artificial Sequence: Synthetic oligonucleotide
tctggtcgtgataagattagt

SEQ ID NO: 42410 - DNA, 21 bp, Artificial Sequence
  Description of Artificial Sequence: Synthetic oligonucleotide
gatcgggttttgagtcagggg

SEQ ID NO: 42411 - DNA, 21 bp, Artificial Sequence
  Description of Artificial Sequence: Synthetic oligonucleotide
gtccacaccagcggcgtccaa

SEQ ID NO: 42412 - DNA, 21 bp, Artificial Sequence
  Description of Artificial Sequence: Synthetic oligonucleotide
agatacccccccgccacccac

SEQ ID NO: 42413 - DNA, 21 bp, Artificial Sequence
  Description of Artificial Sequence: Synthetic oligonucleotide
gtcagcgacaacacctacaaa

SEQ ID NO: 42414 - DNA, 21 bp, Artificial Sequence
  Description of Artificial Sequence: Synthetic oligonucleotide
aatgttgagtcgaagtcgtgt

SEQ ID NO: 42415 - DNA, 21 bp, Artificial Sequence
  Description of Artificial Sequence: Synthetic oligonucleotide
cccagaaccaacaaccccagc

SEQ ID NO: 42416 - DNA, 21 bp, Artificial Sequence
  Description of Artificial Sequence: Synthetic oligonucleotide
ggcaccgacagcaaaagacac

SEQ ID NO: 42417 - DNA, 21 bp, Artificial Sequence
  Description of Artificial Sequence: Synthetic oligonucleotide
gttaatacgaatcgggctgct

SEQ ID NO: 42418 - DNA, 21 bp, Artificial Sequence
  Description of Artificial Sequence: Synthetic oligonucleotide
gtcacccaaagcagcagcaaa

SEQ ID NO: 42419 - DNA, 21 bp, Artificial Sequence
  Description of Artificial Sequence: Synthetic oligonucleotide
ggtattactaagaatcttgcg

SEQ ID NO: 42420 - DNA, 21 bp, Artificial Sequence
  Description of Artificial Sequence: Synthetic oligonucleotide
agcaacaccaacagcgccaac

SEQ ID NO: 42421 - DNA, 21 bp, Artificial Sequence
  Description of Artificial Sequence: Synthetic oligonucleotide
tcttcgcagactcgtggtttg

SEQ ID NO: 42422 - DNA, 21 bp, Artificial Sequence
  Description of Artificial Sequence: Synthetic oligonucleotide
ggcagagtcgtcagcatgcaa

SEQ ID NO: 42423 - DNA, 21 bp, Artificial Sequence
  Description of Artificial Sequence: Synthetic oligonucleotide
aacggcagccaaggcagacaa

SEQ ID NO: 42424 - DNA, 21 bp, Artificial Sequence
  Description of Artificial Sequence: Synthetic oligonucleotide
cgtatgtcgtctacgcatggg

SEQ ID NO: 42425 - DNA, 21 bp, Artificial Sequence
  Description of Artificial Sequence: Synthetic oligonucleotide
agtgctgttgggaaggcgagt

SEQ ID NO: 42426 - DNA, 21 bp, Artificial Sequence
  Description of Artificial Sequence: Synthetic oligonucleotide
gacagaaccaacacccaaaga

SEQ ID NO: 42427 - DNA, 21 bp, Artificial Sequence
  Description of Artificial Sequence: Synthetic oligonucleotide
cataatagtaagagtcagatt

SEQ ID NO: 42428 - DNA, 21 bp, Artificial Sequence
  Description of Artificial Sequence: Synthetic oligonucleotide
ccgtatgctggtaatcagcgg

SEQ ID NO: 42429 - DNA, 21 bp, Artificial Sequence
  Description of Artificial Sequence: Synthetic oligonucleotide
ggtggttcgtctcgtactctt

SEQ ID NO: 42430 - DNA, 21 bp, Artificial Sequence
  Description of Artificial Sequence: Synthetic oligonucleotide
gtggctggggctgctcagagg

SEQ ID NO: 42431 - DNA, 21 bp, Artificial Sequence
  Description of Artificial Sequence: Synthetic oligonucleotide
agagacagcaccaaactcgtc

SEQ ID NO: 42432 - DNA, 21 bp, Artificial Sequence
  Description of Artificial Sequence: Synthetic oligonucleotide
aattcgcatacgcctgtgcgg

SEQ ID NO: 42433 - DNA, 21 bp, Artificial Sequence
  Description of Artificial Sequence: Synthetic oligonucleotide
cccagagtcaaacccgccagc

SEQ ID NO: 42434 - DNA, 21 bp, Artificial Sequence
  Description of Artificial Sequence: Synthetic oligonucleotide
cctccttctaagccgaatact

SEQ ID NO: 42435 - DNA, 21 bp, Artificial Sequence
  Description of Artificial Sequence: Synthetic oligonucleotide
ggcagcaacagaatcctcggc

SEQ ID NO: 42436 - DNA, 21 bp, Artificial Sequence
  Description of Artificial Sequence: Synthetic oligonucleotide
ggcggccacagccccaacaga

SEQ ID NO: 42437 - DNA, 21 bp, Artificial Sequence
  Description of Artificial Sequence: Synthetic oligonucleotide
tttgtttcgcgggagaggtcg

SEQ ID NO: 42438 - DNA, 21 bp, Artificial Sequence
  Description of Artificial Sequence: Synthetic oligonucleotide
tacaccgccgcccccggcaga

SEQ ID NO: 42439 - DNA, 21 bp, Artificial Sequence
  Description of Artificial Sequence: Synthetic oligonucleotide
tataatgtgaatcgtaatacg

SEQ ID NO: 42440 - DNA, 21 bp, Artificial Sequence
  Description of Artificial Sequence: Synthetic oligonucleotide
gagcggaaggttcagaattgt

SEQ ID NO: 42441 - DNA, 21 bp, Artificial Sequence
  Description of Artificial Sequence: Synthetic oligonucleotide
ggtaggcttaatatgctgtcg

SEQ ID NO: 42442 - DNA, 21 bp, Artificial Sequence
  Description of Artificial Sequence: Synthetic oligonucleotide
ttgcagaagccgagtctggtt

SEQ ID NO: 42443 - DNA, 21 bp, Artificial Sequence
  Description of Artificial Sequence: Synthetic oligonucleotide
ggcagaaccgccgaaggcaga

SEQ ID NO: 42444 - DNA, 21 bp, Artificial Sequence
  Description of Artificial Sequence: Synthetic oligonucleotide
cacgtcatcgccccccaacaa

SEQ ID NO: 42445 - DNA, 21 bp, Artificial Sequence
  Description of Artificial Sequence: Synthetic oligonucleotide
caccaaaccaccggcctcaaa

SEQ ID NO: 42446 - DNA, 21 bp, Artificial Sequence
  Description of Artificial Sequence: Synthetic oligonucleotide
gggcagagtgggagtcgtttg

SEQ ID NO: 42447 - DNA, 21 bp, Artificial Sequence
  Description of Artificial Sequence: Synthetic oligonucleotide
caaggcagcagcccccaaaga

SEQ ID NO: 42448 - DNA, 21 bp, Artificial Sequence
  Description of Artificial Sequence: Synthetic oligonucleotide
gccgccaccaacagattcggc

SEQ ID NO: 42449 - DNA, 21 bp, Artificial Sequence
  Description of Artificial Sequence: Synthetic oligonucleotide
agattccccgccaaagaattc

SEQ ID NO: 42450 - DNA, 21 bp, Artificial Sequence
  Description of Artificial Sequence: Synthetic oligonucleotide
acggggtctgggagtaatcat

SEQ ID NO: 42451 - DNA, 21 bp, Artificial Sequence
  Description of Artificial Sequence: Synthetic oligonucleotide
caggttcctgtgcggcctgtt

SEQ ID NO: 42452 - DNA, 21 bp, Artificial Sequence
  Description of Artificial Sequence: Synthetic oligonucleotide
actcttgcttatgataataac

SEQ ID NO: 42453 - DNA, 21 bp, Artificial Sequence
  Description of Artificial Sequence: Synthetic oligonucleotide
cctcggtcttctggtggtttt

SEQ ID NO: 42454 - DNA, 21 bp, Artificial Sequence
  Description of Artificial Sequence: Synthetic oligonucleotide
cccagcagaaacaccagcctc

SEQ ID NO: 42455 - DNA, 21 bp, Artificial Sequence
  Description of Artificial Sequence: Synthetic oligonucleotide
acgggtatgaggaatattggg

SEQ ID NO: 42456 - DNA, 21 bp, Artificial Sequence
  Description of Artificial Sequence: Synthetic oligonucleotide
ggcctccaaaccccccccaga

SEQ ID NO: 42457 - DNA, 21 bp, Artificial Sequence
  Description of Artificial Sequence: Synthetic oligonucleotide
tttcagccgaggagttctacg

SEQ ID NO: 42458 - DNA, 21 bp, Artificial Sequence
  Description of Artificial Sequence: Synthetic oligonucleotide
cccatgagccacgtcagcggc

SEQ ID NO: 42459 - DNA, 21 bp, Artificial Sequence
  Description of Artificial Sequence: Synthetic oligonucleotide
gttagggggtctgatccgacg

SEQ ID NO: 42460 - DNA, 21 bp, Artificial Sequence
  Description of Artificial Sequence: Synthetic oligonucleotide
atgaaggggaataatctgagt

SEQ ID NO: 42461 - DNA, 21 bp, Artificial Sequence
  Description of Artificial Sequence: Synthetic oligonucleotide
cgtattagtgagaatatgcgg

SEQ ID NO: 42462 - DNA, 21 bp, Artificial Sequence
  Description of Artificial Sequence: Synthetic oligonucleotide
tatgggaagagtgttacgcct

SEQ ID NO: 42463 - DNA, 21 bp, Artificial Sequence
  Description of Artificial Sequence: Synthetic oligonucleotide
aatgctaatgtgcagactcgg

SEQ ID NO: 42464 - DNA, 21 bp, Artificial Sequence
  Description of Artificial Sequence: Synthetic oligonucleotide
aagtctgcggatcagggtcgt

SEQ ID NO: 42465 - DNA, 21 bp, Artificial Sequence
  Description of Artificial Sequence: Synthetic oligonucleotide
gctgggtcttcgtcgcgtagt

SEQ ID NO: 42466 - DNA, 21 bp, Artificial Sequence
  Description of Artificial Sequence: Synthetic oligonucleotide
catcatgatgctagtccgaat

SEQ ID NO: 42467 - DNA, 21 bp, Artificial Sequence
  Description of Artificial Sequence: Synthetic oligonucleotide
gccatgggcagcagactcagc

SEQ ID NO: 42468 - DNA, 21 bp, Artificial Sequence
  Description of Artificial Sequence: Synthetic oligonucleotide
tattctaattcgcgtgtgggt

SEQ ID NO: 42469 - DNA, 21 bp, Artificial Sequence
  Description of Artificial Sequence: Synthetic oligonucleotide
gtcagaagcctccccgccatg

SEQ ID NO: 42470 - DNA, 21 bp, Artificial Sequence
  Description of Artificial Sequence: Synthetic oligonucleotide
tacttcaacagccacagcaac

SEQ ID NO: 42471 - DNA, 21 bp, Artificial Sequence
  Description of Artificial Sequence: Synthetic oligonucleotide
ccgacggcttcgaataggagt

SEQ ID NO: 42472 - DNA, 21 bp, Artificial Sequence
  Description of Artificial Sequence: Synthetic oligonucleotide
actcagcagaatgggagtaat

SEQ ID NO: 42473 - DNA, 21 bp, Artificial Sequence
  Description of Artificial Sequence: Synthetic oligonucleotide
agcaccagcaaagactacacc

SEQ ID NO: 42474 - DNA, 21 bp, Artificial Sequence
  Description of Artificial Sequence: Synthetic oligonucleotide
aatcctgctgagcagtatacg

SEQ ID NO: 42475 - DNA, 21 bp, Artificial Sequence
  Description of Artificial Sequence: Synthetic oligonucleotide
tctaggtctcatgcgatgact

SEQ ID NO: 42476 - DNA, 21 bp, Artificial Sequence
  Description of Artificial Sequence: Synthetic oligonucleotide
cggtcgggtaatggttctttg

SEQ ID NO: 42477 - DNA, 21 bp, Artificial Sequence
  Description of Artificial Sequence: Synthetic oligonucleotide
caccccaccagaagcaccgcc

SEQ ID NO: 42478 - DNA, 21 bp, Artificial Sequence
  Description of Artificial Sequence: Synthetic oligonucleotide
actcctgtgaataggactcat

SEQ ID NO: 42479 - DNA, 21 bp, Artificial Sequence
  Description of Artificial Sequence: Synthetic oligonucleotide
agtagtgcttctacttataag

SEQ ID NO: 42480 - DNA, 21 bp, Artificial Sequence
  Description of Artificial Sequence: Synthetic oligonucleotide
tctacggtgggtcatatgaat

SEQ ID NO: 42481 - DNA, 21 bp, Artificial Sequence
  Description of Artificial Sequence: Synthetic oligonucleotide
cagggtcctaagaatgctgat

SEQ ID NO: 42482 - DNA, 21 bp, Artificial Sequence
  Description of Artificial Sequence: Synthetic oligonucleotide
agcagccacagcccccacaga

SEQ ID NO: 42483 - DNA, 21 bp, Artificial Sequence
  Description of Artificial Sequence: Synthetic oligonucleotide
gaaaacatcagcagaagccac

SEQ ID NO: 42484 - DNA, 21 bp, Artificial Sequence
  Description of Artificial Sequence: Synthetic oligonucleotide
actaggatgaataagcagact

SEQ ID NO: 42485 - DNA, 21 bp, Artificial Sequence
  Description of Artificial Sequence: Synthetic oligonucleotide
tttagtagtgcttcttttacg

SEQ ID NO: 42486 - DNA, 21 bp, Artificial Sequence
  Description of Artificial Sequence: Synthetic oligonucleotide
tgcggcaccctcagcagctgc

SEQ ID NO: 42487 - DNA, 21 bp, Artificial Sequence
  Description of Artificial Sequence: Synthetic oligonucleotide
cacgggtcgtctgttcattct

SEQ ID NO: 42488 - DNA, 21 bp, Artificial Sequence
  Description of Artificial Sequence: Synthetic oligonucleotide
tcgggtagttcgacttttagg

SEQ ID NO: 42489 - DNA, 21 bp, Artificial Sequence
  Description of Artificial Sequence: Synthetic oligonucleotide
agcatcagcaaccaaagaagc

SEQ ID NO: 42490 - DNA, 21 bp, Artificial Sequence
  Description of Artificial Sequence: Synthetic oligonucleotide
aacggttctggacagaatcga

SEQ ID NO: 42491 - DNA, 21 bp, Artificial Sequence
  Description of Artificial Sequence: Synthetic oligonucleotide
cgggatcatagtggttcgagg

SEQ ID NO: 42492 - DNA, 21 bp, Artificial Sequence
  Description of Artificial Sequence: Synthetic oligonucleotide
tcttctaagactaatgtttcg

SEQ ID NO: 42493 - DNA, 21 bp, Artificial Sequence
  Description of Artificial Sequence: Synthetic oligonucleotide
agcagagcccaaagcatcccc

SEQ ID NO: 42494 - DNA, 21 bp, Artificial Sequence
  Description of Artificial Sequence: Synthetic oligonucleotide
cttaataggggtaagcctgtt

SEQ ID NO: 42495 - DNA, 21 bp, Artificial Sequence
  Description of Artificial Sequence: Synthetic oligonucleotide
cattcgggtacgaggactagt

SEQ ID NO: 42496 - DNA, 21 bp, Artificial Sequence
  Description of Artificial Sequence: Synthetic oligonucleotide
aatgatcaggctcagttgacg

SEQ ID NO: 42497 - DNA, 21 bp, Artificial Sequence
  Description of Artificial Sequence: Synthetic oligonucleotide
aacaccaccgccaaaagcagc

SEQ ID NO: 42498 - DNA, 21 bp, Artificial Sequence
  Description of Artificial Sequence: Synthetic oligonucleotide
aacggttctggaaagaatcaa

SEQ ID NO: 42499 - DNA, 21 bp, Artificial Sequence
  Description of Artificial Sequence: Synthetic oligonucleotide
caaacccaaggccaactcaaa

SEQ ID NO: 42500 - DNA, 21 bp, Artificial Sequence
  Description of Artificial Sequence: Synthetic oligonucleotide
aattctgcgggtactcgggtg

SEQ ID NO: 42501 - DNA, 21 bp, Artificial Sequence
  Description of Artificial Sequence: Synthetic oligonucleotide
ccggtgggttcgcgtggtggt

SEQ ID NO: 42502 - DNA, 21 bp, Artificial Sequence
  Description of Artificial Sequence: Synthetic oligonucleotide
gatacgaataatagggctaat

SEQ ID NO: 42503 - DNA, 21 bp, Artificial Sequence
  Description of Artificial Sequence: Synthetic oligonucleotide
agccaccccagcagcttcggc

SEQ ID NO: 42504 - DNA, 21 bp, Artificial Sequence
  Description of Artificial Sequence: Synthetic oligonucleotide
aaggttcatcggagtgataat

SEQ ID NO: 42505 - DNA, 21 bp, Artificial Sequence
  Description of Artificial Sequence: Synthetic oligonucleotide
ggttcgccgggggttttgcgt

SEQ ID NO: 42506 - DNA, 21 bp, Artificial Sequence
  Description of Artificial Sequence: Synthetic oligonucleotide
cggcagacgactccgctgggt

SEQ ID NO: 42507 - DNA, 21 bp, Artificial Sequence
  Description of Artificial Sequence: Synthetic oligonucleotide
gatatggtgagtccgcggaat

SEQ ID NO: 42508 - DNA, 21 bp, Artificial Sequence
  Description of Artificial Sequence: Synthetic oligonucleotide
agcaacgacagcagaatcaga

SEQ ID NO: 42509 - DNA, 21 bp, Artificial Sequence
  Description of Artificial Sequence: Synthetic oligonucleotide
caaaccatgcccaaactcgcc

SEQ ID NO: 42510 - DNA, 21 bp, Artificial Sequence
  Description of Artificial Sequence: Synthetic oligonucleotide
gggcctcgttctatgtctaat

SEQ ID NO: 42511 - DNA, 21 bp, Artificial Sequence
  Description of Artificial Sequence: Synthetic oligonucleotide
tttcgggcgcaggctaatgtt

SEQ ID NO: 42512 - DNA, 21 bp, Artificial Sequence
  Description of Artificial Sequence: Synthetic oligonucleotide
tcgactaagagtaagccgatt

SEQ ID NO: 42513 - DNA, 21 bp, Artificial Sequence
  Description of Artificial Sequence: Synthetic oligonucleotide
cccggcaacatgaccagcaga

SEQ ID NO: 42514 - DNA, 21 bp, Artificial Sequence
  Description of Artificial Sequence: Synthetic oligonucleotide
agcaaagccggcagagtcacc

SEQ ID NO: 42515 - DNA, 21 bp, Artificial Sequence
  Description of Artificial Sequence: Synthetic oligonucleotide
atggggtcgagtgtgaggtct

SEQ ID NO: 42516 - DNA, 21 bp, Artificial Sequence
  Description of Artificial Sequence: Synthetic oligonucleotide
gcccacagcaacaacagctac

SEQ ID NO: 42517 - DNA, 21 bp, Artificial Sequence
  Description of Artificial Sequence: Synthetic oligonucleotide
caaaccaaacccgccttcaga

SEQ ID NO: 42518 - DNA, 21 bp, Artificial Sequence
  Description of Artificial Sequence: Synthetic oligonucleotide
attgcgactaaggcggttgct

SEQ ID NO: 42519 - DNA, 21 bp, Artificial Sequence
  Description of Artificial Sequence: Synthetic oligonucleotide
actcagcagaaggggagtaat

SEQ ID NO: 42520 - DNA, 21 bp, Artificial Sequence
  Description of Artificial Sequence: Synthetic oligonucleotide
tctgattctcgtaatacgaat

SEQ ID NO: 42521 - DNA, 21 bp, Artificial Sequence
  Description of Artificial Sequence: Synthetic oligonucleotide
ccggcgactgtgactggtgtt

SEQ ID NO: 42522 - DNA, 21 bp, Artificial Sequence
  Description of Artificial Sequence: Synthetic oligonucleotide
gggattacggctaagttgacg

SEQ ID NO: 42523 - DNA, 21 bp, Artificial Sequence
  Description of Artificial Sequence: Synthetic oligonucleotide
cctgtgtctgatcggaggggt

SEQ ID NO: 42524 - DNA, 21 bp, Artificial Sequence
  Description of Artificial Sequence: Synthetic oligonucleotide
tctaaggctagtgggtttgct

SEQ ID NO: 42525 - DNA, 21 bp, Artificial Sequence
  Description of Artificial Sequence: Synthetic oligonucleotide
ccgcttaatgctcggggtagt

SEQ ID NO: 42526 - DNA, 21 bp, Artificial Sequence
  Description of Artificial Sequence: Synthetic oligonucleotide
ggccaaaccagagaaagcagc

SEQ ID NO: 42527 - DNA, 21 bp, Artificial Sequence
  Description of Artificial Sequence: Synthetic oligonucleotide
agccccgccagcctccccaaa

SEQ ID NO: 42528 - DNA, 21 bp, Artificial Sequence
  Description of Artificial Sequence: Synthetic oligonucleotide
aacggcagcggccaaaacaaa

SEQ ID NO: 42529 - DNA, 21 bp, Artificial Sequence
  Description of Artificial Sequence: Synthetic oligonucleotide
aaggggcctggttctccttct

SEQ ID NO: 42530 - DNA, 21 bp, Artificial Sequence
  Description of Artificial Sequence: Synthetic oligonucleotide
ggtagggagattggtaattat

SEQ ID NO: 42531 - DNA, 21 bp, Artificial Sequence
  Description of Artificial Sequence: Synthetic oligonucleotide
agaagcgtcggcgccaaagcc

SEQ ID NO: 42532 - DNA, 21 bp, Artificial Sequence
  Description of Artificial Sequence: Synthetic oligonucleotide
agaagactcaacatcgaagac

SEQ ID NO: 42533 - DNA, 21 bp, Artificial Sequence
  Description of Artificial Sequence: Synthetic oligonucleotide
ccgagtaatagtaatatgctg

SEQ ID NO: 42534 - DNA, 21 bp, Artificial Sequence
  Description of Artificial Sequence: Synthetic oligonucleotide
gaccccagaaacagcaccagc

SEQ ID NO: 42535 - DNA, 21 bp, Artificial Sequence
  Description of Artificial Sequence: Synthetic oligonucleotide
gagacgaggaagcagggggtt

SEQ ID NO: 42536 - DNA, 21 bp, Artificial Sequence
  Description of Artificial Sequence: Synthetic oligonucleotide
gtgtcttatgctcgtacggag

SEQ ID NO: 42537 - DNA, 21 bp, Artificial Sequence
  Description of Artificial Sequence: Synthetic oligonucleotide
cagcctacgcggtctacggct

SEQ ID NO: 42538 - DNA, 21 bp, Artificial Sequence
  Description of Artificial Sequence: Synthetic oligonucleotide
cctcggacgagggatacttct

SEQ ID NO: 42539 - DNA, 21 bp, Artificial Sequence
  Description of Artificial Sequence: Synthetic oligonucleotide
gccctccacgccagctacaac

SEQ ID NO: 42540 - DNA, 21 bp, Artificial Sequence
  Description of Artificial Sequence: Synthetic oligonucleotide
aaaagcaaaatccaacacccc

SEQ ID NO: 42541 - DNA, 21 bp, Artificial Sequence
  Description of Artificial Sequence: Synthetic oligonucleotide
aaagacaacacccccggcaga

SEQ ID NO: 42542 - DNA, 21 bp, Artificial Sequence
  Description of Artificial Sequence: Synthetic oligonucleotide
aagcctacgcggtctacggct

SEQ ID NO: 42543 - DNA, 21 bp, Artificial Sequence
  Description of Artificial Sequence: Synthetic oligonucleotide
caacccaacaccacctacaga

SEQ ID NO: 42544 - DNA, 21 bp, Artificial Sequence
  Description of Artificial Sequence: Synthetic oligonucleotide
tacatccacaaccaaaccggc

SEQ ID NO: 42545 - DNA, 21 bp, Artificial Sequence
  Description of Artificial Sequence: Synthetic oligonucleotide
tttaatattcagggtcttggt

SEQ ID NO: 42546 - DNA, 21 bp, Artificial Sequence
  Description of Artificial Sequence: Synthetic oligonucleotide
gcttattcgaatattcagaat

SEQ ID NO: 42547 - DNA, 21 bp, Artificial Sequence
  Description of Artificial Sequence: Synthetic oligonucleotide
aagaatgagtcgatggttctt

SEQ ID NO: 42548 - DNA, 21 bp, Artificial Sequence
  Description of Artificial Sequence: Synthetic oligonucleotide
tctggttcgaataattttttg

SEQ ID NO: 42549 - DNA, 21 bp, Artificial Sequence
  Description of Artificial Sequence: Synthetic oligonucleotide
gcgattcggtcgggttatgtt

SEQ ID NO: 42550 - DNA, 21 bp, Artificial Sequence
  Description of Artificial Sequence: Synthetic oligonucleotide
ttttcggtgcaggggcagtgt

SEQ ID NO: 42551 - DNA, 21 bp, Artificial Sequence
  Description of Artificial Sequence: Synthetic oligonucleotide
aacagcacccaaatcaccccc

SEQ ID NO: 42552 - DNA, 21 bp, Artificial Sequence
  Description of Artificial Sequence: Synthetic oligonucleotide
accaacatcaccccccccctc

SEQ ID NO: 42553 - DNA, 21 bp, Artificial Sequence
  Description of Artificial Sequence: Synthetic oligonucleotide
ttccccagcaacggcagaacc

SEQ ID NO: 42554 - DNA, 21 bp, Artificial Sequence
  Description of Artificial Sequence: Synthetic oligonucleotide
ggtaatagtactcgtcttttg

SEQ ID NO: 42555 - DNA, 21 bp, Artificial Sequence
  Description of Artificial Sequence: Synthetic oligonucleotide
tacagacacaccagcaccggc

SEQ ID NO: 42556 - DNA, 21 bp, Artificial Sequence
  Description of Artificial Sequence: Synthetic oligonucleotide
aataatactcagaagaattct

SEQ ID NO: 42557 - DNA, 21 bp, Artificial Sequence
  Description of Artificial Sequence: Synthetic oligonucleotide
ccgctgggtcagtcttatcgg

SEQ ID NO: 42558 - DNA, 21 bp, Artificial Sequence
  Description of Artificial Sequence: Synthetic oligonucleotide
cgtaattctgagtatactggg

SEQ ID NO: 42559 - DNA, 21 bp, Artificial Sequence
  Description of Artificial Sequence: Synthetic oligonucleotide
agccaaaccgtcaaaaccggc

SEQ ID NO: 42560 - DNA, 21 bp, Artificial Sequence
  Description of Artificial Sequence: Synthetic oligonucleotide
gctcttttgaatattaatact

SEQ ID NO: 42561 - DNA, 21 bp, Artificial Sequence
  Description of Artificial Sequence: Synthetic oligonucleotide
atgctccaaagagcccccggc

SEQ ID NO: 42562 - DNA, 21 bp, Artificial Sequence
  Description of Artificial Sequence: Synthetic oligonucleotide
gaaaacatgggcagacccggc

SEQ ID NO: 42563 - DNA, 21 bp, Artificial Sequence
  Description of Artificial Sequence: Synthetic oligonucleotide
tacgtcagacccggcaccggc

SEQ ID NO: 42564 - DNA, 21 bp, Artificial Sequence
  Description of Artificial Sequence: Synthetic oligonucleotide
ccggggtctgggagtaataat

SEQ ID NO: 42565 - DNA, 21 bp, Artificial Sequence
  Description of Artificial Sequence: Synthetic oligonucleotide
aatagtaatgggattaataat

SEQ ID NO: 42566 - DNA, 21 bp, Artificial Sequence
  Description of Artificial Sequence: Synthetic oligonucleotide
aattttaatagtccttcgaat

SEQ ID NO: 42567 - DNA, 21 bp, Artificial Sequence
  Description of Artificial Sequence: Synthetic oligonucleotide
agcacctactgcaaagacccc

SEQ ID NO: 42568 - DNA, 21 bp, Artificial Sequence
  Description of Artificial Sequence: Synthetic oligonucleotide
aatagtaatgggttgaataat

SEQ ID NO: 42569 - DNA, 21 bp, Artificial Sequence
  Description of Artificial Sequence: Synthetic oligonucleotide
tctattggtaaggggtataat

SEQ ID NO: 42570 - DNA, 21 bp, Artificial Sequence
  Description of Artificial Sequence: Synthetic oligonucleotide
taccaaaaagaaagagtcgtc

SEQ ID NO: 42571 - DNA, 21 bp, Artificial Sequence
  Description of Artificial Sequence: Synthetic oligonucleotide
aattcggggaggaattctgtt

SEQ ID NO: 42572 - DNA, 21 bp, Artificial Sequence
  Description of Artificial Sequence: Synthetic oligonucleotide
tgccacaaaagacccggcgaa

SEQ ID NO: 42573 - DNA, 21 bp, Artificial Sequence
  Description of Artificial Sequence: Synthetic oligonucleotide
aatagtaatctgtcgactcag

SEQ ID NO: 42574 - DNA, 21 bp, Artificial Sequence
  Description of Artificial Sequence: Synthetic oligonucleotide
tcttctgggggtaatatgagt

SEQ ID NO: 42575 - DNA, 21 bp, Artificial Sequence
  Description of Artificial Sequence: Synthetic oligonucleotide
aaggattttggtcagatgcgg

SEQ ID NO: 42576 - DNA, 21 bp, Artificial Sequence
  Description of Artificial Sequence: Synthetic oligonucleotide
tctattaagactgttactaat

SEQ ID NO: 42577 - DNA, 21 bp, Artificial Sequence
  Description of Artificial Sequence: Synthetic oligonucleotide
gaagtcttcagcagccaaaaa

SEQ ID NO: 42578 - DNA, 21 bp, Artificial Sequence
  Description of Artificial Sequence: Synthetic oligonucleotide
aatggttttaatagtaataat

SEQ ID NO: 42579 - DNA, 21 bp, Artificial Sequence
  Description of Artificial Sequence: Synthetic oligonucleotide
gccagcagagccccccccggc

SEQ ID NO: 42580 - DNA, 21 bp, Artificial Sequence
  Description of Artificial Sequence: Synthetic oligonucleotide
catctttattctcctcgtggt

SEQ ID NO: 42581 - DNA, 21 bp, Artificial Sequence
  Description of Artificial Sequence: Synthetic oligonucleotide
agtcagattccgccgtctact

SEQ ID NO: 42582 - DNA, 21 bp, Artificial Sequence
  Description of Artificial Sequence: Synthetic oligonucleotide
aacaacaaaggcaaccccggc

SEQ ID NO: 42583 - DNA, 21 bp, Artificial Sequence
  Description of Artificial Sequence: Synthetic oligonucleotide
cccaaagccagacaacacaac

SEQ ID NO: 42584 - DNA, 21 bp, Artificial Sequence
  Description of Artificial Sequence: Synthetic oligonucleotide
aaagccaccgtccccgccggc

SEQ ID NO: 42585 - DNA, 21 bp, Artificial Sequence
  Description of Artificial Sequence: Synthetic oligonucleotide
cctgttcgggagggttctatt

SEQ ID NO: 42586 - DNA, 21 bp, Artificial Sequence
  Description of Artificial Sequence: Synthetic oligonucleotide
aatccttcggagaagatgttg

SEQ ID NO: 42587 - DNA, 21 bp, Artificial Sequence
  Description of Artificial Sequence: Synthetic oligonucleotide
aaaatcaacaccagaaacatg

SEQ ID NO: 42588 - DNA, 21 bp, Artificial Sequence
  Description of Artificial Sequence: Synthetic oligonucleotide
ggtgttaataataatattaat

SEQ ID NO: 42589 - DNA, 21 bp, Artificial Sequence
  Description of Artificial Sequence: Synthetic oligonucleotide
agcttcaccaaaggcgccggc

SEQ ID NO: 42590 - DNA, 21 bp, Artificial Sequence
  Description of Artificial Sequence: Synthetic oligonucleotide
attcagaatagttctaatact

SEQ ID NO: 42591 - DNA, 21 bp, Artificial Sequence
  Description of Artificial Sequence: Synthetic oligonucleotide
ctcgcccaagaaagaggcacc

SEQ ID NO: 42592 - DNA, 21 bp, Artificial Sequence
  Description of Artificial Sequence: Synthetic oligonucleotide
gaagtcagaagacaaagcacc

SEQ ID NO: 42593 - DNA, 21 bp, Artificial Sequence
  Description of Artificial Sequence: Synthetic oligonucleotide
ctcagcagcacccacatgacc

SEQ ID NO: 42594 - DNA, 21 bp, Artificial Sequence
  Description of Artificial Sequence: Synthetic oligonucleotide
attcagtcgcctgggaatatg

SEQ ID NO: 42595 - DNA, 21 bp, Artificial Sequence
  Description of Artificial Sequence: Synthetic oligonucleotide
tttaattcgacggctaatcgg

SEQ ID NO: 42596 - DNA, 21 bp, Artificial Sequence
  Description of Artificial Sequence: Synthetic oligonucleotide
aaaaaccaagcccccctcctc

SEQ ID NO: 42597 - DNA, 21 bp, Artificial Sequence
  Description of Artificial Sequence: Synthetic oligonucleotide
agcgtcgacaccagaaccggc

SEQ ID NO: 42598 - DNA, 21 bp, Artificial Sequence
  Description of Artificial Sequence: Synthetic oligonucleotide
aaagccggccaagaaagaacc

SEQ ID NO: 42599 - DNA, 21 bp, Artificial Sequence
  Description of Artificial Sequence: Synthetic oligonucleotide
tttcttacggggaatactgct

SEQ ID NO: 42600 - DNA, 21 bp, Artificial Sequence
  Description of Artificial Sequence: Synthetic oligonucleotide
gacaacggcgacggctacccc

SEQ ID NO: 42601 - DNA, 21 bp, Artificial Sequence
  Description of Artificial Sequence: Synthetic oligonucleotide
tattctgggggtaatatgagt

SEQ ID NO: 42602 - DNA, 21 bp, Artificial Sequence
  Description of Artificial Sequence: Synthetic oligonucleotide
ctcatcagcaccgcccaaaga

SEQ ID NO: 42603 - DNA, 21 bp, Artificial Sequence
  Description of Artificial Sequence: Synthetic oligonucleotide
attcctgcgaattcttttaag

SEQ ID NO: 42604 - DNA, 21 bp, Artificial Sequence
  Description of Artificial Sequence: Synthetic oligonucleotide
tctatgtctgagcatctgaag

SEQ ID NO: 42605 - DNA, 21 bp, Artificial Sequence
  Description of Artificial Sequence: Synthetic oligonucleotide
gattattctagtgatagttcg

SEQ ID NO: 42606 - DNA, 21 bp, Artificial Sequence
  Description of Artificial Sequence: Synthetic oligonucleotide
gaaaccaccacccccagaaaa

SEQ ID NO: 42607 - DNA, 21 bp, Artificial Sequence
  Description of Artificial Sequence: Synthetic oligonucleotide
aatcctggggagtcgcatcgt

SEQ ID NO: 42608 - DNA, 21 bp, Artificial Sequence
  Description of Artificial Sequence: Synthetic oligonucleotide
tctttgggttctggttttcag

SEQ ID NO: 42609 - DNA, 21 bp, Artificial Sequence
  Description of Artificial Sequence: Synthetic oligonucleotide
tatattcataatccgactggt

SEQ ID NO: 42610 - DNA, 21 bp, Artificial Sequence
  Description of Artificial Sequence: Synthetic oligonucleotide
catacttcgagtaattctctt

SEQ ID NO: 42611 - DNA, 21 bp, Artificial Sequence
  Description of Artificial Sequence: Synthetic oligonucleotide
aataatagtaagagtcagatt

SEQ ID NO: 42612 - DNA, 21 bp, Artificial Sequence
  Description of Artificial Sequence: Synthetic oligonucleotide
gaagtcaacaccagaagcaga

SEQ ID NO: 42613 - DNA, 21 bp, Artificial Sequence
  Description of Artificial Sequence: Synthetic oligonucleotide
catacggctaatagtcagagt

SEQ ID NO: 42614 - DNA, 21 bp, Artificial Sequence
  Description of Artificial Sequence: Synthetic oligonucleotide
ggtccggcgaatactagtggt

SEQ ID NO: 42615 - DNA, 21 bp, Artificial Sequence
  Description of Artificial Sequence: Synthetic oligonucleotide
cccgccaaaagccccgccacc

SEQ ID NO: 42616 - DNA, 21 bp, Artificial Sequence
  Description of Artificial Sequence: Synthetic oligonucleotide
ttcagcgccagcggcgccaga

SEQ ID NO: 42617 - DNA, 21 bp, Artificial Sequence
  Description of Artificial Sequence: Synthetic oligonucleotide
caacaaggcagaaccgccggc

SEQ ID NO: 42618 - DNA, 21 bp, Artificial Sequence
  Description of Artificial Sequence: Synthetic oligonucleotide
tcgcgtgctgcgcattatggg

SEQ ID NO: 42619 - DNA, 21 bp, Artificial Sequence
  Description of Artificial Sequence: Synthetic oligonucleotide
ggcctcgccagagccggccac

SEQ ID NO: 42620 - DNA, 21 bp, Artificial Sequence
  Description of Artificial Sequence: Synthetic oligonucleotide
agtactactgggggggctagt

SEQ ID NO: 42621 - DNA, 21 bp, Artificial Sequence
  Description of Artificial Sequence: Synthetic oligonucleotide
ggttctaatattaataatggt

SEQ ID NO: 42622 - DNA, 21 bp, Artificial Sequence
  Description of Artificial Sequence: Synthetic oligonucleotide
attcagacgcatactagtaat

SEQ ID NO: 42623 - DNA, 21 bp, Artificial Sequence
  Description of Artificial Sequence: Synthetic oligonucleotide
tcttattcggagctggttcgg

SEQ ID NO: 42624 - DNA, 21 bp, Artificial Sequence
  Description of Artificial Sequence: Synthetic oligonucleotide
ctcggcagcagcaccatcttc

SEQ ID NO: 42625 - DNA, 21 bp, Artificial Sequence
  Description of Artificial Sequence: Synthetic oligonucleotide
atggccggcaacagcgtcccc

SEQ ID NO: 42626 - DNA, 21 bp, Artificial Sequence
  Description of Artificial Sequence: Synthetic oligonucleotide
catgatagtaaggttatttct

SEQ ID NO: 42627 - DNA, 21 bp, Artificial Sequence
  Description of Artificial Sequence: Synthetic oligonucleotide
ttcatcggcaccagcaccccc

SEQ ID NO: 42628 - DNA, 21 bp, Artificial Sequence
  Description of Artificial Sequence: Synthetic oligonucleotide
gtcctcagagacggccacaga

SEQ ID NO: 42629 - DNA, 21 bp, Artificial Sequence
  Description of Artificial Sequence: Synthetic oligonucleotide
accggcgacagccccctcgcc

SEQ ID NO: 42630 - DNA, 21 bp, Artificial Sequence
  Description of Artificial Sequence: Synthetic oligonucleotide
cccgtcctcggctacagctac

SEQ ID NO: 42631 - DNA, 21 bp, Artificial Sequence
  Description of Artificial Sequence: Synthetic oligonucleotide
gacttcagcgaaaaaagactc

SEQ ID NO: 42632 - DNA, 21 bp, Artificial Sequence
  Description of Artificial Sequence: Synthetic oligonucleotide
gggaatcagagtcctcgggtt

SEQ ID NO: 42633 - DNA, 21 bp, Artificial Sequence
  Description of Artificial Sequence: Synthetic oligonucleotide
cctcgggatactactgggtct

SEQ ID NO: 42634 - DNA, 21 bp, Artificial Sequence
  Description of Artificial Sequence: Synthetic oligonucleotide
cttagggatacgaatatgaat

SEQ ID NO: 42635 - DNA, 21 bp, Artificial Sequence
  Description of Artificial Sequence: Synthetic oligonucleotide
tctgttactagtcctaataag

SEQ ID NO: 42636 - DNA, 21 bp, Artificial Sequence
  Description of Artificial Sequence: Synthetic oligonucleotide
gacagcaaacacaccagcacc

SEQ ID NO: 42637 - DNA, 21 bp, Artificial Sequence
  Description of Artificial Sequence: Synthetic oligonucleotide
accggccaacaaaccgccacc

SEQ ID NO: 42638 - DNA, 21 bp, Artificial Sequence
  Description of Artificial Sequence: Synthetic oligonucleotide
tttatgggtcgtcctaatgtt

SEQ ID NO: 42639 - DNA, 21 bp, Artificial Sequence
  Description of Artificial Sequence: Synthetic oligonucleotide
gtccaacacacccacagcggc

SEQ ID NO: 42640 - DNA, 21 bp, Artificial Sequence
  Description of Artificial Sequence: Synthetic oligonucleotide
agaaacgacaaacaaaacagc

SEQ ID NO: 42641 - DNA, 21 bp, Artificial Sequence
  Description of Artificial Sequence: Synthetic oligonucleotide
aacgacgtcaaacaaggccac

SEQ ID NO: 42642 - DNA, 21 bp, Artificial Sequence
  Description of Artificial Sequence: Synthetic oligonucleotide
tataataatggtggtactcgt

SEQ ID NO: 42643 - DNA, 21 bp, Artificial Sequence
  Description of Artificial Sequence: Synthetic oligonucleotide
tctttttcgaagggttctagt

SEQ ID NO: 42644 - DNA, 21 bp, Artificial Sequence
  Description of Artificial Sequence: Synthetic oligonucleotide
cttgggcctgggaagaatact

SEQ ID NO: 42645 - DNA, 21 bp, Artificial Sequence
  Description of Artificial Sequence: Synthetic oligonucleotide
cccagcaacaaaaccaacagc

SEQ ID NO: 42646 - DNA, 21 bp, Artificial Sequence
  Description of Artificial Sequence: Synthetic oligonucleotide
ggcctccaaaccccccccaga

SEQ ID NO: 42647 - DNA, 21 bp, Artificial Sequence
  Description of Artificial Sequence: Synthetic oligonucleotide
actcatctgactggtgttcag

SEQ ID NO: 42648 - DNA, 21 bp, Artificial Sequence
  Description of Artificial Sequence: Synthetic oligonucleotide
actggtactgggagttttcat

SEQ ID NO: 42649 - DNA, 21 bp, Artificial Sequence
  Description of Artificial Sequence: Synthetic oligonucleotide
ttggttcgggcgactcatgag

SEQ ID NO: 42650 - DNA, 21 bp, Artificial Sequence
  Description of Artificial Sequence: Synthetic oligonucleotide
gccctcgccaacccccaaacc

SEQ ID NO: 42651 - DNA, 21 bp, Artificial Sequence
  Description of Artificial Sequence: Synthetic oligonucleotide
tttgtgaagacgcatagtgcg

SEQ ID NO: 42652 - DNA, 21 bp, Artificial Sequence
  Description of Artificial Sequence: Synthetic oligonucleotide
agagtcgaaagccccaccaac

SEQ ID NO: 42653 - DNA, 21 bp, Artificial Sequence
  Description of Artificial Sequence: Synthetic oligonucleotide
actgctaattcgcctgcgacg

SEQ ID NO: 42654 - DNA, 21 bp, Artificial Sequence
  Description of Artificial Sequence: Synthetic oligonucleotide
cagattaagactatttctgct

SEQ ID NO: 42655 - DNA, 21 bp, Artificial Sequence
  Description of Artificial Sequence: Synthetic oligonucleotide
cattatacggggaagcagaat

SEQ ID NO: 42656 - DNA, 21 bp, Artificial Sequence
  Description of Artificial Sequence: Synthetic oligonucleotide
ctggttcagggtggtgttaat

SEQ ID NO: 42657 - DNA, 21 bp, Artificial Sequence
  Description of Artificial Sequence: Synthetic oligonucleotide
tcttcgcaggcggtttttcgg

SEQ ID NO: 42658 - DNA, 21 bp, Artificial Sequence
  Description of Artificial Sequence: Synthetic oligonucleotide
catgggcagacggggatgatt

SEQ ID NO: 42659 - DNA, 21 bp, Artificial Sequence
  Description of Artificial Sequence: Synthetic oligonucleotide
gggtctgtgagtccgatgacg

SEQ ID NO: 42660 - DNA, 21 bp, Artificial Sequence
  Description of Artificial Sequence: Synthetic oligonucleotide
tctagttttcaggcgaataag

SEQ ID NO: 42661 - DNA, 21 bp, Artificial Sequence
  Description of Artificial Sequence: Synthetic oligonucleotide
ggcaccgacaacggcatccaa

SEQ ID NO: 42662 - DNA, 21 bp, Artificial Sequence
  Description of Artificial Sequence: Synthetic oligonucleotide
agagtcatgagagaaagccaa

SEQ ID NO: 42663 - DNA, 21 bp, Artificial Sequence
  Description of Artificial Sequence: Synthetic oligonucleotide
caggcgaatactagtacggag

SEQ ID NO: 42664 - DNA, 21 bp, Artificial Sequence
  Description of Artificial Sequence: Synthetic oligonucleotide
cggattcctaataatccgagt

SEQ ID NO: 42665 - DNA, 21 bp, Artificial Sequence
  Description of Artificial Sequence: Synthetic oligonucleotide
aataataggagtgggatgggt

SEQ ID NO: 42666 - DNA, 21 bp, Artificial Sequence
  Description of Artificial Sequence: Synthetic oligonucleotide
cccaccgtccaagtcaccaaa

SEQ ID NO: 42667 - DNA, 21 bp, Artificial Sequence
  Description of Artificial Sequence: Synthetic oligonucleotide
ctctacagcggcagccaagaa

SEQ ID NO: 42668 - DNA, 21 bp, Artificial Sequence
  Description of Artificial Sequence: Synthetic oligonucleotide
aagattctgaatgttggtact

SEQ ID NO: 42669 - DNA, 21 bp, Artificial Sequence
  Description of Artificial Sequence: Synthetic oligonucleotide
tgcccccaaagcagagaaaaa

SEQ ID NO: 42670 - DNA, 21 bp, Artificial Sequence
  Description of Artificial Sequence: Synthetic oligonucleotide
acttctaatagtaatattgcg

SEQ ID NO: 42671 - DNA, 21 bp, Artificial Sequence
  Description of Artificial Sequence: Synthetic oligonucleotide
cctagtgtgaataggactcct

SEQ ID NO: 42672 - DNA, 21 bp, Artificial Sequence
  Description of Artificial Sequence: Synthetic oligonucleotide
aagcttaataagtctcaggcg

SEQ ID NO: 42673 - DNA, 21 bp, Artificial Sequence
  Description of Artificial Sequence: Synthetic oligonucleotide
cataatagtaagagtcagatt

SEQ ID NO: 42674 - DNA, 21 bp, Artificial Sequence
  Description of Artificial Sequence: Synthetic oligonucleotide
gacagcaaacaaaacctcacc

SEQ ID NO: 42675 - DNA, 21 bp, Artificial Sequence
  Description of Artificial Sequence: Synthetic oligonucleotide
gagaatcggacttctgttcag

SEQ ID NO: 42676 - DNA, 21 bp, Artificial Sequence
  Description of Artificial Sequence: Synthetic oligonucleotide
ggtcctgagaatggtattcag

SEQ ID NO: 42677 - DNA, 21 bp, Artificial Sequence
  Description of Artificial Sequence: Synthetic oligonucleotide
acgaggtataatagttctctg

SEQ ID NO: 42678 - DNA, 21 bp, Artificial Sequence
  Description of Artificial Sequence: Synthetic oligonucleotide
tttggttcgtcgaatgctgtt

SEQ ID NO: 42679 - DNA, 21 bp, Artificial Sequence
  Description of Artificial Sequence: Synthetic oligonucleotide
agcgccgaccacatcagaaac

SEQ ID NO: 42680 - DNA, 21 bp, Artificial Sequence
  Description of Artificial Sequence: Synthetic oligonucleotide
tttcagaaggagcggtatcag

SEQ ID NO: 42681 - DNA, 21 bp, Artificial Sequence
  Description of Artificial Sequence: Synthetic oligonucleotide
cttgcgccggggcatggtaat

SEQ ID NO: 42682 - DNA, 21 bp, Artificial Sequence
  Description of Artificial Sequence: Synthetic oligonucleotide
aatactactgcgaagtctagt

SEQ ID NO: 42683 - DNA, 21 bp, Artificial Sequence
  Description of Artificial Sequence: Synthetic oligonucleotide
acccccgtcaacagaacccac

SEQ ID NO: 42684 - DNA, 21 bp, Artificial Sequence
  Description of Artificial Sequence: Synthetic oligonucleotide
cctagtactggtaattcggtg

SEQ ID NO: 42685 - DNA, 21 bp, Artificial Sequence
  Description of Artificial Sequence: Synthetic oligonucleotide
ttttctcagcattcttctaat

SEQ ID NO: 42686 - DNA, 21 bp, Artificial Sequence
  Description of Artificial Sequence: Synthetic oligonucleotide
gtgaatgatcataatgttcgt

SEQ ID NO: 42687 - DNA, 21 bp, Artificial Sequence
  Description of Artificial Sequence: Synthetic oligonucleotide
ggcagctacagcaaccccacc

SEQ ID NO: 42688 - DNA, 21 bp, Artificial Sequence
  Description of Artificial Sequence: Synthetic oligonucleotide
caggatctgcaggctcgtgtt

SEQ ID NO: 42689 - DNA, 21 bp, Artificial Sequence
  Description of Artificial Sequence: Synthetic oligonucleotide
ctcaacgccggcaacaccaga

SEQ ID NO: 42690 - DNA, 21 bp, Artificial Sequence
  Description of Artificial Sequence: Synthetic oligonucleotide
gaagtcaccaacgcccccaaa

SEQ ID NO: 42691 - DNA, 21 bp, Artificial Sequence
  Description of Artificial Sequence: Synthetic oligonucleotide
caccccagcaacaaacccctc

SEQ ID NO: 42692 - DNA, 21 bp, Artificial Sequence
  Description of Artificial Sequence: Synthetic oligonucleotide
aacgattctggacagaatcaa

SEQ ID NO: 42693 - DNA, 21 bp, Artificial Sequence
  Description of Artificial Sequence: Synthetic oligonucleotide
ctcggcaaacccgcccaaccc

SEQ ID NO: 42694 - DNA, 21 bp, Artificial Sequence
  Description of Artificial Sequence: Synthetic oligonucleotide
aatattaagggtgcttcgacg

SEQ ID NO: 42695 - DNA, 21 bp, Artificial Sequence
  Description of Artificial Sequence: Synthetic oligonucleotide
aatacttctacgaatggtatt

SEQ ID NO: 42696 - DNA, 21 bp, Artificial Sequence
  Description of Artificial Sequence: Synthetic oligonucleotide
aatttgggtaattctctgaag

SEQ ID NO: 42697 - DNA, 21 bp, Artificial Sequence
  Description of Artificial Sequence: Synthetic oligonucleotide
aaccccggcagacaacaattc

SEQ ID NO: 42698 - DNA, 21 bp, Artificial Sequence
  Description of Artificial Sequence: Synthetic oligonucleotide
actaatccgaagtcgtcttct

SEQ ID NO: 42699 - DNA, 21 bp, Artificial Sequence
  Description of Artificial Sequence: Synthetic oligonucleotide
tttccgagtgtttcgacgact

SEQ ID NO: 42700 - DNA, 21 bp, Artificial Sequence
  Description of Artificial Sequence: Synthetic oligonucleotide
agcagcgaccaacccagactc

SEQ ID NO: 42701 - DNA, 21 bp, Artificial Sequence
  Description of Artificial Sequence: Synthetic oligonucleotide
gccgaacaaagacccggccaa

SEQ ID NO: 42702 - DNA, 21 bp, Artificial Sequence
  Description of Artificial Sequence: Synthetic oligonucleotide
catgataatgctaattataat

SEQ ID NO: 42703 - DNA, 21 bp, Artificial Sequence
  Description of Artificial Sequence: Synthetic oligonucleotide
agcagcgtccaacacaccggc

SEQ ID NO: 42704 - DNA, 21 bp, Artificial Sequence
  Description of Artificial Sequence: Synthetic oligonucleotide
atgaagaatacgactgtggtt

SEQ ID NO: 42705 - DNA, 21 bp, Artificial Sequence
  Description of Artificial Sequence: Synthetic oligonucleotide
taccccctcagcagaagcacc

SEQ ID NO: 42706 - DNA, 21 bp, Artificial Sequence
  Description of Artificial Sequence: Synthetic oligonucleotide
aatgctaatagtcgtcctgtt

SEQ ID NO: 42707 - DNA, 21 bp, Artificial Sequence
  Description of Artificial Sequence: Synthetic oligonucleotide
gtgagtggtcaggggaattct

SEQ ID NO: 42708 - DNA, 21 bp, Artificial Sequence
  Description of Artificial Sequence: Synthetic oligonucleotide
cgtcattatacgggtgatagt

SEQ ID NO: 42709 - DNA, 21 bp, Artificial Sequence
  Description of Artificial Sequence: Synthetic oligonucleotide
caacaatacgccaaacaagcc

SEQ ID NO: 42710 - DNA, 21 bp, Artificial Sequence
  Description of Artificial Sequence: Synthetic oligonucleotide
ctcccccaaggcagcatcagc

SEQ ID NO: 42711 - DNA, 21 bp, Artificial Sequence
  Description of Artificial Sequence: Synthetic oligonucleotide
cctggtgataggggtaaggtt

SEQ ID NO: 42712 - DNA, 21 bp, Artificial Sequence
  Description of Artificial Sequence: Synthetic oligonucleotide
cataataattctaagagtgcg

SEQ ID NO: 42713 - DNA, 21 bp, Artificial Sequence
  Description of Artificial Sequence: Synthetic oligonucleotide
tcttctacgagtagtccgtat

SEQ ID NO: 42714 - DNA, 21 bp, Artificial Sequence
  Description of Artificial Sequence: Synthetic oligonucleotide
attttgggtaataagtctagt

SEQ ID NO: 42715 - DNA, 21 bp, Artificial Sequence
  Description of Artificial Sequence: Synthetic oligonucleotide
gcttctactccgaataatact

SEQ ID NO: 42716 - DNA, 21 bp, Artificial Sequence
  Description of Artificial Sequence: Synthetic oligonucleotide
gggaatacgggtagttatcag

SEQ ID NO: 42717 - DNA, 21 bp, Artificial Sequence
  Description of Artificial Sequence: Synthetic oligonucleotide
accggccaacaacccgccacc

SEQ ID NO: 42718 - DNA, 21 bp, Artificial Sequence
  Description of Artificial Sequence: Synthetic oligonucleotide
agcatcagcgacaaactcggc

SEQ ID NO: 42719 - DNA, 21 bp, Artificial Sequence
  Description of Artificial Sequence: Synthetic oligonucleotide
attgctaatgcgcattataat

SEQ ID NO: 42720 - DNA, 21 bp, Artificial Sequence
  Description of Artificial Sequence: Synthetic oligonucleotide
ctgggtgtgaagactccgact

SEQ ID NO: 42721 - DNA, 21 bp, Artificial Sequence
  Description of Artificial Sequence: Synthetic oligonucleotide
ctgggtggtggtactttgagg

SEQ ID NO: 42722 - DNA, 21 bp, Artificial Sequence
  Description of Artificial Sequence: Synthetic oligonucleotide
agaagacaagacacccaagaa

SEQ ID NO: 42723 - DNA, 21 bp, Artificial Sequence
  Description of Artificial Sequence: Synthetic oligonucleotide
ggcaccgacagaaccctccac

SEQ ID NO: 42724 - DNA, 21 bp, Artificial Sequence
  Description of Artificial Sequence: Synthetic oligonucleotide
actcagcagaatgggaggaat

SEQ ID NO: 42725 - DNA, 21 bp, Artificial Sequence
  Description of Artificial Sequence: Synthetic oligonucleotide
agtgatcatcagagtgttcgg

SEQ ID NO: 42726 - DNA, 21 bp, Artificial Sequence
  Description of Artificial Sequence: Synthetic oligonucleotide
ttgttgagttcgaagacggct

SEQ ID NO: 42727 - DNA, 21 bp, Artificial Sequence
  Description of Artificial Sequence: Synthetic oligonucleotide
cctgtgcagcattcgagtaat

SEQ ID NO: 42728 - DNA, 21 bp, Artificial Sequence
  Description of Artificial Sequence: Synthetic oligonucleotide
aatgggattagtaagtctaat

SEQ ID NO: 42729 - DNA, 21 bp, Artificial Sequence
  Description of Artificial Sequence: Synthetic oligonucleotide
gagtctgctacgcctattagg

SEQ ID NO: 42730 - DNA, 21 bp, Artificial Sequence
  Description of Artificial Sequence: Synthetic oligonucleotide
aatactactggtagtgggttg

SEQ ID NO: 42731 - DNA, 21 bp, Artificial Sequence
  Description of Artificial Sequence: Synthetic oligonucleotide
agcagcagccccaacgtcaaa

SEQ ID NO: 42732 - DNA, 21 bp, Artificial Sequence
  Description of Artificial Sequence: Synthetic oligonucleotide
gccaccaacagcacccccaga

SEQ ID NO: 42733 - DNA, 21 bp, Artificial Sequence
  Description of Artificial Sequence: Synthetic oligonucleotide
tacagaaacacccacagcgaa

SEQ ID NO: 42734 - DNA, 21 bp, Artificial Sequence
  Description of Artificial Sequence: Synthetic oligonucleotide
ctggataaggagcctaggggt

SEQ ID NO: 42735 - DNA, 21 bp, Artificial Sequence
  Description of Artificial Sequence: Synthetic oligonucleotide
gtcggccacaaaggcggcccc

SEQ ID NO: 42736 - DNA, 21 bp, Artificial Sequence
  Description of Artificial Sequence: Synthetic oligonucleotide
attgtttcgccggtttctaag

SEQ ID NO: 42737 - DNA, 21 bp, Artificial Sequence
  Description of Artificial Sequence: Synthetic oligonucleotide
cccagaatgagagccgtcagc

SEQ ID NO: 42738 - DNA, 21 bp, Artificial Sequence
  Description of Artificial Sequence: Synthetic oligonucleotide
tacagaaccacccacaccctc

SEQ ID NO: 42739 - DNA, 21 bp, Artificial Sequence
  Description of Artificial Sequence: Synthetic oligonucleotide
aagaatgcgactgggattctg

SEQ ID NO: 42740 - DNA, 21 bp, Artificial Sequence
  Description of Artificial Sequence: Synthetic oligonucleotide
aacggcagcggccaaaacaaa

SEQ ID NO: 42741 - DNA, 21 bp, Artificial Sequence
  Description of Artificial Sequence: Synthetic oligonucleotide
aaccaaaaaaccagaaccgac

SEQ ID NO: 42742 - DNA, 21 bp, Artificial Sequence
  Description of Artificial Sequence: Synthetic oligonucleotide
aaggttgggtctccgactgct

SEQ ID NO: 42743 - DNA, 21 bp, Artificial Sequence
  Description of Artificial Sequence: Synthetic oligonucleotide
accaccgacaaaaaaaccgaa

SEQ ID NO: 42744 - DNA, 21 bp, Artificial Sequence
  Description of Artificial Sequence: Synthetic oligonucleotide
gattctggttcttcgacgaag

SEQ ID NO: 42745 - DNA, 21 bp, Artificial Sequence
  Description of Artificial Sequence: Synthetic oligonucleotide
aatactcagagttatacgagt

SEQ ID NO: 42746 - DNA, 21 bp, Artificial Sequence
  Description of Artificial Sequence: Synthetic oligonucleotide
tttccgggtggtaatcatacg

SEQ ID NO: 42747 - DNA, 21 bp, Artificial Sequence
  Description of Artificial Sequence: Synthetic oligonucleotide
cacaccgccacccccctcctc

SEQ ID NO: 42748 - DNA, 21 bp, Artificial Sequence
  Description of Artificial Sequence: Synthetic oligonucleotide
aataattctactggggtggct

SEQ ID NO: 42749 - DNA, 21 bp, Artificial Sequence
  Description of Artificial Sequence: Synthetic oligonucleotide
actccgagtgttactaatatg

SEQ ID NO: 42750 - DNA, 21 bp, Artificial Sequence
  Description of Artificial Sequence: Synthetic oligonucleotide
cttacgtttaattcgtctggt

SEQ ID NO: 42751 - DNA, 21 bp, Artificial Sequence
  Description of Artificial Sequence: Synthetic oligonucleotide
agagacggcaccccccccacc

SEQ ID NO: 42752 - DNA, 21 bp, Artificial Sequence
  Description of Artificial Sequence: Synthetic oligonucleotide
aacagaaaacacaccagcacc

SEQ ID NO: 42753 - DNA, 21 bp, Artificial Sequence
  Description of Artificial Sequence: Synthetic oligonucleotide
catcttcagagtactgatcct

SEQ ID NO: 42754 - DNA, 21 bp, Artificial Sequence
  Description of Artificial Sequence: Synthetic oligonucleotide
gaccccgacaccagaaaaagc

SEQ ID NO: 42755 - DNA, 21 bp, Artificial Sequence
  Description of Artificial Sequence: Synthetic oligonucleotide
caaagattccaaagcagccaa

SEQ ID NO: 42756 - DNA, 21 bp, Artificial Sequence
  Description of Artificial Sequence: Synthetic oligonucleotide
aattctaatactcgtggtcct

SEQ ID NO: 42757 - DNA, 21 bp, Artificial Sequence
  Description of Artificial Sequence: Synthetic oligonucleotide
ggttctggtggggatcgtaat

SEQ ID NO: 42758 - DNA, 21 bp, Artificial Sequence
  Description of Artificial Sequence: Synthetic oligonucleotide
cccagcacccaaagcagcagc

SEQ ID NO: 42759 - DNA, 21 bp, Artificial Sequence
  Description of Artificial Sequence: Synthetic oligonucleotide
ctcaccaccagcgtctacaaa

SEQ ID NO: 42760 - DNA, 21 bp, Artificial Sequence
  Description of Artificial Sequence: Synthetic oligonucleotide
ggtagtacgggtagttctatt

SEQ ID NO: 42761 - DNA, 21 bp, Artificial Sequence
  Description of Artificial Sequence: Synthetic oligonucleotide
gctagtcttaagactcagatg

SEQ ID NO: 42762 - DNA, 21 bp, Artificial Sequence
  Description of Artificial Sequence: Synthetic oligonucleotide
gactgcgtcagcagatgcaaa

SEQ ID NO: 42763 - DNA, 21 bp, Artificial Sequence
  Description of Artificial Sequence: Synthetic oligonucleotide
agttttagtcctgcttctaat

SEQ ID NO: 42764 - DNA, 21 bp, Artificial Sequence
  Description of Artificial Sequence: Synthetic oligonucleotide
aacagcacccccagcaccaga

SEQ ID NO: 42765 - DNA, 21 bp, Artificial Sequence
  Description of Artificial Sequence: Synthetic oligonucleotide
cacgaactcagcagaaccacc

SEQ ID NO: 42766 - DNA, 21 bp, Artificial Sequence
  Description of Artificial Sequence: Synthetic oligonucleotide
aatgatcgtggtcagaatggg

SEQ ID NO: 42767 - DNA, 21 bp, Artificial Sequence
  Description of Artificial Sequence: Synthetic oligonucleotide
ccttctcatgaggggcagcag

SEQ ID NO: 42768 - DNA, 21 bp, Artificial Sequence
  Description of Artificial Sequence: Synthetic oligonucleotide
cagggtgcgggggtttcgtct

SEQ ID NO: 42769 - DNA, 21 bp, Artificial Sequence
  Description of Artificial Sequence: Synthetic oligonucleotide
aaaaccggcgaccaaatgggc

SEQ ID NO: 42770 - DNA, 21 bp, Artificial Sequence
  Description of Artificial Sequence: Synthetic oligonucleotide
attaggtcgaaggagtctgcg

SEQ ID NO: 42771 - DNA, 21 bp, Artificial Sequence
  Description of Artificial Sequence: Synthetic oligonucleotide
ggcctcggccaacaaaccaac

SEQ ID NO: 42772 - DNA, 21 bp, Artificial Sequence
  Description of Artificial Sequence: Synthetic oligonucleotide
ccggggtatgggagtaatcat

SEQ ID NO: 42773 - DNA, 21 bp, Artificial Sequence
  Description of Artificial Sequence: Synthetic oligonucleotide
caaagcgaaatcgtcaacaaa

SEQ ID NO: 42774 - DNA, 21 bp, Artificial Sequence
  Description of Artificial Sequence: Synthetic oligonucleotide
gggattcagagtgggcttggt

SEQ ID NO: 42775 - DNA, 21 bp, Artificial Sequence
  Description of Artificial Sequence: Synthetic oligonucleotide
gaagtctacagcggcagcaac

SEQ ID NO: 42776 - DNA, 21 bp, Artificial Sequence
  Description of Artificial Sequence: Synthetic oligonucleotide
aaaaaccacaccgccgtccaa

SEQ ID NO: 42777 - DNA, 21 bp, Artificial Sequence
  Description of Artificial Sequence: Synthetic oligonucleotide
aattcggctgctttgaatagt

SEQ ID NO: 42778 - DNA, 21 bp, Artificial Sequence
  Description of Artificial Sequence: Synthetic oligonucleotide
aacggcagccaaggcagacaa

SEQ ID NO: 42779 - DNA, 21 bp, Artificial Sequence
  Description of Artificial Sequence: Synthetic oligonucleotide
tcttattcgagttctcagctg

SEQ ID NO: 42780 - DNA, 21 bp, Artificial Sequence
  Description of Artificial Sequence: Synthetic oligonucleotide
actcaggggctgggtcatctt

SEQ ID NO: 42781 - DNA, 21 bp, Artificial Sequence
  Description of Artificial Sequence: Synthetic oligonucleotide
accatgagagccacccccccc

SEQ ID NO: 42782 - DNA, 21 bp, Artificial Sequence
  Description of Artificial Sequence: Synthetic oligonucleotide
tctagggtgagtcgtaatctt

SEQ ID NO: 42783 - DNA, 21 bp, Artificial Sequence
  Description of Artificial Sequence: Synthetic oligonucleotide
attagtgggtctgggtatcat

SEQ ID NO: 42784 - DNA, 21 bp, Artificial Sequence
  Description of Artificial Sequence: Synthetic oligonucleotide
aatgtggataatcgggggttt

SEQ ID NO: 42785 - DNA, 21 bp, Artificial Sequence
  Description of Artificial Sequence: Synthetic oligonucleotide
ttggggatgcgtgataatact

SEQ ID NO: 42786 - DNA, 21 bp, Artificial Sequence
  Description of Artificial Sequence: Synthetic oligonucleotide
gagcagggttcgggtaatcat

SEQ ID NO: 42787 - DNA, 21 bp, Artificial Sequence
  Description of Artificial Sequence: Synthetic oligonucleotide
ggggatatggggatttcgaag

SEQ ID NO: 42788 - DNA, 21 bp, Artificial Sequence
  Description of Artificial Sequence: Synthetic oligonucleotide
caaaacctccccaaagccagc

SEQ ID NO: 42789 - DNA, 21 bp, Artificial Sequence
  Description of Artificial Sequence: Synthetic oligonucleotide
cacggcggccccggcgccgtc

SEQ ID NO: 42790 - DNA, 21 bp, Artificial Sequence
  Description of Artificial Sequence: Synthetic oligonucleotide
ggcagcaccggccaactcatg

SEQ ID NO: 42791 - DNA, 21 bp, Artificial Sequence
  Description of Artificial Sequence: Synthetic oligonucleotide
agagacctcggccacgacaac

SEQ ID NO: 42792 - DNA, 21 bp, Artificial Sequence
  Description of Artificial Sequence: Synthetic oligonucleotide
catggtatttctaatcagagt

SEQ ID NO: 42793 - DNA, 21 bp, Artificial Sequence
  Description of Artificial Sequence: Synthetic oligonucleotide
caaaacaccaacgccgccatc

SEQ ID NO: 42794 - DNA, 21 bp, Artificial Sequence
  Description of Artificial Sequence: Synthetic oligonucleotide
tggggttcgggtcttaatcat

SEQ ID NO: 42795 - DNA, 21 bp, Artificial Sequence
  Description of Artificial Sequence: Synthetic oligonucleotide
cctccttctaagccgaatact

SEQ ID NO: 42796 - DNA, 21 bp, Artificial Sequence
  Description of Artificial Sequence: Synthetic oligonucleotide
aaattcccccccaacagcggc

SEQ ID NO: 42797 - DNA, 21 bp, Artificial Sequence
  Description of Artificial Sequence: Synthetic oligonucleotide
caagtcgtccccgccaccaac

SEQ ID NO: 42798 - DNA, 21 bp, Artificial Sequence
  Description of Artificial Sequence: Synthetic oligonucleotide
aaagacgccggcgaatacggc

SEQ ID NO: 42799 - DNA, 21 bp, Artificial Sequence
  Description of Artificial Sequence: Synthetic oligonucleotide
tcttcgtcggcgaagtctatt

SEQ ID NO: 42800 - DNA, 21 bp, Artificial Sequence
  Description of Artificial Sequence: Synthetic oligonucleotide
tttaatagttcgtcttcgaag

SEQ ID NO: 42801 - DNA, 21 bp, Artificial Sequence
  Description of Artificial Sequence: Synthetic oligonucleotide
tctaattcgggtcgtggtatg

SEQ ID NO: 42802 - DNA, 21 bp, Artificial Sequence
  Description of Artificial Sequence: Synthetic oligonucleotide
gacgaaagcggcaaaagcaaa

SEQ ID NO: 42803 - DNA, 21 bp, Artificial Sequence
  Description of Artificial Sequence: Synthetic oligonucleotide
ggggagaggtctgatgttcgt

SEQ ID NO: 42804 - DNA, 21 bp, Artificial Sequence
  Description of Artificial Sequence: Synthetic oligonucleotide
atcaaccaaagcacctacaaa

SEQ ID NO: 42805 - DNA, 21 bp, Artificial Sequence
  Description of Artificial Sequence: Synthetic oligonucleotide
ttgactcagagggatttttcg

SEQ ID NO: 42806 - DNA, 21 bp, Artificial Sequence
  Description of Artificial Sequence: Synthetic oligonucleotide
tctattaattcgcagcagtgt

SEQ ID NO: 42807 - DNA, 21 bp, Artificial Sequence
  Description of Artificial Sequence: Synthetic oligonucleotide
acggctacgcagaagggtcag

SEQ ID NO: 42808 - DNA, 21 bp, Artificial Sequence
  Description of Artificial Sequence: Synthetic oligonucleotide
agcagcaacgaaaaagacaga

SEQ ID NO: 42809 - DNA, 21 bp, Artificial Sequence
  Description of Artificial Sequence: Synthetic oligonucleotide
tatgttagtaattctaatgcg

SEQ ID NO: 42810 - DNA, 21 bp, Artificial Sequence
  Description of Artificial Sequence: Synthetic oligonucleotide
aaccccggcgaaatgagactc

SEQ ID NO: 42811 - DNA, 21 bp, Artificial Sequence
  Description of Artificial Sequence: Synthetic oligonucleotide
cattcggagaatgggaatcgt

SEQ ID NO: 42812 - DNA, 21 bp, Artificial Sequence
  Description of Artificial Sequence: Synthetic oligonucleotide
cttactccgagtaagattggt

SEQ ID NO: 42813 - DNA, 21 bp, Artificial Sequence
  Description of Artificial Sequence: Synthetic oligonucleotide
cccagaagcaacacccaaaga

SEQ ID NO: 42814 - DNA, 21 bp, Artificial Sequence
  Description of Artificial Sequence: Synthetic oligonucleotide
caaatgaaacacctccaagtc

SEQ ID NO: 42815 - DNA, 21 bp, Artificial Sequence
  Description of Artificial Sequence: Synthetic oligonucleotide
caaagcaccgaaagactcgcc

SEQ ID NO: 42816 - DNA, 21 bp, Artificial Sequence
  Description of Artificial Sequence: Synthetic oligonucleotide
aattttactacgtcgggtcag

SEQ ID NO: 42817 - DNA, 21 bp, Artificial Sequence
  Description of Artificial Sequence: Synthetic oligonucleotide
agagaatacaacaccaccagc

SEQ ID NO: 42818 - DNA, 21 bp, Artificial Sequence
  Description of Artificial Sequence: Synthetic oligonucleotide
ctcggcaccagccaccaacaa

SEQ ID NO: 42819 - DNA, 21 bp, Artificial Sequence
  Description of Artificial Sequence: Synthetic oligonucleotide
aacgccagcggccaaaaccaa

SEQ ID NO: 42820 - DNA, 21 bp, Artificial Sequence
  Description of Artificial Sequence: Synthetic oligonucleotide
ccgggtattaatactaatagt

SEQ ID NO: 42821 - DNA, 21 bp, Artificial Sequence
  Description of Artificial Sequence: Synthetic oligonucleotide
gctactactaaggagggtatt

SEQ ID NO: 42822 - DNA, 21 bp, Artificial Sequence
  Description of Artificial Sequence: Synthetic oligonucleotide
caaaccggcagcaacaacaaa

SEQ ID NO: 42823 - DNA, 21 bp, Artificial Sequence
  Description of Artificial Sequence: Synthetic oligonucleotide
accagagaaagcagaaccaac

SEQ ID NO: 42824 - DNA, 21 bp, Artificial Sequence
  Description of Artificial Sequence: Synthetic oligonucleotide
caaagaaccagcgaccaaacc

SEQ ID NO: 42825 - DNA, 21 bp, Artificial Sequence
  Description of Artificial Sequence: Synthetic oligonucleotide
gtcagcggcagacccaccggc

SEQ ID NO: 42826 - DNA, 21 bp, Artificial Sequence
  Description of Artificial Sequence: Synthetic oligonucleotide
cctcttcgggagctgaagcct

SEQ ID NO: 42827 - DNA, 21 bp, Artificial Sequence
  Description of Artificial Sequence: Synthetic oligonucleotide
ctttctattaagggtgcttcg

SEQ ID NO: 42828 - DNA, 21 bp, Artificial Sequence
  Description of Artificial Sequence: Synthetic oligonucleotide
aattatgtgggtcagaggtct

SEQ ID NO: 42829 - DNA, 21 bp, Artificial Sequence
  Description of Artificial Sequence: Synthetic oligonucleotide
cccaacagaaccagcagctac

SEQ ID NO: 42830 - DNA, 21 bp, Artificial Sequence
  Description of Artificial Sequence: Synthetic oligonucleotide
agtagggagaagaataatgcg

SEQ ID NO: 42831 - DNA, 21 bp, Artificial Sequence
  Description of Artificial Sequence: Synthetic oligonucleotide
cacagcaccagcctcagcaaa

SEQ ID NO: 42832 - DNA, 21 bp, Artificial Sequence
  Description of Artificial Sequence: Synthetic oligonucleotide
atttctggtcagcagacgact

SEQ ID NO: 42833 - DNA, 21 bp, Artificial Sequence
  Description of Artificial Sequence: Synthetic oligonucleotide
tgcagcgtcgccggcaaaaga

SEQ ID NO: 42834 - DNA, 21 bp, Artificial Sequence
  Description of Artificial Sequence: Synthetic oligonucleotide
agtaagactgggactagtttg

SEQ ID NO: 42835 - DNA, 21 bp, Artificial Sequence
  Description of Artificial Sequence: Synthetic oligonucleotide
atttctgtgggtaatacttct

SEQ ID NO: 42836 - DNA, 21 bp, Artificial Sequence
  Description of Artificial Sequence: Synthetic oligonucleotide
cggactctttctaagcatggt

SEQ ID NO: 42837 - DNA, 21 bp, Artificial Sequence
  Description of Artificial Sequence: Synthetic oligonucleotide
cctggtagtgtgactgggtct

SEQ ID NO: 42838 - DNA, 21 bp, Artificial Sequence
  Description of Artificial Sequence: Synthetic oligonucleotide
tctacttcgaaggattatact

SEQ ID NO: 42839 - DNA, 21 bp, Artificial Sequence
  Description of Artificial Sequence: Synthetic oligonucleotide
gtcagaatcagcacccaagcc

SEQ ID NO: 42840 - DNA, 21 bp, Artificial Sequence
  Description of Artificial Sequence: Synthetic oligonucleotide
tatattaatagtccttcgaat

SEQ ID NO: 42841 - DNA, 21 bp, Artificial Sequence
  Description of Artificial Sequence: Synthetic oligonucleotide
aacaacaaaagcgccagccaa

SEQ ID NO: 42842 - DNA, 21 bp, Artificial Sequence
  Description of Artificial Sequence: Synthetic oligonucleotide
tttaatcaggctggggttaat

SEQ ID NO: 42843 - DNA, 21 bp, Artificial Sequence
  Description of Artificial Sequence: Synthetic oligonucleotide
caacaagaaatgagcaaaaaa

SEQ ID NO: 42844 - DNA, 21 bp, Artificial Sequence
  Description of Artificial Sequence: Synthetic oligonucleotide
cccagccacaaccccaccaac

SEQ ID NO: 42845 - DNA, 21 bp, Artificial Sequence
  Description of Artificial Sequence: Synthetic oligonucleotide
agtggtagtaatactattggg

SEQ ID NO: 42846 - DNA, 21 bp, Artificial Sequence
  Description of Artificial Sequence: Synthetic oligonucleotide
aatagtgcgaataagactccg

SEQ ID NO: 42847 - DNA, 21 bp, Artificial Sequence
  Description of Artificial Sequence: Synthetic oligonucleotide
gggaatcgtgggtctgttatt

SEQ ID NO: 42848 - DNA, 21 bp, Artificial Sequence
  Description of Artificial Sequence: Synthetic oligonucleotide
ccgaatggggcgcatgttacg

SEQ ID NO: 42849 - DNA, 21 bp, Artificial Sequence
  Description of Artificial Sequence: Synthetic oligonucleotide
atgggtgttcattctattgct

SEQ ID NO: 42850 - DNA, 21 bp, Artificial Sequence
  Description of Artificial Sequence: Synthetic oligonucleotide
ctccacgacggccaaaccaga

SEQ ID NO: 42851 - DNA, 21 bp, Artificial Sequence
  Description of Artificial Sequence: Synthetic oligonucleotide
tcttttgattcgaagccgcct

SEQ ID NO: 42852 - DNA, 21 bp, Artificial Sequence
  Description of Artificial Sequence: Synthetic oligonucleotide
tatgttactagttctgggggt

SEQ ID NO: 42853 - DNA, 21 bp, Artificial Sequence
  Description of Artificial Sequence: Synthetic oligonucleotide
cccgccgaccacggcaaactc

SEQ ID NO: 42854 - DNA, 21 bp, Artificial Sequence
  Description of Artificial Sequence: Synthetic oligonucleotide
gatgcgactaagaatcattcg

SEQ ID NO: 42855 - DNA, 21 bp, Artificial Sequence
  Description of Artificial Sequence: Synthetic oligonucleotide
caaagagaacaactcctcaaa

SEQ ID NO: 42856 - DNA, 21 bp, Artificial Sequence
  Description of Artificial Sequence: Synthetic oligonucleotide
catagtacttctgggggtcat

SEQ ID NO: 42857 - DNA, 21 bp, Artificial Sequence
  Description of Artificial Sequence: Synthetic oligonucleotide
cataatagtgcggtgcagggg

SEQ ID NO: 42858 - DNA, 21 bp, Artificial Sequence
  Description of Artificial Sequence: Synthetic oligonucleotide
ccccaaagcagccaccaaacc

SEQ ID NO: 42859 - DNA, 21 bp, Artificial Sequence
  Description of Artificial Sequence: Synthetic oligonucleotide
cttcctggggttcgtgttgcg

SEQ ID NO: 42860 - DNA, 21 bp, Artificial Sequence
  Description of Artificial Sequence: Synthetic oligonucleotide
aacagctacgaccccaaaaga

SEQ ID NO: 42861 - DNA, 21 bp, Artificial Sequence
  Description of Artificial Sequence: Synthetic oligonucleotide
ggtagtaattatgaggttggg

SEQ ID NO: 42862 - DNA, 21 bp, Artificial Sequence
  Description of Artificial Sequence: Synthetic oligonucleotide
ggcctcatgacccacagcatc

SEQ ID NO: 42863 - DNA, 21 bp, Artificial Sequence
  Description of Artificial Sequence: Synthetic oligonucleotide
ctcagcaaccaaaacaaccaa

SEQ ID NO: 42864 - DNA, 21 bp, Artificial Sequence
  Description of Artificial Sequence: Synthetic oligonucleotide
ggtctgccgactgagaagatg

SEQ ID NO: 42865 - DNA, 21 bp, Artificial Sequence
  Description of Artificial Sequence: Synthetic oligonucleotide
aatgtgactacgccgcttatt

SEQ ID NO: 42866 - DNA, 21 bp, Artificial Sequence
  Description of Artificial Sequence: Synthetic oligonucleotide
accagctaccccaaccacaga

SEQ ID NO: 42867 - DNA, 21 bp, Artificial Sequence
  Description of Artificial Sequence: Synthetic oligonucleotide
gccaccagagacagccacagc

SEQ ID NO: 42868 - DNA, 21 bp, Artificial Sequence
  Description of Artificial Sequence: Synthetic oligonucleotide
caaggcagcggcagcaaccac

SEQ ID NO: 42869 - DNA, 21 bp, Artificial Sequence
  Description of Artificial Sequence: Synthetic oligonucleotide
tctagttcgactcatgctgtg

SEQ ID NO: 42870 - DNA, 21 bp, Artificial Sequence
  Description of Artificial Sequence: Synthetic oligonucleotide
aacaacctccccagaaacctc

SEQ ID NO: 42871 - DNA, 21 bp, Artificial Sequence
  Description of Artificial Sequence: Synthetic oligonucleotide
agttcggagcagactactcgt

SEQ ID NO: 42872 - DNA, 21 bp, Artificial Sequence
  Description of Artificial Sequence: Synthetic oligonucleotide
gacaccgccagacccaccaaa

SEQ ID NO: 42873 - DNA, 21 bp, Artificial Sequence
  Description of Artificial Sequence: Synthetic oligonucleotide
aatatttcgactaggcagagt

SEQ ID NO: 42874 - DNA, 21 bp, Artificial Sequence
  Description of Artificial Sequence: Synthetic oligonucleotide
tatactattacgccgcagaag

SEQ ID NO: 42875 - DNA, 21 bp, Artificial Sequence
  Description of Artificial Sequence: Synthetic oligonucleotide
gaaaacatcagcagaagccac

SEQ ID NO: 42876 - DNA, 21 bp, Artificial Sequence
  Description of Artificial Sequence: Synthetic oligonucleotide
ccgagtaagattagtaatgcg

SEQ ID NO: 42877 - DNA, 21 bp, Artificial Sequence
  Description of Artificial Sequence: Synthetic oligonucleotide
tgtaattctcataatgcggct

SEQ ID NO: 42878 - DNA, 21 bp, Artificial Sequence
  Description of Artificial Sequence: Synthetic oligonucleotide
gttagttttaagcctaatgag

SEQ ID NO: 42879 - DNA, 21 bp, Artificial Sequence
  Description of Artificial Sequence: Synthetic oligonucleotide
gacaaaacccaaaaacaactc

SEQ ID NO: 42880 - DNA, 21 bp, Artificial Sequence
  Description of Artificial Sequence: Synthetic oligonucleotide
aacaacgtcaccaaagccccc

SEQ ID NO: 42881 - DNA, 21 bp, Artificial Sequence
  Description of Artificial Sequence: Synthetic oligonucleotide
cagaatgttggtgggattcgt

SEQ ID NO: 42882 - DNA, 21 bp, Artificial Sequence
  Description of Artificial Sequence: Synthetic oligonucleotide
agttctgctaagagttcgctt

SEQ ID NO: 42883 - DNA, 21 bp, Artificial Sequence
  Description of Artificial Sequence: Synthetic oligonucleotide
catcatgatgctagtccgaat

SEQ ID NO: 42884 - DNA, 21 bp, Artificial Sequence
  Description of Artificial Sequence: Synthetic oligonucleotide
actggtattgggtctcatctt

SEQ ID NO: 42885 - DNA, 21 bp, Artificial Sequence
  Description of Artificial Sequence: Synthetic oligonucleotide
caagtccccaccagaagcgac

SEQ ID NO: 42886 - DNA, 21 bp, Artificial Sequence
  Description of Artificial Sequence: Synthetic oligonucleotide
cccgaacccgccgccagaaac

SEQ ID NO: 42887 - DNA, 21 bp, Artificial Sequence
  Description of Artificial Sequence: Synthetic oligonucleotide
cccagcagcacccccaaactc

SEQ ID NO: 42888 - DNA, 21 bp, Artificial Sequence
  Description of Artificial Sequence: Synthetic oligonucleotide
cacgacagcagaagcaacgcc

SEQ ID NO: 42889 - DNA, 21 bp, Artificial Sequence
  Description of Artificial Sequence: Synthetic oligonucleotide
gatggtgtgggtatgtatgct

SEQ ID NO: 42890 - DNA, 21 bp, Artificial Sequence
  Description of Artificial Sequence: Synthetic oligonucleotide
acgcggaagactcctactact

SEQ ID NO: 42891 - DNA, 21 bp, Artificial Sequence
  Description of Artificial Sequence: Synthetic oligonucleotide
gttaatacgaatctggttggt

SEQ ID NO: 42892 - DNA, 21 bp, Artificial Sequence
  Description of Artificial Sequence: Synthetic oligonucleotide
tacaccgccagcagaatggaa

SEQ ID NO: 42893 - DNA, 21 bp, Artificial Sequence
  Description of Artificial Sequence: Synthetic oligonucleotide
ggctacaccgtcggcaccaac

SEQ ID NO: 42894 - DNA, 21 bp, Artificial Sequence
  Description of Artificial Sequence: Synthetic oligonucleotide
tctaatgctactagggcgatt

SEQ ID NO: 42895 - DNA, 21 bp, Artificial Sequence
  Description of Artificial Sequence: Synthetic oligonucleotide
agacccgccaccagcaccccc

SEQ ID NO: 42896 - DNA, 21 bp, Artificial Sequence
  Description of Artificial Sequence: Synthetic oligonucleotide
tattttaatagtcattcgaat

SEQ ID NO: 42897 - DNA, 21 bp, Artificial Sequence
  Description of Artificial Sequence: Synthetic oligonucleotide
aagattggtagtatgagtggt

SEQ ID NO: 42898 - DNA, 21 bp, Artificial Sequence
  Description of Artificial Sequence: Synthetic oligonucleotide
atcagaaacgacctcagcaac

SEQ ID NO: 42899 - DNA, 21 bp, Artificial Sequence
  Description of Artificial Sequence: Synthetic oligonucleotide
ccgagtaataaggctgggact

SEQ ID NO: 42900 - DNA, 21 bp, Artificial Sequence
  Description of Artificial Sequence: Synthetic oligonucleotide
gggtctctgactcctaaggct

SEQ ID NO: 42901 - DNA, 21 bp, Artificial Sequence
  Description of Artificial Sequence: Synthetic oligonucleotide
cctgttacgttgcggggtatt

SEQ ID NO: 42902 - DNA, 21 bp, Artificial Sequence
  Description of Artificial Sequence: Synthetic oligonucleotide
atgagtacgcatagttcgggt

SEQ ID NO: 42903 - DNA, 21 bp, Artificial Sequence
  Description of Artificial Sequence: Synthetic oligonucleotide
gtgccgcatggggctacttct

SEQ ID NO: 42904 - DNA, 21 bp, Artificial Sequence
  Description of Artificial Sequence: Synthetic oligonucleotide
caagtccccgtcagacccgtc

SEQ ID NO: 42905 - DNA, 21 bp, Artificial Sequence
  Description of Artificial Sequence: Synthetic oligonucleotide
tcggcgcgggatagggcgtcg

SEQ ID NO: 42906 - DNA, 21 bp, Artificial Sequence
  Description of Artificial Sequence: Synthetic oligonucleotide
tcgaatatgcctggtatggtg

SEQ ID NO: 42907 - DNA, 21 bp, Artificial Sequence
  Description of Artificial Sequence: Synthetic oligonucleotide
aatggggctacgaagaatagt

SEQ ID NO: 42908 - DNA, 21 bp, Artificial Sequence
  Description of Artificial Sequence: Synthetic oligonucleotide
atgaatacgagtattaataat

SEQ ID NO: 42909 - DNA, 21 bp, Artificial Sequence
  Description of Artificial Sequence: Synthetic oligonucleotide
atcctcgacagccacaacaga

SEQ ID NO: 42910 - DNA, 21 bp, Artificial Sequence
  Description of Artificial Sequence: Synthetic oligonucleotide
gacctccaaaccagcgccaaa

SEQ ID NO: 42911 - DNA, 21 bp, Artificial Sequence
  Description of Artificial Sequence: Synthetic oligonucleotide
gaccaagtcagccacaaactc

SEQ ID NO: 42912 - DNA, 21 bp, Artificial Sequence
  Description of Artificial Sequence: Synthetic oligonucleotide
acggctagtggtaatttgtct

SEQ ID NO: 42913 - DNA, 21 bp, Artificial Sequence
  Description of Artificial Sequence: Synthetic oligonucleotide
gaaagattcaccagcagcagc

SEQ ID NO: 42914 - DNA, 21 bp, Artificial Sequence
  Description of Artificial Sequence: Synthetic oligonucleotide
accctccccagagtccccgcc

SEQ ID NO: 42915 - DNA, 21 bp, Artificial Sequence
  Description of Artificial Sequence: Synthetic oligonucleotide
gaacccctcaaaaacaacccc

SEQ ID NO: 42916 - DNA, 21 bp, Artificial Sequence
  Description of Artificial Sequence: Synthetic oligonucleotide
catactgatacgagtgcggtg

SEQ ID NO: 42917 - DNA, 21 bp, Artificial Sequence
  Description of Artificial Sequence: Synthetic oligonucleotide
gtcgtccccgaaagaagcaaa

SEQ ID NO: 42918 - DNA, 21 bp, Artificial Sequence
  Description of Artificial Sequence: Synthetic oligonucleotide
actcatatgcgcacgcagagt

SEQ ID NO: 42919 - DNA, 21 bp, Artificial Sequence
  Description of Artificial Sequence: Synthetic oligonucleotide
acgagggggtctcctttgatg

SEQ ID NO: 42920 - DNA, 21 bp, Artificial Sequence
  Description of Artificial Sequence: Synthetic oligonucleotide
actggtactaagtcggataat

SEQ ID NO: 42921 - DNA, 21 bp, Artificial Sequence
  Description of Artificial Sequence: Synthetic oligonucleotide
ggccccgacacccacagccaa

SEQ ID NO: 42922 - DNA, 21 bp, Artificial Sequence
  Description of Artificial Sequence: Synthetic oligonucleotide
aacggtcctggacagaatcaa

SEQ ID NO: 42923 - DNA, 21 bp, Artificial Sequence
  Description of Artificial Sequence: Synthetic oligonucleotide
cattataatcagactggtttg

SEQ ID NO: 42924 - DNA, 21 bp, Artificial Sequence
  Description of Artificial Sequence: Synthetic oligonucleotide
agccaccaaacccccggctac

SEQ ID NO: 42925 - DNA, 21 bp, Artificial Sequence
  Description of Artificial Sequence: Synthetic oligonucleotide
aacggcaccagacaaaaccaa

SEQ ID NO: 42926 - DNA, 21 bp, Artificial Sequence
  Description of Artificial Sequence: Synthetic oligonucleotide
ttcagcagcaaaaccagcccc

SEQ ID NO: 42927 - DNA, 21 bp, Artificial Sequence
  Description of Artificial Sequence: Synthetic oligonucleotide
tcgatggggaattcgattagt

SEQ ID NO: 42928 - DNA, 21 bp, Artificial Sequence
  Description of Artificial Sequence: Synthetic oligonucleotide
ttcaacgaacaaagagtcagc

SEQ ID NO: 42929 - DNA, 21 bp, Artificial Sequence
  Description of Artificial Sequence: Synthetic oligonucleotide
gacatccccgccaaaaccgcc

SEQ ID NO: 42930 - DNA, 21 bp, Artificial Sequence
  Description of Artificial Sequence: Synthetic oligonucleotide
tctcatacgggtaatatggtt

SEQ ID NO: 42931 - DNA, 21 bp, Artificial Sequence
  Description of Artificial Sequence: Synthetic oligonucleotide
agcaacgtcgccaaaagaacc

SEQ ID NO: 42932 - DNA, 21 bp, Artificial Sequence
  Description of Artificial Sequence: Synthetic oligonucleotide
tctaatgcgactaggtctagt

SEQ ID NO: 42933 - DNA, 21 bp, Artificial Sequence
  Description of Artificial Sequence: Synthetic oligonucleotide
cttggggagacttctatgagg

SEQ ID NO: 42934 - DNA, 21 bp, Artificial Sequence
  Description of Artificial Sequence: Synthetic oligonucleotide
gagggtaatcgttctaatatg

SEQ ID NO: 42935 - DNA, 21 bp, Artificial Sequence
  Description of Artificial Sequence: Synthetic oligonucleotide
cctgctgatcgtactcatatt

SEQ ID NO: 42936 - DNA, 21 bp, Artificial Sequence
  Description of Artificial Sequence: Synthetic oligonucleotide
acccccgccggccccaacaaa

SEQ ID NO: 42937 - DNA, 21 bp, Artificial Sequence
  Description of Artificial Sequence: Synthetic oligonucleotide
caggtgtcgcctttgattttg

SEQ ID NO: 42938 - DNA, 21 bp, Artificial Sequence
  Description of Artificial Sequence: Synthetic oligonucleotide
tctctgtcgactgggtcgggg

SEQ ID NO: 42939 - DNA, 21 bp, Artificial Sequence
  Description of Artificial Sequence: Synthetic oligonucleotide
agtgcttctaatactagtgtt

SEQ ID NO: 42940 - DNA, 21 bp, Artificial Sequence
  Description of Artificial Sequence: Synthetic oligonucleotide
agagacaccaccagcaccgac

SEQ ID NO: 42941 - DNA, 21 bp, Artificial Sequence
  Description of Artificial Sequence: Synthetic oligonucleotide
cctagtaattcgggtaataat

SEQ ID NO: 42942 - DNA, 21 bp, Artificial Sequence
  Description of Artificial Sequence: Synthetic oligonucleotide
ccggtgggttcggtgcggggg

SEQ ID NO: 42943 - DNA, 21 bp, Artificial Sequence
  Description of Artificial Sequence: Synthetic oligonucleotide
gctagggctgattctaatttt

SEQ ID NO: 42944 - DNA, 21 bp, Artificial Sequence
  Description of Artificial Sequence: Synthetic oligonucleotide
gatggtaagaataataatgtg

SEQ ID NO: 42945 - DNA, 21 bp, Artificial Sequence
  Description of Artificial Sequence: Synthetic oligonucleotide
aaacccgccacccccaacggc

SEQ ID NO: 42946 - DNA, 21 bp, Artificial Sequence
  Description of Artificial Sequence: Synthetic oligonucleotide
gaaagcaacagcagcagaggc

SEQ ID NO: 42947 - DNA, 21 bp, Artificial Sequence
  Description of Artificial Sequence: Synthetic oligonucleotide
gaaatgaaccacagcccctgc

SEQ ID NO: 42948 - DNA, 21 bp, Artificial Sequence
  Description of Artificial Sequence: Synthetic oligonucleotide
actgcggaggcgaattcttct

SEQ ID NO: 42949 - DNA, 21 bp, Artificial Sequence
  Description of Artificial Sequence: Synthetic oligonucleotide
cccggcaccggcagcaaccac

SEQ ID NO: 42950 - DNA, 21 bp, Artificial Sequence
  Description of Artificial Sequence: Synthetic oligonucleotide
gaactcatgaacaaaagcaaa

SEQ ID NO: 42951 - DNA, 21 bp, Artificial Sequence
  Description of Artificial Sequence: Synthetic oligonucleotide
aaaagcgcccaaggcggcaac

SEQ ID NO: 42952 - DNA, 21 bp, Artificial Sequence
  Description of Artificial Sequence: Synthetic oligonucleotide
actcctggggcttctttgtcg

SEQ ID NO: 42953 - DNA, 21 bp, Artificial Sequence
  Description of Artificial Sequence: Synthetic oligonucleotide
gtcatcgaacccggcagcacc

SEQ ID NO: 42954 - DNA, 21 bp, Artificial Sequence
  Description of Artificial Sequence: Synthetic oligonucleotide
ggtgttaagacgaatcctctt

SEQ ID NO: 42955 - DNA, 21 bp, Artificial Sequence
  Description of Artificial Sequence: Synthetic oligonucleotide
ctcatgggcagccccagaggc

SEQ ID NO: 42956 - DNA, 21 bp, Artificial Sequence
  Description of Artificial Sequence: Synthetic oligonucleotide
gctagttctaagggtttgact

SEQ ID NO: 42957 - DNA, 21 bp, Artificial Sequence
  Description of Artificial Sequence: Synthetic oligonucleotide
ggccacgccgccggcgtcagc

SEQ ID NO: 42958 - DNA, 21 bp, Artificial Sequence
  Description of Artificial Sequence: Synthetic oligonucleotide
gtgtctatgaatactactagg

SEQ ID NO: 42959 - DNA, 21 bp, Artificial Sequence
  Description of Artificial Sequence: Synthetic oligonucleotide
tcgagtccggctaatatggcg

SEQ ID NO: 42960 - DNA, 21 bp, Artificial Sequence
  Description of Artificial Sequence: Synthetic oligonucleotide
tctgtggagaaggctcagagt

SEQ ID NO: 42961 - DNA, 21 bp, Artificial Sequence
  Description of Artificial Sequence: Synthetic oligonucleotide
gttactcttccgcctaatgcg

SEQ ID NO: 42962 - DNA, 21 bp, Artificial Sequence
  Description of Artificial Sequence: Synthetic oligonucleotide
cccaacggccacgaagtcctc

SEQ ID NO: 42963 - DNA, 21 bp, Artificial Sequence
  Description of Artificial Sequence: Synthetic oligonucleotide
actactgataagagtcgtttg

SEQ ID NO: 42964 - DNA, 21 bp, Artificial Sequence
  Description of Artificial Sequence: Synthetic oligonucleotide
cctttgaatactcatcagtcg

SEQ ID NO: 42965 - DNA, 21 bp, Artificial Sequence
  Description of Artificial Sequence: Synthetic oligonucleotide
tttcggcagactagtgggaat

SEQ ID NO: 42966 - DNA, 21 bp, Artificial Sequence
  Description of Artificial Sequence: Synthetic oligonucleotide
gtcggcgaagccggcaaagcc

SEQ ID NO: 42967 - DNA, 21 bp, Artificial Sequence
  Description of Artificial Sequence: Synthetic oligonucleotide
ggcatcgacaccaaaatgctc

SEQ ID NO: 42968 - DNA, 21 bp, Artificial Sequence
  Description of Artificial Sequence: Synthetic oligonucleotide
cacggcatggaagtcgccaga

SEQ ID NO: 42969 - DNA, 21 bp, Artificial Sequence
  Description of Artificial Sequence: Synthetic oligonucleotide
gcgcttaagagttctaatgag

SEQ ID NO: 42970 - DNA, 21 bp, Artificial Sequence
  Description of Artificial Sequence: Synthetic oligonucleotide
ggtcctagtacgcattcgggt

SEQ ID NO: 42971 - DNA, 21 bp, Artificial Sequence
  Description of Artificial Sequence: Synthetic oligonucleotide
gatgctggggctgctcctaag

SEQ ID NO: 42972 - DNA, 21 bp, Artificial Sequence
  Description of Artificial Sequence: Synthetic oligonucleotide
agtcgggcgcctaatactttg

SEQ ID NO: 42973 - DNA, 21 bp, Artificial Sequence
  Description of Artificial Sequence: Synthetic oligonucleotide
tctgataggtcggttgatggg

SEQ ID NO: 42974 - DNA, 21 bp, Artificial Sequence
  Description of Artificial Sequence: Synthetic oligonucleotide
caagaagccagagtctacagc

SEQ ID NO: 42975 - DNA, 21 bp, Artificial Sequence
  Description of Artificial Sequence: Synthetic oligonucleotide
accaccaccaccagacccagc

SEQ ID NO: 42976 - DNA, 21 bp, Artificial Sequence
  Description of Artificial Sequence: Synthetic oligonucleotide
aaagtcagcagcgccaccccc

SEQ ID NO: 42977 - DNA, 21 bp, Artificial Sequence
  Description of Artificial Sequence: Synthetic oligonucleotide
tctggtggtgattatgcgaag

SEQ ID NO: 42978 - DNA, 21 bp, Artificial Sequence
  Description of Artificial Sequence: Synthetic oligonucleotide
aacagcgaagccagactcagc

SEQ ID NO: 42979 - DNA, 21 bp, Artificial Sequence
  Description of Artificial Sequence: Synthetic oligonucleotide
gctgctcattcgactatgaat

SEQ ID NO: 42980 - DNA, 21 bp, Artificial Sequence
  Description of Artificial Sequence: Synthetic oligonucleotide
ccccaaaccagccccagaacc

SEQ ID NO: 42981 - DNA, 21 bp, Artificial Sequence
  Description of Artificial Sequence: Synthetic oligonucleotide
gacaccaacaacagagccaac

SEQ ID NO: 42982 - DNA, 21 bp, Artificial Sequence
  Description of Artificial Sequence: Synthetic oligonucleotide
tctactatgcataagaatgtt

SEQ ID NO: 42983 - DNA, 21 bp, Artificial Sequence
  Description of Artificial Sequence: Synthetic oligonucleotide
cctggtgctagtggtaaggtt

SEQ ID NO: 42984 - DNA, 21 bp, Artificial Sequence
  Description of Artificial Sequence: Synthetic oligonucleotide
tcgattcagagtgctgctgct

SEQ ID NO: 42985 - DNA, 21 bp, Artificial Sequence
  Description of Artificial Sequence: Synthetic oligonucleotide
cacagcagccacagccccagc

SEQ ID NO: 42986 - DNA, 21 bp, Artificial Sequence
  Description of Artificial Sequence: Synthetic oligonucleotide
gaatacccccaacaagccaaa

SEQ ID NO: 42987 - DNA, 21 bp, Artificial Sequence
  Description of Artificial Sequence: Synthetic oligonucleotide
tctaagccggctaataatgtt

SEQ ID NO: 42988 - DNA, 21 bp, Artificial Sequence
  Description of Artificial Sequence: Synthetic oligonucleotide
caaaaaaccaccatcgacggc

SEQ ID NO: 42989 - DNA, 21 bp, Artificial Sequence
  Description of Artificial Sequence: Synthetic oligonucleotide
cccatcaccagaagcctcctc

SEQ ID NO: 42990 - DNA, 21 bp, Artificial Sequence
  Description of Artificial Sequence: Synthetic oligonucleotide
cctactggtgagaagcgtttg

SEQ ID NO: 42991 - DNA, 21 bp, Artificial Sequence
  Description of Artificial Sequence: Synthetic oligonucleotide
gcccccctccaaagcaacctc

SEQ ID NO: 42992 - DNA, 21 bp, Artificial Sequence
  Description of Artificial Sequence: Synthetic oligonucleotide
atgaatcggactgggattaag

SEQ ID NO: 42993 - DNA, 21 bp, Artificial Sequence
  Description of Artificial Sequence: Synthetic oligonucleotide
cactacggccccgacagcaaa

SEQ ID NO: 42994 - DNA, 21 bp, Artificial Sequence
  Description of Artificial Sequence: Synthetic oligonucleotide
cacgccaacagccccgccacc

SEQ ID NO: 42995 - DNA, 21 bp, Artificial Sequence
  Description of Artificial Sequence: Synthetic oligonucleotide
aatccttctatggctatgaag

SEQ ID NO: 42996 - DNA, 21 bp, Artificial Sequence
  Description of Artificial Sequence: Synthetic oligonucleotide
gaaatcagagcccacaccacc

SEQ ID NO: 42997 - DNA, 21 bp, Artificial Sequence
  Description of Artificial Sequence: Synthetic oligonucleotide
tcgcctgggaataagctgctt

SEQ ID NO: 42998 - DNA, 21 bp, Artificial Sequence
  Description of Artificial Sequence: Synthetic oligonucleotide
agagaaagaaccggcttcaac

SEQ ID NO: 42999 - DNA, 21 bp, Artificial Sequence
  Description of Artificial Sequence: Synthetic oligonucleotide
aatccggctcatggtcttaat

SEQ ID NO: 43000 - DNA, 21 bp, Artificial Sequence
  Description of Artificial Sequence: Synthetic oligonucleotide
atgcttccttctgtgtctggt

SEQ ID NO: 43001 - DNA, 21 bp, Artificial Sequence
  Description of Artificial Sequence: Synthetic oligonucleotide
aagtcggttagttcttctggt

SEQ ID NO: 43002 - DNA, 21 bp, Artificial Sequence
  Description of Artificial Sequence: Synthetic oligonucleotide
gcctgcaacaccagcagatgc

SEQ ID NO: 43003 - DNA, 21 bp, Artificial Sequence
  Description of Artificial Sequence: Synthetic oligonucleotide
gaacccctcagcaaacaaagc

SEQ ID NO: 43004 - DNA, 21 bp, Artificial Sequence
  Description of Artificial Sequence: Synthetic oligonucleotide
aattctaataatgcgatggct

SEQ ID NO: 43005 - DNA, 21 bp, Artificial Sequence
  Description of Artificial Sequence: Synthetic oligonucleotide
tctaattctcataagatttat

SEQ ID NO: 43006 - DNA, 21 bp, Artificial Sequence
  Description of Artificial Sequence: Synthetic oligonucleotide
actaatcctactggttatcgt

SEQ ID NO: 43007 - DNA, 21 bp, Artificial Sequence
  Description of Artificial Sequence: Synthetic oligonucleotide
ggcctcgtccccaacctcatc

SEQ ID NO: 43008 - DNA, 21 bp, Artificial Sequence
  Description of Artificial Sequence: Synthetic oligonucleotide
ggcaccgccggcagattcaac

SEQ ID NO: 43009 - DNA, 21 bp, Artificial Sequence
  Description of Artificial Sequence: Synthetic oligonucleotide
aataggaatgggtttaataat

SEQ ID NO: 43010 - DNA, 21 bp, Artificial Sequence
  Description of Artificial Sequence: Synthetic oligonucleotide
gccgccgccgtcaaaggcggc

SEQ ID NO: 43011 - DNA, 21 bp, Artificial Sequence
  Description of Artificial Sequence: Synthetic oligonucleotide
ctgatggatcatcgtacgcgg

SEQ ID NO: 43012 - DNA, 21 bp, Artificial Sequence
  Description of Artificial Sequence: Synthetic oligonucleotide
gtgaatgcgaataaggcgtgt

SEQ ID NO: 43013 - DNA, 21 bp, Artificial Sequence
  Description of Artificial Sequence: Synthetic oligonucleotide
agccacagcgtcacccccggc

SEQ ID NO: 43014 - DNA, 21 bp, Artificial Sequence
  Description of Artificial Sequence: Synthetic oligonucleotide
agtcttcttgggggtttgggg

SEQ ID NO: 43015 - DNA, 21 bp, Artificial Sequence
  Description of Artificial Sequence: Synthetic oligonucleotide
gggtcgcatactaatacttct

SEQ ID NO: 43016 - DNA, 21 bp, Artificial Sequence
  Description of Artificial Sequence: Synthetic oligonucleotide
gggccgaatccgattaatggg

SEQ ID NO: 43017 - DNA, 21 bp, Artificial Sequence
  Description of Artificial Sequence: Synthetic oligonucleotide
actgggcgggggtcggatgtg

SEQ ID NO: 43018 - DNA, 21 bp, Artificial Sequence
  Description of Artificial Sequence: Synthetic oligonucleotide
ggtttgcagagtaagcagttg

SEQ ID NO: 43019 - DNA, 21 bp, Artificial Sequence
  Description of Artificial Sequence: Synthetic oligonucleotide
tcgccggttaaggggtctgtt

SEQ ID NO: 43020 - DNA, 21 bp, Artificial Sequence
  Description of Artificial Sequence: Synthetic oligonucleotide
gatccgttggggaagcagggt

SEQ ID NO: 43021 - DNA, 21 bp, Artificial Sequence
  Description of Artificial Sequence: Synthetic oligonucleotide
ttgagttcggataagaatgtt

SEQ ID NO: 43022 - DNA, 21 bp, Artificial Sequence
  Description of Artificial Sequence: Synthetic oligonucleotide
cacgacacccacaaattcctc

SEQ ID NO: 43023 - DNA, 21 bp, Artificial Sequence
  Description of Artificial Sequence: Synthetic oligonucleotide
aatctttcgcatagtgcgggg

SEQ ID NO: 43024 - DNA, 21 bp, Artificial Sequence
  Description of Artificial Sequence: Synthetic oligonucleotide
tatagtggtggtactcagcag

SEQ ID NO: 43025 - DNA, 21 bp, Artificial Sequence
  Description of Artificial Sequence: Synthetic oligonucleotide
tctttgcctggggagtctaag

SEQ ID NO: 43026 - DNA, 21 bp, Artificial Sequence
  Description of Artificial Sequence: Synthetic oligonucleotide
tctaggaatcctaatatgatt

SEQ ID NO: 43027 - DNA, 21 bp, Artificial Sequence
  Description of Artificial Sequence: Synthetic oligonucleotide
aatatttcgtctaaggttgcg

SEQ ID NO: 43028 - DNA, 21 bp, Artificial Sequence
  Description of Artificial Sequence: Synthetic oligonucleotide
agtaatccgagtgggttttcg

SEQ ID NO: 43029 - DNA, 21 bp, Artificial Sequence
  Description of Artificial Sequence: Synthetic oligonucleotide
agaagaatcgacaccatcccc

SEQ ID NO: 43030 - DNA, 21 bp, Artificial Sequence
  Description of Artificial Sequence: Synthetic oligonucleotide
catgtttctcatggtccgggg

SEQ ID NO: 43031 - DNA, 21 bp, Artificial Sequence
  Description of Artificial Sequence: Synthetic oligonucleotide
gccagcagcccccaagaaaaa

SEQ ID NO: 43032 - DNA, 21 bp, Artificial Sequence
  Description of Artificial Sequence: Synthetic oligonucleotide
caactcaacgaagaacacggc

SEQ ID NO: 43033 - DNA, 21 bp, Artificial Sequence
  Description of Artificial Sequence: Synthetic oligonucleotide
gaaacccccaacagaagccaa

SEQ ID NO: 43034 - DNA, 21 bp, Artificial Sequence
  Description of Artificial Sequence: Synthetic oligonucleotide
aagatgacgccgcagtctact

SEQ ID NO: 43035 - DNA, 21 bp, Artificial Sequence
  Description of Artificial Sequence: Synthetic oligonucleotide
caaaccagcagccacgcctac

SEQ ID NO: 43036 - DNA, 21 bp, Artificial Sequence
  Description of Artificial Sequence: Synthetic oligonucleotide
cggatgcagccgagtggtaat

SEQ ID NO: 43037 - DNA, 21 bp, Artificial Sequence
  Description of Artificial Sequence: Synthetic oligonucleotide
cctcgtactaatgttatgcct

SEQ ID NO: 43038 - DNA, 21 bp, Artificial Sequence
  Description of Artificial Sequence: Synthetic oligonucleotide
gccaccaccaaagccggcatc

SEQ ID NO: 43039 - DNA, 21 bp, Artificial Sequence
  Description of Artificial Sequence: Synthetic oligonucleotide
aagaatagtagtggtagtacg

SEQ ID NO: 43040 - DNA, 21 bp, Artificial Sequence
  Description of Artificial Sequence: Synthetic oligonucleotide
tctgcgagtccgagtattaag

SEQ ID NO: 43041 - DNA, 21 bp, Artificial Sequence
  Description of Artificial Sequence: Synthetic oligonucleotide
atgcccctcaaaccccacctc

SEQ ID NO: 43042 - DNA, 21 bp, Artificial Sequence
  Description of Artificial Sequence: Synthetic oligonucleotide
cagagtaagggtgggtcgaat

SEQ ID NO: 43043 - DNA, 21 bp, Artificial Sequence
  Description of Artificial Sequence: Synthetic oligonucleotide
aacaacctcgccggcagcaaa

SEQ ID NO: 43044 - DNA, 21 bp, Artificial Sequence
  Description of Artificial Sequence: Synthetic oligonucleotide
caaagcagccaaagcggcccc

SEQ ID NO: 43045 - DNA, 21 bp, Artificial Sequence
  Description of Artificial Sequence: Synthetic oligonucleotide
gggatgggtggtttgaagaat

SEQ ID NO: 43046 - DNA, 21 bp, Artificial Sequence
  Description of Artificial Sequence: Synthetic oligonucleotide
agaagctacgaaggcatgcaa

SEQ ID NO: 43047 - DNA, 21 bp, Artificial Sequence
  Description of Artificial Sequence: Synthetic oligonucleotide
aacccctacaccgccaacaac

SEQ ID NO: 43048 - DNA, 21 bp, Artificial Sequence
  Description of Artificial Sequence: Synthetic oligonucleotide
catagtactccgtcgactagg

SEQ ID NO: 43049 - DNA, 21 bp, Artificial Sequence
  Description of Artificial Sequence: Synthetic oligonucleotide
tgtattgggaataagactaat

SEQ ID NO: 43050 - DNA, 21 bp, Artificial Sequence
  Description of Artificial Sequence: Synthetic oligonucleotide
ggggtgactgggtctcggggt

SEQ ID NO: 43051 - DNA, 21 bp, Artificial Sequence
  Description of Artificial Sequence: Synthetic oligonucleotide
tctccgacgaggcctatgaat

SEQ ID NO: 43052 - DNA, 21 bp, Artificial Sequence
  Description of Artificial Sequence: Synthetic oligonucleotide
tgtccgcagcgtgcgtctact

SEQ ID NO: 43053 - DNA, 21 bp, Artificial Sequence
  Description of Artificial Sequence: Synthetic oligonucleotide
cctcttcagacgagtaggact

SEQ ID NO: 43054 - DNA, 21 bp, Artificial Sequence
  Description of Artificial Sequence: Synthetic oligonucleotide
gattctaggaataatatgacg

SEQ ID NO: 43055 - DNA, 21 bp, Artificial Sequence
  Description of Artificial Sequence: Synthetic oligonucleotide
aggtatgataagcagaattcg

SEQ ID NO: 43056 - DNA, 21 bp, Artificial Sequence
  Description of Artificial Sequence: Synthetic oligonucleotide
aatgctggtcctaattatgat

SEQ ID NO: 43057 - DNA, 21 bp, Artificial Sequence
  Description of Artificial Sequence: Synthetic oligonucleotide
atcagaagcaaaggcagcgcc

SEQ ID NO: 43058 - DNA, 21 bp, Artificial Sequence
  Description of Artificial Sequence: Synthetic oligonucleotide
gactacgacgccaccagcaga

SEQ ID NO: 43059 - DNA, 21 bp, Artificial Sequence
  Description of Artificial Sequence: Synthetic oligonucleotide
ctttcggctaatccgcataat

SEQ ID NO: 43060 - DNA, 21 bp, Artificial Sequence
  Description of Artificial Sequence: Synthetic oligonucleotide
gtcagaatccccaaaagcaac

SEQ ID NO: 43061 - DNA, 21 bp, Artificial Sequence
  Description of Artificial Sequence: Synthetic oligonucleotide
attgtttctggtaagcttacg

SEQ ID NO: 43062 - DNA, 21 bp, Artificial Sequence
  Description of Artificial Sequence: Synthetic oligonucleotide
attggtaataagcagtcgcag

SEQ ID NO: 43063 - DNA, 21 bp, Artificial Sequence
  Description of Artificial Sequence: Synthetic oligonucleotide
ccctaccaaagccacagcccc

SEQ ID NO: 43064 - DNA, 21 bp, Artificial Sequence
  Description of Artificial Sequence: Synthetic oligonucleotide
gggtctatttcgacggctcat

SEQ ID NO: 43065 - DNA, 21 bp, Artificial Sequence
  Description of Artificial Sequence: Synthetic oligonucleotide
gaaaacaacgccctcagcaga

SEQ ID NO: 43066 - DNA, 21 bp, Artificial Sequence
  Description of Artificial Sequence: Synthetic oligonucleotide
tcgcaggtttctcatagtgtg

SEQ ID NO: 43067 - DNA, 21 bp, Artificial Sequence
  Description of Artificial Sequence: Synthetic oligonucleotide
aattattcgggtgcgcatact

SEQ ID NO: 43068 - DNA, 21 bp, Artificial Sequence
  Description of Artificial Sequence: Synthetic oligonucleotide
ccggtttcgacgcattcgtct

SEQ ID NO: 43069 - DNA, 21 bp, Artificial Sequence
  Description of Artificial Sequence: Synthetic oligonucleotide
gttcatgtgacgagtcagact

SEQ ID NO: 43070 - DNA, 21 bp, Artificial Sequence
  Description of Artificial Sequence: Synthetic oligonucleotide
attaggactaatagtactctt

SEQ ID NO: 43071 - DNA, 21 bp, Artificial Sequence
  Description of Artificial Sequence: Synthetic oligonucleotide
gaagccagaaaagtcaccagc

SEQ ID NO: 43072 - DNA, 21 bp, Artificial Sequence
  Description of Artificial Sequence: Synthetic oligonucleotide
aacagcgtcgccggcatgggc

SEQ ID NO: 43073 - DNA, 21 bp, Artificial Sequence
  Description of Artificial Sequence: Synthetic oligonucleotide
aggggtaatgagaatattaat

SEQ ID NO: 43074 - DNA, 21 bp, Artificial Sequence
  Description of Artificial Sequence: Synthetic oligonucleotide
gacccccaagtcagagccctc

SEQ ID NO: 43075 - DNA, 21 bp, Artificial Sequence
  Description of Artificial Sequence: Synthetic oligonucleotide
gggattacgcatggttctcat

SEQ ID NO: 43076 - DNA, 21 bp, Artificial Sequence
  Description of Artificial Sequence: Synthetic oligonucleotide
gggcaggctgttaatactgct

SEQ ID NO: 43077 - DNA, 21 bp, Artificial Sequence
  Description of Artificial Sequence: Synthetic oligonucleotide
actacttatggtgggaatcgg

SEQ ID NO: 43078 - DNA, 21 bp, Artificial Sequence
  Description of Artificial Sequence: Synthetic oligonucleotide
aataatggggcttcggttgtg

SEQ ID NO: 43079 - DNA, 21 bp, Artificial Sequence
  Description of Artificial Sequence: Synthetic oligonucleotide
cccatcggcagccaacacatc

SEQ ID NO: 43080 - DNA, 21 bp, Artificial Sequence
  Description of Artificial Sequence: Synthetic oligonucleotide
tctgttcagaagtcggttaat

SEQ ID NO: 43081 - DNA, 21 bp, Artificial Sequence
  Description of Artificial Sequence: Synthetic oligonucleotide
gaacccgtccccaaaaccaga

SEQ ID NO: 43082 - DNA, 21 bp, Artificial Sequence
  Description of Artificial Sequence: Synthetic oligonucleotide
ggcaccagcaacagatacacc

SEQ ID NO: 43083 - DNA, 21 bp, Artificial Sequence
  Description of Artificial Sequence: Synthetic oligonucleotide
cggaataatccgactacggtt

SEQ ID NO: 43084 - DNA, 21 bp, Artificial Sequence
  Description of Artificial Sequence: Synthetic oligonucleotide
gatccggctacgaggaagagt

SEQ ID NO: 43085 - DNA, 21 bp, Artificial Sequence
  Description of Artificial Sequence: Synthetic oligonucleotide
cccatgagccacgtcagcggc

SEQ ID NO: 43086 - DNA, 21 bp, Artificial Sequence
  Description of Artificial Sequence: Synthetic oligonucleotide
accaacatccaagccagcaaa

SEQ ID NO: 43087 - DNA, 21 bp, Artificial Sequence
  Description of Artificial Sequence: Synthetic oligonucleotide
aagctggttaatagtaatggt

SEQ ID NO: 43088 - DNA, 21 bp, Artificial Sequence
  Description of Artificial Sequence: Synthetic oligonucleotide
tttacttatgcggaggggaat

SEQ ID NO: 43089 - DNA, 21 bp, Artificial Sequence
  Description of Artificial Sequence: Synthetic oligonucleotide
tggcaagaagaaagaggccaa

SEQ ID NO: 43090 - DNA, 21 bp, Artificial Sequence
  Description of Artificial Sequence: Synthetic oligonucleotide
tacggcaaccccagacaagcc

SEQ ID NO: 43091 - DNA, 21 bp, Artificial Sequence
  Description of Artificial Sequence: Synthetic oligonucleotide
caaagcaccggcagagaaaga

SEQ ID NO: 43092 - DNA, 21 bp, Artificial Sequence
  Description of Artificial Sequence: Synthetic oligonucleotide
aacggcgtccaacaacccaaa

SEQ ID NO: 43093 - DNA, 21 bp, Artificial Sequence
  Description of Artificial Sequence: Synthetic oligonucleotide
caatacaaccaagccggcctc

SEQ ID NO: 43094 - DNA, 21 bp, Artificial Sequence
  Description of Artificial Sequence: Synthetic oligonucleotide
ccgcttaatgctcggggtagt

SEQ ID NO: 43095 - DNA, 21 bp, Artificial Sequence
  Description of Artificial Sequence: Synthetic oligonucleotide
catgctaagagttcttctatg

SEQ ID NO: 43096 - DNA, 21 bp, Artificial Sequence
  Description of Artificial Sequence: Synthetic oligonucleotide
gagcatgagacttcttctcgg

SEQ ID NO: 43097 - DNA, 21 bp, Artificial Sequence
  Description of Artificial Sequence: Synthetic oligonucleotide
caaaaaacccaaaccaccagc

SEQ ID NO: 43098 - DNA, 21 bp, Artificial Sequence
  Description of Artificial Sequence: Synthetic oligonucleotide
cagggggcggctgatcattct

SEQ ID NO: 43099 - DNA, 21 bp, Artificial Sequence
  Description of Artificial Sequence: Synthetic oligonucleotide
attgcttcgagtggtatgcat

SEQ ID NO: 43100 - DNA, 21 bp, Artificial Sequence
  Description of Artificial Sequence: Synthetic oligonucleotide
tcgtatcctagtcagttgaat

SEQ ID NO: 43101 - DNA, 21 bp, Artificial Sequence
  Description of Artificial Sequence: Synthetic oligonucleotide
gtcagaagcaacgtcagcggc

SEQ ID NO: 43102 - DNA, 21 bp, Artificial Sequence
  Description of Artificial Sequence: Synthetic oligonucleotide
cctgggacgaagcagagttcg

SEQ ID NO: 43103 - DNA, 21 bp, Artificial Sequence
  Description of Artificial Sequence: Synthetic oligonucleotide
acccacagcaaaagcttcgtc

SEQ ID NO: 43104 - DNA, 21 bp, Artificial Sequence
  Description of Artificial Sequence: Synthetic oligonucleotide
aggggtacgggtattggttct

SEQ ID NO: 43105 - DNA, 21 bp, Artificial Sequence
  Description of Artificial Sequence: Synthetic oligonucleotide
cccagcagccccaacagcatc

SEQ ID NO: 43106 - DNA, 21 bp, Artificial Sequence
  Description of Artificial Sequence: Synthetic oligonucleotide
cgtgcgacggagggtgttttt

SEQ ID NO: 43107 - DNA, 21 bp, Artificial Sequence
  Description of Artificial Sequence: Synthetic oligonucleotide
cccatcctcgacagaaaaagc

SEQ ID NO: 43108 - DNA, 21 bp, Artificial Sequence
  Description of Artificial Sequence: Synthetic oligonucleotide
gattctattggtagttctaag

SEQ ID NO: 43109 - DNA, 21 bp, Artificial Sequence
  Description of Artificial Sequence: Synthetic oligonucleotide
atgagcagcgaaagacccggc

SEQ ID NO: 43110 - DNA, 21 bp, Artificial Sequence
  Description of Artificial Sequence: Synthetic oligonucleotide
aaagaaaaccccgtcagaagc

SEQ ID NO: 43111 - DNA, 21 bp, Artificial Sequence
  Description of Artificial Sequence: Synthetic oligonucleotide
tattcgggtcctgatctgcgt

SEQ ID NO: 43112 - DNA, 21 bp, Artificial Sequence
  Description of Artificial Sequence: Synthetic oligonucleotide
tacagagtcacccaaagcagc

SEQ ID NO: 43113 - DNA, 21 bp, Artificial Sequence
  Description of Artificial Sequence: Synthetic oligonucleotide
agtacttctagttcggctagt

SEQ ID NO: 43114 - DNA, 21 bp, Artificial Sequence
  Description of Artificial Sequence: Synthetic oligonucleotide
cgtcagtatacgggtgatagt

SEQ ID NO: 43115 - DNA, 21 bp, Artificial Sequence
  Description of Artificial Sequence: Synthetic oligonucleotide
agagaactcaaaaacagcagc

SEQ ID NO: 43116 - DNA, 21 bp, Artificial Sequence
  Description of Artificial Sequence: Synthetic oligonucleotide
ggcaccggcaccaccttcaga

SEQ ID NO: 43117 - DNA, 21 bp, Artificial Sequence
  Description of Artificial Sequence: Synthetic oligonucleotide
ttgatgccttctagttcttcg

SEQ ID NO: 43118 - DNA, 21 bp, Artificial Sequence
  Description of Artificial Sequence: Synthetic oligonucleotide
ccggatgttaaggtgactagg

SEQ ID NO: 43119 - DNA, 21 bp, Artificial Sequence
  Description of Artificial Sequence: Synthetic oligonucleotide
gttgcttcttcggctcatgtt

SEQ ID NO: 43120 - DNA, 21 bp, Artificial Sequence
  Description of Artificial Sequence: Synthetic oligonucleotide
ggtaagacgaatgtgtctagt

SEQ ID NO: 43121 - DNA, 21 bp, Artificial Sequence
  Description of Artificial Sequence: Synthetic oligonucleotide
tttgttagtggtaaggtgcag

SEQ ID NO: 43122 - DNA, 21 bp, Artificial Sequence
  Description of Artificial Sequence: Synthetic oligonucleotide
aatagtcggatttctccttcg

SEQ ID NO: 43123 - DNA, 21 bp, Artificial Sequence
  Description of Artificial Sequence: Synthetic oligonucleotide
accagcagcccccaacccagc

SEQ ID NO: 43124 - DNA, 21 bp, Artificial Sequence
  Description of Artificial Sequence: Synthetic oligonucleotide
ggtacgaatactgggattgtt

SEQ ID NO: 43125 - DNA, 21 bp, Artificial Sequence
  Description of Artificial Sequence: Synthetic oligonucleotide
agtactacgaatagtaagaat

SEQ ID NO: 43126 - DNA, 21 bp, Artificial Sequence
  Description of Artificial Sequence: Synthetic oligonucleotide
agaagcctcagcaccgaaaac

SEQ ID NO: 43127 - DNA, 21 bp, Artificial Sequence
  Description of Artificial Sequence: Synthetic oligonucleotide
ttgcgtcctgctaatactatt

SEQ ID NO: 43128 - DNA, 21 bp, Artificial Sequence
  Description of Artificial Sequence: Synthetic oligonucleotide
cctcaggagtctagggggatg

SEQ ID NO: 43129 - DNA, 21 bp, Artificial Sequence
  Description of Artificial Sequence: Synthetic oligonucleotide
ggcgacaaaggcctccaaaga

SEQ ID NO: 43130 - DNA, 21 bp, Artificial Sequence
  Description of Artificial Sequence: Synthetic oligonucleotide
agtaatagtaggcaggctgat

SEQ ID NO: 43131 - DNA, 21 bp, Artificial Sequence
  Description of Artificial Sequence: Synthetic oligonucleotide
gatgtgaatcctagtgcgaag

SEQ ID NO: 43132 - DNA, 21 bp, Artificial Sequence
  Description of Artificial Sequence: Synthetic oligonucleotide
aggagtccggcgtatcaggat

SEQ ID NO: 43133 - DNA, 21 bp, Artificial Sequence
  Description of Artificial Sequence: Synthetic oligonucleotide
tggactgtgagtcggtctggt

SEQ ID NO: 43134 - DNA, 21 bp, Artificial Sequence
  Description of Artificial Sequence: Synthetic oligonucleotide
gtgagtgataatacttataag

SEQ ID NO: 43135 - DNA, 21 bp, Artificial Sequence
  Description of Artificial Sequence: Synthetic oligonucleotide
gacagaaaacacaccagcacc

SEQ ID NO: 43136 - DNA, 21 bp, Artificial Sequence
  Description of Artificial Sequence: Synthetic oligonucleotide
ggcaccaccaacagcagaaac

SEQ ID NO: 43137 - DNA, 21 bp, Artificial Sequence
  Description of Artificial Sequence: Synthetic oligonucleotide
ggtacttcgacgtctcttcgg

SEQ ID NO: 43138 - DNA, 21 bp, Artificial Sequence
  Description of Artificial Sequence: Synthetic oligonucleotide
attattcagaatgggcagggg

SEQ ID NO: 43139 - DNA, 21 bp, Artificial Sequence
  Description of Artificial Sequence: Synthetic oligonucleotide
tctgattctcggaatcctgtt

SEQ ID NO: 43140 - DNA, 21 bp, Artificial Sequence
  Description of Artificial Sequence: Synthetic oligonucleotide
acggggtctgggagtaatcat

SEQ ID NO: 43141 - DNA, 21 bp, Artificial Sequence
  Description of Artificial Sequence: Synthetic oligonucleotide
tcgaatgagactaagtcttcg

SEQ ID NO: 43142 - DNA, 21 bp, Artificial Sequence
  Description of Artificial Sequence: Synthetic oligonucleotide
gccaccatgagaagcaacgaa

SEQ ID NO: 43143 - DNA, 21 bp, Artificial Sequence
  Description of Artificial Sequence: Synthetic oligonucleotide
cagaatacgcctaagagtact

SEQ ID NO: 43144 - DNA, 21 bp, Artificial Sequence
  Description of Artificial Sequence: Synthetic oligonucleotide
aggtcttctgggggtttgact

SEQ ID NO: 43145 - DNA, 21 bp, Artificial Sequence
  Description of Artificial Sequence: Synthetic oligonucleotide
gcgacggttcagtcggcgact

SEQ ID NO: 43146 - DNA, 21 bp, Artificial Sequence
  Description of Artificial Sequence: Synthetic oligonucleotide
acccccacccccgtcaaccaa

SEQ ID NO: 43147 - DNA, 21 bp, Artificial Sequence
  Description of Artificial Sequence: Synthetic oligonucleotide
agcagcgacctcggcaaaaga

SEQ ID NO: 43148 - DNA, 21 bp, Artificial Sequence
  Description of Artificial Sequence: Synthetic oligonucleotide
tatggtcgtgataagtttagt

SEQ ID NO: 43149 - DNA, 21 bp, Artificial Sequence
  Description of Artificial Sequence: Synthetic oligonucleotide
acggagcaggttggtacgcgt

SEQ ID NO: 43150 - DNA, 21 bp, Artificial Sequence
  Description of Artificial Sequence: Synthetic oligonucleotide
agtacgactccggggttgaag

SEQ ID NO: 43151 - DNA, 21 bp, Artificial Sequence
  Description of Artificial Sequence: Synthetic oligonucleotide
agcttcaccggcaacaccgtc

SEQ ID NO: 43152 - DNA, 21 bp, Artificial Sequence
  Description of Artificial Sequence: Synthetic oligonucleotide
tgtgcggggactagtagtgtg

SEQ ID NO: 43153 - DNA, 21 bp, Artificial Sequence
  Description of Artificial Sequence: Synthetic oligonucleotide
catcttgcttatgataataac

SEQ ID NO: 43154 - DNA, 21 bp, Artificial Sequence
  Description of Artificial Sequence: Synthetic oligonucleotide
aacggcagcgaacaaaaccaa

SEQ ID NO: 43155 - DNA, 21 bp, Artificial Sequence
  Description of Artificial Sequence: Synthetic oligonucleotide
accagcagagtcggccaagtc

SEQ ID NO: 43156 - DNA, 21 bp, Artificial Sequence
  Description of Artificial Sequence: Synthetic oligonucleotide
aactacgacagcctcaaaaaa

SEQ ID NO: 43157 - DNA, 21 bp, Artificial Sequence
  Description of Artificial Sequence: Synthetic oligonucleotide
ggggttccggctgggcatact

SEQ ID NO: 43158 - DNA, 21 bp, Artificial Sequence
  Description of Artificial Sequence: Synthetic oligonucleotide
cactacggcgaaaccagaaac

SEQ ID NO: 43159 - DNA, 21 bp, Artificial Sequence
  Description of Artificial Sequence: Synthetic oligonucleotide
attggggggaataagcctctt

SEQ ID NO: 43160 - DNA, 21 bp, Artificial Sequence
  Description of Artificial Sequence: Synthetic oligonucleotide
ccttttggtgctggtcgtcct

SEQ ID NO: 43161 - DNA, 21 bp, Artificial Sequence
  Description of Artificial Sequence: Synthetic oligonucleotide
atggaaatcaaacccaacaga

SEQ ID NO: 43162 - DNA, 21 bp, Artificial Sequence
  Description of Artificial Sequence: Synthetic oligonucleotide
accctcgaaaacagcagaaga

SEQ ID NO: 43163 - DNA, 21 bp, Artificial Sequence
  Description of Artificial Sequence: Synthetic oligonucleotide
tctggtgttaaggctttttct

SEQ ID NO: 43164 - DNA, 21 bp, Artificial Sequence
  Description of Artificial Sequence: Synthetic oligonucleotide
agcagacaagccaccagcagc

SEQ ID NO: 43165 - DNA, 21 bp, Artificial Sequence
  Description of Artificial Sequence: Synthetic oligonucleotide
actccgcagaattctgtgaag

SEQ ID NO: 43166 - DNA, 21 bp, Artificial Sequence
  Description of Artificial Sequence: Synthetic oligonucleotide
cgggtggatactattactaag

SEQ ID NO: 43167 - DNA, 21 bp, Artificial Sequence
  Description of Artificial Sequence: Synthetic oligonucleotide
ctcgccagccacaaaggccaa

SEQ ID NO: 43168 - DNA, 21 bp, Artificial Sequence
  Description of Artificial Sequence: Synthetic oligonucleotide
tttagtaataatggttcgcat

SEQ ID NO: 43169 - DNA, 21 bp, Artificial Sequence
  Description of Artificial Sequence: Synthetic oligonucleotide
attaagcagtcttcttcggct

SEQ ID NO: 43170 - DNA, 21 bp, Artificial Sequence
  Description of Artificial Sequence: Synthetic oligonucleotide
cacggcgtcaacaaaaccgaa

SEQ ID NO: 43171 - DNA, 21 bp, Artificial Sequence
  Description of Artificial Sequence: Synthetic oligonucleotide
tatgatcagactaggacgcgg

SEQ ID NO: 43172 - DNA, 21 bp, Artificial Sequence
  Description of Artificial Sequence: Synthetic oligonucleotide
aatacgacgggtcatgctggg

SEQ ID NO: 43173 - DNA, 21 bp, Artificial Sequence
  Description of Artificial Sequence: Synthetic oligonucleotide
cctaatctgagtaagagtttg

SEQ ID NO: 43174 - DNA, 21 bp, Artificial Sequence
  Description of Artificial Sequence: Synthetic oligonucleotide
ttgccttcgggtaatactagt

SEQ ID NO: 43175 - DNA, 21 bp, Artificial Sequence
  Description of Artificial Sequence: Synthetic oligonucleotide
gctctttctagtcagaagggt

SEQ ID NO: 43176 - DNA, 21 bp, Artificial Sequence
  Description of Artificial Sequence: Synthetic oligonucleotide
gctatgtctgagcatctgaag

SEQ ID NO: 43177 - DNA, 21 bp, Artificial Sequence
  Description of Artificial Sequence: Synthetic oligonucleotide
caagacagcagcatcagaaac

SEQ ID NO: 43178 - DNA, 21 bp, Artificial Sequence
  Description of Artificial Sequence: Synthetic oligonucleotide
tcgttgagtcttgtgaagggt

SEQ ID NO: 43179 - DNA, 21 bp, Artificial Sequence
  Description of Artificial Sequence: Synthetic oligonucleotide
tatccgaattctgtgcctagt

SEQ ID NO: 43180 - DNA, 21 bp, Artificial Sequence
  Description of Artificial Sequence: Synthetic oligonucleotide
cccagactcctcgacgacggc

SEQ ID NO: 43181 - DNA, 21 bp, Artificial Sequence
  Description of Artificial Sequence: Synthetic oligonucleotide
ggccccaaccccggcaaccac

SEQ ID NO: 43182 - DNA, 21 bp, Artificial Sequence
  Description of Artificial Sequence: Synthetic oligonucleotide
cattctacgactgttgcgaag

SEQ ID NO: 43183 - DNA, 21 bp, Artificial Sequence
  Description of Artificial Sequence: Synthetic oligonucleotide
tctacggatcggtcgtttaat

SEQ ID NO: 43184 - DNA, 21 bp, Artificial Sequence
  Description of Artificial Sequence: Synthetic oligonucleotide
cctctgccggctcatagtcct

SEQ ID NO: 43185 - DNA, 21 bp, Artificial Sequence
  Description of Artificial Sequence: Synthetic oligonucleotide
atggtgtctcatactcatggg

SEQ ID NO: 43186 - DNA, 21 bp, Artificial Sequence
  Description of Artificial Sequence: Synthetic oligonucleotide
cctgtttctaggctgactggg

SEQ ID NO: 43187 - DNA, 21 bp, Artificial Sequence
  Description of Artificial Sequence: Synthetic oligonucleotide
attgggactagtattaattct

SEQ ID NO: 43188 - DNA, 21 bp, Artificial Sequence
  Description of Artificial Sequence: Synthetic oligonucleotide
tctcctaataagacttctctt

SEQ ID NO: 43189 - DNA, 21 bp, Artificial Sequence
  Description of Artificial Sequence: Synthetic oligonucleotide
caaacccaaggccaactcaaa

SEQ ID NO: 43190 - DNA, 21 bp, Artificial Sequence
  Description of Artificial Sequence: Synthetic oligonucleotide
aatttggggacgaatgttctg

SEQ ID NO: 43191 - DNA, 21 bp, Artificial Sequence
  Description of Artificial Sequence: Synthetic oligonucleotide
aacagagaaaaactcagctac

SEQ ID NO: 43192 - DNA, 21 bp, Artificial Sequence
  Description of Artificial Sequence: Synthetic oligonucleotide
gctcagtctacgtatcagtcg

SEQ ID NO: 43193 - DNA, 21 bp, Artificial Sequence
  Description of Artificial Sequence: Synthetic oligonucleotide
aattctagtcataatgtttct

SEQ ID NO: 43194 - DNA, 21 bp, Artificial Sequence
  Description of Artificial Sequence: Synthetic oligonucleotide
tcggataagggtaatactcgg

SEQ ID NO: 43195 - DNA, 21 bp, Artificial Sequence
  Description of Artificial Sequence: Synthetic oligonucleotide
atgaatactcagggtcctatt

SEQ ID NO: 43196 - DNA, 21 bp, Artificial Sequence
  Description of Artificial Sequence: Synthetic oligonucleotide
ggcggccaaaccgccagaatc

SEQ ID NO: 43197 - DNA, 21 bp, Artificial Sequence
  Description of Artificial Sequence: Synthetic oligonucleotide
ttgcatcctaaggggcagact

SEQ ID NO: 43198 - DNA, 21 bp, Artificial Sequence
  Description of Artificial Sequence: Synthetic oligonucleotide
tcttatgggaaggggagttct

SEQ ID NO: 43199 - DNA, 21 bp, Artificial Sequence
  Description of Artificial Sequence: Synthetic oligonucleotide
tacggccaaaccaaaacccaa

SEQ ID NO: 43200 - DNA, 21 bp, Artificial Sequence
  Description of Artificial Sequence: Synthetic oligonucleotide
atgatggtgagttctcgttcg

SEQ ID NO: 43201 - DNA, 21 bp, Artificial Sequence
  Description of Artificial Sequence: Synthetic oligonucleotide
ctcggcaccagccaaatgaaa

SEQ ID NO: 43202 - DNA, 21 bp, Artificial Sequence
  Description of Artificial Sequence: Synthetic oligonucleotide
gcgggtcattctgggagggat

SEQ ID NO: 43203 - DNA, 21 bp, Artificial Sequence
  Description of Artificial Sequence: Synthetic oligonucleotide
catgggagtcgtagtatgtct

SEQ ID NO: 43204 - DNA, 21 bp, Artificial Sequence
  Description of Artificial Sequence: Synthetic oligonucleotide
tcgcagcctggttctaatcat

SEQ ID NO: 43205 - DNA, 21 bp, Artificial Sequence
  Description of Artificial Sequence: Synthetic oligonucleotide
gctatggggtcgagtctgtct

SEQ ID NO: 43206 - DNA, 21 bp, Artificial Sequence
  Description of Artificial Sequence: Synthetic oligonucleotide
gacaaccccagacaagcctac

SEQ ID NO: 43207 - DNA, 21 bp, Artificial Sequence
  Description of Artificial Sequence: Synthetic oligonucleotide
tcgagtgcggggacttatact

SEQ ID NO: 43208 - DNA, 21 bp, Artificial Sequence
  Description of Artificial Sequence: Synthetic oligonucleotide
gacaacatgagcacccccaaa

SEQ ID NO: 43209 - DNA, 21 bp, Artificial Sequence
  Description of Artificial Sequence: Synthetic oligonucleotide
aacgccgtcagaagcgaaaac

SEQ ID NO: 43210 - DNA, 21 bp, Artificial Sequence
  Description of Artificial Sequence: Synthetic oligonucleotide
cctttgtctgggtcgaaggct

SEQ ID NO: 43211 - DNA, 21 bp, Artificial Sequence
  Description of Artificial Sequence: Synthetic oligonucleotide
gaccccctcagaaacagcaac

SEQ ID NO: 43212 - DNA, 21 bp, Artificial Sequence
  Description of Artificial Sequence: Synthetic oligonucleotide
tttaattcgaatcgtgatagt

SEQ ID NO: 43213 - DNA, 21 bp, Artificial Sequence
  Description of Artificial Sequence: Synthetic oligonucleotide
ccgctgggttctagggtgaat

SEQ ID NO: 43214 - DNA, 21 bp, Artificial Sequence
  Description of Artificial Sequence: Synthetic oligonucleotide
actactcataatatgcagggg

SEQ ID NO: 43215 - DNA, 21 bp, Artificial Sequence
  Description of Artificial Sequence: Synthetic oligonucleotide
caaatcagcgccagcaccaga

SEQ ID NO: 43216 - DNA, 21 bp, Artificial Sequence
  Description of Artificial Sequence: Synthetic oligonucleotide
cggtttcagaataatactggg

SEQ ID NO: 43217 - DNA, 21 bp, Artificial Sequence
  Description of Artificial Sequence: Synthetic oligonucleotide
gatcctcataatactagtcgt

SEQ ID NO: 43218 - DNA, 21 bp, Artificial Sequence
  Description of Artificial Sequence: Synthetic oligonucleotide
agaaacgacaccaaactcttc

SEQ ID NO: 43219 - DNA, 21 bp, Artificial Sequence
  Description of Artificial Sequence: Synthetic oligonucleotide
gccacccacagcaaagccagc

SEQ ID NO: 43220 - DNA, 21 bp, Artificial Sequence
  Description of Artificial Sequence: Synthetic oligonucleotide
gaaagaaccccccccagaatc

SEQ ID NO: 43221 - DNA, 21 bp, Artificial Sequence
  Description of Artificial Sequence: Synthetic oligonucleotide
agtttgactcctatgggtcgg

SEQ ID NO: 43222 - DNA, 21 bp, Artificial Sequence
  Description of Artificial Sequence: Synthetic oligonucleotide
actccgattactcctatgact

SEQ ID NO: 43223 - DNA, 21 bp, Artificial Sequence
  Description of Artificial Sequence: Synthetic oligonucleotide
tatcatcttaattctcagtct

SEQ ID NO: 43224 - DNA, 21 bp, Artificial Sequence
  Description of Artificial Sequence: Synthetic oligonucleotide
tttacttctaataaggcgtcg

SEQ ID NO: 43225 - DNA, 21 bp, Artificial Sequence
  Description of Artificial Sequence: Synthetic oligonucleotide
aatagtttttctcggaatagt

SEQ ID NO: 43226 - DNA, 21 bp, Artificial Sequence
  Description of Artificial Sequence: Synthetic oligonucleotide
aaagtcgacaaaagaaccgac

SEQ ID NO: 43227 - DNA, 21 bp, Artificial Sequence
  Description of Artificial Sequence: Synthetic oligonucleotide
aaactcaccggccaaagaagc

SEQ ID NO: 43228 - DNA, 21 bp, Artificial Sequence
  Description of Artificial Sequence: Synthetic oligonucleotide
tattctggtgctagtggtcgt

SEQ ID NO: 43229 - DNA, 21 bp, Artificial Sequence
  Description of Artificial Sequence: Synthetic oligonucleotide
agtcttgggaataggagtttg

SEQ ID NO: 43230 - DNA, 21 bp, Artificial Sequence
  Description of Artificial Sequence: Synthetic oligonucleotide
atgctcaacagcagaaccagc

SEQ ID NO: 43231 - DNA, 21 bp, Artificial Sequence
  Description of Artificial Sequence: Synthetic oligonucleotide
cagattactccgcggagtggg

SEQ ID NO: 43232 - DNA, 21 bp, Artificial Sequence
  Description of Artificial Sequence: Synthetic oligonucleotide
accaacagaaacacctacgtc

SEQ ID NO: 43233 - DNA, 21 bp, Artificial Sequence
  Description of Artificial Sequence: Synthetic oligonucleotide
atggctgggaatccgcatagt

SEQ ID NO: 43234 - DNA, 21 bp, Artificial Sequence
  Description of Artificial Sequence: Synthetic oligonucleotide
atgctcagcggcagcagaaac

SEQ ID NO: 43235 - DNA, 21 bp, Artificial Sequence
  Description of Artificial Sequence: Synthetic oligonucleotide
tcgaatactcgggatattaag

SEQ ID NO: 43236 - DNA, 21 bp, Artificial Sequence
  Description of Artificial Sequence: Synthetic oligonucleotide
aacggttctggactgaatcaa

SEQ ID NO: 43237 - DNA, 21 bp, Artificial Sequence
  Description of Artificial Sequence: Synthetic oligonucleotide
agcatcaaaagcgtcaccaac

SEQ ID NO: 43238 - DNA, 21 bp, Artificial Sequence
  Description of Artificial Sequence: Synthetic oligonucleotide
tctcatgataatggtcagtcg

SEQ ID NO: 43239 - DNA, 21 bp, Artificial Sequence
  Description of Artificial Sequence: Synthetic oligonucleotide
gattatgggaaggggagttct

SEQ ID NO: 43240 - DNA, 21 bp, Artificial Sequence
  Description of Artificial Sequence: Synthetic oligonucleotide
tctacggtgggtcatatgaat

SEQ ID NO: 43241 - DNA, 21 bp, Artificial Sequence
  Description of Artificial Sequence: Synthetic oligonucleotide
agaatgctcgacggccacagc

SEQ ID NO: 43242 - DNA, 21 bp, Artificial Sequence
  Description of Artificial Sequence: Synthetic oligonucleotide
cccatggactacagcagaagc

SEQ ID NO: 43243 - DNA, 21 bp, Artificial Sequence
  Description of Artificial Sequence: Synthetic oligonucleotide
aagggttctaatcattcgggt

SEQ ID NO: 43244 - DNA, 21 bp, Artificial Sequence
  Description of Artificial Sequence: Synthetic oligonucleotide
agttcgaagggtattttggct

SEQ ID NO: 43245 - DNA, 21 bp, Artificial Sequence
  Description of Artificial Sequence: Synthetic oligonucleotide
tctgtggggtctggtgctttg

SEQ ID NO: 43246 - DNA, 21 bp, Artificial Sequence
  Description of Artificial Sequence: Synthetic oligonucleotide
cccatcagcagcagagccggc

SEQ ID NO: 43247 - DNA, 21 bp, Artificial Sequence
  Description of Artificial Sequence: Synthetic oligonucleotide
aaccccgtcgccgccgccacc

SEQ ID NO: 43248 - DNA, 21 bp, Artificial Sequence
  Description of Artificial Sequence: Synthetic oligonucleotide
gctaggctgggtgttactagg

SEQ ID NO: 43249 - DNA, 21 bp, Artificial Sequence
  Description of Artificial Sequence: Synthetic oligonucleotide
agtagggttactgggggtact

SEQ ID NO: 43250 - DNA, 21 bp, Artificial Sequence
  Description of Artificial Sequence: Synthetic oligonucleotide
agctgcaccaccagatgcctc

SEQ ID NO: 43251 - DNA, 21 bp, Artificial Sequence
  Description of Artificial Sequence: Synthetic oligonucleotide
aaaaacatcggcagccacggc

SEQ ID NO: 43252 - DNA, 21 bp, Artificial Sequence
  Description of Artificial Sequence: Synthetic oligonucleotide
gctgttgtgactggtcatcgg

SEQ ID NO: 43253 - DNA, 21 bp, Artificial Sequence
  Description of Artificial Sequence: Synthetic oligonucleotide
aacggcagcggcaccaaccaa

SEQ ID NO: 43254 - DNA, 21 bp, Artificial Sequence
  Description of Artificial Sequence: Synthetic oligonucleotide
agaaacgtcagccaccccggc

SEQ ID NO: 43255 - DNA, 21 bp, Artificial Sequence
  Description of Artificial Sequence: Synthetic oligonucleotide
gtttatagtagtccttcggct

SEQ ID NO: 43256 - DNA, 21 bp, Artificial Sequence
  Description of Artificial Sequence: Synthetic oligonucleotide
aagtataattctcttgcttgt

SEQ ID NO: 43257 - DNA, 21 bp, Artificial Sequence
  Description of Artificial Sequence: Synthetic oligonucleotide
gccaaaacccaaagcgtcaac

SEQ ID NO: 43258 - DNA, 21 bp, Artificial Sequence
  Description of Artificial Sequence: Synthetic oligonucleotide
gggagtaatcttaatagtact

SEQ ID NO: 43259 - DNA, 21 bp, Artificial Sequence
  Description of Artificial Sequence: Synthetic oligonucleotide
aagatttcgtctccttttatt

SEQ ID NO: 43260 - DNA, 21 bp, Artificial Sequence
  Description of Artificial Sequence: Synthetic oligonucleotide
aagacgagtcttaatacgagt

SEQ ID NO: 43261 - DNA, 21 bp, Artificial Sequence
  Description of Artificial Sequence: Synthetic oligonucleotide
aagcatgagggttataatgtg

SEQ ID NO: 43262 - DNA, 21 bp, Artificial Sequence
  Description of Artificial Sequence: Synthetic oligonucleotide
agaaccagccacacccccggc

SEQ ID NO: 43263 - DNA, 21 bp, Artificial Sequence
  Description of Artificial Sequence: Synthetic oligonucleotide
aatggtctgagtcagacgcat

SEQ ID NO: 43264 - DNA, 21 bp, Artificial Sequence
  Description of Artificial Sequence: Synthetic oligonucleotide
gacagaggcagacccgccggc

SEQ ID NO: 43265 - DNA, 21 bp, Artificial Sequence
  Description of Artificial Sequence: Synthetic oligonucleotide
tctaatacgaatgctgctatg

SEQ ID NO: 43266 - DNA, 21 bp, Artificial Sequence
  Description of Artificial Sequence: Synthetic oligonucleotide
caaaaaggcaacaacctcccc

SEQ ID NO: 43267 - DNA, 21 bp, Artificial Sequence
  Description of Artificial Sequence: Synthetic oligonucleotide
aaggatgctggtgattatggg

SEQ ID NO: 43268 - DNA, 21 bp, Artificial Sequence
  Description of Artificial Sequence: Synthetic oligonucleotide
acgctggataatcataggtct

SEQ ID NO: 43269 - DNA, 21 bp, Artificial Sequence
  Description of Artificial Sequence: Synthetic oligonucleotide
tctactactaaggatggtatt

SEQ ID NO: 43270 - DNA, 21 bp, Artificial Sequence
  Description of Artificial Sequence: Synthetic oligonucleotide
aattctggtaatattgtgact

SEQ ID NO: 43271 - DNA, 21 bp, Artificial Sequence
  Description of Artificial Sequence: Synthetic oligonucleotide
agtgatgggcagagttctgtg

SEQ ID NO: 43272 - DNA, 21 bp, Artificial Sequence
  Description of Artificial Sequence: Synthetic oligonucleotide
gccttcggcgaaatcagacaa

SEQ ID NO: 43273 - DNA, 21 bp, Artificial Sequence
  Description of Artificial Sequence: Synthetic oligonucleotide
aaaagccaactcgtcatgcac

SEQ ID NO: 43274 - DNA, 21 bp, Artificial Sequence
  Description of Artificial Sequence: Synthetic oligonucleotide
aatgctgagcctacttcgagt

SEQ ID NO: 43275 - DNA, 21 bp, Artificial Sequence
  Description of Artificial Sequence: Synthetic oligonucleotide
cctcagtatggtgataaggag

SEQ ID NO: 43276 - DNA, 21 bp, Artificial Sequence
  Description of Artificial Sequence: Synthetic oligonucleotide
tcgattatgcatttgagtagt

SEQ ID NO: 43277 - DNA, 21 bp, Artificial Sequence
  Description of Artificial Sequence: Synthetic oligonucleotide
cttaataagtctacgcttccg

SEQ ID NO: 43278 - DNA, 21 bp, Artificial Sequence
  Description of Artificial Sequence: Synthetic oligonucleotide
atgagcaccagcagcagcaga

SEQ ID NO: 43279 - DNA, 21 bp, Artificial Sequence
  Description of Artificial Sequence: Synthetic oligonucleotide
acggtgggggctcgtaatggt

SEQ ID NO: 43280 - DNA, 21 bp, Artificial Sequence
  Description of Artificial Sequence: Synthetic oligonucleotide
ggcagcaccaaacccagcccc

SEQ ID NO: 43281 - DNA, 21 bp, Artificial Sequence
  Description of Artificial Sequence: Synthetic oligonucleotide
aacggttctggacagagtcaa

SEQ ID NO: 43282 - DNA, 21 bp, Artificial Sequence
  Description of Artificial Sequence: Synthetic oligonucleotide
agtagttcggcgcctcgtctt

SEQ ID NO: 43283 - DNA, 21 bp, Artificial Sequence
  Description of Artificial Sequence: Synthetic oligonucleotide
ccttctactcggcagtctaat

SEQ ID NO: 43284 - DNA, 21 bp, Artificial Sequence
  Description of Artificial Sequence: Synthetic oligonucleotide
cccagcgaagtcagaagcagc

SEQ ID NO: 43285 - DNA, 21 bp, Artificial Sequence
  Description of Artificial Sequence: Synthetic oligonucleotide
gtttctggttctaaggttggt

SEQ ID NO: 43286 - DNA, 21 bp, Artificial Sequence
  Description of Artificial Sequence: Synthetic oligonucleotide
ctgatttcgtctaagagtagt

SEQ ID NO: 43287 - DNA, 21 bp, Artificial Sequence
  Description of Artificial Sequence: Synthetic oligonucleotide
cccatccaccccagcagcggc

SEQ ID NO: 43288 - DNA, 21 bp, Artificial Sequence
  Description of Artificial Sequence: Synthetic oligonucleotide
atgattagtggtgcgactagg

SEQ ID NO: 43289 - DNA, 21 bp, Artificial Sequence
  Description of Artificial Sequence: Synthetic oligonucleotide
gataggggtcgtaatactggt

SEQ ID NO: 43290 - DNA, 21 bp, Artificial Sequence
  Description of Artificial Sequence: Synthetic oligonucleotide
ggcagactcgaagcccaaaaa

SEQ ID NO: 43291 - DNA, 21 bp, Artificial Sequence
  Description of Artificial Sequence: Synthetic oligonucleotide
gccggcaacatgccccacagc

SEQ ID NO: 43292 - DNA, 21 bp, Artificial Sequence
  Description of Artificial Sequence: Synthetic oligonucleotide
ggccccatcagacccatccaa

SEQ ID NO: 43293 - DNA, 21 bp, Artificial Sequence
  Description of Artificial Sequence: Synthetic oligonucleotide
cacctcggcgtccccctcaaa

SEQ ID NO: 43294 - DNA, 21 bp, Artificial Sequence
  Description of Artificial Sequence: Synthetic oligonucleotide
gtcaccagaggcctcaacgtc

SEQ ID NO: 43295 - DNA, 21 bp, Artificial Sequence
  Description of Artificial Sequence: Synthetic oligonucleotide
gagattcttggtactcatagg

SEQ ID NO: 43296 - DNA, 21 bp, Artificial Sequence
  Description of Artificial Sequence: Synthetic oligonucleotide
cgtacggatcatgggggtgtg

SEQ ID NO: 43297 - DNA, 21 bp, Artificial Sequence
  Description of Artificial Sequence: Synthetic oligonucleotide
tctatttctaagactcaggct

SEQ ID NO: 43298 - DNA, 21 bp, Artificial Sequence
  Description of Artificial Sequence: Synthetic oligonucleotide
gatgggattaagtcgtatgcg

SEQ ID NO: 43299 - DNA, 21 bp, Artificial Sequence
  Description of Artificial Sequence: Synthetic oligonucleotide
caagtccccgccaccaacaga

SEQ ID NO: 43300 - DNA, 21 bp, Artificial Sequence
  Description of Artificial Sequence: Synthetic oligonucleotide
gccggcgccggcaaagtctac

SEQ ID NO: 43301 - DNA, 21 bp, Artificial Sequence
  Description of Artificial Sequence: Synthetic oligonucleotide
gtttcgggtatgagtgggagt

SEQ ID NO: 43302 - DNA, 21 bp, Artificial Sequence
  Description of Artificial Sequence: Synthetic oligonucleotide
gccggcagcagcccccccacc

SEQ ID NO: 43303 - DNA, 21 bp, Artificial Sequence
  Description of Artificial Sequence: Synthetic oligonucleotide
ccggtgagtggggcgactatt

SEQ ID NO: 43304 - DNA, 21 bp, Artificial Sequence
  Description of Artificial Sequence: Synthetic oligonucleotide
gatcagaatcgtgttccttat

SEQ ID NO: 43305 - DNA, 21 bp, Artificial Sequence
  Description of Artificial Sequence: Synthetic oligonucleotide
acgcctacggggcatcgttct

SEQ ID NO: 43306 - DNA, 21 bp, Artificial Sequence
  Description of Artificial Sequence: Synthetic oligonucleotide
atgggtccgaatcatcttcct

SEQ ID NO: 43307 - DNA, 21 bp, Artificial Sequence
  Description of Artificial Sequence: Synthetic oligonucleotide
agggttattactccttctacg

SEQ ID NO: 43308 - DNA, 21 bp, Artificial Sequence
  Description of Artificial Sequence: Synthetic oligonucleotide
gtccccagcaccgccggcaaa

SEQ ID NO: 43309 - DNA, 21 bp, Artificial Sequence
  Description of Artificial Sequence: Synthetic oligonucleotide
cttttgcatcataatactggg

SEQ ID NO: 43310 - DNA, 21 bp, Artificial Sequence
  Description of Artificial Sequence: Synthetic oligonucleotide
tctattcattcggatcggacg

SEQ ID NO: 43311 - DNA, 21 bp, Artificial Sequence
  Description of Artificial Sequence: Synthetic oligonucleotide
cagaatgtttctactatgaat

SEQ ID NO: 43312 - DNA, 21 bp, Artificial Sequence
  Description of Artificial Sequence: Synthetic oligonucleotide
aataatcctaagaatgttgtt

SEQ ID NO: 43313 - DNA, 21 bp, Artificial Sequence
  Description of Artificial Sequence: Synthetic oligonucleotide
atgactactcagttgaatagt

SEQ ID NO: 43314 - DNA, 21 bp, Artificial Sequence
  Description of Artificial Sequence: Synthetic oligonucleotide
actcagcagaatgggagtaat

SEQ ID NO: 43315 - DNA, 21 bp, Artificial Sequence
  Description of Artificial Sequence: Synthetic oligonucleotide
ggtgtgattaataatgagcgg

SEQ ID NO: 43316 - DNA, 21 bp, Artificial Sequence
  Description of Artificial Sequence: Synthetic oligonucleotide
ttttctcaggggaatcgttcg

SEQ ID NO: 43317 - DNA, 21 bp, Artificial Sequence
  Description of Artificial Sequence: Synthetic oligonucleotide
cctgggacgacttctgcgatg

SEQ ID NO: 43318 - DNA, 21 bp, Artificial Sequence
  Description of Artificial Sequence: Synthetic oligonucleotide
agccacgtcaacagcaccaga

SEQ ID NO: 43319 - DNA, 21 bp, Artificial Sequence
  Description of Artificial Sequence: Synthetic oligonucleotide
cctaatcttcagtcttcgaag

SEQ ID NO: 43320 - DNA, 21 bp, Artificial Sequence
  Description of Artificial Sequence: Synthetic oligonucleotide
gcggggattaattctcaggtg

SEQ ID NO: 43321 - DNA, 21 bp, Artificial Sequence
  Description of Artificial Sequence: Synthetic oligonucleotide
tacctcggcaaagtccaagtc

SEQ ID NO: 43322 - DNA, 21 bp, Artificial Sequence
  Description of Artificial Sequence: Synthetic oligonucleotide
gcgacttctaatggtactctg

SEQ ID NO: 43323 - DNA, 21 bp, Artificial Sequence
  Description of Artificial Sequence: Synthetic oligonucleotide
acccaccaaagcagcaccagc

SEQ ID NO: 43324 - DNA, 21 bp, Artificial Sequence
  Description of Artificial Sequence: Synthetic oligonucleotide
ttgggtgatcgttcttttatt

SEQ ID NO: 43325 - DNA, 21 bp, Artificial Sequence
  Description of Artificial Sequence: Synthetic oligonucleotide
tggagcctcggcagccaaagc

SEQ ID NO: 43326 - DNA, 21 bp, Artificial Sequence
  Description of Artificial Sequence: Synthetic oligonucleotide
agcggcaccaccaccttcggc

SEQ ID NO: 43327 - DNA, 21 bp, Artificial Sequence
  Description of Artificial Sequence: Synthetic oligonucleotide
tgtacgggtagtagttctatg

SEQ ID NO: 43328 - DNA, 21 bp, Artificial Sequence
  Description of Artificial Sequence: Synthetic oligonucleotide
tcgagggattctagtattcat

SEQ ID NO: 43329 - DNA, 21 bp, Artificial Sequence
  Description of Artificial Sequence: Synthetic oligonucleotide
acttcgtctacgacttctttg

SEQ ID NO: 43330 - DNA, 21 bp, Artificial Sequence
  Description of Artificial Sequence: Synthetic oligonucleotide
tttcctgtgaatgcgggtgct

SEQ ID NO: 43331 - DNA, 21 bp, Artificial Sequence
  Description of Artificial Sequence: Synthetic oligonucleotide
aacggcatcaccaaaagcagc

SEQ ID NO: 43332 - DNA, 21 bp, Artificial Sequence
  Description of Artificial Sequence: Synthetic oligonucleotide
accccccaccaaagaagcagc

SEQ ID NO: 43333 - DNA, 21 bp, Artificial Sequence
  Description of Artificial Sequence: Synthetic oligonucleotide
tcgggggcttcgagtaattct

SEQ ID NO: 43334 - DNA, 21 bp, Artificial Sequence
  Description of Artificial Sequence: Synthetic oligonucleotide
actacgcattcgtctattaat

SEQ ID NO: 43335 - DNA, 21 bp, Artificial Sequence
  Description of Artificial Sequence: Synthetic oligonucleotide
gatactgctgtgaattatggt

SEQ ID NO: 43336 - DNA, 21 bp, Artificial Sequence
  Description of Artificial Sequence: Synthetic oligonucleotide
tctcagtggcagtcgtcttct

SEQ ID NO: 43337 - DNA, 21 bp, Artificial Sequence
  Description of Artificial Sequence: Synthetic oligonucleotide
aacggttctggacagaatgaa

SEQ ID NO: 43338 - DNA, 21 bp, Artificial Sequence
  Description of Artificial Sequence: Synthetic oligonucleotide
attagttctggtacgcatggg

SEQ ID NO: 43339 - DNA, 21 bp, Artificial Sequence
  Description of Artificial Sequence: Synthetic oligonucleotide
cccaccgacagaatcaacaga

SEQ ID NO: 43340 - DNA, 21 bp, Artificial Sequence
  Description of Artificial Sequence: Synthetic oligonucleotide
caacaagtcaacaccaccaga

SEQ ID NO: 43341 - DNA, 21 bp, Artificial Sequence
  Description of Artificial Sequence: Synthetic oligonucleotide
tcttctcataaggattatttg

SEQ ID NO: 43342 - DNA, 21 bp, Artificial Sequence
  Description of Artificial Sequence: Synthetic oligonucleotide
gtgaatcagagtggttttagt

SEQ ID NO: 43343 - DNA, 21 bp, Artificial Sequence
  Description of Artificial Sequence: Synthetic oligonucleotide
agtgttgcgggtactagtagg

SEQ ID NO: 43344 - DNA, 21 bp, Artificial Sequence
  Description of Artificial Sequence: Synthetic oligonucleotide
gtcccccacaaccacagcctc

SEQ ID NO: 43345 - DNA, 21 bp, Artificial Sequence
  Description of Artificial Sequence: Synthetic oligonucleotide
tttcagccgaggagttctacg

SEQ ID NO: 43346 - DNA, 21 bp, Artificial Sequence
  Description of Artificial Sequence: Synthetic oligonucleotide
gtccacgaagcccccctcaga

SEQ ID NO: 43347 - DNA, 21 bp, Artificial Sequence
  Description of Artificial Sequence: Synthetic oligonucleotide
ctcatcagcgaaaccagcaga

SEQ ID NO: 43348 - DNA, 21 bp, Artificial Sequence
  Description of Artificial Sequence: Synthetic oligonucleotide
ggcttcagcagccaacaaaga

SEQ ID NO: 43349 - DNA, 21 bp, Artificial Sequence
  Description of Artificial Sequence: Synthetic oligonucleotide
gctacgaatcattcgccgcag

SEQ ID NO: 43350 - DNA, 21 bp, Artificial Sequence
  Description of Artificial Sequence: Synthetic oligonucleotide
agaggcgacaccaaaaacctc

SEQ ID NO: 43351 - DNA, 21 bp, Artificial Sequence
  Description of Artificial Sequence: Synthetic oligonucleotide
agaatcaccagcagcaaccaa

SEQ ID NO: 43352 - DNA, 21 bp, Artificial Sequence
  Description of Artificial Sequence: Synthetic oligonucleotide
atggagagtaaggctaattct

SEQ ID NO: 43353 - DNA, 21 bp, Artificial Sequence
  Description of Artificial Sequence: Synthetic oligonucleotide
tataatcggacttctattgtg

SEQ ID NO: 43354 - DNA, 21 bp, Artificial Sequence
  Description of Artificial Sequence: Synthetic oligonucleotide
agaaccaacgacaccacccac

SEQ ID NO: 43355 - DNA, 21 bp, Artificial Sequence
  Description of Artificial Sequence: Synthetic oligonucleotide
ggtgagcttccggataggagg

SEQ ID NO: 43356 - DNA, 21 bp, Artificial Sequence
  Description of Artificial Sequence: Synthetic oligonucleotide
cacctcatgcaacccgtctgc

SEQ ID NO: 43357 - DNA, 21 bp, Artificial Sequence
  Description of Artificial Sequence: Synthetic oligonucleotide
tgtggtactcctgtggctttg

SEQ ID NO: 43358 - DNA, 21 bp, Artificial Sequence
  Description of Artificial Sequence: Synthetic oligonucleotide
aacagcagcggccaaaacccc

SEQ ID NO: 43359 - DNA, 21 bp, Artificial Sequence
  Description of Artificial Sequence: Synthetic oligonucleotide
tctcagaatgtttcttcgaag

SEQ ID NO: 43360 - DNA, 21 bp, Artificial Sequence
  Description of Artificial Sequence: Synthetic oligonucleotide
gggtctattaaggcgccgcct

SEQ ID NO: 43361 - DNA, 21 bp, Artificial Sequence
  Description of Artificial Sequence: Synthetic oligonucleotide
atgtcgggtggtaatatgcgg

SEQ ID NO: 43362 - DNA, 21 bp, Artificial Sequence
  Description of Artificial Sequence: Synthetic oligonucleotide
caaaccagcgccacccaaaga

SEQ ID NO: 43363 - DNA, 21 bp, Artificial Sequence
  Description of Artificial Sequence: Synthetic oligonucleotide
tctggtgggagttcggttctg

SEQ ID NO: 43364 - DNA, 21 bp, Artificial Sequence
  Description of Artificial Sequence: Synthetic oligonucleotide
accaccagcgccagacccaac

SEQ ID NO: 43365 - DNA, 21 bp, Artificial Sequence
  Description of Artificial Sequence: Synthetic oligonucleotide
gtccaaggcaccggcaacacc

SEQ ID NO: 43366 - DNA, 21 bp, Artificial Sequence
  Description of Artificial Sequence: Synthetic oligonucleotide
ccgagtactagtggtgcgatg

SEQ ID NO: 43367 - DNA, 21 bp, Artificial Sequence
  Description of Artificial Sequence: Synthetic oligonucleotide
tatattgatgcttctgcgcgg

SEQ ID NO: 43368 - DNA, 21 bp, Artificial Sequence
  Description of Artificial Sequence: Synthetic oligonucleotide
cctatttcgcatacgactggt

SEQ ID NO: 43369 - DNA, 21 bp, Artificial Sequence
  Description of Artificial Sequence: Synthetic oligonucleotide
gggtctgggattaagcgtgag

SEQ ID NO: 43370 - DNA, 21 bp, Artificial Sequence
  Description of Artificial Sequence: Synthetic oligonucleotide
cttcctggtcagggtgttggt

SEQ ID NO: 43371 - DNA, 21 bp, Artificial Sequence
  Description of Artificial Sequence: Synthetic oligonucleotide
gtccaaagaagcagcaaccaa

SEQ ID NO: 43372 - DNA, 21 bp, Artificial Sequence
  Description of Artificial Sequence: Synthetic oligonucleotide
agtcttagttcgaagcagatg

SEQ ID NO: 43373 - DNA, 21 bp, Artificial Sequence
  Description of Artificial Sequence: Synthetic oligonucleotide
cctcagaataatcaggcgcat

SEQ ID NO: 43374 - DNA, 21 bp, Artificial Sequence
  Description of Artificial Sequence: Synthetic oligonucleotide
cagcttcgttcggatcagact

SEQ ID NO: 43375 - DNA, 21 bp, Artificial Sequence
  Description of Artificial Sequence: Synthetic oligonucleotide
agcagagaaaccgtccccacc

SEQ ID NO: 43376 - DNA, 21 bp, Artificial Sequence
  Description of Artificial Sequence: Synthetic oligonucleotide
atcaaacccagcagcagcgcc

SEQ ID NO: 43377 - DNA, 21 bp, Artificial Sequence
  Description of Artificial Sequence: Synthetic oligonucleotide
cccaccagccaacaaagaccc

SEQ ID NO: 43378 - DNA, 21 bp, Artificial Sequence
  Description of Artificial Sequence: Synthetic oligonucleotide
caaaacagcaaaggctacgtc

SEQ ID NO: 43379 - DNA, 21 bp, Artificial Sequence
  Description of Artificial Sequence: Synthetic oligonucleotide
ctcgccaccgccaacagcaga

SEQ ID NO: 43380 - DNA, 21 bp, Artificial Sequence
  Description of Artificial Sequence: Synthetic oligonucleotide
tattcggataataagactact

SEQ ID NO: 43381 - DNA, 21 bp, Artificial Sequence
  Description of Artificial Sequence: Synthetic oligonucleotide
gtcaaagtcacccaccaacaa

SEQ ID NO: 43382 - DNA, 21 bp, Artificial Sequence
  Description of Artificial Sequence: Synthetic oligonucleotide
ttggggactagtactattttg

SEQ ID NO: 43383 - DNA, 21 bp, Artificial Sequence
  Description of Artificial Sequence: Synthetic oligonucleotide
aatactcggtcgtctagtggg

SEQ ID NO: 43384 - DNA, 21 bp, Artificial Sequence
  Description of Artificial Sequence: Synthetic oligonucleotide
gtcgtcctcgacaccaacaga

SEQ ID NO: 43385 - DNA, 21 bp, Artificial Sequence
  Description of Artificial Sequence: Synthetic oligonucleotide
gggcaggtgaaggctattggg

SEQ ID NO: 43386 - DNA, 21 bp, Artificial Sequence
  Description of Artificial Sequence: Synthetic oligonucleotide
cccgtcagcagagccaccttc

SEQ ID NO: 43387 - DNA, 21 bp, Artificial Sequence
  Description of Artificial Sequence: Synthetic oligonucleotide
caaagcggcaacaccatccaa

SEQ ID NO: 43388 - DNA, 21 bp, Artificial Sequence
  Description of Artificial Sequence: Synthetic oligonucleotide
gctccggatgttcggcggtgt

SEQ ID NO: 43389 - DNA, 21 bp, Artificial Sequence
  Description of Artificial Sequence: Synthetic oligonucleotide
gcggctaggcctgatgttact

SEQ ID NO: 43390 - DNA, 21 bp, Artificial Sequence
  Description of Artificial Sequence: Synthetic oligonucleotide
tgtccgtcgcagcatgtgatt

SEQ ID NO: 43391 - DNA, 21 bp, Artificial Sequence
  Description of Artificial Sequence: Synthetic oligonucleotide
atgagcgacaccagcaccaga

SEQ ID NO: 43392 - DNA, 21 bp, Artificial Sequence
  Description of Artificial Sequence: Synthetic oligonucleotide
ggcttccacggccaaggcagc

SEQ ID NO: 43393 - DNA, 21 bp, Artificial Sequence
  Description of Artificial Sequence: Synthetic oligonucleotide
caccaactcgaagcccacaaa

SEQ ID NO: 43394 - DNA, 21 bp, Artificial Sequence
  Description of Artificial Sequence: Synthetic oligonucleotide
caaggccaaaacagaaccgtc

SEQ ID NO: 43395 - DNA, 21 bp, Artificial Sequence
  Description of Artificial Sequence: Synthetic oligonucleotide
agtcttcctaatactaatggg

SEQ ID NO: 43396 - DNA, 21 bp, Artificial Sequence
  Description of Artificial Sequence: Synthetic oligonucleotide
agtgcgaataataagtcgggg

SEQ ID NO: 43397 - DNA, 21 bp, Artificial Sequence
  Description of Artificial Sequence: Synthetic oligonucleotide
gttagtaagagtccgtctact

SEQ ID NO: 43398 - DNA, 21 bp, Artificial Sequence
  Description of Artificial Sequence: Synthetic oligonucleotide
ccctacaacagcaaagccagc

SEQ ID NO: 43399 - DNA, 21 bp, Artificial Sequence
  Description of Artificial Sequence: Synthetic oligonucleotide
tcttcgagtgggggtgtgaag

SEQ ID NO: 43400 - DNA, 21 bp, Artificial Sequence
  Description of Artificial Sequence: Synthetic oligonucleotide
atcggcagcggccaaaaccaa

SEQ ID NO: 43401 - DNA, 21 bp, Artificial Sequence
  Description of Artificial Sequence: Synthetic oligonucleotide
aacggttctagacagaatcaa

SEQ ID NO: 43402 - DNA, 21 bp, Artificial Sequence
  Description of Artificial Sequence: Synthetic oligonucleotide
gggatgacgcaggggggtaag

SEQ ID NO: 43403 - DNA, 21 bp, Artificial Sequence
  Description of Artificial Sequence: Synthetic oligonucleotide
ggttcgccgggggttttgcgt

SEQ ID NO: 43404 - DNA, 21 bp, Artificial Sequence
  Description of Artificial Sequence: Synthetic oligonucleotide
ggggatcagcataagccgttg

SEQ ID NO: 43405 - DNA, 21 bp, Artificial Sequence
  Description of Artificial Sequence: Synthetic oligonucleotide
gctggtactggtagttcgctt

SEQ ID NO: 43406 - DNA, 21 bp, Artificial Sequence
  Description of Artificial Sequence: Synthetic oligonucleotide
cacggttctggacagaatcaa

SEQ ID NO: 43407 - DNA, 21 bp, Artificial Sequence
  Description of Artificial Sequence: Synthetic oligonucleotide
caaagcgaccacagaagcctc

SEQ ID NO: 43408 - DNA, 21 bp, Artificial Sequence
  Description of Artificial Sequence: Synthetic oligonucleotide
aacggttctggacagattcaa

SEQ ID NO: 43409 - DNA, 21 bp, Artificial Sequence
  Description of Artificial Sequence: Synthetic oligonucleotide
cccctcgacaaaagcatgatg

SEQ ID NO: 43410 - DNA, 21 bp, Artificial Sequence
  Description of Artificial Sequence: Synthetic oligonucleotide
aaaagagacgcccacaccgcc

SEQ ID NO: 43411 - DNA, 21 bp, Artificial Sequence
  Description of Artificial Sequence: Synthetic oligonucleotide
gctggtcgtactcattcgtgt

SEQ ID NO: 43412 - DNA, 21 bp, Artificial Sequence
  Description of Artificial Sequence: Synthetic oligonucleotide
tgtattagggctggttcttgt

SEQ ID NO: 43413 - DNA, 21 bp, Artificial Sequence
  Description of Artificial Sequence: Synthetic oligonucleotide
ggtactgcgaggggggttgct

SEQ ID NO: 43414 - DNA, 21 bp, Artificial Sequence
  Description of Artificial Sequence: Synthetic oligonucleotide
aacaggtctggacagaatcaa

SEQ ID NO: 43415 - DNA, 21 bp, Artificial Sequence
  Description of Artificial Sequence: Synthetic oligonucleotide
aggacggggaataatcatgag

SEQ ID NO: 43416 - DNA, 21 bp, Artificial Sequence
  Description of Artificial Sequence: Synthetic oligonucleotide
cacaccgacatcaaccaccaa

SEQ ID NO: 43417 - DNA, 21 bp, Artificial Sequence
  Description of Artificial Sequence: Synthetic oligonucleotide
aggactgtgaatagtgctaat

SEQ ID NO: 43418 - DNA, 21 bp, Artificial Sequence
  Description of Artificial Sequence: Synthetic oligonucleotide
cggactactaatgctacgtat

SEQ ID NO: 43419 - DNA, 21 bp, Artificial Sequence
  Description of Artificial Sequence: Synthetic oligonucleotide
aatcctgttaatacgaagtct

SEQ ID NO: 43420 - DNA, 21 bp, Artificial Sequence
  Description of Artificial Sequence: Synthetic oligonucleotide
gctttggcgggtactaagggg

SEQ ID NO: 43421 - DNA, 21 bp, Artificial Sequence
  Description of Artificial Sequence: Synthetic oligonucleotide
cccgtcctcaacaaagccacc

SEQ ID NO: 43422 - DNA, 21 bp, Artificial Sequence
  Description of Artificial Sequence: Synthetic oligonucleotide
caccaagaaagagccagcatg

SEQ ID NO: 43423 - DNA, 21 bp, Artificial Sequence
  Description of Artificial Sequence: Synthetic oligonucleotide
agccaacaaagccccagcatg

SEQ ID NO: 43424 - DNA, 21 bp, Artificial Sequence
  Description of Artificial Sequence: Synthetic oligonucleotide
ccccacggcgacaaaaccagc

SEQ ID NO: 43425 - DNA, 21 bp, Artificial Sequence
  Description of Artificial Sequence: Synthetic oligonucleotide
ctttcgcttaataagtctcag

SEQ ID NO: 43426 - DNA, 21 bp, Artificial Sequence
  Description of Artificial Sequence: Synthetic oligonucleotide
cccagcaacagacaaatcgcc

SEQ ID NO: 43427 - DNA, 21 bp, Artificial Sequence
  Description of Artificial Sequence: Synthetic oligonucleotide
gtgcatacttcgggggtgcag

SEQ ID NO: 43428 - DNA, 21 bp, Artificial Sequence
  Description of Artificial Sequence: Synthetic oligonucleotide
cataagacggcggggtctgct

SEQ ID NO: 43429 - DNA, 21 bp, Artificial Sequence
  Description of Artificial Sequence: Synthetic oligonucleotide
cctaggttgaatgtgggtggt

SEQ ID NO: 43430 - DNA, 21 bp, Artificial Sequence
  Description of Artificial Sequence: Synthetic oligonucleotide
accggcatgagaaacatcggc

SEQ ID NO: 43431 - DNA, 21 bp, Artificial Sequence
  Description of Artificial Sequence: Synthetic oligonucleotide
tgtccgagtacgaagagttgt

SEQ ID NO: 43432 - DNA, 21 bp, Artificial Sequence
  Description of Artificial Sequence: Synthetic oligonucleotide
tacagcggcagcgccggccaa

SEQ ID NO: 43433 - DNA, 21 bp, Artificial Sequence
  Description of Artificial Sequence: Synthetic oligonucleotide
agaaccctcagaagcgtcgac

SEQ ID NO: 43434 - DNA, 21 bp, Artificial Sequence
  Description of Artificial Sequence: Synthetic oligonucleotide
aggggttatgggactagtgtg

SEQ ID NO: 43435 - DNA, 21 bp, Artificial Sequence
  Description of Artificial Sequence: Synthetic oligonucleotide
tttagtagtgcttcttttacg

SEQ ID NO: 43436 - DNA, 21 bp, Artificial Sequence
  Description of Artificial Sequence: Synthetic oligonucleotide
atggatcattctacgcgttct

SEQ ID NO: 43437 - DNA, 21 bp, Artificial Sequence
  Description of Artificial Sequence: Synthetic oligonucleotide
ggttatactgataagcatgtg

SEQ ID NO: 43438 - DNA, 21 bp, Artificial Sequence
  Description of Artificial Sequence: Synthetic oligonucleotide
cctcatttgccgcagtctgct

SEQ ID NO: 43439 - DNA, 21 bp, Artificial Sequence
  Description of Artificial Sequence: Synthetic oligonucleotide
tgtcctgggagttctgcttat

SEQ ID NO: 43440 - DNA, 21 bp, Artificial Sequence
  Description of Artificial Sequence: Synthetic oligonucleotide
gaacccccccacaaaatcctc

SEQ ID NO: 43441 - DNA, 21 bp, Artificial Sequence
  Description of Artificial Sequence: Synthetic oligonucleotide
tcttcgcaggaggttttgcgg

SEQ ID NO: 43442 - DNA, 21 bp, Artificial Sequence
  Description of Artificial Sequence: Synthetic oligonucleotide
aatactgatacgagtgcggtg

SEQ ID NO: 43443 - DNA, 21 bp, Artificial Sequence
  Description of Artificial Sequence: Synthetic oligonucleotide
gacagcacccacagagccacc

SEQ ID NO: 43444 - DNA, 21 bp, Artificial Sequence
  Description of Artificial Sequence: Synthetic oligonucleotide
cccctcgaaagaaccaccaaa

SEQ ID NO: 43445 - DNA, 21 bp, Artificial Sequence
  Description of Artificial Sequence: Synthetic oligonucleotide
agacaaagcaccaacatcggc

SEQ ID NO: 43446 - DNA, 21 bp, Artificial Sequence
  Description of Artificial Sequence: Synthetic oligonucleotide
ggcgacagcaaaagcacctgg

SEQ ID NO: 43447 - DNA, 21 bp, Artificial Sequence
  Description of Artificial Sequence: Synthetic oligonucleotide
ggcagccaaatccccagaatc

SEQ ID NO: 43448 - DNA, 21 bp, Artificial Sequence
  Description of Artificial Sequence: Synthetic oligonucleotide
cacgaaagaggccaaaacggc

SEQ ID NO: 43449 - DNA, 21 bp, Artificial Sequence
  Description of Artificial Sequence: Synthetic oligonucleotide
agagaacccgccagaggcgac

SEQ ID NO: 43450 - DNA, 21 bp, Artificial Sequence
  Description of Artificial Sequence: Synthetic oligonucleotide
gtcagcacccaagccatcagc

SEQ ID NO: 43451 - DNA, 21 bp, Artificial Sequence
  Description of Artificial Sequence: Synthetic oligonucleotide
aataatgctcatagttcgtct

SEQ ID NO: 43452 - DNA, 21 bp, Artificial Sequence
  Description of Artificial Sequence: Synthetic oligonucleotide
tataatcagccggttggtaag

SEQ ID NO: 43453 - DNA, 21 bp, Artificial Sequence
  Description of Artificial Sequence: Synthetic oligonucleotide
gccccccacagcgccgccaac

SEQ ID NO: 43454 - DNA, 21 bp, Artificial Sequence
  Description of Artificial Sequence: Synthetic oligonucleotide
agcagaacccaccccgtcatg

SEQ ID NO: 43455 - DNA, 21 bp, Artificial Sequence
  Description of Artificial Sequence: Synthetic oligonucleotide
gacatggtcagccccagaaac

SEQ ID NO: 43456 - DNA, 21 bp, Artificial Sequence
  Description of Artificial Sequence: Synthetic oligonucleotide
gaccccagagcccaaagccac

SEQ ID NO: 43457 - DNA, 21 bp, Artificial Sequence
  Description of Artificial Sequence: Synthetic oligonucleotide
aacgcccaaggcaccgccaaa

SEQ ID NO: 43458 - DNA, 21 bp, Artificial Sequence
  Description of Artificial Sequence: Synthetic oligonucleotide
actactaataatattcagggg

SEQ ID NO: 43459 - DNA, 21 bp, Artificial Sequence
  Description of Artificial Sequence: Synthetic oligonucleotide
atcagaaccaaagaaagcgcc

SEQ ID NO: 43460 - DNA, 21 bp, Artificial Sequence
  Description of Artificial Sequence: Synthetic oligonucleotide
aatgttagtactggggctact

SEQ ID NO: 43461 - DNA, 21 bp, Artificial Sequence
  Description of Artificial Sequence: Synthetic oligonucleotide
cgtattgattcggcgaagggg

SEQ ID NO: 43462 - DNA, 21 bp, Artificial Sequence
  Description of Artificial Sequence: Synthetic oligonucleotide
gcgtatcctactactggtagt

SEQ ID NO: 43463 - DNA, 21 bp, Artificial Sequence
  Description of Artificial Sequence: Synthetic oligonucleotide
aggcatgagtctaaggcgtat

SEQ ID NO: 43464 - DNA, 21 bp, Artificial Sequence
  Description of Artificial Sequence: Synthetic oligonucleotide
gcccaagtcgacaaaagaagc

SEQ ID NO: 43465 - DNA, 21 bp, Artificial Sequence
  Description of Artificial Sequence: Synthetic oligonucleotide
ggtattcagagttctcctact

SEQ ID NO: 43466 - DNA, 21 bp, Artificial Sequence
  Description of Artificial Sequence: Synthetic oligonucleotide
taccaaaacaaaagcctcacc

SEQ ID NO: 43467 - DNA, 21 bp, Artificial Sequence
  Description of Artificial Sequence: Synthetic oligonucleotide
cgtgtgcttacttctaatgcg

SEQ ID NO: 43468 - DNA, 21 bp, Artificial Sequence
  Description of Artificial Sequence: Synthetic oligonucleotide
accccccacgacggccaaaga

SEQ ID NO: 43469 - DNA, 21 bp, Artificial Sequence
  Description of Artificial Sequence: Synthetic oligonucleotide
ccggtggttgggaagatgagt

SEQ ID NO: 43470 - DNA, 21 bp, Artificial Sequence
  Description of Artificial Sequence: Synthetic oligonucleotide
ttggggtctaatcgttattct

SEQ ID NO: 43471 - DNA, 21 bp, Artificial Sequence
  Description of Artificial Sequence: Synthetic oligonucleotide
gagatgaaggggcatacggct

SEQ ID NO: 43472 - DNA, 21 bp, Artificial Sequence
  Description of Artificial Sequence: Synthetic oligonucleotide
tttgggtctagtactattttg

SEQ ID NO: 43473 - DNA, 21 bp, Artificial Sequence
  Description of Artificial Sequence: Synthetic oligonucleotide
ctcaccaccggccaaagcgtc

SEQ ID NO: 43474 - DNA, 21 bp, Artificial Sequence
  Description of Artificial Sequence: Synthetic oligonucleotide
gccagcagagacagagccggc

SEQ ID NO: 43475 - DNA, 21 bp, Artificial Sequence
  Description of Artificial Sequence: Synthetic oligonucleotide
gcttctgatcaggcgcattgt

SEQ ID NO: 43476 - DNA, 21 bp, Artificial Sequence
  Description of Artificial Sequence: Synthetic oligonucleotide
cccggcaacatgaccagcaga

SEQ ID NO: 43477 - DNA, 21 bp, Artificial Sequence
  Description of Artificial Sequence: Synthetic oligonucleotide
cccgccaacagccccgccacc

SEQ ID NO: 43478 - DNA, 21 bp, Artificial Sequence
  Description of Artificial Sequence: Synthetic oligonucleotide
tttcatgcgaatagtactgtg

SEQ ID NO: 43479 - DNA, 21 bp, Artificial Sequence
  Description of Artificial Sequence: Synthetic oligonucleotide
agtgttagtacgaatttttcg

SEQ ID NO: 43480 - DNA, 21 bp, Artificial Sequence
  Description of Artificial Sequence: Synthetic oligonucleotide
cctgtgtctcgggggagtggg

SEQ ID NO: 43481 - DNA, 21 bp, Artificial Sequence
  Description of Artificial Sequence: Synthetic oligonucleotide
aactgttctggacagaatcaa

SEQ ID NO: 43482 - DNA, 21 bp, Artificial Sequence
  Description of Artificial Sequence: Synthetic oligonucleotide
tacagcatgagacccaccgaa

SEQ ID NO: 43483 - DNA, 21 bp, Artificial Sequence
  Description of Artificial Sequence: Synthetic oligonucleotide
cacgggtcgtctgttcattct

SEQ ID NO: 43484 - DNA, 21 bp, Artificial Sequence
  Description of Artificial Sequence: Synthetic oligonucleotide
tctcagtctaatagttttctg

SEQ ID NO: 43485 - DNA, 21 bp, Artificial Sequence
  Description of Artificial Sequence: Synthetic oligonucleotide
gcgggttctcagactggtgtt

SEQ ID NO: 43486 - DNA, 21 bp, Artificial Sequence
  Description of Artificial Sequence: Synthetic oligonucleotide
cccaccctcggcaccaccaaa

SEQ ID NO: 43487 - DNA, 21 bp, Artificial Sequence
  Description of Artificial Sequence: Synthetic oligonucleotide
cgtacttcgacttctcttctt

SEQ ID NO: 43488 - DNA, 21 bp, Artificial Sequence
  Description of Artificial Sequence: Synthetic oligonucleotide
aatttggggattcctaagggt

SEQ ID NO: 43489 - DNA, 21 bp, Artificial Sequence
  Description of Artificial Sequence: Synthetic oligonucleotide
agaatgggcgtcagcaacacc

SEQ ID NO: 43490 - DNA, 21 bp, Artificial Sequence
  Description of Artificial Sequence: Synthetic oligonucleotide
atgggcatcgccaacatcggc

SEQ ID NO: 43491 - DNA, 21 bp, Artificial Sequence
  Description of Artificial Sequence: Synthetic oligonucleotide
gcgctggcttataataagggg

SEQ ID NO: 43492 - DNA, 21 bp, Artificial Sequence
  Description of Artificial Sequence: Synthetic oligonucleotide
agcgaacaccaacccctcagc

SEQ ID NO: 43493 - DNA, 21 bp, Artificial Sequence
  Description of Artificial Sequence: Synthetic oligonucleotide
gtcaacgaaaacagagtcagc

SEQ ID NO: 43494 - DNA, 21 bp, Artificial Sequence
  Description of Artificial Sequence: Synthetic oligonucleotide
ttcagcacccacgaagtcagc

SEQ ID NO: 43495 - DNA, 21 bp, Artificial Sequence
  Description of Artificial Sequence: Synthetic oligonucleotide
gatacgcatgtgagtggtcgg

SEQ ID NO: 43496 - DNA, 21 bp, Artificial Sequence
  Description of Artificial Sequence: Synthetic oligonucleotide
accagcaacacccccagcatc

SEQ ID NO: 43497 - DNA, 21 bp, Artificial Sequence
  Description of Artificial Sequence: Synthetic oligonucleotide
cccgccagagacagcaaaagc

SEQ ID NO: 43498 - DNA, 21 bp, Artificial Sequence
  Description of Artificial Sequence: Synthetic oligonucleotide
ggtttgcatccgcctcgtact

SEQ ID NO: 43499 - DNA, 21 bp, Artificial Sequence
  Description of Artificial Sequence: Synthetic oligonucleotide
gatacgaataagactagttat

SEQ ID NO: 43500 - DNA, 21 bp, Artificial Sequence
  Description of Artificial Sequence: Synthetic oligonucleotide
tctaatactcattcgcctagt

SEQ ID NO: 43501 - DNA, 21 bp, Artificial Sequence
  Description of Artificial Sequence: Synthetic oligonucleotide
tatttgacgagtacgtctaat

SEQ ID NO: 43502 - DNA, 21 bp, Artificial Sequence
  Description of Artificial Sequence: Synthetic oligonucleotide
tacaaacccggcctccaaagc

SEQ ID NO: 43503 - DNA, 21 bp, Artificial Sequence
  Description of Artificial Sequence: Synthetic oligonucleotide
tttccgaatgttaattctgct

SEQ ID NO: 43504 - DNA, 21 bp, Artificial Sequence
  Description of Artificial Sequence: Synthetic oligonucleotide
ccggggattggtacgcctttt

SEQ ID NO: 43505 - DNA, 21 bp, Artificial Sequence
  Description of Artificial Sequence: Synthetic oligonucleotide
atgatcagagacggcagcagc

SEQ ID NO: 43506 - DNA, 21 bp, Artificial Sequence
  Description of Artificial Sequence: Synthetic oligonucleotide
tggggcagaagcagcatggac

SEQ ID NO: 43507 - DNA, 21 bp, Artificial Sequence
  Description of Artificial Sequence: Synthetic oligonucleotide
attaatactgggagtgttaag

SEQ ID NO: 43508 - DNA, 21 bp, Artificial Sequence
  Description of Artificial Sequence: Synthetic oligonucleotide
ccggggcagaagcagggtatt

SEQ ID NO: 43509 - DNA, 21 bp, Artificial Sequence
  Description of Artificial Sequence: Synthetic oligonucleotide
attacgtctggtagtactcgt

SEQ ID NO: 43510 - DNA, 21 bp, Artificial Sequence
  Description of Artificial Sequence: Synthetic oligonucleotide
actccggttattgggcagggg

SEQ ID NO: 43511 - DNA, 21 bp, Artificial Sequence
  Description of Artificial Sequence: Synthetic oligonucleotide
ccgactcattcttctcgggat

SEQ ID NO: 43512 - DNA, 21 bp, Artificial Sequence
  Description of Artificial Sequence: Synthetic oligonucleotide
cctttttctgagatgcagaag

SEQ ID NO: 43513 - DNA, 21 bp, Artificial Sequence
  Description of Artificial Sequence: Synthetic oligonucleotide
ttgaagtctgtttctgggcag

SEQ ID NO: 43514 - DNA, 21 bp, Artificial Sequence
  Description of Artificial Sequence: Synthetic oligonucleotide
tcgcctgagaagaatatgcgg

SEQ ID NO: 43515 - DNA, 21 bp, Artificial Sequence
  Description of Artificial Sequence: Synthetic oligonucleotide
tctaattttcggtctcttggg

SEQ ID NO: 43516 - DNA, 21 bp, Artificial Sequence
  Description of Artificial Sequence: Synthetic oligonucleotide
cctctgagtcattcgaatatg

SEQ ID NO: 43517 - DNA, 21 bp, Artificial Sequence
  Description of Artificial Sequence: Synthetic oligonucleotide
aatggtaatatttctattggg

SEQ ID NO: 43518 - DNA, 21 bp, Artificial Sequence
  Description of Artificial Sequence: Synthetic oligonucleotide
tggagtggggtgagtattaat

SEQ ID NO: 43519 - DNA, 21 bp, Artificial Sequence
  Description of Artificial Sequence: Synthetic oligonucleotide
aatgcgcctaatagttcgggg

SEQ ID NO: 43520 - DNA, 21 bp, Artificial Sequence
  Description of Artificial Sequence: Synthetic oligonucleotide
actcttcctcgtactagtggt

SEQ ID NO: 43521 - DNA, 21 bp, Artificial Sequence
  Description of Artificial Sequence: Synthetic oligonucleotide
gacctcaccaaccacaccaaa

SEQ ID NO: 43522 - DNA, 21 bp, Artificial Sequence
  Description of Artificial Sequence: Synthetic oligonucleotide
accagcaacaccaaaagcgtc

SEQ ID NO: 43523 - DNA, 21 bp, Artificial Sequence
  Description of Artificial Sequence: Synthetic oligonucleotide
tctttgtatccttctaagggt

SEQ ID NO: 43524 - DNA, 21 bp, Artificial Sequence
  Description of Artificial Sequence: Synthetic oligonucleotide
acgtctcagactaagattgtg

SEQ ID NO: 43525 - DNA, 21 bp, Artificial Sequence
  Description of Artificial Sequence: Synthetic oligonucleotide
actactcataatattaagggg

SEQ ID NO: 43526 - DNA, 21 bp, Artificial Sequence
  Description of Artificial Sequence: Synthetic oligonucleotide
ccgttgcaggcgactggtaag

SEQ ID NO: 43527 - DNA, 21 bp, Artificial Sequence
  Description of Artificial Sequence: Synthetic oligonucleotide
ggtgcttctgagaatatgcgg

SEQ ID NO: 43528 - DNA, 21 bp, Artificial Sequence
  Description of Artificial Sequence: Synthetic oligonucleotide
aatagtacgagtacttctcag

SEQ ID NO: 43529 - DNA, 21 bp, Artificial Sequence
  Description of Artificial Sequence: Synthetic oligonucleotide
gtccaacccagaaccagcacc

SEQ ID NO: 43530 - DNA, 21 bp, Artificial Sequence
  Description of Artificial Sequence: Synthetic oligonucleotide
accacccaaaccccctacaaa

SEQ ID NO: 43531 - DNA, 21 bp, Artificial Sequence
  Description of Artificial Sequence: Synthetic oligonucleotide
ccgcagactaataatcctgat

SEQ ID NO: 43532 - DNA, 21 bp, Artificial Sequence
  Description of Artificial Sequence: Synthetic oligonucleotide
cacggcgaaagcagacaagcc

SEQ ID NO: 43533 - DNA, 21 bp, Artificial Sequence
  Description of Artificial Sequence: Synthetic oligonucleotide
aatgctatgaatactcggggt

SEQ ID NO: 43534 - DNA, 21 bp, Artificial Sequence
  Description of Artificial Sequence: Synthetic oligonucleotide
agtcagagtagtcctgttgcg

SEQ ID NO: 43535 - DNA, 21 bp, Artificial Sequence
  Description of Artificial Sequence: Synthetic oligonucleotide
aacggctacggccaaaaccaa

SEQ ID NO: 43536 - DNA, 21 bp, Artificial Sequence
  Description of Artificial Sequence: Synthetic oligonucleotide
ggtaataggtcttctgggctt

SEQ ID NO: 43537 - DNA, 21 bp, Artificial Sequence
  Description of Artificial Sequence: Synthetic oligonucleotide
gataagactaatttgagttct

SEQ ID NO: 43538 - DNA, 21 bp, Artificial Sequence
  Description of Artificial Sequence: Synthetic oligonucleotide
tcttcgcaggaggtttttcgg

SEQ ID NO: 43539 - DNA, 21 bp, Artificial Sequence
  Description of Artificial Sequence: Synthetic oligonucleotide
gacagagaagccaccagcaga

SEQ ID NO: 43540 - DNA, 21 bp, Artificial Sequence
  Description of Artificial Sequence: Synthetic oligonucleotide
ctgccgactgattctcttcgg

SEQ ID NO: 43541 - DNA, 21 bp, Artificial Sequence
  Description of Artificial Sequence: Synthetic oligonucleotide
accagagacagcagcctccac

SEQ ID NO: 43542 - DNA, 21 bp, Artificial Sequence
  Description of Artificial Sequence: Synthetic oligonucleotide
aaccaaagcagcagcgccaga

SEQ ID NO: 43543 - DNA, 21 bp, Artificial Sequence
  Description of Artificial Sequence: Synthetic oligonucleotide
tcgaatgataattcgttgagg

SEQ ID NO: 43544 - DNA, 21 bp, Artificial Sequence
  Description of Artificial Sequence: Synthetic oligonucleotide
gctcctagtgctggtaattct

SEQ ID NO: 43545 - DNA, 21 bp, Artificial Sequence
  Description of Artificial Sequence: Synthetic oligonucleotide
aacagccacctcgccctcaaa

SEQ ID NO: 43546 - DNA, 21 bp, Artificial Sequence
  Description of Artificial Sequence: Synthetic oligonucleotide
ctggtttcgtctaagagtagt

SEQ ID NO: 43547 - DNA, 21 bp, Artificial Sequence
  Description of Artificial Sequence: Synthetic oligonucleotide
gatcagaagactgttaatcgt

SEQ ID NO: 43548 - DNA, 21 bp, Artificial Sequence
  Description of Artificial Sequence: Synthetic oligonucleotide
caagccgtcgccagacaagcc

SEQ ID NO: 43549 - DNA, 21 bp, Artificial Sequence
  Description of Artificial Sequence: Synthetic oligonucleotide
cctagggagactcataagcag

SEQ ID NO: 43550 - DNA, 21 bp, Artificial Sequence
  Description of Artificial Sequence: Synthetic oligonucleotide
agtgatcaggttaggagtgct

SEQ ID NO: 43551 - DNA, 21 bp, Artificial Sequence
  Description of Artificial Sequence: Synthetic oligonucleotide
tcgaataataaggctaatgtt

SEQ ID NO: 43552 - DNA, 21 bp, Artificial Sequence
  Description of Artificial Sequence: Synthetic oligonucleotide
agtagtacgaagtctagtctg

SEQ ID NO: 43553 - DNA, 21 bp, Artificial Sequence
  Description of Artificial Sequence: Synthetic oligonucleotide
gtgaatacgtctcatacgaat

SEQ ID NO: 43554 - DNA, 21 bp, Artificial Sequence
  Description of Artificial Sequence: Synthetic oligonucleotide
accaccatccccaaaagacaa

SEQ ID NO: 43555 - DNA, 21 bp, Artificial Sequence
  Description of Artificial Sequence: Synthetic oligonucleotide
catgtgcaggatgggaggact

SEQ ID NO: 43556 - DNA, 21 bp, Artificial Sequence
  Description of Artificial Sequence: Synthetic oligonucleotide
ctggattttaagactctgccg

SEQ ID NO: 43557 - DNA, 21 bp, Artificial Sequence
  Description of Artificial Sequence: Synthetic oligonucleotide
agttctttggggcataatgat

SEQ ID NO: 43558 - DNA, 21 bp, Artificial Sequence
  Description of Artificial Sequence: Synthetic oligonucleotide
tttaatacttctaagcttagt

SEQ ID NO: 43559 - DNA, 21 bp, Artificial Sequence
  Description of Artificial Sequence: Synthetic oligonucleotide
ggcagcgcccaaagccccaga

SEQ ID NO: 43560 - DNA, 21 bp, Artificial Sequence
  Description of Artificial Sequence: Synthetic oligonucleotide
gtgcagccgtctggtcgtcct

SEQ ID NO: 43561 - DNA, 21 bp, Artificial Sequence
  Description of Artificial Sequence: Synthetic oligonucleotide
aacggcagcggccaataccaa

SEQ ID NO: 43562 - DNA, 21 bp, Artificial Sequence
  Description of Artificial Sequence: Synthetic oligonucleotide
ggttattcgaatcagatgact

SEQ ID NO: 43563 - DNA, 21 bp, Artificial Sequence
  Description of Artificial Sequence: Synthetic oligonucleotide
aagacttctgagactcgttcg

SEQ ID NO: 43564 - DNA, 21 bp, Artificial Sequence
  Description of Artificial Sequence: Synthetic oligonucleotide
ccgactactaggatggtgaat

SEQ ID NO: 43565 - DNA, 21 bp, Artificial Sequence
  Description of Artificial Sequence: Synthetic oligonucleotide
tcgccggcgagggcttctctt

SEQ ID NO: 43566 - DNA, 21 bp, Artificial Sequence
  Description of Artificial Sequence: Synthetic oligonucleotide
acgtctcgtacttcttatgag

SEQ ID NO: 43567 - DNA, 21 bp, Artificial Sequence
  Description of Artificial Sequence: Synthetic oligonucleotide
agttcgccgtcgaggtctagt

SEQ ID NO: 43568 - DNA, 21 bp, Artificial Sequence
  Description of Artificial Sequence: Synthetic oligonucleotide
agcgtcaacagccaccacggc

SEQ ID NO: 43569 - DNA, 21 bp, Artificial Sequence
  Description of Artificial Sequence: Synthetic oligonucleotide
cttgataagcgttcggttgag

SEQ ID NO: 43570 - DNA, 21 bp, Artificial Sequence
  Description of Artificial Sequence: Synthetic oligonucleotide
cacatcaccagcaaccacgcc

SEQ ID NO: 43571 - DNA, 21 bp, Artificial Sequence
  Description of Artificial Sequence: Synthetic oligonucleotide
agcatcaccgacagacacagc

SEQ ID NO: 43572 - DNA, 21 bp, Artificial Sequence
  Description of Artificial Sequence: Synthetic oligonucleotide
tctggggttactactaggggt

SEQ ID NO: 43573 - DNA, 21 bp, Artificial Sequence
  Description of Artificial Sequence: Synthetic oligonucleotide
cacgccagagccagcaccgcc

SEQ ID NO: 43574 - DNA, 21 bp, Artificial Sequence
  Description of Artificial Sequence: Synthetic oligonucleotide
cttaatggtactcctcagtct

SEQ ID NO: 43575 - DNA, 21 bp, Artificial Sequence
  Description of Artificial Sequence: Synthetic oligonucleotide
ggcatgagcagcccccacatc

SEQ ID NO: 43576 - DNA, 21 bp, Artificial Sequence
  Description of Artificial Sequence: Synthetic oligonucleotide
acttctatgaatggtaataag

SEQ ID NO: 43577 - DNA, 21 bp, Artificial Sequence
  Description of Artificial Sequence: Synthetic oligonucleotide
tctagggtggagattaatcgt

SEQ ID NO: 43578 - DNA, 21 bp, Artificial Sequence
  Description of Artificial Sequence: Synthetic oligonucleotide
ttgcagaagccgagtctggtt

SEQ ID NO: 43579 - DNA, 21 bp, Artificial Sequence
  Description of Artificial Sequence: Synthetic oligonucleotide
ggcggccacaaaagcctcaac

SEQ ID NO: 43580 - DNA, 21 bp, Artificial Sequence
  Description of Artificial Sequence: Synthetic oligonucleotide
gccgaaagcggcggcagcaga

SEQ ID NO: 43581 - DNA, 21 bp, Artificial Sequence
  Description of Artificial Sequence: Synthetic oligonucleotide
gatgggggtaatcagaggagt

SEQ ID NO: 43582 - DNA, 21 bp, Artificial Sequence
  Description of Artificial Sequence: Synthetic oligonucleotide
tacggttctggacagaatcaa

SEQ ID NO: 43583 - DNA, 21 bp, Artificial Sequence
  Description of Artificial Sequence: Synthetic oligonucleotide
gttggttcggatagttctacg

SEQ ID NO: 43584 - DNA, 21 bp, Artificial Sequence
  Description of Artificial Sequence: Synthetic oligonucleotide
cacatgacccacaccaccgcc

SEQ ID NO: 43585 - DNA, 21 bp, Artificial Sequence
  Description of Artificial Sequence: Synthetic oligonucleotide
gataatatttctcggagtagg

SEQ ID NO: 43586 - DNA, 21 bp, Artificial Sequence
  Description of Artificial Sequence: Synthetic oligonucleotide
atggggactcattctattggt

SEQ ID NO: 43587 - DNA, 21 bp, Artificial Sequence
  Description of Artificial Sequence: Synthetic oligonucleotide
ggccaaatcaaaaacctcggc

SEQ ID NO: 43588 - DNA, 21 bp, Artificial Sequence
  Description of Artificial Sequence: Synthetic oligonucleotide
aatcttgcttctagttcttat

SEQ ID NO: 43589 - DNA, 21 bp, Artificial Sequence
  Description of Artificial Sequence: Synthetic oligonucleotide
ggcagcgccggcaacatgctc

SEQ ID NO: 43590 - DNA, 21 bp, Artificial Sequence
  Description of Artificial Sequence: Synthetic oligonucleotide
cttcttacgtcgcctaattcg

SEQ ID NO: 43591 - DNA, 21 bp, Artificial Sequence
  Description of Artificial Sequence: Synthetic oligonucleotide
agacccgccagcacccacacc

SEQ ID NO: 43592 - DNA, 21 bp, Artificial Sequence
  Description of Artificial Sequence: Synthetic oligonucleotide
agttcgtctgataagcttcgt

SEQ ID NO: 43593 - DNA, 21 bp, Artificial Sequence
  Description of Artificial Sequence: Synthetic oligonucleotide
gacggcctcagaaacagcctc

SEQ ID NO: 43594 - DNA, 21 bp, Artificial Sequence
  Description of Artificial Sequence: Synthetic oligonucleotide
gacgtcctcagcaaaagccaa

SEQ ID NO: 43595 - DNA, 21 bp, Artificial Sequence
  Description of Artificial Sequence: Synthetic oligonucleotide
gtccccagccaaaacagagcc

SEQ ID NO: 43596 - DNA, 21 bp, Artificial Sequence
  Description of Artificial Sequence: Synthetic oligonucleotide
gtgggtagtcagactaatagt

SEQ ID NO: 43597 - DNA, 21 bp, Artificial Sequence
  Description of Artificial Sequence: Synthetic oligonucleotide
agcccccacaaacaagccaac

SEQ ID NO: 43598 - DNA, 21 bp, Artificial Sequence
  Description of Artificial Sequence: Synthetic oligonucleotide
gtcagcgtcgacaaaagaccc

SEQ ID NO: 43599 - DNA, 21 bp, Artificial Sequence
  Description of Artificial Sequence: Synthetic oligonucleotide
agcagagtcaccgtcagccaa

SEQ ID NO: 43600 - DNA, 21 bp, Artificial Sequence
  Description of Artificial Sequence: Synthetic oligonucleotide
gctaggggtgcttctactaat

SEQ ID NO: 43601 - DNA, 21 bp, Artificial Sequence
  Description of Artificial Sequence: Synthetic oligonucleotide
catgtgactaagtctacggct

SEQ ID NO: 43602 - DNA, 21 bp, Artificial Sequence
  Description of Artificial Sequence: Synthetic oligonucleotide
gtccaacaaagcaaagcctac

SEQ ID NO: 43603 - DNA, 21 bp, Artificial Sequence
  Description of Artificial Sequence: Synthetic oligonucleotide
gctaatgctacgccgcatcat

SEQ ID NO: 43604 - DNA, 21 bp, Artificial Sequence
  Description of Artificial Sequence: Synthetic oligonucleotide
aacggcagcggccaaaaacaa

SEQ ID NO: 43605 - DNA, 21 bp, Artificial Sequence
  Description of Artificial Sequence: Synthetic oligonucleotide
tataatagtactactgcgact

SEQ ID NO: 43606 - DNA, 21 bp, Artificial Sequence
  Description of Artificial Sequence: Synthetic oligonucleotide
aatcggcatgagcgggtgatt

SEQ ID NO: 43607 - DNA, 21 bp, Artificial Sequence
  Description of Artificial Sequence: Synthetic oligonucleotide
agacccgccggccaacacagc

SEQ ID NO: 43608 - DNA, 21 bp, Artificial Sequence
  Description of Artificial Sequence: Synthetic oligonucleotide
tctgctcagaagaatcttatt

SEQ ID NO: 43609 - DNA, 21 bp, Artificial Sequence
  Description of Artificial Sequence: Synthetic oligonucleotide
gttatggatgtgcagcatagg

SEQ ID NO: 43610 - DNA, 21 bp, Artificial Sequence
  Description of Artificial Sequence: Synthetic oligonucleotide
aatcgttctaataattctgtg

SEQ ID NO: 43611 - DNA, 21 bp, Artificial Sequence
  Description of Artificial Sequence: Synthetic oligonucleotide
agagaagtcgacggcatcaga

SEQ ID NO: 43612 - DNA, 21 bp, Artificial Sequence
  Description of Artificial Sequence: Synthetic oligonucleotide
ggtactacttctagtcgggat

SEQ ID NO: 43613 - DNA, 21 bp, Artificial Sequence
  Description of Artificial Sequence: Synthetic oligonucleotide
cgttattcgagggataatgtt

SEQ ID NO: 43614 - DNA, 21 bp, Artificial Sequence
  Description of Artificial Sequence: Synthetic oligonucleotide
ccgaagttggcggcggatctt

SEQ ID NO: 43615 - DNA, 21 bp, Artificial Sequence
  Description of Artificial Sequence: Synthetic oligonucleotide
accaccgccagcagccccacc

SEQ ID NO: 43616 - DNA, 21 bp, Artificial Sequence
  Description of Artificial Sequence: Synthetic oligonucleotide
ggtgggactaataatcttaat

SEQ ID NO: 43617 - DNA, 21 bp, Artificial Sequence
  Description of Artificial Sequence: Synthetic oligonucleotide
actaatgttgataagccgttt

SEQ ID NO: 43618 - DNA, 21 bp, Artificial Sequence
  Description of Artificial Sequence: Synthetic oligonucleotide
ccccccctcgaccaagtctac

SEQ ID NO: 43619 - DNA, 21 bp, Artificial Sequence
  Description of Artificial Sequence: Synthetic oligonucleotide
gttgttaatgctctgaggggg

SEQ ID NO: 43620 - DNA, 21 bp, Artificial Sequence
  Description of Artificial Sequence: Synthetic oligonucleotide
tattttactgatgatacgagg

SEQ ID NO: 43621 - DNA, 21 bp, Artificial Sequence
  Description of Artificial Sequence: Synthetic oligonucleotide
agacaaaccgacaaactcagc

SEQ ID NO: 43622 - DNA, 21 bp, Artificial Sequence
  Description of Artificial Sequence: Synthetic oligonucleotide
tggaacaaaaccagcccccaa

SEQ ID NO: 43623 - DNA, 21 bp, Artificial Sequence
  Description of Artificial Sequence: Synthetic oligonucleotide
agcgccgacaccagacccgtc

SEQ ID NO: 43624 - DNA, 21 bp, Artificial Sequence
  Description of Artificial Sequence: Synthetic oligonucleotide
ccgagttctggtcatagtcgt

SEQ ID NO: 43625 - DNA, 21 bp, Artificial Sequence
  Description of Artificial Sequence: Synthetic oligonucleotide
aatcgggagtcgccgcagagg

SEQ ID NO: 43626 - DNA, 21 bp, Artificial Sequence
  Description of Artificial Sequence: Synthetic oligonucleotide
tctactgggtcggtgagtaag

SEQ ID NO: 43627 - DNA, 21 bp, Artificial Sequence
  Description of Artificial Sequence: Synthetic oligonucleotide
agccccgccagcctccccaaa

SEQ ID NO: 43628 - DNA, 21 bp, Artificial Sequence
  Description of Artificial Sequence: Synthetic oligonucleotide
aaactcggccaagacgtcaga

SEQ ID NO: 43629 - DNA, 21 bp, Artificial Sequence
  Description of Artificial Sequence: Synthetic oligonucleotide
tttggtgagtcgactatgagg

SEQ ID NO: 43630 - DNA, 21 bp, Artificial Sequence
  Description of Artificial Sequence: Synthetic oligonucleotide
agagacaccagagaaagccaa

SEQ ID NO: 43631 - DNA, 21 bp, Artificial Sequence
  Description of Artificial Sequence: Synthetic oligonucleotide
aataatcctaatcgtgatcag

SEQ ID NO: 43632 - DNA, 21 bp, Artificial Sequence
  Description of Artificial Sequence: Synthetic oligonucleotide
caaagcagcagccaacaaaga

SEQ ID NO: 43633 - DNA, 21 bp, Artificial Sequence
  Description of Artificial Sequence: Synthetic oligonucleotide
ggtagtcttgataataggaag

SEQ ID NO: 43634 - DNA, 21 bp, Artificial Sequence
  Description of Artificial Sequence: Synthetic oligonucleotide
cccggcagcggcagcaaccac

SEQ ID NO: 43635 - DNA, 21 bp, Artificial Sequence
  Description of Artificial Sequence: Synthetic oligonucleotide
gacctcgacaccaaagccctc

SEQ ID NO: 43636 - DNA, 21 bp, Artificial Sequence
  Description of Artificial Sequence: Synthetic oligonucleotide
caacccaccagaagcaccgcc

SEQ ID NO: 43637 - DNA, 21 bp, Artificial Sequence
  Description of Artificial Sequence: Synthetic oligonucleotide
cccagcaacaccggcaccatc

SEQ ID NO: 43638 - DNA, 21 bp, Artificial Sequence
  Description of Artificial Sequence: Synthetic oligonucleotide
gctacttctacgaatggtatt

SEQ ID NO: 43639 - DNA, 21 bp, Artificial Sequence
  Description of Artificial Sequence: Synthetic oligonucleotide
gagggttctgggaggcttact

SEQ ID NO: 43640 - DNA, 21 bp, Artificial Sequence
  Description of Artificial Sequence: Synthetic oligonucleotide
acgcagatgggtaagtcgaat

SEQ ID NO: 43641 - DNA, 21 bp, Artificial Sequence
  Description of Artificial Sequence: Synthetic oligonucleotide
tataataagaatgctcagttg

SEQ ID NO: 43642 - DNA, 21 bp, Artificial Sequence
  Description of Artificial Sequence: Synthetic oligonucleotide
actggtaataaggggggggtg

SEQ ID NO: 43643 - DNA, 21 bp, Artificial Sequence
  Description of Artificial Sequence: Synthetic oligonucleotide
ccgcctcatgatgggcagcgt

SEQ ID NO: 43644 - DNA, 21 bp, Artificial Sequence
  Description of Artificial Sequence: Synthetic oligonucleotide
aacaacgtcggcgtcagaggc

SEQ ID NO: 43645 - DNA, 21 bp, Artificial Sequence
  Description of Artificial Sequence: Synthetic oligonucleotide
agggagaagcagcataatggg

SEQ ID NO: 43646 - DNA, 21 bp, Artificial Sequence
  Description of Artificial Sequence: Synthetic oligonucleotide
caagtccccgccagccacggc

SEQ ID NO: 43647 - DNA, 21 bp, Artificial Sequence
  Description of Artificial Sequence: Synthetic oligonucleotide
catccggagactgcttttaag

SEQ ID NO: 43648 - DNA, 21 bp, Artificial Sequence
  Description of Artificial Sequence: Synthetic oligonucleotide
ttgaatcagcattcgagtatt

SEQ ID NO: 43649 - DNA, 21 bp, Artificial Sequence
  Description of Artificial Sequence: Synthetic oligonucleotide
agaaccgtcgacagcagcgac

SEQ ID NO: 43650 - DNA, 21 bp, Artificial Sequence
  Description of Artificial Sequence: Synthetic oligonucleotide
agaaccagaaacacccccacc

SEQ ID NO: 43651 - DNA, 21 bp, Artificial Sequence
  Description of Artificial Sequence: Synthetic oligonucleotide
ttcagaacccaaagcgtcggc

SEQ ID NO: 43652 - DNA, 21 bp, Artificial Sequence
  Description of Artificial Sequence: Synthetic oligonucleotide
ccgactggggcgcatgttacg

SEQ ID NO: 43653 - DNA, 21 bp, Artificial Sequence
  Description of Artificial Sequence: Synthetic oligonucleotide
ccccacagcaccggcagcatc

SEQ ID NO: 43654 - DNA, 21 bp, Artificial Sequence
  Description of Artificial Sequence: Synthetic oligonucleotide
gcgcaggcgaggctgatgaat

SEQ ID NO: 43655 - DNA, 21 bp, Artificial Sequence
  Description of Artificial Sequence: Synthetic oligonucleotide
catagttctaagtcgcatgat

SEQ ID NO: 43656 - DNA, 21 bp, Artificial Sequence
  Description of Artificial Sequence: Synthetic oligonucleotide
ggctgcatcaccaactgcagc

SEQ ID NO: 43657 - DNA, 21 bp, Artificial Sequence
  Description of Artificial Sequence: Synthetic oligonucleotide
gaaagaatgggcaaaaaccaa

SEQ ID NO: 43658 - DNA, 21 bp, Artificial Sequence
  Description of Artificial Sequence: Synthetic oligonucleotide
atgacccaacacaaacaagcc

SEQ ID NO: 43659 - DNA, 21 bp, Artificial Sequence
  Description of Artificial Sequence: Synthetic oligonucleotide
aagagtgatgctcatacggct

SEQ ID NO: 43660 - DNA, 21 bp, Artificial Sequence
  Description of Artificial Sequence: Synthetic oligonucleotide
actgttactaatgcggctcgt

SEQ ID NO: 43661 - DNA, 21 bp, Artificial Sequence
  Description of Artificial Sequence: Synthetic oligonucleotide
gtttctggtacgcctcgggtt

SEQ ID NO: 43662 - DNA, 21 bp, Artificial Sequence
  Description of Artificial Sequence: Synthetic oligonucleotide
taccccaacggcaaaagcagc

SEQ ID NO: 43663 - DNA, 21 bp, Artificial Sequence
  Description of Artificial Sequence: Synthetic oligonucleotide
gccgtcagcaaaggcggcccc

SEQ ID NO: 43664 - DNA, 21 bp, Artificial Sequence
  Description of Artificial Sequence: Synthetic oligonucleotide
cccgaaatcagcgccagcaga

SEQ ID NO: 43665 - DNA, 21 bp, Artificial Sequence
  Description of Artificial Sequence: Synthetic oligonucleotide
cagaatcgtaatactgttggt

SEQ ID NO: 43666 - DNA, 21 bp, Artificial Sequence
  Description of Artificial Sequence: Synthetic oligonucleotide
tctgtttctgggaggcatatt

SEQ ID NO: 43667 - DNA, 21 bp, Artificial Sequence
  Description of Artificial Sequence: Synthetic oligonucleotide
atgcctgcgaggaatgtttct

SEQ ID NO: 43668 - DNA, 21 bp, Artificial Sequence
  Description of Artificial Sequence: Synthetic oligonucleotide
aaccccagaatgagcatgagc

SEQ ID NO: 43669 - DNA, 21 bp, Artificial Sequence
  Description of Artificial Sequence: Synthetic oligonucleotide
agcagagcccaaagcatcccc

SEQ ID NO: 43670 - DNA, 21 bp, Artificial Sequence
  Description of Artificial Sequence: Synthetic oligonucleotide
ccgttgattaatcgtactatg

SEQ ID NO: 43671 - DNA, 21 bp, Artificial Sequence
  Description of Artificial Sequence: Synthetic oligonucleotide
tctgctgagttgagggttgcg

SEQ ID NO: 43672 - DNA, 21 bp, Artificial Sequence
  Description of Artificial Sequence: Synthetic oligonucleotide
gccatcagccccacctacatg

SEQ ID NO: 43673 - DNA, 21 bp, Artificial Sequence
  Description of Artificial Sequence: Synthetic oligonucleotide
agggatgataagcagaattcg

SEQ ID NO: 43674 - DNA, 21 bp, Artificial Sequence
  Description of Artificial Sequence: Synthetic oligonucleotide
ccttctcaggaggggcagcag

SEQ ID NO: 43675 - DNA, 21 bp, Artificial Sequence
  Description of Artificial Sequence: Synthetic oligonucleotide
ccgacgcggacggcgagtaat

SEQ ID NO: 43676 - DNA, 21 bp, Artificial Sequence
  Description of Artificial Sequence: Synthetic oligonucleotide
ggcagactcaccagcagcatc

SEQ ID NO: 43677 - DNA, 21 bp, Artificial Sequence
  Description of Artificial Sequence: Synthetic oligonucleotide
atgcttgggtctagtaataag

SEQ ID NO: 43678 - DNA, 21 bp, Artificial Sequence
  Description of Artificial Sequence: Synthetic oligonucleotide
gaggttactaattcgcctagg

SEQ ID NO: 43679 - DNA, 21 bp, Artificial Sequence
  Description of Artificial Sequence: Synthetic oligonucleotide
ggtggggttggtgggaagtct

SEQ ID NO: 43680 - DNA, 21 bp, Artificial Sequence
  Description of Artificial Sequence: Synthetic oligonucleotide
aacgccaccagccccagaaaa

SEQ ID NO: 43681 - DNA, 21 bp, Artificial Sequence
  Description of Artificial Sequence: Synthetic oligonucleotide
tctcttagtaagcaggcggcg

SEQ ID NO: 43682 - DNA, 21 bp, Artificial Sequence
  Description of Artificial Sequence: Synthetic oligonucleotide
ggccaagccatgcccttcaaa

SEQ ID NO: 43683 - DNA, 21 bp, Artificial Sequence
  Description of Artificial Sequence: Synthetic oligonucleotide
tacagaagcaaagaaatcggc

SEQ ID NO: 43684 - DNA, 21 bp, Artificial Sequence
  Description of Artificial Sequence: Synthetic oligonucleotide
aacagccaccaaaaacccagc

SEQ ID NO: 43685 - DNA, 21 bp, Artificial Sequence
  Description of Artificial Sequence: Synthetic oligonucleotide
gcgacggcgaatactcatatg

SEQ ID NO: 43686 - DNA, 21 bp, Artificial Sequence
  Description of Artificial Sequence: Synthetic oligonucleotide
cccagacacgcccccctcctc

SEQ ID NO: 43687 - DNA, 21 bp, Artificial Sequence
  Description of Artificial Sequence: Synthetic oligonucleotide
ggtagggatactcggagtagt

SEQ ID NO: 43688 - DNA, 21 bp, Artificial Sequence
  Description of Artificial Sequence: Synthetic oligonucleotide
gacagcgtcgccggcttcacc

SEQ ID NO: 43689 - DNA, 21 bp, Artificial Sequence
  Description of Artificial Sequence: Synthetic oligonucleotide
cagagggttcatccgagtggg

SEQ ID NO: 43690 - DNA, 21 bp, Artificial Sequence
  Description of Artificial Sequence: Synthetic oligonucleotide
taccaacacagagcccccagc

SEQ ID NO: 43691 - DNA, 21 bp, Artificial Sequence
  Description of Artificial Sequence: Synthetic oligonucleotide
aacggccaagccggcaacaga

SEQ ID NO: 43692 - DNA, 21 bp, Artificial Sequence
  Description of Artificial Sequence: Synthetic oligonucleotide
gggcgtgagactgtttctcgg

SEQ ID NO: 43693 - DNA, 21 bp, Artificial Sequence
  Description of Artificial Sequence: Synthetic oligonucleotide
cctcaggattctagggggatg

SEQ ID NO: 43694 - DNA, 21 bp, Artificial Sequence
  Description of Artificial Sequence: Synthetic oligonucleotide
tttcctctgactaagcctgct

SEQ ID NO: 43695 - DNA, 21 bp, Artificial Sequence
  Description of Artificial Sequence: Synthetic oligonucleotide
ggtattgcgggggtgactcgt

SEQ ID NO: 43696 - DNA, 21 bp, Artificial Sequence
  Description of Artificial Sequence: Synthetic oligonucleotide
tataataggagtgagcgtcct

SEQ ID NO: 43697 - DNA, 21 bp, Artificial Sequence
  Description of Artificial Sequence: Synthetic oligonucleotide
gtcaccggcagagcctacctc

SEQ ID NO: 43698 - DNA, 21 bp, Artificial Sequence
  Description of Artificial Sequence: Synthetic oligonucleotide
cagaatcgtgtttctaatggg

SEQ ID NO: 43699 - DNA, 21 bp, Artificial Sequence
  Description of Artificial Sequence: Synthetic oligonucleotide
accagaagccaaggcatcctc

SEQ ID NO: 43700 - DNA, 21 bp, Artificial Sequence
  Description of Artificial Sequence: Synthetic oligonucleotide
tatggtcgtgggcgtgatctt

SEQ ID NO: 43701 - DNA, 21 bp, Artificial Sequence
  Description of Artificial Sequence: Synthetic oligonucleotide
gggagttctccttctttaagg

SEQ ID NO: 43702 - DNA, 21 bp, Artificial Sequence
  Description of Artificial Sequence: Synthetic oligonucleotide
gttaatacgaatcgggctgct

SEQ ID NO: 43703 - DNA, 21 bp, Artificial Sequence
  Description of Artificial Sequence: Synthetic oligonucleotide
cggcctattgctagttcgggt

SEQ ID NO: 43704 - DNA, 21 bp, Artificial Sequence
  Description of Artificial Sequence: Synthetic oligonucleotide
gctgggtcgtcttcgcctgct

SEQ ID NO: 43705 - DNA, 21 bp, Artificial Sequence
  Description of Artificial Sequence: Synthetic oligonucleotide
cccaccaccggcccccaaaga

SEQ ID NO: 43706 - DNA, 21 bp, Artificial Sequence
  Description of Artificial Sequence: Synthetic oligonucleotide
atttcgcagtctactactagg

SEQ ID NO: 43707 - DNA, 21 bp, Artificial Sequence
  Description of Artificial Sequence: Synthetic oligonucleotide
accaacctccccagaagccac

SEQ ID NO: 43708 - DNA, 21 bp, Artificial Sequence
  Description of Artificial Sequence: Synthetic oligonucleotide
gggaatactaattcgtttctt

SEQ ID NO: 43709 - DNA, 21 bp, Artificial Sequence
  Description of Artificial Sequence: Synthetic oligonucleotide
accctcagccaaaccgtcaga

SEQ ID NO: 43710 - DNA, 21 bp, Artificial Sequence
  Description of Artificial Sequence: Synthetic oligonucleotide
agcagcaaagccgccatcacc

SEQ ID NO: 43711 - DNA, 21 bp, Artificial Sequence
  Description of Artificial Sequence: Synthetic oligonucleotide
tctagtgggccgtcttctggg

SEQ ID NO: 43712 - DNA, 21 bp, Artificial Sequence
  Description of Artificial Sequence: Synthetic oligonucleotide
gcggagaagacgaggtctttg

SEQ ID NO: 43713 - DNA, 21 bp, Artificial Sequence
  Description of Artificial Sequence: Synthetic oligonucleotide
tctactcctattcgttcggtt

SEQ ID NO: 43714 - DNA, 21 bp, Artificial Sequence
  Description of Artificial Sequence: Synthetic oligonucleotide
agcttcagcggcgccaacaaa

SEQ ID NO: 43715 - DNA, 21 bp, Artificial Sequence
  Description of Artificial Sequence: Synthetic oligonucleotide
gttaatacgactcgtgctgag

SEQ ID NO: 43716 - DNA, 21 bp, Artificial Sequence
  Description of Artificial Sequence: Synthetic oligonucleotide
ttgattaatcctgctggttct

SEQ ID NO: 43717 - DNA, 21 bp, Artificial Sequence
  Description of Artificial Sequence: Synthetic oligonucleotide
atgtcgtctactcgtagtatt

SEQ ID NO: 43718 - DNA, 21 bp, Artificial Sequence
  Description of Artificial Sequence: Synthetic oligonucleotide
agcccccacggcgccggctac

SEQ ID NO: 43719 - DNA, 21 bp, Artificial Sequence
  Description of Artificial Sequence: Synthetic oligonucleotide
catggtactagtcctcttcgt

SEQ ID NO: 43720 - DNA, 21 bp, Artificial Sequence
  Description of Artificial Sequence: Synthetic oligonucleotide
tcgaattataagtcttcgaat

SEQ ID NO: 43721 - DNA, 21 bp, Artificial Sequence
  Description of Artificial Sequence: Synthetic oligonucleotide
ggcaacggcaccagacaaaac

SEQ ID NO: 43722 - DNA, 21 bp, Artificial Sequence
  Description of Artificial Sequence: Synthetic oligonucleotide
ggcaccgacaacaacaccaga

SEQ ID NO: 43723 - DNA, 21 bp, Artificial Sequence
  Description of Artificial Sequence: Synthetic oligonucleotide
actaggacggcgggggttgat

SEQ ID NO: 43724 - DNA, 21 bp, Artificial Sequence
  Description of Artificial Sequence: Synthetic oligonucleotide
accggcgcccaaagcaccatg

SEQ ID NO: 43725 - DNA, 21 bp, Artificial Sequence
  Description of Artificial Sequence: Synthetic oligonucleotide
cgtagtgcgagtgggcagttg

SEQ ID NO: 43726 - DNA, 21 bp, Artificial Sequence
  Description of Artificial Sequence: Synthetic oligonucleotide
cccagaaaaatcagcaacgcc

SEQ ID NO: 43727 - DNA, 21 bp, Artificial Sequence
  Description of Artificial Sequence: Synthetic oligonucleotide
gccaccaccagcagaatcagc

SEQ ID NO: 43728 - DNA, 21 bp, Artificial Sequence
  Description of Artificial Sequence: Synthetic oligonucleotide
actactcctacttatactggg

SEQ ID NO: 43729 - DNA, 21 bp, Artificial Sequence
  Description of Artificial Sequence: Synthetic oligonucleotide
ggggggcagaattctagtaag

SEQ ID NO: 43730 - DNA, 21 bp, Artificial Sequence
  Description of Artificial Sequence: Synthetic oligonucleotide
tcgaatactaatagtgcgaat

SEQ ID NO: 43731 - DNA, 21 bp, Artificial Sequence
  Description of Artificial Sequence: Synthetic oligonucleotide
cccacccaaaacggcagaagc

SEQ ID NO: 43732 - DNA, 21 bp, Artificial Sequence
  Description of Artificial Sequence: Synthetic oligonucleotide
tctcagcatcgtccttcttcg

SEQ ID NO: 43733 - DNA, 21 bp, Artificial Sequence
  Description of Artificial Sequence: Synthetic oligonucleotide
agcgaaagcggccaacaaaga

SEQ ID NO: 43734 - DNA, 21 bp, Artificial Sequence
  Description of Artificial Sequence: Synthetic oligonucleotide
ggtactggtcatcagaggtct

SEQ ID NO: 43735 - DNA, 21 bp, Artificial Sequence
  Description of Artificial Sequence: Synthetic oligonucleotide
ccttctacgtcttctgcgggg

SEQ ID NO: 43736 - DNA, 21 bp, Artificial Sequence
  Description of Artificial Sequence: Synthetic oligonucleotide
tatacggcttcagctcttcgg

SEQ ID NO: 43737 - DNA, 21 bp, Artificial Sequence
  Description of Artificial Sequence: Synthetic oligonucleotide
accggcgacagcggcaaagtc

SEQ ID NO: 43738 - DNA, 21 bp, Artificial Sequence
  Description of Artificial Sequence: Synthetic oligonucleotide
tcgaaggttactgcgcagtct

SEQ ID NO: 43739 - DNA, 21 bp, Artificial Sequence
  Description of Artificial Sequence: Synthetic oligonucleotide
atgagcctcagcaaaaaccac

SEQ ID NO: 43740 - DNA, 21 bp, Artificial Sequence
  Description of Artificial Sequence: Synthetic oligonucleotide
aatcggtcgacggattttaag

SEQ ID NO: 43741 - DNA, 21 bp, Artificial Sequence
  Description of Artificial Sequence: Synthetic oligonucleotide
ttggggcttcgtgataatact

SEQ ID NO: 43742 - DNA, 21 bp, Artificial Sequence
  Description of Artificial Sequence: Synthetic oligonucleotide
agcagaaacgccgccaacgcc

SEQ ID NO: 43743 - DNA, 21 bp, Artificial Sequence
  Description of Artificial Sequence: Synthetic oligonucleotide
caaaaccaaaacagcggcaga

SEQ ID NO: 43744 - DNA, 21 bp, Artificial Sequence
  Description of Artificial Sequence: Synthetic oligonucleotide
tcggtttcgaatactaatact

SEQ ID NO: 43745 - DNA, 21 bp, Artificial Sequence
  Description of Artificial Sequence: Synthetic oligonucleotide
gccagcagcagagaaagcctc

SEQ ID NO: 43746 - DNA, 21 bp, Artificial Sequence
  Description of Artificial Sequence: Synthetic oligonucleotide
aaactcagccaaaccagccaa

SEQ ID NO: 43747 - DNA, 21 bp, Artificial Sequence
  Description of Artificial Sequence: Synthetic oligonucleotide
agagacgtcggcagcgccgcc

SEQ ID NO: 43748 - DNA, 21 bp, Artificial Sequence
  Description of Artificial Sequence: Synthetic oligonucleotide
aacagcagaagccaccacgaa

SEQ ID NO: 43749 - DNA, 21 bp, Artificial Sequence
  Description of Artificial Sequence: Synthetic oligonucleotide
tctggtagtgataagtttagt

SEQ ID NO: 43750 - DNA, 21 bp, Artificial Sequence
  Description of Artificial Sequence: Synthetic oligonucleotide
tctcatcctagttcttttggg

SEQ ID NO: 43751 - DNA, 21 bp, Artificial Sequence
  Description of Artificial Sequence: Synthetic oligonucleotide
tctgggatgtctcgtcatgtt

SEQ ID NO: 43752 - DNA, 21 bp, Artificial Sequence
  Description of Artificial Sequence: Synthetic oligonucleotide
gggccgactgatcataagctt

SEQ ID NO: 43753 - DNA, 21 bp, Artificial Sequence
  Description of Artificial Sequence: Synthetic oligonucleotide
attaatgtgtcgaggagtacg

SEQ ID NO: 43754 - DNA, 21 bp, Artificial Sequence
  Description of Artificial Sequence: Synthetic oligonucleotide
cccaaactcagccacaccggc

SEQ ID NO: 43755 - DNA, 21 bp, Artificial Sequence
  Description of Artificial Sequence: Synthetic oligonucleotide
ttcaacatgcaaagaagccaa

SEQ ID NO: 43756 - DNA, 21 bp, Artificial Sequence
  Description of Artificial Sequence: Synthetic oligonucleotide
gtgcctgtgactaagtcgagt

SEQ ID NO: 43757 - DNA, 21 bp, Artificial Sequence
  Description of Artificial Sequence: Synthetic oligonucleotide
aacagcgccgccgccatgaaa

SEQ ID NO: 43758 - DNA, 21 bp, Artificial Sequence
  Description of Artificial Sequence: Synthetic oligonucleotide
ctggtttctccgggtcatgtg

SEQ ID NO: 43759 - DNA, 21 bp, Artificial Sequence
  Description of Artificial Sequence: Synthetic oligonucleotide
caagtcaccgtcagacccgtc

SEQ ID NO: 43760 - DNA, 21 bp, Artificial Sequence
  Description of Artificial Sequence: Synthetic oligonucleotide
tacggcagcagagaaaacagc

SEQ ID NO: 43761 - DNA, 21 bp, Artificial Sequence
  Description of Artificial Sequence: Synthetic oligonucleotide
caaagcagcaacgccagaaac

SEQ ID NO: 43762 - DNA, 21 bp, Artificial Sequence
  Description of Artificial Sequence: Synthetic oligonucleotide
cgggctcctggtagtaatact

SEQ ID NO: 43763 - DNA, 21 bp, Artificial Sequence
  Description of Artificial Sequence: Synthetic oligonucleotide
ttcaacagcggcagcggcaga

SEQ ID NO: 43764 - DNA, 21 bp, Artificial Sequence
  Description of Artificial Sequence: Synthetic oligonucleotide
atgaattcgaatcatcggaat

SEQ ID NO: 43765 - DNA, 21 bp, Artificial Sequence
  Description of Artificial Sequence: Synthetic oligonucleotide
atgggtcgtgagatgaagggt

SEQ ID NO: 43766 - DNA, 21 bp, Artificial Sequence
  Description of Artificial Sequence: Synthetic oligonucleotide
gctgggccgttgaattctctt

SEQ ID NO: 43767 - DNA, 21 bp, Artificial Sequence
  Description of Artificial Sequence: Synthetic oligonucleotide
aacaacgtccccctcatcaaa

SEQ ID NO: 43768 - DNA, 21 bp, Artificial Sequence
  Description of Artificial Sequence: Synthetic oligonucleotide
caggctcagcatactcgttct

SEQ ID NO: 43769 - DNA, 21 bp, Artificial Sequence
  Description of Artificial Sequence: Synthetic oligonucleotide
ggcaccgccagcggcgtcgcc

SEQ ID NO: 43770 - DNA, 21 bp, Artificial Sequence
  Description of Artificial Sequence: Synthetic oligonucleotide
acgtcgactcttgattatctt

SEQ ID NO: 43771 - DNA, 21 bp, Artificial Sequence
  Description of Artificial Sequence: Synthetic oligonucleotide
cctgggcctgaggttggtcgg

SEQ ID NO: 43772 - DNA, 21 bp, Artificial Sequence
  Description of Artificial Sequence: Synthetic oligonucleotide
gtcaacgtcagcaccttcacc

SEQ ID NO: 43773 - DNA, 21 bp, Artificial Sequence
  Description of Artificial Sequence: Synthetic oligonucleotide
accgccttccccggctacctc

SEQ ID NO: 43774 - DNA, 21 bp, Artificial Sequence
  Description of Artificial Sequence: Synthetic oligonucleotide
caagtcagcgccaaaagcgcc

SEQ ID NO: 43775 - DNA, 21 bp, Artificial Sequence
  Description of Artificial Sequence: Synthetic oligonucleotide
ctcgccatggaaagacaaaga

SEQ ID NO: 43776 - DNA, 21 bp, Artificial Sequence
  Description of Artificial Sequence: Synthetic oligonucleotide
cttcctcagaggggtgttagt

SEQ ID NO: 43777 - DNA, 21 bp, Artificial Sequence
  Description of Artificial Sequence: Synthetic oligonucleotide
cgttcgagtccggctagtttg

SEQ ID NO: 43778 - DNA, 21 bp, Artificial Sequence
  Description of Artificial Sequence: Synthetic oligonucleotide
tggagcaacggcagaaccagc

SEQ ID NO: 43779 - DNA, 21 bp, Artificial Sequence
  Description of Artificial Sequence: Synthetic oligonucleotide
tctaattcggcgtcgtatggt

SEQ ID NO: 43780 - DNA, 21 bp, Artificial Sequence
  Description of Artificial Sequence: Synthetic oligonucleotide
cccagccaaaccaaacccagc

SEQ ID NO: 43781 - DNA, 21 bp, Artificial Sequence
  Description of Artificial Sequence: Synthetic oligonucleotide
tacggcagcgaaagcaacaaa

SEQ ID NO: 43782 - DNA, 21 bp, Artificial Sequence
  Description of Artificial Sequence: Synthetic oligonucleotide
gggcttagtcctgttcttaag

SEQ ID NO: 43783 - DNA, 21 bp, Artificial Sequence
  Description of Artificial Sequence: Synthetic oligonucleotide
agggaggatactaagatgcat

SEQ ID NO: 43784 - DNA, 21 bp, Artificial Sequence
  Description of Artificial Sequence: Synthetic oligonucleotide
aatgttttgagtaataagcat

SEQ ID NO: 43785 - DNA, 21 bp, Artificial Sequence
  Description of Artificial Sequence: Synthetic oligonucleotide
agccaaagccaaacccccgaa

SEQ ID NO: 43786 - DNA, 21 bp, Artificial Sequence
  Description of Artificial Sequence: Synthetic oligonucleotide
tcgtctaatggtaatattgtt

SEQ ID NO: 43787 - DNA, 21 bp, Artificial Sequence
  Description of Artificial Sequence: Synthetic oligonucleotide
agtatttcgggtgagagggat

SEQ ID NO: 43788 - DNA, 21 bp, Artificial Sequence
  Description of Artificial Sequence: Synthetic oligonucleotide
aaggatgcgtcttcttggttg

SEQ ID NO: 43789 - DNA, 21 bp, Artificial Sequence
  Description of Artificial Sequence: Synthetic oligonucleotide
agtccgaattctcatccttct

SEQ ID NO: 43790 - DNA, 21 bp, Artificial Sequence
  Description of Artificial Sequence: Synthetic oligonucleotide
agttctggtagtaataggtct

SEQ ID NO: 43791 - DNA, 21 bp, Artificial Sequence
  Description of Artificial Sequence: Synthetic oligonucleotide
accacccaaagcagaagcctc

SEQ ID NO: 43792 - DNA, 21 bp, Artificial Sequence
  Description of Artificial Sequence: Synthetic oligonucleotide
cccggcagaccccaaaccgac

SEQ ID NO: 43793 - DNA, 21 bp, Artificial Sequence
  Description of Artificial Sequence: Synthetic oligonucleotide
tctgttcatcagaatcgggcg

SEQ ID NO: 43794 - DNA, 21 bp, Artificial Sequence
  Description of Artificial Sequence: Synthetic oligonucleotide
gtgggggctcgtactgggggg

SEQ ID NO: 43795 - DNA, 21 bp, Artificial Sequence
  Description of Artificial Sequence: Synthetic oligonucleotide
ggccccggcagaaacctcatc

SEQ ID NO: 43796 - DNA, 21 bp, Artificial Sequence
  Description of Artificial Sequence: Synthetic oligonucleotide
aacggttctgtacagaatcaa

SEQ ID NO: 43797 - DNA, 21 bp, Artificial Sequence
  Description of Artificial Sequence: Synthetic oligonucleotide
ggcttcgaaagaaacagagaa

SEQ ID NO: 43798 - DNA, 21 bp, Artificial Sequence
  Description of Artificial Sequence: Synthetic oligonucleotide
gccacccacaccagcgtcagc

SEQ ID NO: 43799 - DNA, 21 bp, Artificial Sequence
  Description of Artificial Sequence: Synthetic oligonucleotide
attggtaagaattctatggct

SEQ ID NO: 43800 - DNA, 21 bp, Artificial Sequence
  Description of Artificial Sequence: Synthetic oligonucleotide
aatcgggttactcagagtagt

SEQ ID NO: 43801 - DNA, 21 bp, Artificial Sequence
  Description of Artificial Sequence: Synthetic oligonucleotide
ggcgtcaacagaatccccgcc

SEQ ID NO: 43802 - DNA, 21 bp, Artificial Sequence
  Description of Artificial Sequence: Synthetic oligonucleotide
gttacggcgaatcgtagtact

SEQ ID NO: 43803 - DNA, 21 bp, Artificial Sequence
  Description of Artificial Sequence: Synthetic oligonucleotide
agctacgccgacaaacaaggc

SEQ ID NO: 43804 - DNA, 21 bp, Artificial Sequence
  Description of Artificial Sequence: Synthetic oligonucleotide
ccgttgggtgctacgtttgcg

SEQ ID NO: 43805 - DNA, 21 bp, Artificial Sequence
  Description of Artificial Sequence: Synthetic oligonucleotide
ctcaccgccaccaaccccaga

SEQ ID NO: 43806 - DNA, 21 bp, Artificial Sequence
  Description of Artificial Sequence: Synthetic oligonucleotide
tgggacagcaaaacccccaga

SEQ ID NO: 43807 - DNA, 21 bp, Artificial Sequence
  Description of Artificial Sequence: Synthetic oligonucleotide
cacaccagcaccaacaccatc

SEQ ID NO: 43808 - DNA, 21 bp, Artificial Sequence
  Description of Artificial Sequence: Synthetic oligonucleotide
tctggtcgtgataagattagt

SEQ ID NO: 43809 - DNA, 21 bp, Artificial Sequence
  Description of Artificial Sequence: Synthetic oligonucleotide
gtggatgttagggggatgtcg

SEQ ID NO: 43810 - DNA, 21 bp, Artificial Sequence
  Description of Artificial Sequence: Synthetic oligonucleotide
atggtcagcagcaaaagcagc

SEQ ID NO: 43811 - DNA, 21 bp, Artificial Sequence
  Description of Artificial Sequence: Synthetic oligonucleotide
aacgccctccccaacagaggc

SEQ ID NO: 43812 - DNA, 21 bp, Artificial Sequence
  Description of Artificial Sequence: Synthetic oligonucleotide
atcaacagcctcagcagcaaa

SEQ ID NO: 43813 - DNA, 21 bp, Artificial Sequence
  Description of Artificial Sequence: Synthetic oligonucleotide
agtggtcagcattctttgaat

SEQ ID NO: 43814 - DNA, 21 bp, Artificial Sequence
  Description of Artificial Sequence: Synthetic oligonucleotide
tatgctatggagagggttggg

SEQ ID NO: 43815 - DNA, 21 bp, Artificial Sequence
  Description of Artificial Sequence: Synthetic oligonucleotide
aacggcagcggccaagaccaa

SEQ ID NO: 43816 - DNA, 21 bp, Artificial Sequence
  Description of Artificial Sequence: Synthetic oligonucleotide
gacagagccggcaaacaaagc

SEQ ID NO: 43817 - DNA, 21 bp, Artificial Sequence
  Description of Artificial Sequence: Synthetic oligonucleotide
ggtggggttccttctaggctt

SEQ ID NO: 43818 - DNA, 21 bp, Artificial Sequence
  Description of Artificial Sequence: Synthetic oligonucleotide
ggtgtgtctgcgacggtgaag

SEQ ID NO: 43819 - DNA, 21 bp, Artificial Sequence
  Description of Artificial Sequence: Synthetic oligonucleotide
gactacagcgaaaccagaaga

SEQ ID NO: 43820 - DNA, 21 bp, Artificial Sequence
  Description of Artificial Sequence: Synthetic oligonucleotide
atcacccccagcaacatcggc

SEQ ID NO: 43821 - DNA, 21 bp, Artificial Sequence
  Description of Artificial Sequence: Synthetic oligonucleotide
atggctacgtctactcgtaat

SEQ ID NO: 43822 - DNA, 21 bp, Artificial Sequence
  Description of Artificial Sequence: Synthetic oligonucleotide
atgagccacaccaaaagcaac

SEQ ID NO: 43823 - DNA, 21 bp, Artificial Sequence
  Description of Artificial Sequence: Synthetic oligonucleotide
atgaatcgtaatggttcgctg

SEQ ID NO: 43824 - DNA, 21 bp, Artificial Sequence
  Description of Artificial Sequence: Synthetic oligonucleotide
gacatcatgagccccctcaaa

SEQ ID NO: 43825 - DNA, 21 bp, Artificial Sequence
  Description of Artificial Sequence: Synthetic oligonucleotide
aataagtcgaatgggcagtcg

SEQ ID NO: 43826 - DNA, 21 bp, Artificial Sequence
  Description of Artificial Sequence: Synthetic oligonucleotide
cctgggacgccttcttctggt

SEQ ID NO: 43827 - DNA, 21 bp, Artificial Sequence
  Description of Artificial Sequence: Synthetic oligonucleotide
tctagtgttcggccgtatgct

SEQ ID NO: 43828 - DNA, 21 bp, Artificial Sequence
  Description of Artificial Sequence: Synthetic oligonucleotide
atgagaagcggcacccacaac

SEQ ID NO: 43829 - DNA, 21 bp, Artificial Sequence
  Description of Artificial Sequence: Synthetic oligonucleotide
ggcacccccaacaccaaagtc

SEQ ID NO: 43830 - DNA, 21 bp, Artificial Sequence
  Description of Artificial Sequence: Synthetic oligonucleotide
cccggcctcagagacaccgcc

SEQ ID NO: 43831 - DNA, 21 bp, Artificial Sequence
  Description of Artificial Sequence: Synthetic oligonucleotide
tctactacgggtgattcgaag

SEQ ID NO: 43832 - DNA, 21 bp, Artificial Sequence
  Description of Artificial Sequence: Synthetic oligonucleotide
acgagtaagcctaattctccg

SEQ ID NO: 43833 - DNA, 21 bp, Artificial Sequence
  Description of Artificial Sequence: Synthetic oligonucleotide
aattctggtactcattttaag

SEQ ID NO: 43834 - DNA, 21 bp, Artificial Sequence
  Description of Artificial Sequence: Synthetic oligonucleotide
tatggttctcctgtgcatcag

SEQ ID NO: 43835 - DNA, 21 bp, Artificial Sequence
  Description of Artificial Sequence: Synthetic oligonucleotide
ttcaccttcaacgccgccacc

SEQ ID NO: 43836 - DNA, 21 bp, Artificial Sequence
  Description of Artificial Sequence: Synthetic oligonucleotide
gctggtgagaataagctgagt

SEQ ID NO: 43837 - DNA, 21 bp, Artificial Sequence
  Description of Artificial Sequence: Synthetic oligonucleotide
cttattcgtggtgggaataat

SEQ ID NO: 43838 - DNA, 21 bp, Artificial Sequence
  Description of Artificial Sequence: Synthetic oligonucleotide
ggtagtaataggaatcctctt

SEQ ID NO: 43839 - DNA, 21 bp, Artificial Sequence
  Description of Artificial Sequence: Synthetic oligonucleotide
atcaccgccacccacgcccac

SEQ ID NO: 43840 - DNA, 21 bp, Artificial Sequence
  Description of Artificial Sequence: Synthetic oligonucleotide
gacgactaccaacacaaaggc

SEQ ID NO: 43841 - DNA, 21 bp, Artificial Sequence
  Description of Artificial Sequence: Synthetic oligonucleotide
caggtgacggctattggtgct

SEQ ID NO: 43842 - DNA, 21 bp, Artificial Sequence
  Description of Artificial Sequence: Synthetic oligonucleotide
tctaatcggccttctattgtg

SEQ ID NO: 43843 - DNA, 21 bp, Artificial Sequence
  Description of Artificial Sequence: Synthetic oligonucleotide
ttccccaccagccccaccaga

SEQ ID NO: 43844 - DNA, 21 bp, Artificial Sequence
  Description of Artificial Sequence: Synthetic oligonucleotide
ccgacgaggaatgggaatatg

SEQ ID NO: 43845 - DNA, 21 bp, Artificial Sequence
  Description of Artificial Sequence: Synthetic oligonucleotide
gttcttcataatgctagtagt

SEQ ID NO: 43846 - DNA, 21 bp, Artificial Sequence
  Description of Artificial Sequence: Synthetic oligonucleotide
gtcctcagcagcagccccaaa

SEQ ID NO: 43847 - DNA, 21 bp, Artificial Sequence
  Description of Artificial Sequence: Synthetic oligonucleotide
cagagtaaggctggtaattcg

SEQ ID NO: 43848 - DNA, 21 bp, Artificial Sequence
  Description of Artificial Sequence: Synthetic oligonucleotide
caaaccagccacagcgccaaa

SEQ ID NO: 43849 - DNA, 21 bp, Artificial Sequence
  Description of Artificial Sequence: Synthetic oligonucleotide
gacatcagaaacctccaaaga

SEQ ID NO: 43850 - DNA, 21 bp, Artificial Sequence
  Description of Artificial Sequence: Synthetic oligonucleotide
gcgacgagtcctcggttgtct

SEQ ID NO: 43851 - DNA, 21 bp, Artificial Sequence
  Description of Artificial Sequence: Synthetic oligonucleotide
gccttcggcggcgaaaccaaa

SEQ ID NO: 43852 - DNA, 21 bp, Artificial Sequence
  Description of Artificial Sequence: Synthetic oligonucleotide
tcgtctcaggcgcagccgact

SEQ ID NO: 43853 - DNA, 21 bp, Artificial Sequence
  Description of Artificial Sequence: Synthetic oligonucleotide
accgtcctcggcagcagctac

SEQ ID NO: 43854 - DNA, 21 bp, Artificial Sequence
  Description of Artificial Sequence: Synthetic oligonucleotide
tttcgtccttctactgtggtg

SEQ ID NO: 43855 - DNA, 21 bp, Artificial Sequence
  Description of Artificial Sequence: Synthetic oligonucleotide
agtgctcattctcttgggatt

SEQ ID NO: 43856 - DNA, 21 bp, Artificial Sequence
  Description of Artificial Sequence: Synthetic oligonucleotide
agtaggtcggttactgcgagg

SEQ ID NO: 43857 - DNA, 21 bp, Artificial Sequence
  Description of Artificial Sequence: Synthetic oligonucleotide
gccggcaccagcaaagacatc

SEQ ID NO: 43858 - DNA, 21 bp, Artificial Sequence
  Description of Artificial Sequence: Synthetic oligonucleotide
gtgactggtagtgtgtcggat

SEQ ID NO: 43859 - DNA, 21 bp, Artificial Sequence
  Description of Artificial Sequence: Synthetic oligonucleotide
tctgggaatagtcataatggg

SEQ ID NO: 43860 - DNA, 21 bp, Artificial Sequence
  Description of Artificial Sequence: Synthetic oligonucleotide
ggtccgcatactgcggttggt

SEQ ID NO: 43861 - DNA, 21 bp, Artificial Sequence
  Description of Artificial Sequence: Synthetic oligonucleotide
ggcagacaaagccaacccaga

SEQ ID NO: 43862 - DNA, 21 bp, Artificial Sequence
  Description of Artificial Sequence: Synthetic oligonucleotide
ctgaggcctaatgggcagctt

SEQ ID NO: 43863 - DNA, 21 bp, Artificial Sequence
  Description of Artificial Sequence: Synthetic oligonucleotide
agaatgaaaagcctcgacaac

SEQ ID NO: 43864 - DNA, 21 bp, Artificial Sequence
  Description of Artificial Sequence: Synthetic oligonucleotide
aatgtgaatagtcagatgctg

SEQ ID NO: 43865 - DNA, 21 bp, Artificial Sequence
  Description of Artificial Sequence: Synthetic oligonucleotide
agtttttcgtcgactatgggt

SEQ ID NO: 43866 - DNA, 21 bp, Artificial Sequence
  Description of Artificial Sequence: Synthetic oligonucleotide
gggaataatcggccggcttcg

SEQ ID NO: 43867 - DNA, 21 bp, Artificial Sequence
  Description of Artificial Sequence: Synthetic oligonucleotide
gggcagactggtgatatgcgt

SEQ ID NO: 43868 - DNA, 21 bp, Artificial Sequence
  Description of Artificial Sequence: Synthetic oligonucleotide
actaatccgaatccgcatagg

SEQ ID NO: 43869 - DNA, 21 bp, Artificial Sequence
  Description of Artificial Sequence: Synthetic oligonucleotide
atccccctcagcagccaaaga

SEQ ID NO: 43870 - DNA, 21 bp, Artificial Sequence
  Description of Artificial Sequence: Synthetic oligonucleotide
agtggtgttgagcgggttaat

SEQ ID NO: 43871 - DNA, 21 bp, Artificial Sequence
  Description of Artificial Sequence: Synthetic oligonucleotide
tttaattcttcttctggtagt

SEQ ID NO: 43872 - DNA, 21 bp, Artificial Sequence
  Description of Artificial Sequence: Synthetic oligonucleotide
catattgggtctccgcatacg

SEQ ID NO: 43873 - DNA, 21 bp, Artificial Sequence
  Description of Artificial Sequence: Synthetic oligonucleotide
ggcagcggccacggcaccaac

SEQ ID NO: 43874 - DNA, 21 bp, Artificial Sequence
  Description of Artificial Sequence: Synthetic oligonucleotide
agtacgcatgatcatagtagg

SEQ ID NO: 43875 - DNA, 21 bp, Artificial Sequence
  Description of Artificial Sequence: Synthetic oligonucleotide
cctcttcagcagaatcggtct

SEQ ID NO: 43876 - DNA, 21 bp, Artificial Sequence
  Description of Artificial Sequence: Synthetic oligonucleotide
atgatggggggtgttaagaat

SEQ ID NO: 43877 - DNA, 21 bp, Artificial Sequence
  Description of Artificial Sequence: Synthetic oligonucleotide
aatcctgttgctctgagggat

SEQ ID NO: 43878 - DNA, 21 bp, Artificial Sequence
  Description of Artificial Sequence: Synthetic oligonucleotide
cttttggatcggagggctgct

SEQ ID NO: 43879 - DNA, 21 bp, Artificial Sequence
  Description of Artificial Sequence: Synthetic oligonucleotide
aggtcgatggggaattcttcg

SEQ ID NO: 43880 - DNA, 21 bp, Artificial Sequence
  Description of Artificial Sequence: Synthetic oligonucleotide
aaacaacccgacagcacccac

SEQ ID NO: 43881 - DNA, 21 bp, Artificial Sequence
  Description of Artificial Sequence: Synthetic oligonucleotide
actcagggtgcgagtaatttg

SEQ ID NO: 43882 - DNA, 21 bp, Artificial Sequence
  Description of Artificial Sequence: Synthetic oligonucleotide
cgtaattatacgggtgatagt

SEQ ID NO: 43883 - DNA, 21 bp, Artificial Sequence
  Description of Artificial Sequence: Synthetic oligonucleotide
gggactattaatggtattacg

SEQ ID NO: 43884 - DNA, 21 bp, Artificial Sequence
  Description of Artificial Sequence: Synthetic oligonucleotide
gttcctggtaatttgccttct

SEQ ID NO: 43885 - DNA, 21 bp, Artificial Sequence
  Description of Artificial Sequence: Synthetic oligonucleotide
gacagaagcagagtcctcggc

SEQ ID NO: 43886 - DNA, 21 bp, Artificial Sequence
  Description of Artificial Sequence: Synthetic oligonucleotide
tctgatattaatcggtctact

SEQ ID NO: 43887 - DNA, 21 bp, Artificial Sequence
  Description of Artificial Sequence: Synthetic oligonucleotide
ccttctgtggcgaatgttatg

SEQ ID NO: 43888 - DNA, 21 bp, Artificial Sequence
  Description of Artificial Sequence: Synthetic oligonucleotide
caattccccgacgaaaccctc

SEQ ID NO: 43889 - DNA, 21 bp, Artificial Sequence
  Description of Artificial Sequence: Synthetic oligonucleotide
tcgagtttggagaagtctaat

SEQ ID NO: 43890 - DNA, 21 bp, Artificial Sequence
  Description of Artificial Sequence: Synthetic oligonucleotide
attggtactagtccgatgaag

SEQ ID NO: 43891 - DNA, 21 bp, Artificial Sequence
  Description of Artificial Sequence: Synthetic oligonucleotide
cctgttacgaggttgtcggag

SEQ ID NO: 43892 - DNA, 21 bp, Artificial Sequence
  Description of Artificial Sequence: Synthetic oligonucleotide
gatcgtcaggggttgtctggg

SEQ ID NO: 43893 - DNA, 21 bp, Artificial Sequence
  Description of Artificial Sequence: Synthetic oligonucleotide
acccaaggcagcagactcagc

SEQ ID NO: 43894 - DNA, 21 bp, Artificial Sequence
  Description of Artificial Sequence: Synthetic oligonucleotide
agagacagaaccaacgccgcc

SEQ ID NO: 43895 - DNA, 21 bp, Artificial Sequence
  Description of Artificial Sequence: Synthetic oligonucleotide
gtcagcagaagcgccaccaac

SEQ ID NO: 43896 - DNA, 21 bp, Artificial Sequence
  Description of Artificial Sequence: Synthetic oligonucleotide
aatgtttcgagtgcgattaag

SEQ ID NO: 43897 - DNA, 21 bp, Artificial Sequence
  Description of Artificial Sequence: Synthetic oligonucleotide
ccgcattctgggaatcgtcat

SEQ ID NO: 43898 - DNA, 21 bp, Artificial Sequence
  Description of Artificial Sequence: Synthetic oligonucleotide
taccccagcaccccccacaga

SEQ ID NO: 43899 - DNA, 21 bp, Artificial Sequence
  Description of Artificial Sequence: Synthetic oligonucleotide
tcgaaggctacgcataatatt

SEQ ID NO: 43900 - DNA, 21 bp, Artificial Sequence
  Description of Artificial Sequence: Synthetic oligonucleotide
gagctggctgcgccttctaag

SEQ ID NO: 43901 - DNA, 21 bp, Artificial Sequence
  Description of Artificial Sequence: Synthetic oligonucleotide
ccggttggtactaagtctggt

SEQ ID NO: 43902 - DNA, 21 bp, Artificial Sequence
  Description of Artificial Sequence: Synthetic oligonucleotide
agttctagtcgggggcagaat

SEQ ID NO: 43903 - DNA, 21 bp, Artificial Sequence
  Description of Artificial Sequence: Synthetic oligonucleotide
caagtcagccccctcaacgcc

SEQ ID NO: 43904 - DNA, 21 bp, Artificial Sequence
  Description of Artificial Sequence: Synthetic oligonucleotide
tacggcgccagccccagcctc

SEQ ID NO: 43905 - DNA, 21 bp, Artificial Sequence
  Description of Artificial Sequence: Synthetic oligonucleotide
tataatgcttcgactaatgtg

SEQ ID NO: 43906 - DNA, 21 bp, Artificial Sequence
  Description of Artificial Sequence: Synthetic oligonucleotide
tcttcgagggcttctcaggat

SEQ ID NO: 43907 - DNA, 21 bp, Artificial Sequence
  Description of Artificial Sequence: Synthetic oligonucleotide
ctcacccccagcaacatgggc

SEQ ID NO: 43908 - DNA, 21 bp, Artificial Sequence
  Description of Artificial Sequence: Synthetic oligonucleotide
gtgttggcgggtagtaatact

SEQ ID NO: 43909 - DNA, 21 bp, Artificial Sequence
  Description of Artificial Sequence: Synthetic oligonucleotide
cccagcggcgaaaccagcaaa

SEQ ID NO: 43910 - DNA, 21 bp, Artificial Sequence
  Description of Artificial Sequence: Synthetic oligonucleotide
ggcgtcaacaccggcacccaa

SEQ ID NO: 43911 - DNA, 21 bp, Artificial Sequence
  Description of Artificial Sequence: Synthetic oligonucleotide
agtcatatgacgggggttact

SEQ ID NO: 43912 - DNA, 21 bp, Artificial Sequence
  Description of Artificial Sequence: Synthetic oligonucleotide
gtggctcatcggcctcagctg

SEQ ID NO: 43913 - DNA, 21 bp, Artificial Sequence
  Description of Artificial Sequence: Synthetic oligonucleotide
gggacggatagtaagaggcat

SEQ ID NO: 43914 - DNA, 21 bp, Artificial Sequence
  Description of Artificial Sequence: Synthetic oligonucleotide
ggcacctacggcgaaatgaga

SEQ ID NO: 43915 - DNA, 21 bp, Artificial Sequence
  Description of Artificial Sequence: Synthetic oligonucleotide
cctcagaatctggctcatgtt

SEQ ID NO: 43916 - DNA, 21 bp, Artificial Sequence
  Description of Artificial Sequence: Synthetic oligonucleotide
cctagtgctaggatgtctggt

SEQ ID NO: 43917 - DNA, 21 bp, Artificial Sequence
  Description of Artificial Sequence: Synthetic oligonucleotide
tcgcataattcgaaggattct

SEQ ID NO: 43918 - DNA, 21 bp, Artificial Sequence
  Description of Artificial Sequence: Synthetic oligonucleotide
tttgtttcggctcgtagtggt

SEQ ID NO: 43919 - DNA, 21 bp, Artificial Sequence
  Description of Artificial Sequence: Synthetic oligonucleotide
cttaattcgacggcgggtaag

SEQ ID NO: 43920 - DNA, 21 bp, Artificial Sequence
  Description of Artificial Sequence: Synthetic oligonucleotide
cgtgatccgaaggcgggtgtt

SEQ ID NO: 43921 - DNA, 21 bp, Artificial Sequence
  Description of Artificial Sequence: Synthetic oligonucleotide
catcagagtagttcgagttcg

SEQ ID NO: 43922 - DNA, 21 bp, Artificial Sequence
  Description of Artificial Sequence: Synthetic oligonucleotide
gatattgggaatcctactaat

SEQ ID NO: 43923 - DNA, 21 bp, Artificial Sequence
  Description of Artificial Sequence: Synthetic oligonucleotide
tctagtcctgtgagtgctgtt

SEQ ID NO: 43924 - DNA, 21 bp, Artificial Sequence
  Description of Artificial Sequence: Synthetic oligonucleotide
gcccaccaaagacccatccaa

SEQ ID NO: 43925 - DNA, 21 bp, Artificial Sequence
  Description of Artificial Sequence: Synthetic oligonucleotide
ggtaatgggatttctactaag

SEQ ID NO: 43926 - DNA, 21 bp, Artificial Sequence
  Description of Artificial Sequence: Synthetic oligonucleotide
aatggttctacttcttctggt

SEQ ID NO: 43927 - DNA, 21 bp, Artificial Sequence
  Description of Artificial Sequence: Synthetic oligonucleotide
caacccagccaaggccacagc

SEQ ID NO: 43928 - DNA, 21 bp, Artificial Sequence
  Description of Artificial Sequence: Synthetic oligonucleotide
tcgatggcttcggcgtataag

SEQ ID NO: 43929 - DNA, 21 bp, Artificial Sequence
  Description of Artificial Sequence: Synthetic oligonucleotide
accaacggcggcagagtcacc

SEQ ID NO: 43930 - DNA, 21 bp, Artificial Sequence
  Description of Artificial Sequence: Synthetic oligonucleotide
aaaagagtcacctacaccgac

SEQ ID NO: 43931 - DNA, 21 bp, Artificial Sequence
  Description of Artificial Sequence: Synthetic oligonucleotide
gccagagacgaccaaagaaga

SEQ ID NO: 43932 - DNA, 21 bp, Artificial Sequence
  Description of Artificial Sequence: Synthetic oligonucleotide
attcctgcgtcgtcgtcgggt

SEQ ID NO: 43933 - DNA, 21 bp, Artificial Sequence
  Description of Artificial Sequence: Synthetic oligonucleotide
tgtgtgactggtggtcttact

SEQ ID NO: 43934 - DNA, 21 bp, Artificial Sequence
  Description of Artificial Sequence: Synthetic oligonucleotide
gttaatggtaagatttgttcg

SEQ ID NO: 43935 - DNA, 21 bp, Artificial Sequence
  Description of Artificial Sequence: Synthetic oligonucleotide
gcgactggttctcctagtaag

SEQ ID NO: 43936 - DNA, 21 bp, Artificial Sequence
  Description of Artificial Sequence: Synthetic oligonucleotide
gtgcctggtaagtctgcgcag

SEQ ID NO: 43937 - DNA, 21 bp, Artificial Sequence
  Description of Artificial Sequence: Synthetic oligonucleotide
acccccagcgtcagcaccaaa

SEQ ID NO: 43938 - DNA, 21 bp, Artificial Sequence
  Description of Artificial Sequence: Synthetic oligonucleotide
agaaccctcaacctcaacacc

SEQ ID NO: 43939 - DNA, 21 bp, Artificial Sequence
  Description of Artificial Sequence: Synthetic oligonucleotide
tcggatatgtctggtcagcgt

SEQ ID NO: 43940 - DNA, 21 bp, Artificial Sequence
  Description of Artificial Sequence: Synthetic oligonucleotide
agtactggtaaggctacttgt

SEQ ID NO: 43941 - DNA, 21 bp, Artificial Sequence
  Description of Artificial Sequence: Synthetic oligonucleotide
ggccccagcagccccagactc

SEQ ID NO: 43942 - DNA, 21 bp, Artificial Sequence
  Description of Artificial Sequence: Synthetic oligonucleotide
cccagaaccaacaaccccagc

SEQ ID NO: 43943 - DNA, 21 bp, Artificial Sequence
  Description of Artificial Sequence: Synthetic oligonucleotide
ggtggtaatgataggtttcgg

SEQ ID NO: 43944 - DNA, 21 bp, Artificial Sequence
  Description of Artificial Sequence: Synthetic oligonucleotide
accatcagcaccagacaaagc

SEQ ID NO: 43945 - DNA, 21 bp, Artificial Sequence
  Description of Artificial Sequence: Synthetic oligonucleotide
caaggcaccaccgccagaagc

SEQ ID NO: 43946 - DNA, 21 bp, Artificial Sequence
  Description of Artificial Sequence: Synthetic oligonucleotide
gaactcagaaccaacgccctc

SEQ ID NO: 43947 - DNA, 21 bp, Artificial Sequence
  Description of Artificial Sequence: Synthetic oligonucleotide
actggggtttcgcctctggct

SEQ ID NO: 43948 - DNA, 21 bp, Artificial Sequence
  Description of Artificial Sequence: Synthetic oligonucleotide
tctcatgcgacggctgctact

SEQ ID NO: 43949 - DNA, 21 bp, Artificial Sequence
  Description of Artificial Sequence: Synthetic oligonucleotide
tcgagttcgcgtaatgtggct

SEQ ID NO: 43950 - DNA, 21 bp, Artificial Sequence
  Description of Artificial Sequence: Synthetic oligonucleotide
ggcatcaacagcagaggcagc

SEQ ID NO: 43951 - DNA, 21 bp, Artificial Sequence
  Description of Artificial Sequence: Synthetic oligonucleotide
atggatgggaggtcgactact

SEQ ID NO: 43952 - DNA, 21 bp, Artificial Sequence
  Description of Artificial Sequence: Synthetic oligonucleotide
gaaagacccggcggcaccccc

SEQ ID NO: 43953 - DNA, 21 bp, Artificial Sequence
  Description of Artificial Sequence: Synthetic oligonucleotide
atccccagcggcgtccacagc

SEQ ID NO: 43954 - DNA, 21 bp, Artificial Sequence
  Description of Artificial Sequence: Synthetic oligonucleotide
cctgtgggttctggtgtgcct

SEQ ID NO: 43955 - DNA, 21 bp, Artificial Sequence
  Description of Artificial Sequence: Synthetic oligonucleotide
gatgcgcgtactatggcggct

SEQ ID NO: 43956 - DNA, 21 bp, Artificial Sequence
  Description of Artificial Sequence: Synthetic oligonucleotide
tatggttcgaatacgccgact

SEQ ID NO: 43957 - DNA, 21 bp, Artificial Sequence
  Description of Artificial Sequence: Synthetic oligonucleotide
agagtcctcagcaacgaaacc

SEQ ID NO: 43958 - DNA, 21 bp, Artificial Sequence
  Description of Artificial Sequence: Synthetic oligonucleotide
agcgccatcagaaacgtcacc

SEQ ID NO: 43959 - DNA, 21 bp, Artificial Sequence
  Description of Artificial Sequence: Synthetic oligonucleotide
agtgggtctctttcttctgct

SEQ ID NO: 43960 - DNA, 21 bp, Artificial Sequence
  Description of Artificial Sequence: Synthetic oligonucleotide
gttcagccggtgaagatgagt

SEQ ID NO: 43961 - DNA, 21 bp, Artificial Sequence
  Description of Artificial Sequence: Synthetic oligonucleotide
accagaagcaaagaaagcccc

SEQ ID NO: 43962 - DNA, 21 bp, Artificial Sequence
  Description of Artificial Sequence: Synthetic oligonucleotide
agccccggcaaactcaccacc

SEQ ID NO: 43963 - DNA, 21 bp, Artificial Sequence
  Description of Artificial Sequence: Synthetic oligonucleotide
gttagttcgaatgctagtatg

SEQ ID NO: 43964 - DNA, 21 bp, Artificial Sequence
  Description of Artificial Sequence: Synthetic oligonucleotide
gccatgggccaccccctcgcc

SEQ ID NO: 43965 - DNA, 21 bp, Artificial Sequence
  Description of Artificial Sequence: Synthetic oligonucleotide
atgagttctaagcaggttagt

SEQ ID NO: 43966 - DNA, 21 bp, Artificial Sequence
  Description of Artificial Sequence: Synthetic oligonucleotide
tcgattagtacgcgtacgggg

SEQ ID NO: 43967 - DNA, 21 bp, Artificial Sequence
  Description of Artificial Sequence: Synthetic oligonucleotide
ggcaaccccagccccctcgtc

SEQ ID NO: 43968 - DNA, 21 bp, Artificial Sequence
  Description of Artificial Sequence: Synthetic oligonucleotide
ggcgtcaccggcacccacgtc

SEQ ID NO: 43969 - DNA, 21 bp, Artificial Sequence
  Description of Artificial Sequence: Synthetic oligonucleotide
ctcggcaccagccccatgaaa

SEQ ID NO: 43970 - DNA, 21 bp, Artificial Sequence
  Description of Artificial Sequence: Synthetic oligonucleotide
tcgactcatcatccggctagt

SEQ ID NO: 43971 - DNA, 21 bp, Artificial Sequence
  Description of Artificial Sequence: Synthetic oligonucleotide
gtcgccggcgccgcccaaaga

SEQ ID NO: 43972 - DNA, 21 bp, Artificial Sequence
  Description of Artificial Sequence: Synthetic oligonucleotide
gggcctcgttctatgtctaat

SEQ ID NO: 43973 - DNA, 21 bp, Artificial Sequence
  Description of Artificial Sequence: Synthetic oligonucleotide
tcgccgcgggcgagtcttaat

SEQ ID NO: 43974 - DNA, 21 bp, Artificial Sequence
  Description of Artificial Sequence: Synthetic oligonucleotide
tctattacgtctgttactaat

SEQ ID NO: 43975 - DNA, 21 bp, Artificial Sequence
  Description of Artificial Sequence: Synthetic oligonucleotide
atgggcgccggcgccctcacc

SEQ ID NO: 43976 - DNA, 21 bp, Artificial Sequence
  Description of Artificial Sequence: Synthetic oligonucleotide
tacgccatcgaaagagtcggc

SEQ ID NO: 43977 - DNA, 21 bp, Artificial Sequence
  Description of Artificial Sequence: Synthetic oligonucleotide
cctactagtaatgggagtctt

SEQ ID NO: 43978 - DNA, 21 bp, Artificial Sequence
  Description of Artificial Sequence: Synthetic oligonucleotide
ctcaccccccccggcgtcggc

SEQ ID NO: 43979 - DNA, 21 bp, Artificial Sequence
  Description of Artificial Sequence: Synthetic oligonucleotide
tctccgcatcgggatacggtt

SEQ ID NO: 43980 - DNA, 21 bp, Artificial Sequence
  Description of Artificial Sequence: Synthetic oligonucleotide
gctgtggagtcgtctagttct

SEQ ID NO: 43981 - DNA, 21 bp, Artificial Sequence
  Description of Artificial Sequence: Synthetic oligonucleotide
ggtacttctccttccacgatg

SEQ ID NO: 43982 - DNA, 21 bp, Artificial Sequence
  Description of Artificial Sequence: Synthetic oligonucleotide
gaccccggcaccagaaaaagc

SEQ ID NO: 43983 - DNA, 21 bp, Artificial Sequence
  Description of Artificial Sequence: Synthetic oligonucleotide
gtggtgaggaattctgtttcg

SEQ ID NO: 43984 - DNA, 21 bp, Artificial Sequence
  Description of Artificial Sequence: Synthetic oligonucleotide
cggaagatggttccttatagt

SEQ ID NO: 43985 - DNA, 21 bp, Artificial Sequence
  Description of Artificial Sequence: Synthetic oligonucleotide
tgtcagggtcagggtgtgtct

SEQ ID NO: 43986 - DNA, 21 bp, Artificial Sequence
  Description of Artificial Sequence: Synthetic oligonucleotide
agaatcgccggccccaccgtc

SEQ ID NO: 43987 - DNA, 21 bp, Artificial Sequence
  Description of Artificial Sequence: Synthetic oligonucleotide
attatttcgcagcatgggatg

SEQ ID NO: 43988 - DNA, 21 bp, Artificial Sequence
  Description of Artificial Sequence: Synthetic oligonucleotide
ggtaattctacggcgaatagg

SEQ ID NO: 43989 - DNA, 21 bp, Artificial Sequence
  Description of Artificial Sequence: Synthetic oligonucleotide
agtccggggcgtacgcagagt

SEQ ID NO: 43990 - DNA, 21 bp, Artificial Sequence
  Description of Artificial Sequence: Synthetic oligonucleotide
cccatcagcgaaagcaccaga

SEQ ID NO: 43991 - DNA, 21 bp, Artificial Sequence
  Description of Artificial Sequence: Synthetic oligonucleotide
tctagtggtttgtcgtcgtct

SEQ ID NO: 43992 - DNA, 21 bp, Artificial Sequence
  Description of Artificial Sequence: Synthetic oligonucleotide
gaaagaaacggcaacttcacc

SEQ ID NO: 43993 - DNA, 21 bp, Artificial Sequence
  Description of Artificial Sequence: Synthetic oligonucleotide
ggtcattctcagtcgcatcag

SEQ ID NO: 43994 - DNA, 21 bp, Artificial Sequence
  Description of Artificial Sequence: Synthetic oligonucleotide
gggagtcttggtgctctgact

SEQ ID NO: 43995 - DNA, 21 bp, Artificial Sequence
  Description of Artificial Sequence: Synthetic oligonucleotide
atgagacaaaccgccagcctc

SEQ ID NO: 43996 - DNA, 21 bp, Artificial Sequence
  Description of Artificial Sequence: Synthetic oligonucleotide
ggccaaaacagaaacaacacc

SEQ ID NO: 43997 - DNA, 21 bp, Artificial Sequence
  Description of Artificial Sequence: Synthetic oligonucleotide
ctgcagagtgggggtcatagg

SEQ ID NO: 43998 - DNA, 21 bp, Artificial Sequence
  Description of Artificial Sequence: Synthetic oligonucleotide
gccgtcaacaccaaagccctc

SEQ ID NO: 43999 - DNA, 21 bp, Artificial Sequence
  Description of Artificial Sequence: Synthetic oligonucleotide
atggggggtgttacgtcttct

SEQ ID NO: 44000 - DNA, 21 bp, Artificial Sequence
  Description of Artificial Sequence: Synthetic oligonucleotide
gagaataatagtcgtgctact

SEQ ID NO: 44001 - DNA, 21 bp, Artificial Sequence
  Description of Artificial Sequence: Synthetic oligonucleotide
cagatgcctggtcatactggg

SEQ ID NO: 44002 - DNA, 21 bp, Artificial Sequence
  Description of Artificial Sequence: Synthetic oligonucleotide
aagcctcaggggagtctggtt

SEQ ID NO: 44003 - DNA, 21 bp, Artificial Sequence
  Description of Artificial Sequence: Synthetic oligonucleotide
gggactggtgttccggggaag

SEQ ID NO: 44004 - DNA, 21 bp, Artificial Sequence
  Description of Artificial Sequence: Synthetic oligonucleotide
ggcagagacaacagcagacaa

SEQ ID NO: 44005 - DNA, 21 bp, Artificial Sequence
  Description of Artificial Sequence: Synthetic oligonucleotide
agcggcaacgacaaaaacaac

SEQ ID NO: 44006 - DNA, 21 bp, Artificial Sequence
  Description of Artificial Sequence: Synthetic oligonucleotide
tctgttaattctcggagtgag

SEQ ID NO: 44007 - DNA, 21 bp, Artificial Sequence
  Description of Artificial Sequence: Synthetic oligonucleotide
gtgactcatggtcggcctggg

SEQ ID NO: 44008 - DNA, 21 bp, Artificial Sequence
  Description of Artificial Sequence: Synthetic oligonucleotide
tcgaattctgatagggcgaat

SEQ ID NO: 44009 - DNA, 21 bp, Artificial Sequence
  Description of Artificial Sequence: Synthetic oligonucleotide
catactactggtattcttggg

SEQ ID NO: 44010 - DNA, 21 bp, Artificial Sequence
  Description of Artificial Sequence: Synthetic oligonucleotide
ggcagagtcgtcagcatgcaa

SEQ ID NO: 44011 - DNA, 21 bp, Artificial Sequence
  Description of Artificial Sequence: Synthetic oligonucleotide
agcggcccccaacccgtcgcc

SEQ ID NO: 44012 - DNA, 21 bp, Artificial Sequence
  Description of Artificial Sequence: Synthetic oligonucleotide
acgccgacgactagtgcgaat

SEQ ID NO: 44013 - DNA, 21 bp, Artificial Sequence
  Description of Artificial Sequence: Synthetic oligonucleotide
cgtcaggatagtactcctggg

SEQ ID NO: 44014 - DNA, 21 bp, Artificial Sequence
  Description of Artificial Sequence: Synthetic oligonucleotide
catcagcctcatcagaatcag

SEQ ID NO: 44015 - DNA, 21 bp, Artificial Sequence
  Description of Artificial Sequence: Synthetic oligonucleotide
gggatgattccttcgtctagg

SEQ ID NO: 44016 - DNA, 21 bp, Artificial Sequence
  Description of Artificial Sequence: Synthetic oligonucleotide
agaaccgccagcagcctcccc

SEQ ID NO: 44017 - DNA, 21 bp, Artificial Sequence
  Description of Artificial Sequence: Synthetic oligonucleotide
cttgagaggaatggtttgaag

SEQ ID NO: 44018 - DNA, 21 bp, Artificial Sequence
  Description of Artificial Sequence: Synthetic oligonucleotide
cacatgaaacacctccaagtc

SEQ ID NO: 44019 - DNA, 21 bp, Artificial Sequence
  Description of Artificial Sequence: Synthetic oligonucleotide
gccaccatcggccacaacaga

SEQ ID NO: 44020 - DNA, 21 bp, Artificial Sequence
  Description of Artificial Sequence: Synthetic oligonucleotide
cacgcccacagcaacgtcggc

SEQ ID NO: 44021 - DNA, 21 bp, Artificial Sequence
  Description of Artificial Sequence: Synthetic oligonucleotide
tctaatcgtcagcatggtctt

SEQ ID NO: 44022 - DNA, 21 bp, Artificial Sequence
  Description of Artificial Sequence: Synthetic oligonucleotide
tcgtctatgtcgcatcagaag

SEQ ID NO: 44023 - DNA, 21 bp, Artificial Sequence
  Description of Artificial Sequence: Synthetic oligonucleotide
tatcattcgaagggtacgact

SEQ ID NO: 44024 - DNA, 21 bp, Artificial Sequence
  Description of Artificial Sequence: Synthetic oligonucleotide
tatcaggttccgttggctaag

SEQ ID NO: 44025 - DNA, 21 bp, Artificial Sequence
  Description of Artificial Sequence: Synthetic oligonucleotide
ctgtctcgtcagcataattcg

SEQ ID NO: 44026 - DNA, 21 bp, Artificial Sequence
  Description of Artificial Sequence: Synthetic oligonucleotide
aacagttctggacagaatcaa

SEQ ID NO: 44027 - DNA, 21 bp, Artificial Sequence
  Description of Artificial Sequence: Synthetic oligonucleotide
cctcatcagcgtgctgggtct

SEQ ID NO: 44028 - DNA, 21 bp, Artificial Sequence
  Description of Artificial Sequence: Synthetic oligonucleotide
gccctcagaaccagcaactac

SEQ ID NO: 44029 - DNA, 21 bp, Artificial Sequence
  Description of Artificial Sequence: Synthetic oligonucleotide
gataatactggtcgtaatgct

SEQ ID NO: 44030 - DNA, 21 bp, Artificial Sequence
  Description of Artificial Sequence: Synthetic oligonucleotide
cattctcatgggaagtcgatt

SEQ ID NO: 44031 - DNA, 21 bp, Artificial Sequence
  Description of Artificial Sequence: Synthetic oligonucleotide
aaaaccagcaccccctacagc

SEQ ID NO: 44032 - DNA, 21 bp, Artificial Sequence
  Description of Artificial Sequence: Synthetic oligonucleotide
atgtctttgcctggtcagcgg

SEQ ID NO: 44033 - DNA, 21 bp, Artificial Sequence
  Description of Artificial Sequence: Synthetic oligonucleotide
catatgaatcgtaagcttgag

SEQ ID NO: 44034 - DNA, 21 bp, Artificial Sequence
  Description of Artificial Sequence: Synthetic oligonucleotide
ggggggtcgaattctaggctg

SEQ ID NO: 44035 - DNA, 21 bp, Artificial Sequence
  Description of Artificial Sequence: Synthetic oligonucleotide
agaagcgaccccaccagaggc

SEQ ID NO: 44036 - DNA, 21 bp, Artificial Sequence
  Description of Artificial Sequence: Synthetic oligonucleotide
agagacagcaccaaactcgtc

SEQ ID NO: 44037 - DNA, 21 bp, Artificial Sequence
  Description of Artificial Sequence: Synthetic oligonucleotide
catgttgttgagcagtttaag

SEQ ID NO: 44038 - DNA, 21 bp, Artificial Sequence
  Description of Artificial Sequence: Synthetic oligonucleotide
aaaaccaacagcgaaagcatg

SEQ ID NO: 44039 - DNA, 21 bp, Artificial Sequence
  Description of Artificial Sequence: Synthetic oligonucleotide
agtcgtaagaataatacgttg

SEQ ID NO: 44040 - DNA, 21 bp, Artificial Sequence
  Description of Artificial Sequence: Synthetic oligonucleotide
tcgcataataggacgaatgat

SEQ ID NO: 44041 - DNA, 21 bp, Artificial Sequence
  Description of Artificial Sequence: Synthetic oligonucleotide
cagtctatttctcatacgcgt

SEQ ID NO: 44042 - DNA, 21 bp, Artificial Sequence
  Description of Artificial Sequence: Synthetic oligonucleotide
acgaataattctcatcattcc

SEQ ID NO: 44043 - DNA, 21 bp, Artificial Sequence
  Description of Artificial Sequence: Synthetic oligonucleotide
agcctcaacagcagagaaggc

SEQ ID NO: 44044 - DNA, 21 bp, Artificial Sequence
  Description of Artificial Sequence: Synthetic oligonucleotide
agcaacgtcagcaaaccccaa

SEQ ID NO: 44045 - DNA, 21 bp, Artificial Sequence
  Description of Artificial Sequence: Synthetic oligonucleotide
actgagactcggtcggcgaat

SEQ ID NO: 44046 - DNA, 21 bp, Artificial Sequence
  Description of Artificial Sequence: Synthetic oligonucleotide
tataatgggggtaatcgtagt

SEQ ID NO: 44047 - DNA, 21 bp, Artificial Sequence
  Description of Artificial Sequence: Synthetic oligonucleotide
ctgaatcattcgaagtattcg

SEQ ID NO: 44048 - DNA, 21 bp, Artificial Sequence
  Description of Artificial Sequence: Synthetic oligonucleotide
gaccccctcagaagcatgcac

SEQ ID NO: 44049 - DNA, 21 bp, Artificial Sequence
  Description of Artificial Sequence: Synthetic oligonucleotide
attacgagtactggttctagt

SEQ ID NO: 44050 - DNA, 21 bp, Artificial Sequence
  Description of Artificial Sequence: Synthetic oligonucleotide
tacgccagcagcagagacggc

SEQ ID NO: 44051 - DNA, 21 bp, Artificial Sequence
  Description of Artificial Sequence: Synthetic oligonucleotide
ttcgccagaagcgccagcagc

SEQ ID NO: 44052 - DNA, 21 bp, Artificial Sequence
  Description of Artificial Sequence: Synthetic oligonucleotide
atgggtcataaggtggaggcg

SEQ ID NO: 44053 - DNA, 21 bp, Artificial Sequence
  Description of Artificial Sequence: Synthetic oligonucleotide
gatacggcgactcgtaatagg

SEQ ID NO: 44054 - DNA, 21 bp, Artificial Sequence
  Description of Artificial Sequence: Synthetic oligonucleotide
acgttttctaagggtactaat

SEQ ID NO: 44055 - DNA, 21 bp, Artificial Sequence
  Description of Artificial Sequence: Synthetic oligonucleotide
atgagagccaaccacaccagc

SEQ ID NO: 44056 - DNA, 21 bp, Artificial Sequence
  Description of Artificial Sequence: Synthetic oligonucleotide
accagcaccagccccatgaaa

SEQ ID NO: 44057 - DNA, 21 bp, Artificial Sequence
  Description of Artificial Sequence: Synthetic oligonucleotide
tctactccgcatcatacgact

SEQ ID NO: 44058 - DNA, 21 bp, Artificial Sequence
  Description of Artificial Sequence: Synthetic oligonucleotide
ctcggccaccaaggccacctc

SEQ ID NO: 44059 - DNA, 21 bp, Artificial Sequence
  Description of Artificial Sequence: Synthetic oligonucleotide
gccgccaccagacaacccgac

SEQ ID NO: 44060 - DNA, 21 bp, Artificial Sequence
  Description of Artificial Sequence: Synthetic oligonucleotide
attacgggtaatcgtcatagt

SEQ ID NO: 44061 - DNA, 21 bp, Artificial Sequence
  Description of Artificial Sequence: Synthetic oligonucleotide
aacagcggcccccccaaaccc

SEQ ID NO: 44062 - DNA, 21 bp, Artificial Sequence
  Description of Artificial Sequence: Synthetic oligonucleotide
tgccaaagcagcagagtcacc

SEQ ID NO: 44063 - DNA, 21 bp, Artificial Sequence
  Description of Artificial Sequence: Synthetic oligonucleotide
agtgcggggacttcggttggt

SEQ ID NO: 44064 - DNA, 21 bp, Artificial Sequence
  Description of Artificial Sequence: Synthetic oligonucleotide
agtccttcttcgcctcatgat

SEQ ID NO: 44065 - DNA, 21 bp, Artificial Sequence
  Description of Artificial Sequence: Synthetic oligonucleotide
cttagggctgagcatgttagg

SEQ ID NO: 44066 - DNA, 21 bp, Artificial Sequence
  Description of Artificial Sequence: Synthetic oligonucleotide
tttgcgaatactgctaatagg

SEQ ID NO: 44067 - DNA, 21 bp, Artificial Sequence
  Description of Artificial Sequence: Synthetic oligonucleotide
aatgcgcttcctgtgactcag

SEQ ID NO: 44068 - DNA, 21 bp, Artificial Sequence
  Description of Artificial Sequence: Synthetic oligonucleotide
cgtgcttctggtgttactaat

SEQ ID NO: 44069 - DNA, 21 bp, Artificial Sequence
  Description of Artificial Sequence: Synthetic oligonucleotide
cctccgagtaatgggaggctt

SEQ ID NO: 44070 - DNA, 21 bp, Artificial Sequence
  Description of Artificial Sequence: Synthetic oligonucleotide
ggtgttaggagtgtggctggg

SEQ ID NO: 44071 - DNA, 21 bp, Artificial Sequence
  Description of Artificial Sequence: Synthetic oligonucleotide
ttggggtctagtactattttg

SEQ ID NO: 44072 - DNA, 21 bp, Artificial Sequence
  Description of Artificial Sequence: Synthetic oligonucleotide
cattcggttaatggtcatagt

SEQ ID NO: 44073 - DNA, 21 bp, Artificial Sequence
  Description of Artificial Sequence: Synthetic oligonucleotide
ttgggggctagtactattttg

SEQ ID NO: 44074 - DNA, 21 bp, Artificial Sequence
  Description of Artificial Sequence: Synthetic oligonucleotide
tgcctcagcagcagcgccaaa

SEQ ID NO: 44075 - DNA, 21 bp, Artificial Sequence
  Description of Artificial Sequence: Synthetic oligonucleotide
gaacccgtcaccagcaaaagc

SEQ ID NO: 44076 - DNA, 21 bp, Artificial Sequence
  Description of Artificial Sequence: Synthetic oligonucleotide
gagatgagggttgagaggccg

SEQ ID NO: 44077 - DNA, 21 bp, Artificial Sequence
  Description of Artificial Sequence: Synthetic oligonucleotide
tatagtaagcagaatttgact

SEQ ID NO: 44078 - DNA, 21 bp, Artificial Sequence
  Description of Artificial Sequence: Synthetic oligonucleotide
gacggccaagaaagaagcagc

SEQ ID NO: 44079 - DNA, 21 bp, Artificial Sequence
  Description of Artificial Sequence: Synthetic oligonucleotide
ctcagcaaacaagcctactgc

SEQ ID NO: 44080 - DNA, 21 bp, Artificial Sequence
  Description of Artificial Sequence: Synthetic oligonucleotide
accggcatcaccaaactcagc

SEQ ID NO: 44081 - DNA, 21 bp, Artificial Sequence
  Description of Artificial Sequence: Synthetic oligonucleotide
aatcgggttggttcgatttct

SEQ ID NO: 44082 - DNA, 21 bp, Artificial Sequence
  Description of Artificial Sequence: Synthetic oligonucleotide
gctcctagtgcgggtatgtct

SEQ ID NO: 44083 - DNA, 21 bp, Artificial Sequence
  Description of Artificial Sequence: Synthetic oligonucleotide
cattcgggtacgaggactagt

SEQ ID NO: 44084 - DNA, 21 bp, Artificial Sequence
  Description of Artificial Sequence: Synthetic oligonucleotide
tctcctaataatcggggtatg

SEQ ID NO: 44085 - DNA, 21 bp, Artificial Sequence
  Description of Artificial Sequence: Synthetic oligonucleotide
cccagcgtcagaaccctcggc

SEQ ID NO: 44086 - DNA, 21 bp, Artificial Sequence
  Description of Artificial Sequence: Synthetic oligonucleotide
cgtgagaataatactagttct

SEQ ID NO: 44087 - DNA, 21 bp, Artificial Sequence
  Description of Artificial Sequence: Synthetic oligonucleotide
cagcctactcagaggatgggt

SEQ ID NO: 44088 - DNA, 21 bp, Artificial Sequence
  Description of Artificial Sequence: Synthetic oligonucleotide
caggagggtgtgcgtagttct

SEQ ID NO: 44089 - DNA, 21 bp, Artificial Sequence
  Description of Artificial Sequence: Synthetic oligonucleotide
tggaccggcgtcccccccagc

SEQ ID NO: 44090 - DNA, 21 bp, Artificial Sequence
  Description of Artificial Sequence: Synthetic oligonucleotide
caacccaccaccagcgccctc

SEQ ID NO: 44091 - DNA, 21 bp, Artificial Sequence
  Description of Artificial Sequence: Synthetic oligonucleotide
cacgccaccagcggcaccaga

SEQ ID NO: 44092 - DNA, 21 bp, Artificial Sequence
  Description of Artificial Sequence: Synthetic oligonucleotide
gacagagtcaccggcaaaatg

SEQ ID NO: 44093 - DNA, 21 bp, Artificial Sequence
  Description of Artificial Sequence: Synthetic oligonucleotide
tctactttttctccttctaag

SEQ ID NO: 44094 - DNA, 21 bp, Artificial Sequence
  Description of Artificial Sequence: Synthetic oligonucleotide
caaagaaacgtcagcgtcgtc

SEQ ID NO: 44095 - DNA, 21 bp, Artificial Sequence
  Description of Artificial Sequence: Synthetic oligonucleotide
gacagccccaacagaggcaga

SEQ ID NO: 44096 - DNA, 21 bp, Artificial Sequence
  Description of Artificial Sequence: Synthetic oligonucleotide
attcctcatgcggggacggcg

SEQ ID NO: 44097 - DNA, 21 bp, Artificial Sequence
  Description of Artificial Sequence: Synthetic oligonucleotide
agccacacccccaaactcgtc

SEQ ID NO: 44098 - DNA, 21 bp, Artificial Sequence
  Description of Artificial Sequence: Synthetic oligonucleotide
tttcttaagggtactggttcg

SEQ ID NO: 44099 - DNA, 21 bp, Artificial Sequence
  Description of Artificial Sequence: Synthetic oligonucleotide
agcagaagcaccggcaccctc

SEQ ID NO: 44100 - DNA, 21 bp, Artificial Sequence
  Description of Artificial Sequence: Synthetic oligonucleotide
agtcctcttcttgattataag

SEQ ID NO: 44101 - DNA, 21 bp, Artificial Sequence
  Description of Artificial Sequence: Synthetic oligonucleotide
ggtgatactcgtctgaatgcg

SEQ ID NO: 44102 - DNA, 21 bp, Artificial Sequence
  Description of Artificial Sequence: Synthetic oligonucleotide
acccaaagaagccaagccgcc

SEQ ID NO: 44103 - DNA, 21 bp, Artificial Sequence
  Description of Artificial Sequence: Synthetic oligonucleotide
gagattagtcgtcctgcttcg

SEQ ID NO: 44104 - DNA, 21 bp, Artificial Sequence
  Description of Artificial Sequence: Synthetic oligonucleotide
cgttctaatggttcggcggct

SEQ ID NO: 44105 - DNA, 21 bp, Artificial Sequence
  Description of Artificial Sequence: Synthetic oligonucleotide
tctgatcgtaatatgtctcgt

SEQ ID NO: 44106 - DNA, 21 bp, Artificial Sequence
  Description of Artificial Sequence: Synthetic oligonucleotide
tacagacacgaaagactcagc

SEQ ID NO: 44107 - DNA, 21 bp, Artificial Sequence
  Description of Artificial Sequence: Synthetic oligonucleotide
agccaacaaaccaccgaagcc

SEQ ID NO: 44108 - DNA, 21 bp, Artificial Sequence
  Description of Artificial Sequence: Synthetic oligonucleotide
cggtcgggtaatggttctttg

SEQ ID NO: 44109 - DNA, 21 bp, Artificial Sequence
  Description of Artificial Sequence: Synthetic oligonucleotide
ttcagcaccatcaaaggcgtc

SEQ ID NO: 44110 - DNA, 21 bp, Artificial Sequence
  Description of Artificial Sequence: Synthetic oligonucleotide
gttggtagtagtattaagacg

SEQ ID NO: 44111 - DNA, 21 bp, Artificial Sequence
  Description of Artificial Sequence: Synthetic oligonucleotide
ccgtcgggtcctgttaggggg

SEQ ID NO: 44112 - DNA, 21 bp, Artificial Sequence
  Description of Artificial Sequence: Synthetic oligonucleotide
gccagagaccccggcggcgtc

SEQ ID NO: 44113 - DNA, 21 bp, Artificial Sequence
  Description of Artificial Sequence: Synthetic oligonucleotide
caagtcaccggcgccagccac

SEQ ID NO: 44114 - DNA, 21 bp, Artificial Sequence
  Description of Artificial Sequence: Synthetic oligonucleotide
ctcagaaacggcatcgccagc

SEQ ID NO: 44115 - DNA, 21 bp, Artificial Sequence
  Description of Artificial Sequence: Synthetic oligonucleotide
actggttctagttcttcgcag

SEQ ID NO: 44116 - DNA, 21 bp, Artificial Sequence
  Description of Artificial Sequence: Synthetic oligonucleotide
agcaccagcagagacgccacc

SEQ ID NO: 44117 - DNA, 21 bp, Artificial Sequence
  Description of Artificial Sequence: Synthetic oligonucleotide
aacaccctccaaggccacaga

SEQ ID NO: 44118 - DNA, 21 bp, Artificial Sequence
  Description of Artificial Sequence: Synthetic oligonucleotide
atgtcgggtgttactgcgagg

SEQ ID NO: 44119 - DNA, 21 bp, Artificial Sequence
  Description of Artificial Sequence: Synthetic oligonucleotide
ccgcatactaataatcctgat

SEQ ID NO: 44120 - DNA, 21 bp, Artificial Sequence
  Description of Artificial Sequence: Synthetic oligonucleotide
caccaacccgaaaaaatcgcc

SEQ ID NO: 44121 - DNA, 21 bp, Artificial Sequence
  Description of Artificial Sequence: Synthetic oligonucleotide
ggggcttcgactcctaggctt

SEQ ID NO: 44122 - DNA, 21 bp, Artificial Sequence
  Description of Artificial Sequence: Synthetic oligonucleotide
cccaccatgcaaggcgtccac

SEQ ID NO: 44123 - DNA, 21 bp, Artificial Sequence
  Description of Artificial Sequence: Synthetic oligonucleotide
agcaccatgaccaccagaaga

SEQ ID NO: 44124 - DNA, 21 bp, Artificial Sequence
  Description of Artificial Sequence: Synthetic oligonucleotide
gattcgactcttggtcagtct

SEQ ID NO: 44125 - DNA, 21 bp, Artificial Sequence
  Description of Artificial Sequence: Synthetic oligonucleotide
gtcgccaccagaggcgaccac

SEQ ID NO: 44126 - DNA, 21 bp, Artificial Sequence
  Description of Artificial Sequence: Synthetic oligonucleotide
tgtcttactgatgctcgggct

SEQ ID NO: 44127 - DNA, 21 bp, Artificial Sequence
  Description of Artificial Sequence: Synthetic oligonucleotide
tctactaatggtaatggtttg

SEQ ID NO: 44128 - DNA, 21 bp, Artificial Sequence
  Description of Artificial Sequence: Synthetic oligonucleotide
tataatcatggtagtgtggat

SEQ ID NO: 44129 - DNA, 21 bp, Artificial Sequence
  Description of Artificial Sequence: Synthetic oligonucleotide
cacgacagcagcgccagaacc

SEQ ID NO: 44130 - DNA, 21 bp, Artificial Sequence
  Description of Artificial Sequence: Synthetic oligonucleotide
gtcagcgacagcaacaccaaa

SEQ ID NO: 44131 - DNA, 21 bp, Artificial Sequence
  Description of Artificial Sequence: Synthetic oligonucleotide
cacaccaccggcatcatcggc

SEQ ID NO: 44132 - DNA, 21 bp, Artificial Sequence
  Description of Artificial Sequence: Synthetic oligonucleotide
gcgtcgtctttgttgaatgtg

SEQ ID NO: 44133 - DNA, 21 bp, Artificial Sequence
  Description of Artificial Sequence: Synthetic oligonucleotide
ccctacgcccccagaaaagac

SEQ ID NO: 44134 - DNA, 21 bp, Artificial Sequence
  Description of Artificial Sequence: Synthetic oligonucleotide
tcggtgacgggtggtcggggt

SEQ ID NO: 44135 - DNA, 21 bp, Artificial Sequence
  Description of Artificial Sequence: Synthetic oligonucleotide
actttgccgacgtcgattagg

SEQ ID NO: 44136 - DNA, 21 bp, Artificial Sequence
  Description of Artificial Sequence: Synthetic oligonucleotide
ggcagacacggcgcccccacc

SEQ ID NO: 44137 - DNA, 21 bp, Artificial Sequence
  Description of Artificial Sequence: Synthetic oligonucleotide
aagtctactcatgggatgact

SEQ ID NO: 44138 - DNA, 21 bp, Artificial Sequence
  Description of Artificial Sequence: Synthetic oligonucleotide
aacctccacgccacccccctc

SEQ ID NO: 44139 - DNA, 21 bp, Artificial Sequence
  Description of Artificial Sequence: Synthetic oligonucleotide
gtgtctgggcagacgtctggt

SEQ ID NO: 44140 - DNA, 21 bp, Artificial Sequence
  Description of Artificial Sequence: Synthetic oligonucleotide
cccggcagagaaaaaaccgtc

SEQ ID NO: 44141 - DNA, 21 bp, Artificial Sequence
  Description of Artificial Sequence: Synthetic oligonucleotide
ccgacgagtagtccgcagagg

SEQ ID NO: 44142 - DNA, 21 bp, Artificial Sequence
  Description of Artificial Sequence: Synthetic oligonucleotide
accaccatgagcaaagtcggc

SEQ ID NO: 44143 - DNA, 21 bp, Artificial Sequence
  Description of Artificial Sequence: Synthetic oligonucleotide
acttataatagtagtcaggcg

SEQ ID NO: 44144 - DNA, 21 bp, Artificial Sequence
  Description of Artificial Sequence: Synthetic oligonucleotide
cttaatgttggttctgtgagg

SEQ ID NO: 44145 - DNA, 21 bp, Artificial Sequence
  Description of Artificial Sequence: Synthetic oligonucleotide
agagacgccaccagcatcggc

SEQ ID NO: 44146 - DNA, 21 bp, Artificial Sequence
  Description of Artificial Sequence: Synthetic oligonucleotide
gtcagcaccggcagcttcacc

SEQ ID NO: 44147 - DNA, 21 bp, Artificial Sequence
  Description of Artificial Sequence: Synthetic oligonucleotide
cggtttgattctgttaaggat

SEQ ID NO: 44148 - DNA, 21 bp, Artificial Sequence
  Description of Artificial Sequence: Synthetic oligonucleotide
ctcctcggcgacaccaaaccc

SEQ ID NO: 44149 - DNA, 21 bp, Artificial Sequence
  Description of Artificial Sequence: Synthetic oligonucleotide
ggttctaagaatgcggattat

SEQ ID NO: 44150 - DNA, 21 bp, Artificial Sequence
  Description of Artificial Sequence: Synthetic oligonucleotide
aataatgggaggcctattgcg

SEQ ID NO: 44151 - DNA, 21 bp, Artificial Sequence
  Description of Artificial Sequence: Synthetic oligonucleotide
gaagtccccaaacccggcaga

SEQ ID NO: 44152 - DNA, 21 bp, Artificial Sequence
  Description of Artificial Sequence: Synthetic oligonucleotide
aacacccacaacatccaaggc

SEQ ID NO: 44153 - DNA, 21 bp, Artificial Sequence
  Description of Artificial Sequence: Synthetic oligonucleotide
tctggtcgtgataagtttagt

SEQ ID NO: 44154 - DNA, 21 bp, Artificial Sequence
  Description of Artificial Sequence: Synthetic oligonucleotide
cccagaaccgacagaaacacc

SEQ ID NO: 44155 - DNA, 21 bp, Artificial Sequence
  Description of Artificial Sequence: Synthetic oligonucleotide
gttagtagtcctcgtatgagt

SEQ ID NO: 44156 - DNA, 21 bp, Artificial Sequence
  Description of Artificial Sequence: Synthetic oligonucleotide
caaacccacgcccccaccagc

SEQ ID NO: 44157 - DNA, 21 bp, Artificial Sequence
  Description of Artificial Sequence: Synthetic oligonucleotide
tctgattctcgtaatacgaat

SEQ ID NO: 44158 - DNA, 21 bp, Artificial Sequence
  Description of Artificial Sequence: Synthetic oligonucleotide
agacaaaccacccccctcggc

SEQ ID NO: 44159 - DNA, 21 bp, Artificial Sequence
  Description of Artificial Sequence: Synthetic oligonucleotide
gaagccaccagcagcaccaaa

SEQ ID NO: 44160 - DNA, 21 bp, Artificial Sequence
  Description of Artificial Sequence: Synthetic oligonucleotide
ggttctcggaattcgagtgcg

SEQ ID NO: 44161 - DNA, 21 bp, Artificial Sequence
  Description of Artificial Sequence: Synthetic oligonucleotide
cttaatattgctaatagtaag

SEQ ID NO: 44162 - DNA, 21 bp, Artificial Sequence
  Description of Artificial Sequence: Synthetic oligonucleotide
ctcatgagcaacaaccaaccc

SEQ ID NO: 44163 - DNA, 21 bp, Artificial Sequence
  Description of Artificial Sequence: Synthetic oligonucleotide
catcttgctatgaatcgtaat

SEQ ID NO: 44164 - DNA, 21 bp, Artificial Sequence
  Description of Artificial Sequence: Synthetic oligonucleotide
agcgtcagcagccccagagac

SEQ ID NO: 44165 - DNA, 21 bp, Artificial Sequence
  Description of Artificial Sequence: Synthetic oligonucleotide
attatggataagcatcttaat

SEQ ID NO: 44166 - DNA, 21 bp, Artificial Sequence
  Description of Artificial Sequence: Synthetic oligonucleotide
agggggctggattctattaat

SEQ ID NO: 44167 - DNA, 21 bp, Artificial Sequence
  Description of Artificial Sequence: Synthetic oligonucleotide
ggggctaagccgggtttggct

SEQ ID NO: 44168 - DNA, 21 bp, Artificial Sequence
  Description of Artificial Sequence: Synthetic oligonucleotide
gttaggtctagggagagtcct

SEQ ID NO: 44169 - DNA, 21 bp, Artificial Sequence
  Description of Artificial Sequence: Synthetic oligonucleotide
actgttaatacgcggtctgcg

SEQ ID NO: 44170 - DNA, 21 bp, Artificial Sequence
  Description of Artificial Sequence: Synthetic oligonucleotide
ggtacgcctaataatcgttct

SEQ ID NO: 44171 - DNA, 21 bp, Artificial Sequence
  Description of Artificial Sequence: Synthetic oligonucleotide
gaggggcttaatactagtcgt

SEQ ID NO: 44172 - DNA, 21 bp, Artificial Sequence
  Description of Artificial Sequence: Synthetic oligonucleotide
ccggggctttctaattcgcgt

SEQ ID NO: 44173 - DNA, 21 bp, Artificial Sequence
  Description of Artificial Sequence: Synthetic oligonucleotide
gtcggcaacaacaacagactc

SEQ ID NO: 44174 - DNA, 21 bp, Artificial Sequence
  Description of Artificial Sequence: Synthetic oligonucleotide
cccatggaagtcagaagcgac

SEQ ID NO: 44175 - DNA, 21 bp, Artificial Sequence
  Description of Artificial Sequence: Synthetic oligonucleotide
ctccccatcaccgccagaaac

SEQ ID NO: 44176 - DNA, 21 bp, Artificial Sequence
  Description of Artificial Sequence: Synthetic oligonucleotide
gctcagcggtcgactatggtg

SEQ ID NO: 44177 - DNA, 21 bp, Artificial Sequence
  Description of Artificial Sequence: Synthetic oligonucleotide
ggtaattctatggctgggact

SEQ ID NO: 44178 - DNA, 21 bp, Artificial Sequence
  Description of Artificial Sequence: Synthetic oligonucleotide
ccgttgcctaagaatagtagt

SEQ ID NO: 44179 - DNA, 21 bp, Artificial Sequence
  Description of Artificial Sequence: Synthetic oligonucleotide
tcgggttctagtaagccgact

SEQ ID NO: 44180 - DNA, 21 bp, Artificial Sequence
  Description of Artificial Sequence: Synthetic oligonucleotide
atcaacttcagcggcaccaga

SEQ ID NO: 44181 - DNA, 21 bp, Artificial Sequence
  Description of Artificial Sequence: Synthetic oligonucleotide
agccccatgggcgtcaccaga

SEQ ID NO: 44182 - DNA, 21 bp, Artificial Sequence
  Description of Artificial Sequence: Synthetic oligonucleotide
atgtaccaaaaacccgccagc

SEQ ID NO: 44183 - DNA, 21 bp, Artificial Sequence
  Description of Artificial Sequence: Synthetic oligonucleotide
gggacttttagtactcagagt

SEQ ID NO: 44184 - DNA, 21 bp, Artificial Sequence
  Description of Artificial Sequence: Synthetic oligonucleotide
gccaacaccagcggccaagcc

SEQ ID NO: 44185 - DNA, 21 bp, Artificial Sequence
  Description of Artificial Sequence: Synthetic oligonucleotide
ttcggcagcagaaacgaaggc

SEQ ID NO: 44186 - DNA, 21 bp, Artificial Sequence
  Description of Artificial Sequence: Synthetic oligonucleotide
cctggtgatagtggtaaggtt

SEQ ID NO: 44187 - DNA, 21 bp, Artificial Sequence
  Description of Artificial Sequence: Synthetic oligonucleotide
aatgcttcgacggctaatatg

SEQ ID NO: 44188 - DNA, 21 bp, Artificial Sequence
  Description of Artificial Sequence: Synthetic oligonucleotide
aatagtcgtgagtcgcagggg

SEQ ID NO: 44189 - DNA, 21 bp, Artificial Sequence
  Description of Artificial Sequence: Synthetic oligonucleotide
tcgggtgcggggtcggctggg

SEQ ID NO: 44190 - DNA, 21 bp, Artificial Sequence
  Description of Artificial Sequence: Synthetic oligonucleotide
gctactgggaatgggcggggg

SEQ ID NO: 44191 - DNA, 21 bp, Artificial Sequence
  Description of Artificial Sequence: Synthetic oligonucleotide
ctcaccgccaaaagcagccaa

SEQ ID NO: 44192 - DNA, 21 bp, Artificial Sequence
  Description of Artificial Sequence: Synthetic oligonucleotide
tcgagttatacgggtcagagg

SEQ ID NO: 44193 - DNA, 21 bp, Artificial Sequence
  Description of Artificial Sequence: Synthetic oligonucleotide
cagtctcttacgcggactcat

SEQ ID NO: 44194 - DNA, 21 bp, Artificial Sequence
  Description of Artificial Sequence: Synthetic oligonucleotide
aattcggcgagtctgaatcat

SEQ ID NO: 44195 - DNA, 21 bp, Artificial Sequence
  Description of Artificial Sequence: Synthetic oligonucleotide
ttgaatcagcattcgagtctt

SEQ ID NO: 44196 - DNA, 21 bp, Artificial Sequence
  Description of Artificial Sequence: Synthetic oligonucleotide
cctactttggggggtccgatg

SEQ ID NO: 44197 - DNA, 21 bp, Artificial Sequence
  Description of Artificial Sequence: Synthetic oligonucleotide
cctaatgttggtgttgttagg

SEQ ID NO: 44198 - DNA, 21 bp, Artificial Sequence
  Description of Artificial Sequence: Synthetic oligonucleotide
tcttctgctccgagtctttct

SEQ ID NO: 44199 - DNA, 21 bp, Artificial Sequence
  Description of Artificial Sequence: Synthetic oligonucleotide
cccctcagcaaaagcgccctc

SEQ ID NO: 44200 - DNA, 21 bp, Artificial Sequence
  Description of Artificial Sequence: Synthetic oligonucleotide
tacgccaccgacggcctcaaa

SEQ ID NO: 44201 - DNA, 21 bp, Artificial Sequence
  Description of Artificial Sequence: Synthetic oligonucleotide
gacatcagcagaagccacggc

SEQ ID NO: 44202 - DNA, 21 bp, Artificial Sequence
  Description of Artificial Sequence: Synthetic oligonucleotide
ggcaccgccagaaccaccggc

SEQ ID NO: 44203 - DNA, 21 bp, Artificial Sequence
  Description of Artificial Sequence: Synthetic oligonucleotide
tgcagacacacccccggcaac

SEQ ID NO: 44204 - DNA, 21 bp, Artificial Sequence
  Description of Artificial Sequence: Synthetic oligonucleotide
tgcccccaaagcagagaaaaa

SEQ ID NO: 44205 - DNA, 21 bp, Artificial Sequence
  Description of Artificial Sequence: Synthetic oligonucleotide
catactactggtattattggg

SEQ ID NO: 44206 - DNA, 21 bp, Artificial Sequence
  Description of Artificial Sequence: Synthetic oligonucleotide
gggctggttcctaatttgatt

SEQ ID NO: 44207 - DNA, 21 bp, Artificial Sequence
  Description of Artificial Sequence: Synthetic oligonucleotide
ttcaccgccagcggcggcaac

SEQ ID NO: 44208 - DNA, 21 bp, Artificial Sequence
  Description of Artificial Sequence: Synthetic oligonucleotide
tctattaagtctgttactaat

SEQ ID NO: 44209 - DNA, 21 bp, Artificial Sequence
  Description of Artificial Sequence: Synthetic oligonucleotide
agctacagcagcagccaactc

SEQ ID NO: 44210 - DNA, 21 bp, Artificial Sequence
  Description of Artificial Sequence: Synthetic oligonucleotide
ttgagttcggataagaatgtt

SEQ ID NO: 44211 - DNA, 21 bp, Artificial Sequence
  Description of Artificial Sequence: Synthetic oligonucleotide
gataggtataatcgtcagctt

SEQ ID NO: 44212 - DNA, 21 bp, Artificial Sequence
  Description of Artificial Sequence: Synthetic oligonucleotide
agcagcgaccaacccagactc

SEQ ID NO: 44213 - DNA, 21 bp, Artificial Sequence
  Description of Artificial Sequence: Synthetic oligonucleotide
cattataatcagactggtttg

SEQ ID NO: 44214 - DNA, 21 bp, Artificial Sequence
  Description of Artificial Sequence: Synthetic oligonucleotide
ggtgggactaataatcttaat

SEQ ID NO: 44215 - DNA, 21 bp, Artificial Sequence
  Description of Artificial Sequence: Synthetic oligonucleotide
caagtccccgtcagacccgtc

SEQ ID NO: 44216 - DNA, 21 bp, Artificial Sequence
  Description of Artificial Sequence: Synthetic oligonucleotide
atccaaacccacaccagcaac

SEQ ID NO: 44217 - DNA, 21 bp, Artificial Sequence
  Description of Artificial Sequence: Synthetic oligonucleotide
caatacaaccaagccggcctc

SEQ ID NO: 44218 - DNA, 21 bp, Artificial Sequence
  Description of Artificial Sequence: Synthetic oligonucleotide
tatgagaagaatagtctgatg

SEQ ID NO: 44219 - DNA, 21 bp, Artificial Sequence
  Description of Artificial Sequence: Synthetic oligonucleotide
aacgacgtcaaacaaggccac

SEQ ID NO: 44220 - DNA, 21 bp, Artificial Sequence
  Description of Artificial Sequence: Synthetic oligonucleotide
aattctattactcggagtagt

SEQ ID NO: 44221 - DNA, 21 bp, Artificial Sequence
  Description of Artificial Sequence: Synthetic oligonucleotide
ccccaacacagcgtctacagc

SEQ ID NO: 44222 - DNA, 21 bp, Artificial Sequence
  Description of Artificial Sequence: Synthetic oligonucleotide
gataagactgagtcgttgggg

SEQ ID NO: 44223 - DNA, 21 bp, Artificial Sequence
  Description of Artificial Sequence: Synthetic oligonucleotide
tctacttcgggtacgagtagt

SEQ ID NO: 44224 - DNA, 21 bp, Artificial Sequence
  Description of Artificial Sequence: Synthetic oligonucleotide
attacggcgacggcggagagt

SEQ ID NO: 44225 - DNA, 21 bp, Artificial Sequence
  Description of Artificial Sequence: Synthetic oligonucleotide
atgagttctgagcgtccgggt

SEQ ID NO: 44226 - DNA, 21 bp, Artificial Sequence
  Description of Artificial Sequence: Synthetic oligonucleotide
catcagctggaggctcataag

SEQ ID NO: 44227 - DNA, 21 bp, Artificial Sequence
  Description of Artificial Sequence: Synthetic oligonucleotide
actacgcattcgtctattaat

SEQ ID NO: 44228 - DNA, 21 bp, Artificial Sequence
  Description of Artificial Sequence: Synthetic oligonucleotide
tatcgggttggttcgatttct

SEQ ID NO: 44229 - DNA, 21 bp, Artificial Sequence
  Description of Artificial Sequence: Synthetic oligonucleotide
cggtttgattctgttaaggat

SEQ ID NO: 44230 - DNA, 21 bp, Artificial Sequence
  Description of Artificial Sequence: Synthetic oligonucleotide
ttggggtctagtactattttg

SEQ ID NO: 44231 - DNA, 21 bp, Artificial Sequence
  Description of Artificial Sequence: Synthetic oligonucleotide
cgtctttctaatgcttatgct

SEQ ID NO: 44232 - DNA, 21 bp, Artificial Sequence
  Description of Artificial Sequence: Synthetic oligonucleotide
gccagcctcaaaacccaaatg

SEQ ID NO: 44233 - DNA, 21 bp, Artificial Sequence
  Description of Artificial Sequence: Synthetic oligonucleotide
gcgggtggtattaataagctt

SEQ ID NO: 44234 - DNA, 21 bp, Artificial Sequence
  Description of Artificial Sequence: Synthetic oligonucleotide
aatacttatcagtctaagaat

SEQ ID NO: 44235 - DNA, 21 bp, Artificial Sequence
  Description of Artificial Sequence: Synthetic oligonucleotide
agtactatgaagagtgcggcg

SEQ ID NO: 44236 - DNA, 21 bp, Artificial Sequence
  Description of Artificial Sequence: Synthetic oligonucleotide
agagacctcggccacgacaac

SEQ ID NO: 44237 - DNA, 21 bp, Artificial Sequence
  Description of Artificial Sequence: Synthetic oligonucleotide
atgacggcttctttggggatg

SEQ ID NO: 44238 - DNA, 21 bp, Artificial Sequence
  Description of Artificial Sequence: Synthetic oligonucleotide
cgtcagattggtaagcaggtg

SEQ ID NO: 44239 - DNA, 21 bp, Artificial Sequence
  Description of Artificial Sequence: Synthetic oligonucleotide
gtcctcgccaccaaagactgc

SEQ ID NO: 44240 - DNA, 21 bp, Artificial Sequence
  Description of Artificial Sequence: Synthetic oligonucleotide
ggtgttaataataatattaat

SEQ ID NO: 44241 - DNA, 21 bp, Artificial Sequence
  Description of Artificial Sequence: Synthetic oligonucleotide
aagacgggggatcagatgggg

SEQ ID NO: 44242 - DNA, 21 bp, Artificial Sequence
  Description of Artificial Sequence: Synthetic oligonucleotide
gtttcgggtatgagtgggagt

SEQ ID NO: 44243 - DNA, 21 bp, Artificial Sequence
  Description of Artificial Sequence: Synthetic oligonucleotide
ccggattctactttttcgagt

SEQ ID NO: 44244 - DNA, 21 bp, Artificial Sequence
  Description of Artificial Sequence: Synthetic oligonucleotide
ctcatcctccccggcaacaac

SEQ ID NO: 44245 - DNA, 21 bp, Artificial Sequence
  Description of Artificial Sequence: Synthetic oligonucleotide
ggttctaatattaataatggt

SEQ ID NO: 44246 - DNA, 21 bp, Artificial Sequence
  Description of Artificial Sequence: Synthetic oligonucleotide
aagaatggttctgtggctctt

SEQ ID NO: 44247 - DNA, 21 bp, Artificial Sequence
  Description of Artificial Sequence: Synthetic oligonucleotide
aagtttcctccgaattctggg

SEQ ID NO: 44248 - DNA, 21 bp, Artificial Sequence
  Description of Artificial Sequence: Synthetic oligonucleotide
attaatactgggagtgttaag

SEQ ID NO: 44249 - DNA, 21 bp, Artificial Sequence
  Description of Artificial Sequence: Synthetic oligonucleotide
gagaataacgcgctttcgagg

SEQ ID NO: 44250 - DNA, 21 bp, Artificial Sequence
  Description of Artificial Sequence: Synthetic oligonucleotide
agccccagagacagaaccagc

SEQ ID NO: 44251 - DNA, 21 bp, Artificial Sequence
  Description of Artificial Sequence: Synthetic oligonucleotide
cacagcgaaaacggcaacaga

SEQ ID NO: 44252 - DNA, 21 bp, Artificial Sequence
  Description of Artificial Sequence: Synthetic oligonucleotide
tacagaagcaaagaaatcggc

SEQ ID NO: 44253 - DNA, 21 bp, Artificial Sequence
  Description of Artificial Sequence: Synthetic oligonucleotide
ggcagcgccggcaacatgctc

SEQ ID NO: 44254 - DNA, 21 bp, Artificial Sequence
  Description of Artificial Sequence: Synthetic oligonucleotide
aatattgctcagaaggagttg

SEQ ID NO: 44255 - DNA, 21 bp, Artificial Sequence
  Description of Artificial Sequence: Synthetic oligonucleotide
ccccaaaacaaccaagcccac

SEQ ID NO: 44256 - DNA, 21 bp, Artificial Sequence
  Description of Artificial Sequence: Synthetic oligonucleotide
ctgtcgaatcagaataatcag

SEQ ID NO: 44257 - DNA, 21 bp, Artificial Sequence
  Description of Artificial Sequence: Synthetic oligonucleotide
gagagtaattcgagtcggggg

SEQ ID NO: 44258 - DNA, 21 bp, Artificial Sequence
  Description of Artificial Sequence: Synthetic oligonucleotide
aacagcagcggccaaaacccc

SEQ ID NO: 44259 - DNA, 21 bp, Artificial Sequence
  Description of Artificial Sequence: Synthetic oligonucleotide
tctaatgtggctaagcgtact

SEQ ID NO: 44260 - DNA, 21 bp, Artificial Sequence
  Description of Artificial Sequence: Synthetic oligonucleotide
gttagtaagagtccgtctact

SEQ ID NO: 44261 - DNA, 21 bp, Artificial Sequence
  Description of Artificial Sequence: Synthetic oligonucleotide
agcagagaaaaaaacaacgcc

SEQ ID NO: 44262 - DNA, 21 bp, Artificial Sequence
  Description of Artificial Sequence: Synthetic oligonucleotide
ggggttagtaatctggcttcg

SEQ ID NO: 44263 - DNA, 21 bp, Artificial Sequence
  Description of Artificial Sequence: Synthetic oligonucleotide
gagcggaatgggaattttacg

SEQ ID NO: 44264 - DNA, 21 bp, Artificial Sequence
  Description of Artificial Sequence: Synthetic oligonucleotide
gatcagggtaatggttatggg

SEQ ID NO: 44265 - DNA, 21 bp, Artificial Sequence
  Description of Artificial Sequence: Synthetic oligonucleotide
tgcagaagcgcccccaccaga

SEQ ID NO: 44266 - DNA, 21 bp, Artificial Sequence
  Description of Artificial Sequence: Synthetic oligonucleotide
gacagcaaacaaaacctcacc

SEQ ID NO: 44267 - DNA, 21 bp, Artificial Sequence
  Description of Artificial Sequence: Synthetic oligonucleotide
aacggcagcgcccaaaaccaa

SEQ ID NO: 44268 - DNA, 21 bp, Artificial Sequence
  Description of Artificial Sequence: Synthetic oligonucleotide
ctcagagaaggcgaaagaacc

SEQ ID NO: 44269 - DNA, 21 bp, Artificial Sequence
  Description of Artificial Sequence: Synthetic oligonucleotide
tctactagtcgtctgccgagt

SEQ ID NO: 44270 - DNA, 21 bp, Artificial Sequence
  Description of Artificial Sequence: Synthetic oligonucleotide
tcttcgtcggcgaagtctatt

SEQ ID NO: 44271 - DNA, 21 bp, Artificial Sequence
  Description of Artificial Sequence: Synthetic oligonucleotide
ggtcatgtgtcttcgtatatg

SEQ ID NO: 44272 - DNA, 21 bp, Artificial Sequence
  Description of Artificial Sequence: Synthetic oligonucleotide
caagccaaaaacatccacagc

SEQ ID NO: 44273 - DNA, 21 bp, Artificial Sequence
  Description of Artificial Sequence: Synthetic oligonucleotide
cttaatagtatgtctcctagg

SEQ ID NO: 44274 - DNA, 21 bp, Artificial Sequence
  Description of Artificial Sequence: Synthetic oligonucleotide
atgagtcatactaataggccg

SEQ ID NO: 44275 - DNA, 21 bp, Artificial Sequence
  Description of Artificial Sequence: Synthetic oligonucleotide
gggtcgaataggatgagtagt

SEQ ID NO: 44276 - DNA, 21 bp, Artificial Sequence
  Description of Artificial Sequence: Synthetic oligonucleotide
cacatgaacagaaaactcgaa

SEQ ID NO: 44277 - DNA, 21 bp, Artificial Sequence
  Description of Artificial Sequence: Synthetic oligonucleotide
tctgataggtcggttgatggg

SEQ ID NO: 44278 - DNA, 21 bp, Artificial Sequence
  Description of Artificial Sequence: Synthetic oligonucleotide
catacggctaatagtcagagt

SEQ ID NO: 44279 - DNA, 21 bp, Artificial Sequence
  Description of Artificial Sequence: Synthetic oligonucleotide
cctagtactggtaattcggtg

SEQ ID NO: 44280 - DNA, 21 bp, Artificial Sequence
  Description of Artificial Sequence: Synthetic oligonucleotide
actagtcatatgcagcttagt

SEQ ID NO: 44281 - DNA, 21 bp, Artificial Sequence
  Description of Artificial Sequence: Synthetic oligonucleotide
gtgagtgataatacttataag

SEQ ID NO: 44282 - DNA, 21 bp, Artificial Sequence
  Description of Artificial Sequence: Synthetic oligonucleotide
tttcggcagactagtgggaat

SEQ ID NO: 44283 - DNA, 21 bp, Artificial Sequence
  Description of Artificial Sequence: Synthetic oligonucleotide
gtgcatacttcgggggtgcag

SEQ ID NO: 44284 - DNA, 21 bp, Artificial Sequence
  Description of Artificial Sequence: Synthetic oligonucleotide
cctcagtcgtctcatcagacg

SEQ ID NO: 44285 - DNA, 21 bp, Artificial Sequence
  Description of Artificial Sequence: Synthetic oligonucleotide
cacggcatggaagtcgccaga

SEQ ID NO: 44286 - DNA, 21 bp, Artificial Sequence
  Description of Artificial Sequence: Synthetic oligonucleotide
actgaggctcggtcggcgaat

SEQ ID NO: 44287 - DNA, 21 bp, Artificial Sequence
  Description of Artificial Sequence: Synthetic oligonucleotide
tctaatacgaatgctgctatg

SEQ ID NO: 44288 - DNA, 21 bp, Artificial Sequence
  Description of Artificial Sequence: Synthetic oligonucleotide
caactcggcgacagaaacaga

SEQ ID NO: 44289 - DNA, 21 bp, Artificial Sequence
  Description of Artificial Sequence: Synthetic oligonucleotide
actccgagtgttactaatatg

SEQ ID NO: 44290 - DNA, 21 bp, Artificial Sequence
  Description of Artificial Sequence: Synthetic oligonucleotide
aatttgggtaattctctgaag

SEQ ID NO: 44291 - DNA, 21 bp, Artificial Sequence
  Description of Artificial Sequence: Synthetic oligonucleotide
agtctgattacgatgaaggat

SEQ ID NO: 44292 - DNA, 21 bp, Artificial Sequence
  Description of Artificial Sequence: Synthetic oligonucleotide
tcgagtccgtctaatatggcg

SEQ ID NO: 44293 - DNA, 21 bp, Artificial Sequence
  Description of Artificial Sequence: Synthetic oligonucleotide
cccagcctcgaaagaggcagc

SEQ ID NO: 44294 - DNA, 21 bp, Artificial Sequence
  Description of Artificial Sequence: Synthetic oligonucleotide
caaaccagcagccacgcctac

SEQ ID NO: 44295 - DNA, 21 bp, Artificial Sequence
  Description of Artificial Sequence: Synthetic oligonucleotide
ggcgtcgaaagaatgagaggc

SEQ ID NO: 44296 - DNA, 21 bp, Artificial Sequence
  Description of Artificial Sequence: Synthetic oligonucleotide
gactacagcgaaaccagaaga

SEQ ID NO: 44297 - DNA, 21 bp, Artificial Sequence
  Description of Artificial Sequence: Synthetic oligonucleotide
ttccccaacgtcaacagcgcc

SEQ ID NO: 44298 - DNA, 21 bp, Artificial Sequence
  Description of Artificial Sequence: Synthetic oligonucleotide
catggttctaagccgtatatt

SEQ ID NO: 44299 - DNA, 21 bp, Artificial Sequence
  Description of Artificial Sequence: Synthetic oligonucleotide
agatacccccccgccacccac

SEQ ID NO: 44300 - DNA, 21 bp, Artificial Sequence
  Description of Artificial Sequence: Synthetic oligonucleotide
gctacggtttctaagacggct

SEQ ID NO: 44301 - DNA, 21 bp, Artificial Sequence
  Description of Artificial Sequence: Synthetic oligonucleotide
ggtccggatacgcattctcag

SEQ ID NO: 44302 - DNA, 21 bp, Artificial Sequence
  Description of Artificial Sequence: Synthetic oligonucleotide
ggggatctgaatcctccttct

SEQ ID NO: 44303 - DNA, 21 bp, Artificial Sequence
  Description of Artificial Sequence: Synthetic oligonucleotide
gctcagcgtaatatttcttcg

SEQ ID NO: 44304 - DNA, 21 bp, Artificial Sequence
  Description of Artificial Sequence: Synthetic oligonucleotide
cggactaatgttatggcgggg

SEQ ID NO: 44305 - DNA, 21 bp, Artificial Sequence
  Description of Artificial Sequence: Synthetic oligonucleotide
acccccacccccgtcaaccaa

SEQ ID NO: 44306 - DNA, 21 bp, Artificial Sequence
  Description of Artificial Sequence: Synthetic oligonucleotide
attcatgcgactagtctggct

SEQ ID NO: 44307 - DNA, 21 bp, Artificial Sequence
  Description of Artificial Sequence: Synthetic oligonucleotide
cagagtgagattgtgaataag

SEQ ID NO: 44308 - DNA, 21 bp, Artificial Sequence
  Description of Artificial Sequence: Synthetic oligonucleotide
ttcaacagcagcagcagcaaa

SEQ ID NO: 44309 - DNA, 21 bp, Artificial Sequence
  Description of Artificial Sequence: Synthetic oligonucleotide
tggcagacgggttcgactatg

SEQ ID NO: 44310 - DNA, 21 bp, Artificial Sequence
  Description of Artificial Sequence: Synthetic oligonucleotide
accagcctcagccccagcgtc

SEQ ID NO: 44311 - DNA, 21 bp, Artificial Sequence
  Description of Artificial Sequence: Synthetic oligonucleotide
tattctactcatttgaataat

SEQ ID NO: 44312 - DNA, 21 bp, Artificial Sequence
  Description of Artificial Sequence: Synthetic oligonucleotide
gtgactaattctgctcctact

SEQ ID NO: 44313 - DNA, 21 bp, Artificial Sequence
  Description of Artificial Sequence: Synthetic oligonucleotide
caggataagcataatcctggt

SEQ ID NO: 44314 - DNA, 21 bp, Artificial Sequence
  Description of Artificial Sequence: Synthetic oligonucleotide
gatgggggtaatcagaggagt

SEQ ID NO: 44315 - DNA, 21 bp, Artificial Sequence
  Description of Artificial Sequence: Synthetic oligonucleotide
catcagcctgagaagattgct

SEQ ID NO: 44316 - DNA, 21 bp, Artificial Sequence
  Description of Artificial Sequence: Synthetic oligonucleotide
tacatcgacgccagcgccaga

SEQ ID NO: 44317 - DNA, 21 bp, Artificial Sequence
  Description of Artificial Sequence: Synthetic oligonucleotide
aatatttcgtctaaggttgcg

SEQ ID NO: 44318 - DNA, 21 bp, Artificial Sequence
  Description of Artificial Sequence: Synthetic oligonucleotide
atggccaccgcccacggcggc

SEQ ID NO: 44319 - DNA, 21 bp, Artificial Sequence
  Description of Artificial Sequence: Synthetic oligonucleotide
tgcagcaccggcaccagaaaa

SEQ ID NO: 44320 - DNA, 21 bp, Artificial Sequence
  Description of Artificial Sequence: Synthetic oligonucleotide
agtgggtctctttcttctgct

SEQ ID NO: 44321 - DNA, 21 bp, Artificial Sequence
  Description of Artificial Sequence: Synthetic oligonucleotide
aacctcaaaaaccaagtcgcc

SEQ ID NO: 44322 - DNA, 21 bp, Artificial Sequence
  Description of Artificial Sequence: Synthetic oligonucleotide
cctcgggagaataagttttct

SEQ ID NO: 44323 - DNA, 21 bp, Artificial Sequence
  Description of Artificial Sequence: Synthetic oligonucleotide
ggtgcgcgtccggtgcttcag

SEQ ID NO: 44324 - DNA, 21 bp, Artificial Sequence
  Description of Artificial Sequence: Synthetic oligonucleotide
aatttttctaatcctacggtg

SEQ ID NO: 44325 - DNA, 21 bp, Artificial Sequence
  Description of Artificial Sequence: Synthetic oligonucleotide
cttggtaatgcgcatcagctt

SEQ ID NO: 44326 - DNA, 21 bp, Artificial Sequence
  Description of Artificial Sequence: Synthetic oligonucleotide
cacacccccgacgtcggcaaa

SEQ ID NO: 44327 - DNA, 21 bp, Artificial Sequence
  Description of Artificial Sequence: Synthetic oligonucleotide
gtcaaaagcaacaacctcccc

SEQ ID NO: 44328 - DNA, 21 bp, Artificial Sequence
  Description of Artificial Sequence: Synthetic oligonucleotide
cccagaaaagacgacagcatg

SEQ ID NO: 44329 - DNA, 21 bp, Artificial Sequence
  Description of Artificial Sequence: Synthetic oligonucleotide
ggggttccggctgggcatact

SEQ ID NO: 44330 - DNA, 21 bp, Artificial Sequence
  Description of Artificial Sequence: Synthetic oligonucleotide
gatcgtgaggctacttctcgg

SEQ ID NO: 44331 - DNA, 21 bp, Artificial Sequence
  Description of Artificial Sequence: Synthetic oligonucleotide
gccagagccgacagcaacttc

SEQ ID NO: 44332 - DNA, 21 bp, Artificial Sequence
  Description of Artificial Sequence: Synthetic oligonucleotide
gggactgttgataaggcgtct

SEQ ID NO: 44333 - DNA, 21 bp, Artificial Sequence
  Description of Artificial Sequence: Synthetic oligonucleotide
aggtcgactaatacggataat

SEQ ID NO: 44334 - DNA, 21 bp, Artificial Sequence
  Description of Artificial Sequence: Synthetic oligonucleotide
acgggtgcgggtggttattgt

SEQ ID NO: 44335 - DNA, 21 bp, Artificial Sequence
  Description of Artificial Sequence: Synthetic oligonucleotide
tatattcataatcagactggt

SEQ ID NO: 44336 - DNA, 21 bp, Artificial Sequence
  Description of Artificial Sequence: Synthetic oligonucleotide
cgtacggtgccttcgagtctt

SEQ ID NO: 44337 - DNA, 21 bp, Artificial Sequence
  Description of Artificial Sequence: Synthetic oligonucleotide
gccatgagcagcaacaacggc

SEQ ID NO: 44338 - DNA, 21 bp, Artificial Sequence
  Description of Artificial Sequence: Synthetic oligonucleotide
ggcggccacaaaagcctcaac

SEQ ID NO: 44339 - DNA, 21 bp, Artificial Sequence
  Description of Artificial Sequence: Synthetic oligonucleotide
gccttcggcggcgaaaccaaa

SEQ ID NO: 44340 - DNA, 21 bp, Artificial Sequence
  Description of Artificial Sequence: Synthetic oligonucleotide
caggggtctgggagtaatcat

SEQ ID NO: 44341 - DNA, 21 bp, Artificial Sequence
  Description of Artificial Sequence: Synthetic oligonucleotide
tgtctgcggtcttcgagtaat

SEQ ID NO: 44342 - DNA, 21 bp, Artificial Sequence
  Description of Artificial Sequence: Synthetic oligonucleotide
gagaatcggacttctgttcag

SEQ ID NO: 44343 - DNA, 21 bp, Artificial Sequence
  Description of Artificial Sequence: Synthetic oligonucleotide
aacagcgtcgccggcatgggc

SEQ ID NO: 44344 - DNA, 21 bp, Artificial Sequence
  Description of Artificial Sequence: Synthetic oligonucleotide
agcagacacgacggcaaaggc

SEQ ID NO: 44345 - DNA, 21 bp, Artificial Sequence
  Description of Artificial Sequence: Synthetic oligonucleotide
caaaaaacccaaaccaccagc

SEQ ID NO: 44346 - DNA, 21 bp, Artificial Sequence
  Description of Artificial Sequence: Synthetic oligonucleotide
cataggttgccttctcattct

SEQ ID NO: 44347 - DNA, 21 bp, Artificial Sequence
  Description of Artificial Sequence: Synthetic oligonucleotide
aataataggagtgggatgggt

SEQ ID NO: 44348 - DNA, 21 bp, Artificial Sequence
  Description of Artificial Sequence: Synthetic oligonucleotide
ggcgccaaagaaagccaaagc

SEQ ID NO: 44349 - DNA, 21 bp, Artificial Sequence
  Description of Artificial Sequence: Synthetic oligonucleotide
atgactgagagtagtcggact

SEQ ID NO: 44350 - DNA, 21 bp, Artificial Sequence
  Description of Artificial Sequence: Synthetic oligonucleotide
acggagcaggttggtacgcgt

SEQ ID NO: 44351 - DNA, 21 bp, Artificial Sequence
  Description of Artificial Sequence: Synthetic oligonucleotide
gacgtcctcagcaaaagccaa

SEQ ID NO: 44352 - DNA, 21 bp, Artificial Sequence
  Description of Artificial Sequence: Synthetic oligonucleotide
caaggcagcagcctcagaacc

SEQ ID NO: 44353 - DNA, 21 bp, Artificial Sequence
  Description of Artificial Sequence: Synthetic oligonucleotide
cttggtattatggataagggg

SEQ ID NO: 44354 - DNA, 21 bp, Artificial Sequence
  Description of Artificial Sequence: Synthetic oligonucleotide
ccgatgattaattcgagtgat

SEQ ID NO: 44355 - DNA, 21 bp, Artificial Sequence
  Description of Artificial Sequence: Synthetic oligonucleotide
ggggcttataatcatgttacg

SEQ ID NO: 44356 - DNA, 21 bp, Artificial Sequence
  Description of Artificial Sequence: Synthetic oligonucleotide
attacttcggctagtccgtgt

SEQ ID NO: 44357 - DNA, 21 bp, Artificial Sequence
  Description of Artificial Sequence: Synthetic oligonucleotide
acgtctaggggtaatttgtct

SEQ ID NO: 44358 - DNA, 21 bp, Artificial Sequence
  Description of Artificial Sequence: Synthetic oligonucleotide
actccgggtagtacgattagg

SEQ ID NO: 44359 - DNA, 21 bp, Artificial Sequence
  Description of Artificial Sequence: Synthetic oligonucleotide
ggtcctgataatggtattcag

SEQ ID NO: 44360 - DNA, 21 bp, Artificial Sequence
  Description of Artificial Sequence: Synthetic oligonucleotide
tacagcatgagacccaccgaa

SEQ ID NO: 44361 - DNA, 21 bp, Artificial Sequence
  Description of Artificial Sequence: Synthetic oligonucleotide
gatatggtgagtccgcggaat

SEQ ID NO: 44362 - DNA, 21 bp, Artificial Sequence
  Description of Artificial Sequence: Synthetic oligonucleotide
aagaatcaggcgccgttgctt

SEQ ID NO: 44363 - DNA, 21 bp, Artificial Sequence
  Description of Artificial Sequence: Synthetic oligonucleotide
ctcgacgccggcgtcgccaga

SEQ ID NO: 44364 - DNA, 21 bp, Artificial Sequence
  Description of Artificial Sequence: Synthetic oligonucleotide
cccagaaccagagaaaaccaa

SEQ ID NO: 44365 - DNA, 21 bp, Artificial Sequence
  Description of Artificial Sequence: Synthetic oligonucleotide
agaaccagcagcacctacagc

SEQ ID NO: 44366 - DNA, 21 bp, Artificial Sequence
  Description of Artificial Sequence: Synthetic oligonucleotide
agtgttgttgcgcatggtcct

SEQ ID NO: 44367 - DNA, 21 bp, Artificial Sequence
  Description of Artificial Sequence: Synthetic oligonucleotide
aatccggtggctgcggctacg

SEQ ID NO: 44368 - DNA, 21 bp, Artificial Sequence
  Description of Artificial Sequence: Synthetic oligonucleotide
ctcgcccaagaaagaggcacc

SEQ ID NO: 44369 - DNA, 21 bp, Artificial Sequence
  Description of Artificial Sequence: Synthetic oligonucleotide
gcgcataagtctgcgatgaat

SEQ ID NO: 44370 - DNA, 21 bp, Artificial Sequence
  Description of Artificial Sequence: Synthetic oligonucleotide
ttgactcagagggatttttcg

SEQ ID NO: 44371 - DNA, 21 bp, Artificial Sequence
  Description of Artificial Sequence: Synthetic oligonucleotide
cagtctggtaatacgattcag

SEQ ID NO: 44372 - DNA, 21 bp, Artificial Sequence
  Description of Artificial Sequence: Synthetic oligonucleotide
aatctgaattctgttagtaag

SEQ ID NO: 44373 - DNA, 21 bp, Artificial Sequence
  Description of Artificial Sequence: Synthetic oligonucleotide
tatggttcgaatacgccgact

SEQ ID NO: 44374 - DNA, 21 bp, Artificial Sequence
  Description of Artificial Sequence: Synthetic oligonucleotide
cgtgagggtggtcagatggtg

SEQ ID NO: 44375 - DNA, 21 bp, Artificial Sequence
  Description of Artificial Sequence: Synthetic oligonucleotide
aatgatcaggctaagttgacg

SEQ ID NO: 44376 - DNA, 21 bp, Artificial Sequence
  Description of Artificial Sequence: Synthetic oligonucleotide
gttagtgggactaagattgag

SEQ ID NO: 44377 - DNA, 21 bp, Artificial Sequence
  Description of Artificial Sequence: Synthetic oligonucleotide
cagagtcatggtattacgaat

SEQ ID NO: 44378 - DNA, 21 bp, Artificial Sequence
  Description of Artificial Sequence: Synthetic oligonucleotide
catcgggttgataatcagggg

SEQ ID NO: 44379 - DNA, 21 bp, Artificial Sequence
  Description of Artificial Sequence: Synthetic oligonucleotide
catagtacttctgggggtcat

SEQ ID NO: 44380 - DNA, 21 bp, Artificial Sequence
  Description of Artificial Sequence: Synthetic oligonucleotide
agcgacagcagaaaccccgtc

SEQ ID NO: 44381 - DNA, 21 bp, Artificial Sequence
  Description of Artificial Sequence: Synthetic oligonucleotide
gacatcaacagacaaagaacc

SEQ ID NO: 44382 - DNA, 21 bp, Artificial Sequence
  Description of Artificial Sequence: Synthetic oligonucleotide
cccggcaccggcagcaaccac

SEQ ID NO: 44383 - DNA, 21 bp, Artificial Sequence
  Description of Artificial Sequence: Synthetic oligonucleotide
agccacgacaacggccaaagc

SEQ ID NO: 44384 - DNA, 21 bp, Artificial Sequence
  Description of Artificial Sequence: Synthetic oligonucleotide
gttcttcataatgctagtagt

SEQ ID NO: 44385 - DNA, 21 bp, Artificial Sequence
  Description of Artificial Sequence: Synthetic oligonucleotide
tattctggtgctagtggtcgt

SEQ ID NO: 44386 - DNA, 21 bp, Artificial Sequence
  Description of Artificial Sequence: Synthetic oligonucleotide
agagaccacagcggcagcaga

SEQ ID NO: 44387 - DNA, 21 bp, Artificial Sequence
  Description of Artificial Sequence: Synthetic oligonucleotide
ggggtgaatttgcatgcggat

SEQ ID NO: 44388 - DNA, 21 bp, Artificial Sequence
  Description of Artificial Sequence: Synthetic oligonucleotide
gttaatggtcatggggttagt

SEQ ID NO: 44389 - DNA, 21 bp, Artificial Sequence
  Description of Artificial Sequence: Synthetic oligonucleotide
gatccgttggggaagcagggt

SEQ ID NO: 44390 - DNA, 21 bp, Artificial Sequence
  Description of Artificial Sequence: Synthetic oligonucleotide
tttgtttcgcgggagcatact

SEQ ID NO: 44391 - DNA, 21 bp, Artificial Sequence
  Description of Artificial Sequence: Synthetic oligonucleotide
aattctgcggctgctcctgct

SEQ ID NO: 44392 - DNA, 21 bp, Artificial Sequence
  Description of Artificial Sequence: Synthetic oligonucleotide
cacaccaccggcatcctcggc

SEQ ID NO: 44393 - DNA, 21 bp, Artificial Sequence
  Description of Artificial Sequence: Synthetic oligonucleotide
aatgcgcaggttacgactggt

SEQ ID NO: 44394 - DNA, 21 bp, Artificial Sequence
  Description of Artificial Sequence: Synthetic oligonucleotide
tatgcgcagtctccttcttcg

SEQ ID NO: 44395 - DNA, 21 bp, Artificial Sequence
  Description of Artificial Sequence: Synthetic oligonucleotide
aatattgctcagaaggatttg

SEQ ID NO: 44396 - DNA, 21 bp, Artificial Sequence
  Description of Artificial Sequence: Synthetic oligonucleotide
atgattcgggatggtagttct

SEQ ID NO: 44397 - DNA, 21 bp, Artificial Sequence
  Description of Artificial Sequence: Synthetic oligonucleotide
cccaacggccacgaagtcctc

SEQ ID NO: 44398 - DNA, 21 bp, Artificial Sequence
  Description of Artificial Sequence: Synthetic oligonucleotide
tctgtgagttctcctagggat

SEQ ID NO: 44399 - DNA, 21 bp, Artificial Sequence
  Description of Artificial Sequence: Synthetic oligonucleotide
agaaccctcagaagcgtcgac

SEQ ID NO: 44400 - DNA, 21 bp, Artificial Sequence
  Description of Artificial Sequence: Synthetic oligonucleotide
aattctcataatggtgcttct

SEQ ID NO: 44401 - DNA, 21 bp, Artificial Sequence
  Description of Artificial Sequence: Synthetic oligonucleotide
actttgcctacgaagtatccg

SEQ ID NO: 44402 - DNA, 21 bp, Artificial Sequence
  Description of Artificial Sequence: Synthetic oligonucleotide
ctgagtacggcgaataagtct

SEQ ID NO: 44403 - DNA, 21 bp, Artificial Sequence
  Description of Artificial Sequence: Synthetic oligonucleotide
tatccgaattctgtgcctagt

SEQ ID NO: 44404 - DNA, 21 bp, Artificial Sequence
  Description of Artificial Sequence: Synthetic oligonucleotide
atcatcagccaacacggcatg

SEQ ID NO: 44405 - DNA, 21 bp, Artificial Sequence
  Description of Artificial Sequence: Synthetic oligonucleotide
cccggccccgaagtcggcaga

SEQ ID NO: 44406 - DNA, 21 bp, Artificial Sequence
  Description of Artificial Sequence: Synthetic oligonucleotide
gccaccaacaaaaccaccaac

SEQ ID NO: 44407 - DNA, 21 bp, Artificial Sequence
  Description of Artificial Sequence: Synthetic oligonucleotide
ttgcctcatcatacttctgcg

SEQ ID NO: 44408 - DNA, 21 bp, Artificial Sequence
  Description of Artificial Sequence: Synthetic oligonucleotide
tcttatggtggtcagtcgagg

SEQ ID NO: 44409 - DNA, 21 bp, Artificial Sequence
  Description of Artificial Sequence: Synthetic oligonucleotide
catatggctgcttcgacgggt

SEQ ID NO: 44410 - DNA, 21 bp, Artificial Sequence
  Description of Artificial Sequence: Synthetic oligonucleotide
cccatccacaccagaatcgac

SEQ ID NO: 44411 - DNA, 21 bp, Artificial Sequence
  Description of Artificial Sequence: Synthetic oligonucleotide
cccagaagcctcagcaccagc

SEQ ID NO: 44412 - DNA, 21 bp, Artificial Sequence
  Description of Artificial Sequence: Synthetic oligonucleotide
agggctggtaatgctcctact

SEQ ID NO: 44413 - DNA, 21 bp, Artificial Sequence
  Description of Artificial Sequence: Synthetic oligonucleotide
ccctacgccggcaaccaaaga

SEQ ID NO: 44414 - DNA, 21 bp, Artificial Sequence
  Description of Artificial Sequence: Synthetic oligonucleotide
tcgagggattctagtattcat

SEQ ID NO: 44415 - DNA, 21 bp, Artificial Sequence
  Description of Artificial Sequence: Synthetic oligonucleotide
aacgtcaccacccccctcatc

SEQ ID NO: 44416 - DNA, 21 bp, Artificial Sequence
  Description of Artificial Sequence: Synthetic oligonucleotide
agcaaccaagtcagacaaatc

SEQ ID NO: 44417 - DNA, 21 bp, Artificial Sequence
  Description of Artificial Sequence: Synthetic oligonucleotide
acgctggataatcataggtct

SEQ ID NO: 44418 - DNA, 21 bp, Artificial Sequence
  Description of Artificial Sequence: Synthetic oligonucleotide
gaactccacagcaaaaacgcc

SEQ ID NO: 44419 - DNA, 21 bp, Artificial Sequence
  Description of Artificial Sequence: Synthetic oligonucleotide
cggtcttatgatccgaatcgg

SEQ ID NO: 44420 - DNA, 21 bp, Artificial Sequence
  Description of Artificial Sequence: Synthetic oligonucleotide
ctccccaccgacagcctcaga

SEQ ID NO: 44421 - DNA, 21 bp, Artificial Sequence
  Description of Artificial Sequence: Synthetic oligonucleotide
gaggttactaattcgcctagg

SEQ ID NO: 44422 - DNA, 21 bp, Artificial Sequence
  Description of Artificial Sequence: Synthetic oligonucleotide
ggcggccaaaccgccagaatc

SEQ ID NO: 44423 - DNA, 21 bp, Artificial Sequence
  Description of Artificial Sequence: Synthetic oligonucleotide
agcgccggcggcgccgtcagc

SEQ ID NO: 44424 - DNA, 21 bp, Artificial Sequence
  Description of Artificial Sequence: Synthetic oligonucleotide
cccagccacggcccccccgcc

SEQ ID NO: 44425 - DNA, 21 bp, Artificial Sequence
  Description of Artificial Sequence: Synthetic oligonucleotide
tacaccgccgccagccacaga

SEQ ID NO: 44426 - DNA, 21 bp, Artificial Sequence
  Description of Artificial Sequence: Synthetic oligonucleotide
atgcgtgctaatcatacttcg

SEQ ID NO: 44427 - DNA, 21 bp, Artificial Sequence
  Description of Artificial Sequence: Synthetic oligonucleotide
gatgttgcgattcagcctagg

SEQ ID NO: 44428 - DNA, 21 bp, Artificial Sequence
  Description of Artificial Sequence: Synthetic oligonucleotide
ttccccagcaacggcagaacc

SEQ ID NO: 44429 - DNA, 21 bp, Artificial Sequence
  Description of Artificial Sequence: Synthetic oligonucleotide
agcgacagcagaagcagaagc

SEQ ID NO: 44430 - DNA, 21 bp, Artificial Sequence
  Description of Artificial Sequence: Synthetic oligonucleotide
ctcatgcaaacccacggcagc

SEQ ID NO: 44431 - DNA, 21 bp, Artificial Sequence
  Description of Artificial Sequence: Synthetic oligonucleotide
atccaaagcagcgacagactc

SEQ ID NO: 44432 - DNA, 21 bp, Artificial Sequence
  Description of Artificial Sequence: Synthetic oligonucleotide
attcctgcgaattcttttaag

SEQ ID NO: 44433 - DNA, 21 bp, Artificial Sequence
  Description of Artificial Sequence: Synthetic oligonucleotide
tctatgtcgccgcgtaatggt

SEQ ID NO: 44434 - DNA, 21 bp, Artificial Sequence
  Description of Artificial Sequence: Synthetic oligonucleotide
gggacttttagtactcagagt

SEQ ID NO: 44435 - DNA, 21 bp, Artificial Sequence
  Description of Artificial Sequence: Synthetic oligonucleotide
tctgcgagtccgagtattaag

SEQ ID NO: 44436 - DNA, 21 bp, Artificial Sequence
  Description of Artificial Sequence: Synthetic oligonucleotide
tatgcttctagtagggatggt

SEQ ID NO: 44437 - DNA, 21 bp, Artificial Sequence
  Description of Artificial Sequence: Synthetic oligonucleotide
agaatgaaaagcctcgacaac

SEQ ID NO: 44438 - DNA, 21 bp, Artificial Sequence
  Description of Artificial Sequence: Synthetic oligonucleotide
cccgccgaccacggcaaactc

SEQ ID NO: 44439 - DNA, 21 bp, Artificial Sequence
  Description of Artificial Sequence: Synthetic oligonucleotide
gtcagcgacagcaacaccaaa

SEQ ID NO: 44440 - DNA, 21 bp, Artificial Sequence
  Description of Artificial Sequence: Synthetic oligonucleotide
aagttggggcaggatgtgcgg

SEQ ID NO: 44441 - DNA, 21 bp, Artificial Sequence
  Description of Artificial Sequence: Synthetic oligonucleotide
gtcggcgacagaagctggagc

SEQ ID NO: 44442 - DNA, 21 bp, Artificial Sequence
  Description of Artificial Sequence: Synthetic oligonucleotide
cgtaatggtgctatgtctaat

SEQ ID NO: 44443 - DNA, 21 bp, Artificial Sequence
  Description of Artificial Sequence: Synthetic oligonucleotide
tctaagccggctaataatgtt

SEQ ID NO: 44444 - DNA, 21 bp, Artificial Sequence
  Description of Artificial Sequence: Synthetic oligonucleotide
agaggcgccgccgacagcaac

SEQ ID NO: 44445 - DNA, 21 bp, Artificial Sequence
  Description of Artificial Sequence: Synthetic oligonucleotide
gcgcttcctgggagtactagt

SEQ ID NO: 44446 - DNA, 21 bp, Artificial Sequence
  Description of Artificial Sequence: Synthetic oligonucleotide
cacgtccaagacggcagaacc

SEQ ID NO: 44447 - DNA, 21 bp, Artificial Sequence
  Description of Artificial Sequence: Synthetic oligonucleotide
aacggcagcggccaagaccaa

SEQ ID NO: 44448 - DNA, 21 bp, Artificial Sequence
  Description of Artificial Sequence: Synthetic oligonucleotide
aatattcatttggctggtact

SEQ ID NO: 44449 - DNA, 21 bp, Artificial Sequence
  Description of Artificial Sequence: Synthetic oligonucleotide
catggtgagtctcggcaggcg

SEQ ID NO: 44450 - DNA, 21 bp, Artificial Sequence
  Description of Artificial Sequence: Synthetic oligonucleotide
gaaagaggcaaaaacgccctc

SEQ ID NO: 44451 - DNA, 21 bp, Artificial Sequence
  Description of Artificial Sequence: Synthetic oligonucleotide
ggcatccaaagcagccccacc

SEQ ID NO: 44452 - DNA, 21 bp, Artificial Sequence
  Description of Artificial Sequence: Synthetic oligonucleotide
gtgggtagtcagactaatagt

SEQ ID NO: 44453 - DNA, 21 bp, Artificial Sequence
  Description of Artificial Sequence: Synthetic oligonucleotide
gacacccacgtcagcggcaga

SEQ ID NO: 44454 - DNA, 21 bp, Artificial Sequence
  Description of Artificial Sequence: Synthetic oligonucleotide
agcagcaccaaaagcagcctc

SEQ ID NO: 44455 - DNA, 21 bp, Artificial Sequence
  Description of Artificial Sequence: Synthetic oligonucleotide
ggccaaatcaaaaacctcggc

SEQ ID NO: 44456 - DNA, 21 bp, Artificial Sequence
  Description of Artificial Sequence: Synthetic oligonucleotide
aaaagcgacgcccacaccgcc

SEQ ID NO: 44457 - DNA, 21 bp, Artificial Sequence
  Description of Artificial Sequence: Synthetic oligonucleotide
gggcaggtgaaggctattggg

SEQ ID NO: 44458 - DNA, 21 bp, Artificial Sequence
  Description of Artificial Sequence: Synthetic oligonucleotide
gaaagcgccacccccatcaga

SEQ ID NO: 44459 - DNA, 21 bp, Artificial Sequence
  Description of Artificial Sequence: Synthetic oligonucleotide
aacaacacccaaaaaaacagc

SEQ ID NO: 44460 - DNA, 21 bp, Artificial Sequence
  Description of Artificial Sequence: Synthetic oligonucleotide
agccccggcaaactcaccacc

SEQ ID NO: 44461 - DNA, 21 bp, Artificial Sequence
  Description of Artificial Sequence: Synthetic oligonucleotide
ctcaccaccggcaaccacatc

SEQ ID NO: 44462 - DNA, 21 bp, Artificial Sequence
  Description of Artificial Sequence: Synthetic oligonucleotide
gacgacagaagcgccagaggc

SEQ ID NO: 44463 - DNA, 21 bp, Artificial Sequence
  Description of Artificial Sequence: Synthetic oligonucleotide
ttcagaacccaaagcgtcggc

SEQ ID NO: 44464 - DNA, 21 bp, Artificial Sequence
  Description of Artificial Sequence: Synthetic oligonucleotide
agcgccggcaaccacgacatc

SEQ ID NO: 44465 - DNA, 21 bp, Artificial Sequence
  Description of Artificial Sequence: Synthetic oligonucleotide
aaccccggcgaaagccacaga

SEQ ID NO: 44466 - DNA, 21 bp, Artificial Sequence
  Description of Artificial Sequence: Synthetic oligonucleotide
ggcaccagcaacagatacacc

SEQ ID NO: 44467 - DNA, 21 bp, Artificial Sequence
  Description of Artificial Sequence: Synthetic oligonucleotide
caagacgccacccccagaagc

SEQ ID NO: 44468 - DNA, 21 bp, Artificial Sequence
  Description of Artificial Sequence: Synthetic oligonucleotide
cagatgcctggtcatactggg

SEQ ID NO: 44469 - DNA, 21 bp, Artificial Sequence
  Description of Artificial Sequence: Synthetic oligonucleotide
accaacagagtcggctacggc

SEQ ID NO: 44470 - DNA, 21 bp, Artificial Sequence
  Description of Artificial Sequence: Synthetic oligonucleotide
caggtgacggctattggtgct

SEQ ID NO: 44471 - DNA, 21 bp, Artificial Sequence
  Description of Artificial Sequence: Synthetic oligonucleotide
aatggtctgagtcagacgcat

SEQ ID NO: 44472 - DNA, 21 bp, Artificial Sequence
  Description of Artificial Sequence: Synthetic oligonucleotide
aatgtggctactttgagtgct

SEQ ID NO: 44473 - DNA, 21 bp, Artificial Sequence
  Description of Artificial Sequence: Synthetic oligonucleotide
ccttctactcggcagtctaat

SEQ ID NO: 44474 - DNA, 21 bp, Artificial Sequence
  Description of Artificial Sequence: Synthetic oligonucleotide
tacagcggcggcaacatgagc

SEQ ID NO: 44475 - DNA, 21 bp, Artificial Sequence
  Description of Artificial Sequence: Synthetic oligonucleotide
acccccatcacccccatgacc

SEQ ID NO: 44476 - DNA, 21 bp, Artificial Sequence
  Description of Artificial Sequence: Synthetic oligonucleotide
agctacgccagcacccaacaa

SEQ ID NO: 44477 - DNA, 21 bp, Artificial Sequence
  Description of Artificial Sequence: Synthetic oligonucleotide
accagcagaaccagctacgaa

SEQ ID NO: 44478 - DNA, 21 bp, Artificial Sequence
  Description of Artificial Sequence: Synthetic oligonucleotide
cagggttcttcgcctatggag

SEQ ID NO: 44479 - DNA, 21 bp, Artificial Sequence
  Description of Artificial Sequence: Synthetic oligonucleotide
cttaatcagattgggaagagt

SEQ ID NO: 44480 - DNA, 21 bp, Artificial Sequence
  Description of Artificial Sequence: Synthetic oligonucleotide
actagtgagcgtccgacgtgt

SEQ ID NO: 44481 - DNA, 21 bp, Artificial Sequence
  Description of Artificial Sequence: Synthetic oligonucleotide
gatatttcgaggtctcatggt

SEQ ID NO: 44482 - DNA, 21 bp, Artificial Sequence
  Description of Artificial Sequence: Synthetic oligonucleotide
cggaataataatacgcctggg

SEQ ID NO: 44483 - DNA, 21 bp, Artificial Sequence
  Description of Artificial Sequence: Synthetic oligonucleotide
cgtcagtatacgggtgatagt

SEQ ID NO: 44484 - DNA, 21 bp, Artificial Sequence
  Description of Artificial Sequence: Synthetic oligonucleotide
gcccccaccagcgaccaccac

SEQ ID NO: 44485 - DNA, 21 bp, Artificial Sequence
  Description of Artificial Sequence: Synthetic oligonucleotide
tgtttggcgcagccgagggtt

SEQ ID NO: 44486 - DNA, 21 bp, Artificial Sequence
  Description of Artificial Sequence: Synthetic oligonucleotide
agttcgactagtcttggttcg

SEQ ID NO: 44487 - DNA, 21 bp, Artificial Sequence
  Description of Artificial Sequence: Synthetic oligonucleotide
aagactcctcagctgtctcag

SEQ ID NO: 44488 - DNA, 21 bp, Artificial Sequence
  Description of Artificial Sequence: Synthetic oligonucleotide
atgggtgttggtatgaatggt

SEQ ID NO: 44489 - DNA, 21 bp, Artificial Sequence
  Description of Artificial Sequence: Synthetic oligonucleotide
agcgtcagcaacaccaacacc

SEQ ID NO: 44490 - DNA, 21 bp, Artificial Sequence
  Description of Artificial Sequence: Synthetic oligonucleotide
catgttattgctcctcagcag

SEQ ID NO: 44491 - DNA, 21 bp, Artificial Sequence
  Description of Artificial Sequence: Synthetic oligonucleotide
gggaatactaattcgtttctt

SEQ ID NO: 44492 - DNA, 21 bp, Artificial Sequence
  Description of Artificial Sequence: Synthetic oligonucleotide
ggggctaagccgggtttggct

SEQ ID NO: 44493 - DNA, 21 bp, Artificial Sequence
  Description of Artificial Sequence: Synthetic oligonucleotide
gtttctggtacgcctcgggtt

SEQ ID NO: 44494 - DNA, 21 bp, Artificial Sequence
  Description of Artificial Sequence: Synthetic oligonucleotide
tcgtcttatgtggggccttcg

SEQ ID NO: 44495 - DNA, 21 bp, Artificial Sequence
  Description of Artificial Sequence: Synthetic oligonucleotide
cttattcgtggtgggaataat

SEQ ID NO: 44496 - DNA, 21 bp, Artificial Sequence
  Description of Artificial Sequence: Synthetic oligonucleotide
gacagcatcggcagcagcaaa

SEQ ID NO: 44497 - DNA, 21 bp, Artificial Sequence
  Description of Artificial Sequence: Synthetic oligonucleotide
cggtttcagaataatactggg

SEQ ID NO: 44498 - DNA, 21 bp, Artificial Sequence
  Description of Artificial Sequence: Synthetic oligonucleotide
accagcaacagcaacatcgcc

SEQ ID NO: 44499 - DNA, 21 bp, Artificial Sequence
  Description of Artificial Sequence: Synthetic oligonucleotide
gggatgcatgtgagtaatcct

SEQ ID NO: 44500 - DNA, 21 bp, Artificial Sequence
  Description of Artificial Sequence: Synthetic oligonucleotide
agtcttcctaatactaatggg

SEQ ID NO: 44501 - DNA, 21 bp, Artificial Sequence
  Description of Artificial Sequence: Synthetic oligonucleotide
gatcctcgtaattctacgtct

SEQ ID NO: 44502 - DNA, 21 bp, Artificial Sequence
  Description of Artificial Sequence: Synthetic oligonucleotide
agcggttctggacagaatcaa

SEQ ID NO: 44503 - DNA, 21 bp, Artificial Sequence
  Description of Artificial Sequence: Synthetic oligonucleotide
tctacggatcggtcgtttaat

SEQ ID NO: 44504 - DNA, 21 bp, Artificial Sequence
  Description of Artificial Sequence: Synthetic oligonucleotide
gagacgaattctcgtttgggt

SEQ ID NO: 44505 - DNA, 21 bp, Artificial Sequence
  Description of Artificial Sequence: Synthetic oligonucleotide
gttcggcatacgacggatagt

SEQ ID NO: 44506 - DNA, 21 bp, Artificial Sequence
  Description of Artificial Sequence: Synthetic oligonucleotide
actgctgtgacggcgaatcag

SEQ ID NO: 44507 - DNA, 21 bp, Artificial Sequence
  Description of Artificial Sequence: Synthetic oligonucleotide
aacaaccccaaaaacgccgtc

SEQ ID NO: 44508 - DNA, 21 bp, Artificial Sequence
  Description of Artificial Sequence: Synthetic oligonucleotide
cccctcagaatcggcacccaa

SEQ ID NO: 44509 - DNA, 21 bp, Artificial Sequence
  Description of Artificial Sequence: Synthetic oligonucleotide
ccggcttcgcttggtcagggt

SEQ ID NO: 44510 - DNA, 21 bp, Artificial Sequence
  Description of Artificial Sequence: Synthetic oligonucleotide
cataatagtggtaatggttcg

SEQ ID NO: 44511 - DNA, 21 bp, Artificial Sequence
  Description of Artificial Sequence: Synthetic oligonucleotide
gcgacgcataattcgtctcag

SEQ ID NO: 44512 - DNA, 21 bp, Artificial Sequence
  Description of Artificial Sequence: Synthetic oligonucleotide
ggttctcataatgatagtagg

SEQ ID NO: 44513 - DNA, 21 bp, Artificial Sequence
  Description of Artificial Sequence: Synthetic oligonucleotide
gctttttctcattcttcgggt

SEQ ID NO: 44514 - DNA, 21 bp, Artificial Sequence
  Description of Artificial Sequence: Synthetic oligonucleotide
attaatagtggtaatggttcg

SEQ ID NO: 44515 - DNA, 21 bp, Artificial Sequence
  Description of Artificial Sequence: Synthetic oligonucleotide
agttcttcgcatgctactcgt

SEQ ID NO: 44516 - DNA, 21 bp, Artificial Sequence
  Description of Artificial Sequence: Synthetic oligonucleotide
gccaccggcaacggcagaggc

SEQ ID NO: 44517 - DNA, 21 bp, Artificial Sequence
  Description of Artificial Sequence: Synthetic oligonucleotide
ctcagagccggcaccgtcaga

SEQ ID NO: 44518 - DNA, 21 bp, Artificial Sequence
  Description of Artificial Sequence: Synthetic oligonucleotide
agtaatggtcagaggaaggag

SEQ ID NO: 44519 - DNA, 21 bp, Artificial Sequence
  Description of Artificial Sequence: Synthetic oligonucleotide
gctcctagtgcgggtatgtct

SEQ ID NO: 44520 - DNA, 21 bp, Artificial Sequence
  Description of Artificial Sequence: Synthetic oligonucleotide
gacagaaaacacaccagcacc

SEQ ID NO: 44521 - DNA, 21 bp, Artificial Sequence
  Description of Artificial Sequence: Synthetic oligonucleotide
ggcttccccgtcagcagcatg

SEQ ID NO: 44522 - DNA, 21 bp, Artificial Sequence
  Description of Artificial Sequence: Synthetic oligonucleotide
acggtggctcatcctagtcat

SEQ ID NO: 44523 - DNA, 21 bp, Artificial Sequence
  Description of Artificial Sequence: Synthetic oligonucleotide
cctcatacttctgggcgtccg

SEQ ID NO: 44524 - DNA, 21 bp, Artificial Sequence
  Description of Artificial Sequence: Synthetic oligonucleotide
aacgtcagcagcgccatcaaa

SEQ ID NO: 44525 - DNA, 21 bp, Artificial Sequence
  Description of Artificial Sequence: Synthetic oligonucleotide
cattatacggggaagcagaat

SEQ ID NO: 44526 - DNA, 21 bp, Artificial Sequence
  Description of Artificial Sequence: Synthetic oligonucleotide
cacagcagccacagccccagc

SEQ ID NO: 44527 - DNA, 21 bp, Artificial Sequence
  Description of Artificial Sequence: Synthetic oligonucleotide
acgttggagaatagtcgtcgt

SEQ ID NO: 44528 - DNA, 21 bp, Artificial Sequence
  Description of Artificial Sequence: Synthetic oligonucleotide
agaggcaacgaaaacatcaac

SEQ ID NO: 44529 - DNA, 21 bp, Artificial Sequence
  Description of Artificial Sequence: Synthetic oligonucleotide
ggtcagactagggagtctagt

SEQ ID NO: 44530 - DNA, 21 bp, Artificial Sequence
  Description of Artificial Sequence: Synthetic oligonucleotide
aacggcaacatcagcatcggc

SEQ ID NO: 44531 - DNA, 21 bp, Artificial Sequence
  Description of Artificial Sequence: Synthetic oligonucleotide
cccagcagcaaccacgtcaaa

SEQ ID NO: 44532 - DNA, 21 bp, Artificial Sequence
  Description of Artificial Sequence: Synthetic oligonucleotide
ggcagactcaacaccaacggc

SEQ ID NO: 44533 - DNA, 21 bp, Artificial Sequence
  Description of Artificial Sequence: Synthetic oligonucleotide
ccgacggcttcgaataggagt

SEQ ID NO: 44534 - DNA, 21 bp, Artificial Sequence
  Description of Artificial Sequence: Synthetic oligonucleotide
tgcaccggcagcagaagcatg

SEQ ID NO: 44535 - DNA, 21 bp, Artificial Sequence
  Description of Artificial Sequence: Synthetic oligonucleotide
accagcagcagccaacacgac

SEQ ID NO: 44536 - DNA, 21 bp, Artificial Sequence
  Description of Artificial Sequence: Synthetic oligonucleotide
aggcttcctagtgtgtctagt

SEQ ID NO: 44537 - DNA, 21 bp, Artificial Sequence
  Description of Artificial Sequence: Synthetic oligonucleotide
tacgccgacggcgccagaaac

SEQ ID NO: 44538 - DNA, 21 bp, Artificial Sequence
  Description of Artificial Sequence: Synthetic oligonucleotide
cctttttctgagatgcagaag

SEQ ID NO: 44539 - DNA, 21 bp, Artificial Sequence
  Description of Artificial Sequence: Synthetic oligonucleotide
ccggatgttaaggtgactagg

SEQ ID NO: 44540 - DNA, 21 bp, Artificial Sequence
  Description of Artificial Sequence: Synthetic oligonucleotide
aacagcagcgacagcctcacc

SEQ ID NO: 44541 - DNA, 21 bp, Artificial Sequence
  Description of Artificial Sequence: Synthetic oligonucleotide
atggctgctaagcctaatgat

SEQ ID NO: 44542 - DNA, 21 bp, Artificial Sequence
  Description of Artificial Sequence: Synthetic oligonucleotide
catggtgatagtggtaaggtt

SEQ ID NO: 44543 - DNA, 21 bp, Artificial Sequence
  Description of Artificial Sequence: Synthetic oligonucleotide
ggccccaacatcagcctcggc

SEQ ID NO: 44544 - DNA, 21 bp, Artificial Sequence
  Description of Artificial Sequence: Synthetic oligonucleotide
gagagtgctcggattggttct

SEQ ID NO: 44545 - DNA, 21 bp, Artificial Sequence
  Description of Artificial Sequence: Synthetic oligonucleotide
gggggtactccgactcatcgg

SEQ ID NO: 44546 - DNA, 21 bp, Artificial Sequence
  Description of Artificial Sequence: Synthetic oligonucleotide
gccagaaaccccaccagcacc

SEQ ID NO: 44547 - DNA, 21 bp, Artificial Sequence
  Description of Artificial Sequence: Synthetic oligonucleotide
aatacttcttcttctcatacg

SEQ ID NO: 44548 - DNA, 21 bp, Artificial Sequence
  Description of Artificial Sequence: Synthetic oligonucleotide
agcagcggcaaaagcttcagc

SEQ ID NO: 44549 - DNA, 21 bp, Artificial Sequence
  Description of Artificial Sequence: Synthetic oligonucleotide
tctatttctaagactcaggct

SEQ ID NO: 44550 - DNA, 21 bp, Artificial Sequence
  Description of Artificial Sequence: Synthetic oligonucleotide
actcagtcttcgagtaggacg

SEQ ID NO: 44551 - DNA, 21 bp, Artificial Sequence
  Description of Artificial Sequence: Synthetic oligonucleotide
cacaaaagcagcgccgtcggc

SEQ ID NO: 44552 - DNA, 21 bp, Artificial Sequence
  Description of Artificial Sequence: Synthetic oligonucleotide
caagaaggcgtcagaagcagc

SEQ ID NO: 44553 - DNA, 21 bp, Artificial Sequence
  Description of Artificial Sequence: Synthetic oligonucleotide
cccgtcagacccgccaacctc

SEQ ID NO: 44554 - DNA, 21 bp, Artificial Sequence
  Description of Artificial Sequence: Synthetic oligonucleotide
tctgtgggtgctcctactctt

SEQ ID NO: 44555 - DNA, 21 bp, Artificial Sequence
  Description of Artificial Sequence: Synthetic oligonucleotide
gcgggttctcagactggtgtt

SEQ ID NO: 44556 - DNA, 21 bp, Artificial Sequence
  Description of Artificial Sequence: Synthetic oligonucleotide
tttgggactaataaggtggat

SEQ ID NO: 44557 - DNA, 21 bp, Artificial Sequence
  Description of Artificial Sequence: Synthetic oligonucleotide
agaggcgacccccacagagcc

SEQ ID NO: 44558 - DNA, 21 bp, Artificial Sequence
  Description of Artificial Sequence: Synthetic oligonucleotide
ggcaacagacccaccaccctc

SEQ ID NO: 44559 - DNA, 21 bp, Artificial Sequence
  Description of Artificial Sequence: Synthetic oligonucleotide
actatgaggccttctagtgat

SEQ ID NO: 44560 - DNA, 21 bp, Artificial Sequence
  Description of Artificial Sequence: Synthetic oligonucleotide
tatggtcgtgataagtttagt

SEQ ID NO: 44561 - DNA, 21 bp, Artificial Sequence
  Description of Artificial Sequence: Synthetic oligonucleotide
cagactcgtagtaatggtaat

SEQ ID NO: 44562 - DNA, 21 bp, Artificial Sequence
  Description of Artificial Sequence: Synthetic oligonucleotide
agccccgccagcctccccaaa

SEQ ID NO: 44563 - DNA, 21 bp, Artificial Sequence
  Description of Artificial Sequence: Synthetic oligonucleotide
tctgaggttaatcgtgggacg

SEQ ID NO: 44564 - DNA, 21 bp, Artificial Sequence
  Description of Artificial Sequence: Synthetic oligonucleotide
ggcagagccaacggccaaacc

SEQ ID NO: 44565 - DNA, 21 bp, Artificial Sequence
  Description of Artificial Sequence: Synthetic oligonucleotide
aatagttatgatccgaagcgt

SEQ ID NO: 44566 - DNA, 21 bp, Artificial Sequence
  Description of Artificial Sequence: Synthetic oligonucleotide
tttacggttactgggctgagt

SEQ ID NO: 44567 - DNA, 21 bp, Artificial Sequence
  Description of Artificial Sequence: Synthetic oligonucleotide
aaagccgacgccaccagaacc

SEQ ID NO: 44568 - DNA, 21 bp, Artificial Sequence
  Description of Artificial Sequence: Synthetic oligonucleotide
cagatgaatcatctgcaggtt

SEQ ID NO: 44569 - DNA, 21 bp, Artificial Sequence
  Description of Artificial Sequence: Synthetic oligonucleotide
accagcggcagcgccagaggc

SEQ ID NO: 44570 - DNA, 21 bp, Artificial Sequence
  Description of Artificial Sequence: Synthetic oligonucleotide
actggtactcaggggactagg

SEQ ID NO: 44571 - DNA, 21 bp, Artificial Sequence
  Description of Artificial Sequence: Synthetic oligonucleotide
ggcctcgaaagcatgagacaa

SEQ ID NO: 44572 - DNA, 21 bp, Artificial Sequence
  Description of Artificial Sequence: Synthetic oligonucleotide
cccggcaccaccagcgccatg

SEQ ID NO: 44573 - DNA, 21 bp, Artificial Sequence
  Description of Artificial Sequence: Synthetic oligonucleotide
agaaccgaccacggcggcgtc

SEQ ID NO: 44574 - DNA, 21 bp, Artificial Sequence
  Description of Artificial Sequence: Synthetic oligonucleotide
gacagagtcggcagcatcagc

SEQ ID NO: 44575 - DNA, 21 bp, Artificial Sequence
  Description of Artificial Sequence: Synthetic oligonucleotide
gactaccacaacagcaaactc

SEQ ID NO: 44576 - DNA, 21 bp, Artificial Sequence
  Description of Artificial Sequence: Synthetic oligonucleotide
acgccgacgactagtgcgaat

SEQ ID NO: 44577 - DNA, 21 bp, Artificial Sequence
  Description of Artificial Sequence: Synthetic oligonucleotide
caacccatcaacgtccacaac

SEQ ID NO: 44578 - DNA, 21 bp, Artificial Sequence
  Description of Artificial Sequence: Synthetic oligonucleotide
cacggcatcggcaacagcgcc

SEQ ID NO: 44579 - DNA, 21 bp, Artificial Sequence
  Description of Artificial Sequence: Synthetic oligonucleotide
ggcagaaccaacagctacagc

SEQ ID NO: 44580 - DNA, 21 bp, Artificial Sequence
  Description of Artificial Sequence: Synthetic oligonucleotide
actgatacttctaggaggcag

SEQ ID NO: 44581 - DNA, 21 bp, Artificial Sequence
  Description of Artificial Sequence: Synthetic oligonucleotide
ctgaggaatagtacgagtgtg

SEQ ID NO: 44582 - DNA, 21 bp, Artificial Sequence
  Description of Artificial Sequence: Synthetic oligonucleotide
accagagaaagcagaaccaac

SEQ ID NO: 44583 - DNA, 21 bp, Artificial Sequence
  Description of Artificial Sequence: Synthetic oligonucleotide
ggcaacggcatcagcaccaaa

SEQ ID NO: 44584 - DNA, 21 bp, Artificial Sequence
  Description of Artificial Sequence: Synthetic oligonucleotide
gaaagacacgtccccagcagc

SEQ ID NO: 44585 - DNA, 21 bp, Artificial Sequence
  Description of Artificial Sequence: Synthetic oligonucleotide
tttgctcgtagtgctagttct

SEQ ID NO: 44586 - DNA, 21 bp, Artificial Sequence
  Description of Artificial Sequence: Synthetic oligonucleotide
ccgatggctcagcagcgggct

SEQ ID NO: 44587 - DNA, 21 bp, Artificial Sequence
  Description of Artificial Sequence: Synthetic oligonucleotide
gacagagtcctcagccaaggc

SEQ ID NO: 44588 - DNA, 21 bp, Artificial Sequence
  Description of Artificial Sequence: Synthetic oligonucleotide
aattcggcgagtctgaatcat

SEQ ID NO: 44589 - DNA, 21 bp, Artificial Sequence
  Description of Artificial Sequence: Synthetic oligonucleotide
catcgggtggagggttcgctt

SEQ ID NO: 44590 - DNA, 21 bp, Artificial Sequence
  Description of Artificial Sequence: Synthetic oligonucleotide
tcgaaggctacgcataatatt

SEQ ID NO: 44591 - DNA, 21 bp, Artificial Sequence
  Description of Artificial Sequence: Synthetic oligonucleotide
ctttcgcttaataagtctcag

SEQ ID NO: 44592 - DNA, 21 bp, Artificial Sequence
  Description of Artificial Sequence: Synthetic oligonucleotide
agagaccccaaaagcagcacc

SEQ ID NO: 44593 - DNA, 21 bp, Artificial Sequence
  Description of Artificial Sequence: Synthetic oligonucleotide
acgtctgcggctccgcatgcg

SEQ ID NO: 44594 - DNA, 21 bp, Artificial Sequence
  Description of Artificial Sequence: Synthetic oligonucleotide
cccaccatcagcgtcgacaga

SEQ ID NO: 44595 - DNA, 21 bp, Artificial Sequence
  Description of Artificial Sequence: Synthetic oligonucleotide
cacagcagcaaaagccacgac

SEQ ID NO: 44596 - DNA, 21 bp, Artificial Sequence
  Description of Artificial Sequence: Synthetic oligonucleotide
atggggattcgtgataatact

SEQ ID NO: 44597 - DNA, 21 bp, Artificial Sequence
  Description of Artificial Sequence: Synthetic oligonucleotide
aggtcgtcgaattctgatcat

SEQ ID NO: 44598 - DNA, 21 bp, Artificial Sequence
  Description of Artificial Sequence: Synthetic oligonucleotide
gatgtgcataggagtagtggg

SEQ ID NO: 44599 - DNA, 21 bp, Artificial Sequence
  Description of Artificial Sequence: Synthetic oligonucleotide
ctcagcgccgccagaagccaa

SEQ ID NO: 44600 - DNA, 21 bp, Artificial Sequence
  Description of Artificial Sequence: Synthetic oligonucleotide
cccagcaaaagcagcagcgcc

SEQ ID NO: 44601 - DNA, 21 bp, Artificial Sequence
  Description of Artificial Sequence: Synthetic oligonucleotide
caaagcagccaaagcggcccc

SEQ ID NO: 44602 - DNA, 21 bp, Artificial Sequence
  Description of Artificial Sequence: Synthetic oligonucleotide
ggtggtaataagcagggttgt

SEQ ID NO: 44603 - DNA, 21 bp, Artificial Sequence
  Description of Artificial Sequence: Synthetic oligonucleotide
actcagcggcctgctcagatg

SEQ ID NO: 44604 - DNA, 21 bp, Artificial Sequence
  Description of Artificial Sequence: Synthetic oligonucleotide
gcgggtactcgtcagtcttgt

SEQ ID NO: 44605 - DNA, 21 bp, Artificial Sequence
  Description of Artificial Sequence: Synthetic oligonucleotide
gccaacaccagcggccaagcc

SEQ ID NO: 44606 - DNA, 21 bp, Artificial Sequence
  Description of Artificial Sequence: Synthetic oligonucleotide
tctgtggggtctggtgctttg

SEQ ID NO: 44607 - DNA, 21 bp, Artificial Sequence
  Description of Artificial Sequence: Synthetic oligonucleotide
gatgttaatactaaggcgctt

SEQ ID NO: 44608 - DNA, 21 bp, Artificial Sequence
  Description of Artificial Sequence: Synthetic oligonucleotide
caaggcaaaaccgccccctac

SEQ ID NO: 44609 - DNA, 21 bp, Artificial Sequence
  Description of Artificial Sequence: Synthetic oligonucleotide
attgcttcgagtggtatgcat

SEQ ID NO: 44610 - DNA, 21 bp, Artificial Sequence
  Description of Artificial Sequence: Synthetic oligonucleotide
cccagcagaggcgtcgccatg

SEQ ID NO: 44611 - DNA, 21 bp, Artificial Sequence
  Description of Artificial Sequence: Synthetic oligonucleotide
cgtcctgctacttccactccg

SEQ ID NO: 44612 - DNA, 21 bp, Artificial Sequence
  Description of Artificial Sequence: Synthetic oligonucleotide
ccgattggttctcagcatatt

SEQ ID NO: 44613 - DNA, 21 bp, Artificial Sequence
  Description of Artificial Sequence: Synthetic oligonucleotide
gctagttctaagggtttgact

SEQ ID NO: 44614 - DNA, 21 bp, Artificial Sequence
  Description of Artificial Sequence: Synthetic oligonucleotide
tatcagcctgagcggtcttct

SEQ ID NO: 44615 - DNA, 21 bp, Artificial Sequence
  Description of Artificial Sequence: Synthetic oligonucleotide
cattatggtccggattcgaag

SEQ ID NO: 44616 - DNA, 21 bp, Artificial Sequence
  Description of Artificial Sequence: Synthetic oligonucleotide
ccgagtaataaggctgggact

SEQ ID NO: 44617 - DNA, 21 bp, Artificial Sequence
  Description of Artificial Sequence: Synthetic oligonucleotide
cgggtggcgacttcggtgtcg

SEQ ID NO: 44618 - DNA, 21 bp, Artificial Sequence
  Description of Artificial Sequence: Synthetic oligonucleotide
cagtcgagtaatgctcggaat

SEQ ID NO: 44619 - DNA, 21 bp, Artificial Sequence
  Description of Artificial Sequence: Synthetic oligonucleotide
ggggatatggggatttcgaag

SEQ ID NO: 44620 - DNA, 21 bp, Artificial Sequence
  Description of Artificial Sequence: Synthetic oligonucleotide
agcagcatcagcagaaccagc

SEQ ID NO: 44621 - DNA, 21 bp, Artificial Sequence
  Description of Artificial Sequence: Synthetic oligonucleotide
catcttggggttccgctgaag

SEQ ID NO: 44622 - DNA, 21 bp, Artificial Sequence
  Description of Artificial Sequence: Synthetic oligonucleotide
ccgaatgggggtattcctcct

SEQ ID NO: 44623 - DNA, 21 bp, Artificial Sequence
  Description of Artificial Sequence: Synthetic oligonucleotide
gctaatccggttaggcctgag

SEQ ID NO: 44624 - DNA, 21 bp, Artificial Sequence
  Description of Artificial Sequence: Synthetic oligonucleotide
tcggtgcagggggagcggatg

SEQ ID NO: 44625 - DNA, 21 bp, Artificial Sequence
  Description of Artificial Sequence: Synthetic oligonucleotide
tatcagcatccgaagatggct

SEQ ID NO: 44626 - DNA, 21 bp, Artificial Sequence
  Description of Artificial Sequence: Synthetic oligonucleotide
actcctacgttggctcatggt

SEQ ID NO: 44627 - DNA, 21 bp, Artificial Sequence
  Description of Artificial Sequence: Synthetic oligonucleotide
caacccaacaccacctacaga

SEQ ID NO: 44628 - DNA, 21 bp, Artificial Sequence
  Description of Artificial Sequence: Synthetic oligonucleotide
aataatgctcatagttcgtct

SEQ ID NO: 44629 - DNA, 21 bp, Artificial Sequence
  Description of Artificial Sequence: Synthetic oligonucleotide
catgctaataatgggacgtct

SEQ ID NO: 44630 - DNA, 21 bp, Artificial Sequence
  Description of Artificial Sequence: Synthetic oligonucleotide
ccgactggggcgcatgttacg

SEQ ID NO: 44631 - DNA, 21 bp, Artificial Sequence
  Description of Artificial Sequence: Synthetic oligonucleotide
ggcatgaaaggcagcgtcaac

SEQ ID NO: 44632 - DNA, 21 bp, Artificial Sequence
  Description of Artificial Sequence: Synthetic oligonucleotide
attagttctggtacgcatggg

SEQ ID NO: 44633 - DNA, 21 bp, Artificial Sequence
  Description of Artificial Sequence: Synthetic oligonucleotide
tcgcagtctcagactccggag

SEQ ID NO: 44634 - DNA, 21 bp, Artificial Sequence
  Description of Artificial Sequence: Synthetic oligonucleotide
aggagtatgtctagtgcggtg

SEQ ID NO: 44635 - DNA, 21 bp, Artificial Sequence
  Description of Artificial Sequence: Synthetic oligonucleotide
cttaggaatggtattgcttct

SEQ ID NO: 44636 - DNA, 21 bp, Artificial Sequence
  Description of Artificial Sequence: Synthetic oligonucleotide
ctccccagcaacagcatccac

SEQ ID NO: 44637 - DNA, 21 bp, Artificial Sequence
  Description of Artificial Sequence: Synthetic oligonucleotide
ccccacgtcatgggcaaacac

SEQ ID NO: 44638 - DNA, 21 bp, Artificial Sequence
  Description of Artificial Sequence: Synthetic oligonucleotide
aatcgggttactcagagtagt

SEQ ID NO: 44639 - DNA, 21 bp, Artificial Sequence
  Description of Artificial Sequence: Synthetic oligonucleotide
agcaaaagcacccaccaagcc

SEQ ID NO: 44640 - DNA, 21 bp, Artificial Sequence
  Description of Artificial Sequence: Synthetic oligonucleotide
ttgcgtcctgctaatactatt

SEQ ID NO: 44641 - DNA, 21 bp, Artificial Sequence
  Description of Artificial Sequence: Synthetic oligonucleotide
ggtgttgaggcgatgcggaat

SEQ ID NO: 44642 - DNA, 21 bp, Artificial Sequence
  Description of Artificial Sequence: Synthetic oligonucleotide
cagagtagtcatgaggggagg

SEQ ID NO: 44643 - DNA, 21 bp, Artificial Sequence
  Description of Artificial Sequence: Synthetic oligonucleotide
cccaaagtcagagacggctac

SEQ ID NO: 44644 - DNA, 21 bp, Artificial Sequence
  Description of Artificial Sequence: Synthetic oligonucleotide
actcctgcggggccgaataag

SEQ ID NO: 44645 - DNA, 21 bp, Artificial Sequence
  Description of Artificial Sequence: Synthetic oligonucleotide
aataatgtgggtgttcgtggt

SEQ ID NO: 44646 - DNA, 21 bp, Artificial Sequence
  Description of Artificial Sequence: Synthetic oligonucleotide
agtaagactgggactagtttg

SEQ ID NO: 44647 - DNA, 21 bp, Artificial Sequence
  Description of Artificial Sequence: Synthetic oligonucleotide
ccgacggttcggtcgtctacg

SEQ ID NO: 44648 - DNA, 21 bp, Artificial Sequence
  Description of Artificial Sequence: Synthetic oligonucleotide
tcggtgcttaatcgtaatggg

SEQ ID NO: 44649 - DNA, 21 bp, Artificial Sequence
  Description of Artificial Sequence: Synthetic oligonucleotide
tctggtagtgataagtttagt

SEQ ID NO: 44650 - DNA, 21 bp, Artificial Sequence
  Description of Artificial Sequence: Synthetic oligonucleotide
attcgggattcgacgctgggt

SEQ ID NO: 44651 - DNA, 21 bp, Artificial Sequence
  Description of Artificial Sequence: Synthetic oligonucleotide
ccgtcgtctcctacggatcgg

SEQ ID NO: 44652 - DNA, 21 bp, Artificial Sequence
  Description of Artificial Sequence: Synthetic oligonucleotide
acggggcatcatcctccttct

SEQ ID NO: 44653 - DNA, 21 bp, Artificial Sequence
  Description of Artificial Sequence: Synthetic oligonucleotide
aataatgctgctactcattcg

SEQ ID NO: 44654 - DNA, 21 bp, Artificial Sequence
  Description of Artificial Sequence: Synthetic oligonucleotide
agaagcggcaacggcagcctc

SEQ ID NO: 44655 - DNA, 21 bp, Artificial Sequence
  Description of Artificial Sequence: Synthetic oligonucleotide
cttgggacgtctcatcagcag

SEQ ID NO: 44656 - DNA, 21 bp, Artificial Sequence
  Description of Artificial Sequence: Synthetic oligonucleotide
accaccgccagcagccccacc

SEQ ID NO: 44657 - DNA, 21 bp, Artificial Sequence
  Description of Artificial Sequence: Synthetic oligonucleotide
tttcctctgactaagcctgct

SEQ ID NO: 44658 - DNA, 21 bp, Artificial Sequence
  Description of Artificial Sequence: Synthetic oligonucleotide
ccgtctggggagactagtaag

SEQ ID NO: 44659 - DNA, 21 bp, Artificial Sequence
  Description of Artificial Sequence: Synthetic oligonucleotide
ccggggctttctaattcgcgt

SEQ ID NO: 44660 - DNA, 21 bp, Artificial Sequence
  Description of Artificial Sequence: Synthetic oligonucleotide
gatttgcagactagtgctaag

SEQ ID NO: 44661 - DNA, 21 bp, Artificial Sequence
  Description of Artificial Sequence: Synthetic oligonucleotide
tcttctactagggcgctgtct

SEQ ID NO: 44662 - DNA, 21 bp, Artificial Sequence
  Description of Artificial Sequence: Synthetic oligonucleotide
ggcatcaccgccaaactcacc

SEQ ID NO: 44663 - DNA, 21 bp, Artificial Sequence
  Description of Artificial Sequence: Synthetic oligonucleotide
acgacttcgaataaggatagt

SEQ ID NO: 44664 - DNA, 21 bp, Artificial Sequence
  Description of Artificial Sequence: Synthetic oligonucleotide
ccgagtagtccgaattctatt

SEQ ID NO: 44665 - DNA, 21 bp, Artificial Sequence
  Description of Artificial Sequence: Synthetic oligonucleotide
ggcagacacggcgcccccacc

SEQ ID NO: 44666 - DNA, 21 bp, Artificial Sequence
  Description of Artificial Sequence: Synthetic oligonucleotide
cctggtatgaaggtgagtccg

SEQ ID NO: 44667 - DNA, 21 bp, Artificial Sequence
  Description of Artificial Sequence: Synthetic oligonucleotide
aatgcggttcgttctgagaat

SEQ ID NO: 44668 - DNA, 21 bp, Artificial Sequence
  Description of Artificial Sequence: Synthetic oligonucleotide
gtcgtccccgaaagaagcaaa

SEQ ID NO: 44669 - DNA, 21 bp, Artificial Sequence
  Description of Artificial Sequence: Synthetic oligonucleotide
gacagcagaagcatcaaaggc

SEQ ID NO: 44670 - DNA, 21 bp, Artificial Sequence
  Description of Artificial Sequence: Synthetic oligonucleotide
cagaggacttcggatcagact

SEQ ID NO: 44671 - DNA, 21 bp, Artificial Sequence
  Description of Artificial Sequence: Synthetic oligonucleotide
aacaacagcagagtcctcggc

SEQ ID NO: 44672 - DNA, 21 bp, Artificial Sequence
  Description of Artificial Sequence: Synthetic oligonucleotide
ctcagacccaacggccaactc

SEQ ID NO: 44673 - DNA, 21 bp, Artificial Sequence
  Description of Artificial Sequence: Synthetic oligonucleotide
gagaataatagtcgtgctact

SEQ ID NO: 44674 - DNA, 21 bp, Artificial Sequence
  Description of Artificial Sequence: Synthetic oligonucleotide
tgtgtgactggtggtcttact

SEQ ID NO: 44675 - DNA, 21 bp, Artificial Sequence
  Description of Artificial Sequence: Synthetic oligonucleotide
cctgctaattcgcctgcgacg

SEQ ID NO: 44676 - DNA, 21 bp, Artificial Sequence
  Description of Artificial Sequence: Synthetic oligonucleotide
gttagttttaagcctaatgag

SEQ ID NO: 44677 - DNA, 21 bp, Artificial Sequence
  Description of Artificial Sequence: Synthetic oligonucleotide
atgagaagcaaagaaagcgcc

SEQ ID NO: 44678 - DNA, 21 bp, Artificial Sequence
  Description of Artificial Sequence: Synthetic oligonucleotide
gcgcatagtaataattcgtat

SEQ ID NO: 44679 - DNA, 21 bp, Artificial Sequence
  Description of Artificial Sequence: Synthetic oligonucleotide
aaaagcaacagcagcctcggc

SEQ ID NO: 44680 - DNA, 21 bp, Artificial Sequence
  Description of Artificial Sequence: Synthetic oligonucleotide
ggcagcaacctcaacagcacc

SEQ ID NO: 44681 - DNA, 21 bp, Artificial Sequence
  Description of Artificial Sequence: Synthetic oligonucleotide
agcgcccacagcctcggcatc

SEQ ID NO: 44682 - DNA, 21 bp, Artificial Sequence
  Description of Artificial Sequence: Synthetic oligonucleotide
gggacgaggtctgctgttgtt

SEQ ID NO: 44683 - DNA, 21 bp, Artificial Sequence
  Description of Artificial Sequence: Synthetic oligonucleotide
aatcctggtgagatgcgtctg

SEQ ID NO: 44684 - DNA, 21 bp, Artificial Sequence
  Description of Artificial Sequence: Synthetic oligonucleotide
agaagcgccaacaccaacgcc

SEQ ID NO: 44685 - DNA, 21 bp, Artificial Sequence
  Description of Artificial Sequence: Synthetic oligonucleotide
ggtgtgaatattcatgcgact

SEQ ID NO: 44686 - DNA, 21 bp, Artificial Sequence
  Description of Artificial Sequence: Synthetic oligonucleotide
atcaccgccacccacgcccac

SEQ ID NO: 44687 - DNA, 21 bp, Artificial Sequence
  Description of Artificial Sequence: Synthetic oligonucleotide
aggattacgtcgagtaatcag

SEQ ID NO: 44688 - DNA, 21 bp, Artificial Sequence
  Description of Artificial Sequence: Synthetic oligonucleotide
ctcggcggcggcaccctcaga

SEQ ID NO: 44689 - DNA, 21 bp, Artificial Sequence
  Description of Artificial Sequence: Synthetic oligonucleotide
accgccagcggcagcaacgcc

SEQ ID NO: 44690 - DNA, 21 bp, Artificial Sequence
  Description of Artificial Sequence: Synthetic oligonucleotide
ggcgccgccgtccaagccaac

SEQ ID NO: 44691 - DNA, 21 bp, Artificial Sequence
  Description of Artificial Sequence: Synthetic oligonucleotide
aattctagtcataatgtttct

SEQ ID NO: 44692 - DNA, 21 bp, Artificial Sequence
  Description of Artificial Sequence: Synthetic oligonucleotide
gggaagtctcagatgcagttg

SEQ ID NO: 44693 - DNA, 21 bp, Artificial Sequence
  Description of Artificial Sequence: Synthetic oligonucleotide
ggcgtcagcgccaccgtcaaa

SEQ ID NO: 44694 - DNA, 21 bp, Artificial Sequence
  Description of Artificial Sequence: Synthetic oligonucleotide
ggcgccggcagagccctccaa

SEQ ID NO: 44695 - DNA, 21 bp, Artificial Sequence
  Description of Artificial Sequence: Synthetic oligonucleotide
cttcctggggttcgtgttgcg

SEQ ID NO: 44696 - DNA, 21 bp, Artificial Sequence
  Description of Artificial Sequence: Synthetic oligonucleotide
gccagagaccccggcggcgtc

SEQ ID NO: 44697 - DNA, 21 bp, Artificial Sequence
  Description of Artificial Sequence: Synthetic oligonucleotide
caaaacatcggcagacccagc

SEQ ID NO: 44698 - DNA, 21 bp, Artificial Sequence
  Description of Artificial Sequence: Synthetic oligonucleotide
gccagagacgaccaaagaaga

SEQ ID NO: 44699 - DNA, 21 bp, Artificial Sequence
  Description of Artificial Sequence: Synthetic oligonucleotide
atgtaccaaaaacccgccagc

SEQ ID NO: 44700 - DNA, 21 bp, Artificial Sequence
  Description of Artificial Sequence: Synthetic oligonucleotide
ggcaacagcatggccggcacc

SEQ ID NO: 44701 - DNA, 21 bp, Artificial Sequence
  Description of Artificial Sequence: Synthetic oligonucleotide
ggcctcagcgccatcaacaac

SEQ ID NO: 44702 - DNA, 21 bp, Artificial Sequence
  Description of Artificial Sequence: Synthetic oligonucleotide
accagcaccagaagcagctgc

SEQ ID NO: 44703 - DNA, 21 bp, Artificial Sequence
  Description of Artificial Sequence: Synthetic oligonucleotide
gtgacgatgcctccgagtgct

SEQ ID NO: 44704 - DNA, 21 bp, Artificial Sequence
  Description of Artificial Sequence: Synthetic oligonucleotide
atgagtcatactaagtcgaat

SEQ ID NO: 44705 - DNA, 21 bp, Artificial Sequence
  Description of Artificial Sequence: Synthetic oligonucleotide
aaacaacccgccagcacccac

SEQ ID NO: 44706 - DNA, 21 bp, Artificial Sequence
  Description of Artificial Sequence: Synthetic oligonucleotide
cacgacagcagcgccagaacc

SEQ ID NO: 44707 - DNA, 21 bp, Artificial Sequence
  Description of Artificial Sequence: Synthetic oligonucleotide
cagcggaatgtgagtgtggtt

SEQ ID NO: 44708 - DNA, 21 bp, Artificial Sequence
  Description of Artificial Sequence: Synthetic oligonucleotide
aggattggtcagggttcgagt

SEQ ID NO: 44709 - DNA, 21 bp, Artificial Sequence
  Description of Artificial Sequence: Synthetic oligonucleotide
aggagtacgaggattagtgag

SEQ ID NO: 44710 - DNA, 21 bp, Artificial Sequence
  Description of Artificial Sequence: Synthetic oligonucleotide
caagtcaacagcatccccgcc

SEQ ID NO: 44711 - DNA, 21 bp, Artificial Sequence
  Description of Artificial Sequence: Synthetic oligonucleotide
caaagacccagcaccggcaac

SEQ ID NO: 44712 - DNA, 21 bp, Artificial Sequence
  Description of Artificial Sequence: Synthetic oligonucleotide
agttttagggctcaggagggg

SEQ ID NO: 44713 - DNA, 21 bp, Artificial Sequence
  Description of Artificial Sequence: Synthetic oligonucleotide
gacagcacccacagagccacc

SEQ ID NO: 44714 - DNA, 21 bp, Artificial Sequence
  Description of Artificial Sequence: Synthetic oligonucleotide
ctcatgcacagcgccgtcagc

SEQ ID NO: 44715 - DNA, 21 bp, Artificial Sequence
  Description of Artificial Sequence: Synthetic oligonucleotide
acgcatcagagttcgacgtcg

SEQ ID NO: 44716 - DNA, 21 bp, Artificial Sequence
  Description of Artificial Sequence: Synthetic oligonucleotide
cccaacggcgcccacgtcacc

SEQ ID NO: 44717 - DNA, 21 bp, Artificial Sequence
  Description of Artificial Sequence: Synthetic oligonucleotide
caaaccagcagcagagaaatg

SEQ ID NO: 44718 - DNA, 21 bp, Artificial Sequence
  Description of Artificial Sequence: Synthetic oligonucleotide
gctaggggtgcttctactaat

SEQ ID NO: 44719 - DNA, 21 bp, Artificial Sequence
  Description of Artificial Sequence: Synthetic oligonucleotide
aatgggttttcgcctagggtg

SEQ ID NO: 44720 - DNA, 21 bp, Artificial Sequence
  Description of Artificial Sequence: Synthetic oligonucleotide
agaagcctccccaacgtcgcc

SEQ ID NO: 44721 - DNA, 21 bp, Artificial Sequence
  Description of Artificial Sequence: Synthetic oligonucleotide
ggtactacttctagtcgggat

SEQ ID NO: 44722 - DNA, 21 bp, Artificial Sequence
  Description of Artificial Sequence: Synthetic oligonucleotide
gctcagcggtcgactatggtg

SEQ ID NO: 44723 - DNA, 21 bp, Artificial Sequence
  Description of Artificial Sequence: Synthetic oligonucleotide
tctggtggtggtacgaggact

SEQ ID NO: 44724 - DNA, 21 bp, Artificial Sequence
  Description of Artificial Sequence: Synthetic oligonucleotide
caacccgccggcaaagtcgtc

SEQ ID NO: 44725 - DNA, 21 bp, Artificial Sequence
  Description of Artificial Sequence: Synthetic oligonucleotide
catcagtctggtagtacgtgt

SEQ ID NO: 44726 - DNA, 21 bp, Artificial Sequence
  Description of Artificial Sequence: Synthetic oligonucleotide
cagcttggtacgaataatagt

SEQ ID NO: 44727 - DNA, 21 bp, Artificial Sequence
  Description of Artificial Sequence: Synthetic oligonucleotide
tttcgggcgcaggctaatgtt

SEQ ID NO: 44728 - DNA, 21 bp, Artificial Sequence
  Description of Artificial Sequence: Synthetic oligonucleotide
agtcgtgctcagtcgcagatt

SEQ ID NO: 44729 - DNA, 21 bp, Artificial Sequence
  Description of Artificial Sequence: Synthetic oligonucleotide
ccgaggacggatcgtaatact

SEQ ID NO: 44730 - DNA, 21 bp, Artificial Sequence
  Description of Artificial Sequence: Synthetic oligonucleotide
aggactttgagtgcttcgtcg

SEQ ID NO: 44731 - DNA, 21 bp, Artificial Sequence
  Description of Artificial Sequence: Synthetic oligonucleotide
agttttagtcctgcttctaat

SEQ ID NO: 44732 - DNA, 21 bp, Artificial Sequence
  Description of Artificial Sequence: Synthetic oligonucleotide
gacagagccctccacatgagc

SEQ ID NO: 44733 - DNA, 21 bp, Artificial Sequence
  Description of Artificial Sequence: Synthetic oligonucleotide
aaaatcgccagcaaaagcgaa

SEQ ID NO: 44734 - DNA, 21 bp, Artificial Sequence
  Description of Artificial Sequence: Synthetic oligonucleotide
agcggcggcgactacgccaaa

SEQ ID NO: 44735 - DNA, 21 bp, Artificial Sequence
  Description of Artificial Sequence: Synthetic oligonucleotide
cccctcagagacagcatgccc

SEQ ID NO: 44736 - DNA, 21 bp, Artificial Sequence
  Description of Artificial Sequence: Synthetic oligonucleotide
actcagccttctcatgattcg

SEQ ID NO: 44737 - DNA, 21 bp, Artificial Sequence
  Description of Artificial Sequence: Synthetic oligonucleotide
gtgcagacgcatcaggttcgt

SEQ ID NO: 44738 - DNA, 21 bp, Artificial Sequence
  Description of Artificial Sequence: Synthetic oligonucleotide
gggattaattctcgggggtcg

SEQ ID NO: 44739 - DNA, 21 bp, Artificial Sequence
  Description of Artificial Sequence: Synthetic oligonucleotide
ctcatcagcgaaaccagcaga

SEQ ID NO: 44740 - DNA, 21 bp, Artificial Sequence
  Description of Artificial Sequence: Synthetic oligonucleotide
tcgagtgttgggaggctgaat

SEQ ID NO: 44741 - DNA, 21 bp, Artificial Sequence
  Description of Artificial Sequence: Synthetic oligonucleotide
aactacagcggcgcccacacc

SEQ ID NO: 44742 - DNA, 21 bp, Artificial Sequence
  Description of Artificial Sequence: Synthetic oligonucleotide
ggtactaattctactaggggt

SEQ ID NO: 44743 - DNA, 21 bp, Artificial Sequence
  Description of Artificial Sequence: Synthetic oligonucleotide
aaccaaagcagacccggcgtc

SEQ ID NO: 44744 - DNA, 21 bp, Artificial Sequence
  Description of Artificial Sequence: Synthetic oligonucleotide
tacgtcagcaacagcaacgcc

SEQ ID NO: 44745 - DNA, 21 bp, Artificial Sequence
  Description of Artificial Sequence: Synthetic oligonucleotide
gacaacatcagcagaagcaga

SEQ ID NO: 44746 - DNA, 21 bp, Artificial Sequence
  Description of Artificial Sequence: Synthetic oligonucleotide
acctacagcagcaaagccgac

SEQ ID NO: 44747 - DNA, 21 bp, Artificial Sequence
  Description of Artificial Sequence: Synthetic oligonucleotide
cgtgttgagagtcctactaat

SEQ ID NO: 44748 - DNA, 21 bp, Artificial Sequence
  Description of Artificial Sequence: Synthetic oligonucleotide
aattcggctgctttgaatagt

SEQ ID NO: 44749 - DNA, 21 bp, Artificial Sequence
  Description of Artificial Sequence: Synthetic oligonucleotide
gctcagattaatacgcctact

SEQ ID NO: 44750 - DNA, 21 bp, Artificial Sequence
  Description of Artificial Sequence: Synthetic oligonucleotide
ccgttgggtgctacgtttgcg

SEQ ID NO: 44751 - DNA, 21 bp, Artificial Sequence
  Description of Artificial Sequence: Synthetic oligonucleotide
tcgtatagtggtactcttggt

SEQ ID NO: 44752 - DNA, 21 bp, Artificial Sequence
  Description of Artificial Sequence: Synthetic oligonucleotide
tttgttagtggtaaggtgcag

SEQ ID NO: 44753 - DNA, 21 bp, Artificial Sequence
  Description of Artificial Sequence: Synthetic oligonucleotide
atgaacggcaaagacgtcgtc

SEQ ID NO: 44754 - DNA, 21 bp, Artificial Sequence
  Description of Artificial Sequence: Synthetic oligonucleotide
cctactagtaatgggagtctt

SEQ ID NO: 44755 - DNA, 21 bp, Artificial Sequence
  Description of Artificial Sequence: Synthetic oligonucleotide
tacagcggcctcaccggcagc

SEQ ID NO: 44756 - DNA, 21 bp, Artificial Sequence
  Description of Artificial Sequence: Synthetic oligonucleotide
aatattggttctcaggggcgt

SEQ ID NO: 44757 - DNA, 21 bp, Artificial Sequence
  Description of Artificial Sequence: Synthetic oligonucleotide
atgggtcatgctaagacggct

SEQ ID NO: 44758 - DNA, 21 bp, Artificial Sequence
  Description of Artificial Sequence: Synthetic oligonucleotide
ccgttgcagcctagggttgcg

SEQ ID NO: 44759 - DNA, 21 bp, Artificial Sequence
  Description of Artificial Sequence: Synthetic oligonucleotide
agggatggtgggcaggatcgg

SEQ ID NO: 44760 - DNA, 21 bp, Artificial Sequence
  Description of Artificial Sequence: Synthetic oligonucleotide
cagtgtaattcggcttgtcag

SEQ ID NO: 44761 - DNA, 21 bp, Artificial Sequence
  Description of Artificial Sequence: Synthetic oligonucleotide
accggcctcaaagaccaacac

SEQ ID NO: 44762 - DNA, 21 bp, Artificial Sequence
  Description of Artificial Sequence: Synthetic oligonucleotide
catgagctgtcgaggactact

SEQ ID NO: 44763 - DNA, 21 bp, Artificial Sequence
  Description of Artificial Sequence: Synthetic oligonucleotide
gggcggtcttctcatatggat

SEQ ID NO: 44764 - DNA, 21 bp, Artificial Sequence
  Description of Artificial Sequence: Synthetic oligonucleotide
tcggctgctaagcctgggcct

SEQ ID NO: 44765 - DNA, 21 bp, Artificial Sequence
  Description of Artificial Sequence: Synthetic oligonucleotide
atcggcagcaacgccagacaa

SEQ ID NO: 44766 - DNA, 21 bp, Artificial Sequence
  Description of Artificial Sequence: Synthetic oligonucleotide
ctgagtggtcatagtcctcag

SEQ ID NO: 44767 - DNA, 21 bp, Artificial Sequence
  Description of Artificial Sequence: Synthetic oligonucleotide
acgtctaattctattcagggg

SEQ ID NO: 44768 - DNA, 21 bp, Artificial Sequence
  Description of Artificial Sequence: Synthetic oligonucleotide
cctcttcagacgagtaggact

SEQ ID NO: 44769 - DNA, 21 bp, Artificial Sequence
  Description of Artificial Sequence: Synthetic oligonucleotide
cccaacaccaaacccgtcctc

SEQ ID NO: 44770 - DNA, 21 bp, Artificial Sequence
  Description of Artificial Sequence: Synthetic oligonucleotide
tcgttgaatagtagggagggt

SEQ ID NO: 44771 - DNA, 21 bp, Artificial Sequence
  Description of Artificial Sequence: Synthetic oligonucleotide
catcgtgatacgaatgggaag

SEQ ID NO: 44772 - DNA, 21 bp, Artificial Sequence
  Description of Artificial Sequence: Synthetic oligonucleotide
gctgagcagaggccggggcag

SEQ ID NO: 44773 - DNA, 21 bp, Artificial Sequence
  Description of Artificial Sequence: Synthetic oligonucleotide
ccggttttgaataaggcgacg

SEQ ID NO: 44774 - DNA, 21 bp, Artificial Sequence
  Description of Artificial Sequence: Synthetic oligonucleotide
cctaggactaataatcctagt

SEQ ID NO: 44775 - DNA, 21 bp, Artificial Sequence
  Description of Artificial Sequence: Synthetic oligonucleotide
cccctcgacaaaagcatgatg

SEQ ID NO: 44776 - DNA, 21 bp, Artificial Sequence
  Description of Artificial Sequence: Synthetic oligonucleotide
atgagcaccggcgtcagcccc

SEQ ID NO: 44777 - DNA, 21 bp, Artificial Sequence
  Description of Artificial Sequence: Synthetic oligonucleotide
aaacaacccgtcagcacccac

SEQ ID NO: 44778 - DNA, 21 bp, Artificial Sequence
  Description of Artificial Sequence: Synthetic oligonucleotide
gtcagaagcaaagaagcccac

SEQ ID NO: 44779 - DNA, 21 bp, Artificial Sequence
  Description of Artificial Sequence: Synthetic oligonucleotide
actcagcagaatgggagtaat

SEQ ID NO: 44780 - DNA, 21 bp, Artificial Sequence
  Description of Artificial Sequence: Synthetic oligonucleotide
tgccaaagcagcagagtcacc

SEQ ID NO: 44781 - DNA, 21 bp, Artificial Sequence
  Description of Artificial Sequence: Synthetic oligonucleotide
acgcagatgggtaagtcgaat

SEQ ID NO: 44782 - DNA, 21 bp, Artificial Sequence
  Description of Artificial Sequence: Synthetic oligonucleotide
gagtatcctcagcaggcgaag

SEQ ID NO: 44783 - DNA, 21 bp, Artificial Sequence
  Description of Artificial Sequence: Synthetic oligonucleotide
cccaacaacgccaccaaaaac

SEQ ID NO: 44784 - DNA, 21 bp, Artificial Sequence
  Description of Artificial Sequence: Synthetic oligonucleotide
gggtctcttccttcttgtcgg

SEQ ID NO: 44785 - DNA, 21 bp, Artificial Sequence
  Description of Artificial Sequence: Synthetic oligonucleotide
actcagcggtcgcaggctgct

SEQ ID NO: 44786 - DNA, 21 bp, Artificial Sequence
  Description of Artificial Sequence: Synthetic oligonucleotide
gagggtaatcgttctaatatg

SEQ ID NO: 44787 - DNA, 21 bp, Artificial Sequence
  Description of Artificial Sequence: Synthetic oligonucleotide
atgggggtgcggccgtcggcg

SEQ ID NO: 44788 - DNA, 21 bp, Artificial Sequence
  Description of Artificial Sequence: Synthetic oligonucleotide
cacggcgtcggcagcatggtc

SEQ ID NO: 44789 - DNA, 21 bp, Artificial Sequence
  Description of Artificial Sequence: Synthetic oligonucleotide
agcaccaccgcccaagtcaaa

SEQ ID NO: 44790 - DNA, 21 bp, Artificial Sequence
  Description of Artificial Sequence: Synthetic oligonucleotide
tcgcataataggacgaatgat

SEQ ID NO: 44791 - DNA, 21 bp, Artificial Sequence
  Description of Artificial Sequence: Synthetic oligonucleotide
aataattctatttctaatccg

SEQ ID NO: 44792 - DNA, 21 bp, Artificial Sequence
  Description of Artificial Sequence: Synthetic oligonucleotide
ggcggcctcagccccaaagtc

SEQ ID NO: 44793 - DNA, 21 bp, Artificial Sequence
  Description of Artificial Sequence: Synthetic oligonucleotide
tcgattccgtcgactagtcag

SEQ ID NO: 44794 - DNA, 21 bp, Artificial Sequence
  Description of Artificial Sequence: Synthetic oligonucleotide
accggcagcggcaccatcctc

SEQ ID NO: 44795 - DNA, 21 bp, Artificial Sequence
  Description of Artificial Sequence: Synthetic oligonucleotide
actgcgacgacgctttcgagt

SEQ ID NO: 44796 - DNA, 21 bp, Artificial Sequence
  Description of Artificial Sequence: Synthetic oligonucleotide
ccccccagcaacggcagactc

SEQ ID NO: 44797 - DNA, 21 bp, Artificial Sequence
  Description of Artificial Sequence: Synthetic oligonucleotide
caccaaagcagccccccctgc

SEQ ID NO: 44798 - DNA, 21 bp, Artificial Sequence
  Description of Artificial Sequence: Synthetic oligonucleotide
agtttttcgtcgactatgggt

SEQ ID NO: 44799 - DNA, 21 bp, Artificial Sequence
  Description of Artificial Sequence: Synthetic oligonucleotide
atgaggtctgagcgtgctgct

SEQ ID NO: 44800 - DNA, 21 bp, Artificial Sequence
  Description of Artificial Sequence: Synthetic oligonucleotide
ggtagtacgggtagttctatt

SEQ ID NO: 44801 - DNA, 21 bp, Artificial Sequence
  Description of Artificial Sequence: Synthetic oligonucleotide
ggcatcacccacggcagccac

SEQ ID NO: 44802 - DNA, 21 bp, Artificial Sequence
  Description of Artificial Sequence: Synthetic oligonucleotide
ggcacccccaacaccaaagtc

SEQ ID NO: 44803 - DNA, 21 bp, Artificial Sequence
  Description of Artificial Sequence: Synthetic oligonucleotide
ggcttccccaacgtcgccacc

SEQ ID NO: 44804 - DNA, 21 bp, Artificial Sequence
  Description of Artificial Sequence: Synthetic oligonucleotide
cctttgtctgggtcgaaggct

SEQ ID NO: 44805 - DNA, 21 bp, Artificial Sequence
  Description of Artificial Sequence: Synthetic oligonucleotide
gttactaagtcgggtaatggg

SEQ ID NO: 44806 - DNA, 21 bp, Artificial Sequence
  Description of Artificial Sequence: Synthetic oligonucleotide
gccagaagcgaaagcaccgcc

SEQ ID NO: 44807 - DNA, 21 bp, Artificial Sequence
  Description of Artificial Sequence: Synthetic oligonucleotide
tacgtcagcagcggcaaagcc

SEQ ID NO: 44808 - DNA, 21 bp, Artificial Sequence
  Description of Artificial Sequence: Synthetic oligonucleotide
cagaagggtaataatttgccg

SEQ ID NO: 44809 - DNA, 21 bp, Artificial Sequence
  Description of Artificial Sequence: Synthetic oligonucleotide
cagcctattattagtcctacg

SEQ ID NO: 44810 - DNA, 21 bp, Artificial Sequence
  Description of Artificial Sequence: Synthetic oligonucleotide
ggcagagacaacagcagacaa

SEQ ID NO: 44811 - DNA, 21 bp, Artificial Sequence
  Description of Artificial Sequence: Synthetic oligonucleotide
gtccccagccaaagcctccac

SEQ ID NO: 44812 - DNA, 21 bp, Artificial Sequence
  Description of Artificial Sequence: Synthetic oligonucleotide
ccgacggttcaggttacgaag

SEQ ID NO: 44813 - DNA, 21 bp, Artificial Sequence
  Description of Artificial Sequence: Synthetic oligonucleotide
ctcaccgccatccaccccgcc

SEQ ID NO: 44814 - DNA, 21 bp, Artificial Sequence
  Description of Artificial Sequence: Synthetic oligonucleotide
ctcagccaaagcaacacccac

SEQ ID NO: 44815 - DNA, 21 bp, Artificial Sequence
  Description of Artificial Sequence: Synthetic oligonucleotide
cgtgatcggactaatgctgct

SEQ ID NO: 44816 - DNA, 21 bp, Artificial Sequence
  Description of Artificial Sequence: Synthetic oligonucleotide
gtgggttctagtaagggttgt

SEQ ID NO: 44817 - DNA, 21 bp, Artificial Sequence
  Description of Artificial Sequence: Synthetic oligonucleotide
cttcctacgagtagtgttgcg

SEQ ID NO: 44818 - DNA, 21 bp, Artificial Sequence
  Description of Artificial Sequence: Synthetic oligonucleotide
aatgggattagtaagtctaat

SEQ ID NO: 44819 - DNA, 21 bp, Artificial Sequence
  Description of Artificial Sequence: Synthetic oligonucleotide
agcggcgtcgaaagagtcaac

SEQ ID NO: 44820 - DNA, 21 bp, Artificial Sequence
  Description of Artificial Sequence: Synthetic oligonucleotide
ctcgtcagaaccaccaccgcc

SEQ ID NO: 44821 - DNA, 21 bp, Artificial Sequence
  Description of Artificial Sequence: Synthetic oligonucleotide
tctcagtctaatagttttctg

SEQ ID NO: 44822 - DNA, 21 bp, Artificial Sequence
  Description of Artificial Sequence: Synthetic oligonucleotide
ccgtcgggtcctgttaggggg

SEQ ID NO: 44823 - DNA, 21 bp, Artificial Sequence
  Description of Artificial Sequence: Synthetic oligonucleotide
cacagaagcaacagcaccacc

SEQ ID NO: 44824 - DNA, 21 bp, Artificial Sequence
  Description of Artificial Sequence: Synthetic oligonucleotide
agagacagcaccgccgccaga

SEQ ID NO: 44825 - DNA, 21 bp, Artificial Sequence
  Description of Artificial Sequence: Synthetic oligonucleotide
cagtctatttctcatacgcgt

SEQ ID NO: 44826 - DNA, 21 bp, Artificial Sequence
  Description of Artificial Sequence: Synthetic oligonucleotide
cacaacaccgcccacgccagc

SEQ ID NO: 44827 - DNA, 21 bp, Artificial Sequence
  Description of Artificial Sequence: Synthetic oligonucleotide
tctccgcatcgggatacggtt

SEQ ID NO: 44828 - DNA, 21 bp, Artificial Sequence
  Description of Artificial Sequence: Synthetic oligonucleotide
tcgccgatgggtgttactcgg

SEQ ID NO: 44829 - DNA, 21 bp, Artificial Sequence
  Description of Artificial Sequence: Synthetic oligonucleotide
cggggtccgactggtatgatg

SEQ ID NO: 44830 - DNA, 21 bp, Artificial Sequence
  Description of Artificial Sequence: Synthetic oligonucleotide
acgacttatggtagtctgggg

SEQ ID NO: 44831 - DNA, 21 bp, Artificial Sequence
  Description of Artificial Sequence: Synthetic oligonucleotide
agtctgcatcaggtgggtggg

SEQ ID NO: 44832 - DNA, 21 bp, Artificial Sequence
  Description of Artificial Sequence: Synthetic oligonucleotide
agtggtcagcattctttgaat

SEQ ID NO: 44833 - DNA, 21 bp, Artificial Sequence
  Description of Artificial Sequence: Synthetic oligonucleotide
ggcaacagcaacaccctcgcc

SEQ ID NO: 44834 - DNA, 21 bp, Artificial Sequence
  Description of Artificial Sequence: Synthetic oligonucleotide
aacacccacaacatccaaggc

SEQ ID NO: 44835 - DNA, 21 bp, Artificial Sequence
  Description of Artificial Sequence: Synthetic oligonucleotide
gtccaacccgtcaaaatgagc

SEQ ID NO: 44836 - DNA, 21 bp, Artificial Sequence
  Description of Artificial Sequence: Synthetic oligonucleotide
aacgcttctggacagaatcaa

SEQ ID NO: 44837 - DNA, 21 bp, Artificial Sequence
  Description of Artificial Sequence: Synthetic oligonucleotide
gggcctaatccgggtaatcat

SEQ ID NO: 44838 - DNA, 21 bp, Artificial Sequence
  Description of Artificial Sequence: Synthetic oligonucleotide
agcagaaacgccgccaacgcc

SEQ ID NO: 44839 - DNA, 21 bp, Artificial Sequence
  Description of Artificial Sequence: Synthetic oligonucleotide
atgtctaggtctgatcctcct

SEQ ID NO: 44840 - DNA, 21 bp, Artificial Sequence
  Description of Artificial Sequence: Synthetic oligonucleotide
actggtactaagtcggataat

SEQ ID NO: 44841 - DNA, 21 bp, Artificial Sequence
  Description of Artificial Sequence: Synthetic oligonucleotide
aacggcagcggccaaacccaa

SEQ ID NO: 44842 - DNA, 21 bp, Artificial Sequence
  Description of Artificial Sequence: Synthetic oligonucleotide
aacagcggcgccagactcagc

SEQ ID NO: 44843 - DNA, 21 bp, Artificial Sequence
  Description of Artificial Sequence: Synthetic oligonucleotide
accaacagccaaaaactcgcc

SEQ ID NO: 44844 - DNA, 21 bp, Artificial Sequence
  Description of Artificial Sequence: Synthetic oligonucleotide
cttggggctgggcagagggag

SEQ ID NO: 44845 - DNA, 21 bp, Artificial Sequence
  Description of Artificial Sequence: Synthetic oligonucleotide
agcatgagcgaacacctcaaa

SEQ ID NO: 44846 - DNA, 21 bp, Artificial Sequence
  Description of Artificial Sequence: Synthetic oligonucleotide
ggtactggtcatcagaggtct

SEQ ID NO: 44847 - DNA, 21 bp, Artificial Sequence
  Description of Artificial Sequence: Synthetic oligonucleotide
caccacagcaccctccaaacc

SEQ ID NO: 44848 - DNA, 21 bp, Artificial Sequence
  Description of Artificial Sequence: Synthetic oligonucleotide
agcggcggcaaaagcgccctc

SEQ ID NO: 44849 - DNA, 21 bp, Artificial Sequence
  Description of Artificial Sequence: Synthetic oligonucleotide
gcgccgaatggtatgcaggct

SEQ ID NO: 44850 - DNA, 21 bp, Artificial Sequence
  Description of Artificial Sequence: Synthetic oligonucleotide
taccaagccaacgccctcggc

SEQ ID NO: 44851 - DNA, 21 bp, Artificial Sequence
  Description of Artificial Sequence: Synthetic oligonucleotide
agaaccggcaacaaccacgaa

SEQ ID NO: 44852 - DNA, 21 bp, Artificial Sequence
  Description of Artificial Sequence: Synthetic oligonucleotide
agtcagagtagtcctgttgcg

SEQ ID NO: 44853 - DNA, 21 bp, Artificial Sequence
  Description of Artificial Sequence: Synthetic oligonucleotide
gacggcctcagaaacagcctc

SEQ ID NO: 44854 - DNA, 21 bp, Artificial Sequence
  Description of Artificial Sequence: Synthetic oligonucleotide
gaccacagaaacatcagcagc

SEQ ID NO: 44855 - DNA, 21 bp, Artificial Sequence
  Description of Artificial Sequence: Synthetic oligonucleotide
tcggggggtactcacattgcg

SEQ ID NO: 44856 - DNA, 21 bp, Artificial Sequence
  Description of Artificial Sequence: Synthetic oligonucleotide
agtaatactaggtctctttcg

SEQ ID NO: 44857 - DNA, 21 bp, Artificial Sequence
  Description of Artificial Sequence: Synthetic oligonucleotide
gagaggcctgggggtacgcct

SEQ ID NO: 44858 - DNA, 21 bp, Artificial Sequence
  Description of Artificial Sequence: Synthetic oligonucleotide
agtgttgctgatactcgtctg

SEQ ID NO: 44859 - DNA, 21 bp, Artificial Sequence
  Description of Artificial Sequence: Synthetic oligonucleotide
ccgatgtctcatgtgtcgggg

SEQ ID NO: 44860 - DNA, 21 bp, Artificial Sequence
  Description of Artificial Sequence: Synthetic oligonucleotide
gacagaagcgccaccgccacc

SEQ ID NO: 44861 - DNA, 21 bp, Artificial Sequence
  Description of Artificial Sequence: Synthetic oligonucleotide
tgtttgcctaatcattgtaat

SEQ ID NO: 44862 - DNA, 21 bp, Artificial Sequence
  Description of Artificial Sequence: Synthetic oligonucleotide
cccaccagccaacaaagaccc

SEQ ID NO: 44863 - DNA, 21 bp, Artificial Sequence
  Description of Artificial Sequence: Synthetic oligonucleotide
cccaacctcaacagcagaggc

SEQ ID NO: 44864 - DNA, 21 bp, Artificial Sequence
  Description of Artificial Sequence: Synthetic oligonucleotide
atgaacagcggcagacacgtc

SEQ ID NO: 44865 - DNA, 21 bp, Artificial Sequence
  Description of Artificial Sequence: Synthetic oligonucleotide
aggaatcagggtgcgttgcag

SEQ ID NO: 44866 - DNA, 21 bp, Artificial Sequence
  Description of Artificial Sequence: Synthetic oligonucleotide
tcggcgtcgcatggtgctctg

SEQ ID NO: 44867 - DNA, 21 bp, Artificial Sequence
  Description of Artificial Sequence: Synthetic oligonucleotide
ggtaagacgaatgtgtctagt

SEQ ID NO: 44868 - DNA, 21 bp, Artificial Sequence
  Description of Artificial Sequence: Synthetic oligonucleotide
ggttttaccggttctcatgtg

SEQ ID NO: 44869 - DNA, 21 bp, Artificial Sequence
  Description of Artificial Sequence: Synthetic oligonucleotide
agcctcggcagcagacccagc

SEQ ID NO: 44870 - DNA, 21 bp, Artificial Sequence
  Description of Artificial Sequence: Synthetic oligonucleotide
aacagaaacggcttcaacaac

SEQ ID NO: 44871 - DNA, 21 bp, Artificial Sequence
  Description of Artificial Sequence: Synthetic oligonucleotide
agctacgtcggcaccaccgcc

SEQ ID NO: 44872 - DNA, 21 bp, Artificial Sequence
  Description of Artificial Sequence: Synthetic oligonucleotide
gtcaaccaaagcggcttcagc

SEQ ID NO: 44873 - DNA, 21 bp, Artificial Sequence
  Description of Artificial Sequence: Synthetic oligonucleotide
cagccttctcaggggcatagt

SEQ ID NO: 44874 - DNA, 21 bp, Artificial Sequence
  Description of Artificial Sequence: Synthetic oligonucleotide
aacggttctggaaagaatcaa

SEQ ID NO: 44875 - DNA, 21 bp, Artificial Sequence
  Description of Artificial Sequence: Synthetic oligonucleotide
agcagaaacggcggccccctc

SEQ ID NO: 44876 - DNA, 21 bp, Artificial Sequence
  Description of Artificial Sequence: Synthetic oligonucleotide
gaaggcatcagcagcatcagc

SEQ ID NO: 44877 - DNA, 21 bp, Artificial Sequence
  Description of Artificial Sequence: Synthetic oligonucleotide
ccctacaacagcaaagccagc

SEQ ID NO: 44878 - DNA, 21 bp, Artificial Sequence
  Description of Artificial Sequence: Synthetic oligonucleotide
gcggtgacgggtgcgagtggt

SEQ ID NO: 44879 - DNA, 21 bp, Artificial Sequence
  Description of Artificial Sequence: Synthetic oligonucleotide
tcggtgacgccgcatgttacg

SEQ ID NO: 44880 - DNA, 21 bp, Artificial Sequence
  Description of Artificial Sequence: Synthetic oligonucleotide
ccggtgagtggggcgactatt

SEQ ID NO: 44881 - DNA, 21 bp, Artificial Sequence
  Description of Artificial Sequence: Synthetic oligonucleotide
gggagtcgtgataattcgcgt

SEQ ID NO: 44882 - DNA, 21 bp, Artificial Sequence
  Description of Artificial Sequence: Synthetic oligonucleotide
agagaacccgccagaggcgac

SEQ ID NO: 44883 - DNA, 21 bp, Artificial Sequence
  Description of Artificial Sequence: Synthetic oligonucleotide
cccagaagccaacccgtcccc

SEQ ID NO: 44884 - DNA, 21 bp, Artificial Sequence
  Description of Artificial Sequence: Synthetic oligonucleotide
acgtctagtggtcattctgtt

SEQ ID NO: 44885 - DNA, 21 bp, Artificial Sequence
  Description of Artificial Sequence: Synthetic oligonucleotide
gccgacctcaccagaagcagc

SEQ ID NO: 44886 - DNA, 21 bp, Artificial Sequence
  Description of Artificial Sequence: Synthetic oligonucleotide
ctcggccccggcaaaaacacc

SEQ ID NO: 44887 - DNA, 21 bp, Artificial Sequence
  Description of Artificial Sequence: Synthetic oligonucleotide
tctactttttctccttctaag

SEQ ID NO: 44888 - DNA, 21 bp, Artificial Sequence
  Description of Artificial Sequence: Synthetic oligonucleotide
tctcctggtaataagagtact

SEQ ID NO: 44889 - DNA, 21 bp, Artificial Sequence
  Description of Artificial Sequence: Synthetic oligonucleotide
gatcgtcaggggttgtctggg

SEQ ID NO: 44890 - DNA, 21 bp, Artificial Sequence
  Description of Artificial Sequence: Synthetic oligonucleotide
ttcaacgaacaaagagtcagc

SEQ ID NO: 44891 - DNA, 21 bp, Artificial Sequence
  Description of Artificial Sequence: Synthetic oligonucleotide
cggtcttatgagggtatgcag

SEQ ID NO: 44892 - DNA, 21 bp, Artificial Sequence
  Description of Artificial Sequence: Synthetic oligonucleotide
atccccagcggcgtccacagc

SEQ ID NO: 44893 - DNA, 21 bp, Artificial Sequence
  Description of Artificial Sequence: Synthetic oligonucleotide
gatacgattacttcgaggggt

SEQ ID NO: 44894 - DNA, 21 bp, Artificial Sequence
  Description of Artificial Sequence: Synthetic oligonucleotide
cccagcgtcaacagaaccccc

SEQ ID NO: 44895 - DNA, 21 bp, Artificial Sequence
  Description of Artificial Sequence: Synthetic oligonucleotide
ccggtttcgacgcattcgtct

SEQ ID NO: 44896 - DNA, 21 bp, Artificial Sequence
  Description of Artificial Sequence: Synthetic oligonucleotide
agcagagtcaccagcgtcagc

SEQ ID NO: 44897 - DNA, 21 bp, Artificial Sequence
  Description of Artificial Sequence: Synthetic oligonucleotide
aggtcttctgggggtttgact

SEQ ID NO: 44898 - DNA, 21 bp, Artificial Sequence
  Description of Artificial Sequence: Synthetic oligonucleotide
agcaaaggcctcagcatggtc

SEQ ID NO: 44899 - DNA, 21 bp, Artificial Sequence
  Description of Artificial Sequence: Synthetic oligonucleotide
gataatccgaggcaggcttat

SEQ ID NO: 44900 - DNA, 21 bp, Artificial Sequence
  Description of Artificial Sequence: Synthetic oligonucleotide
gggacgactaattcgcgtaat

SEQ ID NO: 44901 - DNA, 21 bp, Artificial Sequence
  Description of Artificial Sequence: Synthetic oligonucleotide
ggtagttctaggtcgcttggg

SEQ ID NO: 44902 - DNA, 21 bp, Artificial Sequence
  Description of Artificial Sequence: Synthetic oligonucleotide
atgctcccccaaaacggcaga

SEQ ID NO: 44903 - DNA, 21 bp, Artificial Sequence
  Description of Artificial Sequence: Synthetic oligonucleotide
ggtagtaataggaatcctctt

SEQ ID NO: 44904 - DNA, 21 bp, Artificial Sequence
  Description of Artificial Sequence: Synthetic oligonucleotide
agcaccagcagagacgccacc

SEQ ID NO: 44905 - DNA, 21 bp, Artificial Sequence
  Description of Artificial Sequence: Synthetic oligonucleotide
catggttctagttcttttacg

SEQ ID NO: 44906 - DNA, 21 bp, Artificial Sequence
  Description of Artificial Sequence: Synthetic oligonucleotide
agcgacatgagcggccaaaga

SEQ ID NO: 44907 - DNA, 21 bp, Artificial Sequence
  Description of Artificial Sequence: Synthetic oligonucleotide
agaagcggcagcgtcaacccc

SEQ ID NO: 44908 - DNA, 21 bp, Artificial Sequence
  Description of Artificial Sequence: Synthetic oligonucleotide
ggcaccgccgacagacacctc

SEQ ID NO: 44909 - DNA, 21 bp, Artificial Sequence
  Description of Artificial Sequence: Synthetic oligonucleotide
tgcaccagcaaaagcagcagc

SEQ ID NO: 44910 - DNA, 21 bp, Artificial Sequence
  Description of Artificial Sequence: Synthetic oligonucleotide
gaaggcaccagaggcgtcggc

SEQ ID NO: 44911 - DNA, 21 bp, Artificial Sequence
  Description of Artificial Sequence: Synthetic oligonucleotide
cgtgttactaatcagaatgcg

SEQ ID NO: 44912 - DNA, 21 bp, Artificial Sequence
  Description of Artificial Sequence: Synthetic oligonucleotide
agcagaaacgtcaacgccatg

SEQ ID NO: 44913 - DNA, 21 bp, Artificial Sequence
  Description of Artificial Sequence: Synthetic oligonucleotide
gccggcggccccgccaacaga

SEQ ID NO: 44914 - DNA, 21 bp, Artificial Sequence
  Description of Artificial Sequence: Synthetic oligonucleotide
accggcagcggcagcaaccac

SEQ ID NO: 44915 - DNA, 21 bp, Artificial Sequence
  Description of Artificial Sequence: Synthetic oligonucleotide
ggcctccaaagcaaacaactc

SEQ ID NO: 44916 - DNA, 21 bp, Artificial Sequence
  Description of Artificial Sequence: Synthetic oligonucleotide
gctatgactggttcgcatact

SEQ ID NO: 44917 - DNA, 21 bp, Artificial Sequence
  Description of Artificial Sequence: Synthetic oligonucleotide
ccgagtactagtggtgcgatg

SEQ ID NO: 44918 - DNA, 21 bp, Artificial Sequence
  Description of Artificial Sequence: Synthetic oligonucleotide
agcagcgccaaccaccccaga

SEQ ID NO: 44919 - DNA, 21 bp, Artificial Sequence
  Description of Artificial Sequence: Synthetic oligonucleotide
ggccacgtcagccccgccttc

SEQ ID NO: 44920 - DNA, 21 bp, Artificial Sequence
  Description of Artificial Sequence: Synthetic oligonucleotide
agaaacgtcgacaaaagcagc

SEQ ID NO: 44921 - DNA, 21 bp, Artificial Sequence
  Description of Artificial Sequence: Synthetic oligonucleotide
taccccaaaaccaacgtcacc

SEQ ID NO: 44922 - DNA, 21 bp, Artificial Sequence
  Description of Artificial Sequence: Synthetic oligonucleotide
aatcctaatcagtctcttggg

SEQ ID NO: 44923 - DNA, 21 bp, Artificial Sequence
  Description of Artificial Sequence: Synthetic oligonucleotide
gccgtcgacagcaccagagcc

SEQ ID NO: 44924 - DNA, 21 bp, Artificial Sequence
  Description of Artificial Sequence: Synthetic oligonucleotide
gatactagtcgtgctccgggt

SEQ ID NO: 44925 - DNA, 21 bp, Artificial Sequence
  Description of Artificial Sequence: Synthetic oligonucleotide
gccaacaccaccagactcacc

SEQ ID NO: 44926 - DNA, 21 bp, Artificial Sequence
  Description of Artificial Sequence: Synthetic oligonucleotide
gtgccgcatggggctacttct

SEQ ID NO: 44927 - DNA, 21 bp, Artificial Sequence
  Description of Artificial Sequence: Synthetic oligonucleotide
acgtctactagtccgatgaag

SEQ ID NO: 44928 - DNA, 21 bp, Artificial Sequence
  Description of Artificial Sequence: Synthetic oligonucleotide
gaaacccccaacagaagccaa

SEQ ID NO: 44929 - DNA, 21 bp, Artificial Sequence
  Description of Artificial Sequence: Synthetic oligonucleotide
cgttcgaatcctactttggtg

SEQ ID NO: 44930 - DNA, 21 bp, Artificial Sequence
  Description of Artificial Sequence: Synthetic oligonucleotide
acggctacgcagaagggtcag

SEQ ID NO: 44931 - DNA, 21 bp, Artificial Sequence
  Description of Artificial Sequence: Synthetic oligonucleotide
ggtcatagttcgaataatgct

SEQ ID NO: 44932 - DNA, 21 bp, Artificial Sequence
  Description of Artificial Sequence: Synthetic oligonucleotide
ggtggtttgcatgggagtggt

SEQ ID NO: 44933 - DNA, 21 bp, Artificial Sequence
  Description of Artificial Sequence: Synthetic oligonucleotide
ccgaggagtactacgggtggg

SEQ ID NO: 44934 - DNA, 21 bp, Artificial Sequence
  Description of Artificial Sequence: Synthetic oligonucleotide
aatagtgggaagccgaatgcg

SEQ ID NO: 44935 - DNA, 21 bp, Artificial Sequence
  Description of Artificial Sequence: Synthetic oligonucleotide
aatacggtttcgaagtctcag

SEQ ID NO: 44936 - DNA, 21 bp, Artificial Sequence
  Description of Artificial Sequence: Synthetic oligonucleotide
gatgtgaagtctacgcatgcg

SEQ ID NO: 44937 - DNA, 21 bp, Artificial Sequence
  Description of Artificial Sequence: Synthetic oligonucleotide
gctggtactggtagttcgctt

SEQ ID NO: 44938 - DNA, 21 bp, Artificial Sequence
  Description of Artificial Sequence: Synthetic oligonucleotide
accacccacaacatgcaaggc

SEQ ID NO: 44939 - DNA, 21 bp, Artificial Sequence
  Description of Artificial Sequence: Synthetic oligonucleotide
agcagagaaaccgtccccacc

SEQ ID NO: 44940 - DNA, 21 bp, Artificial Sequence
  Description of Artificial Sequence: Synthetic oligonucleotide
cagtcgcattcggggatttct

SEQ ID NO: 44941 - DNA, 21 bp, Artificial Sequence
  Description of Artificial Sequence: Synthetic oligonucleotide
ccgcctaatctgaagttgagt

SEQ ID NO: 44942 - DNA, 21 bp, Artificial Sequence
  Description of Artificial Sequence: Synthetic oligonucleotide
cagcatactacgactaatcag

SEQ ID NO: 44943 - DNA, 21 bp, Artificial Sequence
  Description of Artificial Sequence: Synthetic oligonucleotide
agcaacgaaaccaaaagcagc

SEQ ID NO: 44944 - DNA, 21 bp, Artificial Sequence
  Description of Artificial Sequence: Synthetic oligonucleotide
gagcagggttcgggtaatcat

SEQ ID NO: 44945 - DNA, 21 bp, Artificial Sequence
  Description of Artificial Sequence: Synthetic oligonucleotide
ggcaccgacaacaacaccaga

SEQ ID NO: 44946 - DNA, 21 bp, Artificial Sequence
  Description of Artificial Sequence: Synthetic oligonucleotide
cacggcaccagccccctcaga

SEQ ID NO: 44947 - DNA, 21 bp, Artificial Sequence
  Description of Artificial Sequence: Synthetic oligonucleotide
gctactaattcgactcctagg

SEQ ID NO: 44948 - DNA, 21 bp, Artificial Sequence
  Description of Artificial Sequence: Synthetic oligonucleotide
cagagtaatccgcgtcctggt

SEQ ID NO: 44949 - DNA, 21 bp, Artificial Sequence
  Description of Artificial Sequence: Synthetic oligonucleotide
agttcgttgcagccttttact

SEQ ID NO: 44950 - DNA, 21 bp, Artificial Sequence
  Description of Artificial Sequence: Synthetic oligonucleotide
ggcaccgccagaggcgtcgcc

SEQ ID NO: 44951 - DNA, 21 bp, Artificial Sequence
  Description of Artificial Sequence: Synthetic oligonucleotide
gctgcgagtactgtgccgcgt

SEQ ID NO: 44952 - DNA, 21 bp, Artificial Sequence
  Description of Artificial Sequence: Synthetic oligonucleotide
actggtatgcagagtttgtcg

SEQ ID NO: 44953 - DNA, 21 bp, Artificial Sequence
  Description of Artificial Sequence: Synthetic oligonucleotide
gccagcagcagagaaagcctc

SEQ ID NO: 44954 - DNA, 21 bp, Artificial Sequence
  Description of Artificial Sequence: Synthetic oligonucleotide
cacggcagcggccaaaaccaa

SEQ ID NO: 44955 - DNA, 21 bp, Artificial Sequence
  Description of Artificial Sequence: Synthetic oligonucleotide
agagccggcagcgccgtcgaa

SEQ ID NO: 44956 - DNA, 21 bp, Artificial Sequence
  Description of Artificial Sequence: Synthetic oligonucleotide
ggcagcaccaccagcggcaga

SEQ ID NO: 44957 - DNA, 21 bp, Artificial Sequence
  Description of Artificial Sequence: Synthetic oligonucleotide
gtgcatacgggtcagaatggg

SEQ ID NO: 44958 - DNA, 21 bp, Artificial Sequence
  Description of Artificial Sequence: Synthetic oligonucleotide
cggggtcctgggcataatacg

SEQ ID NO: 44959 - DNA, 21 bp, Artificial Sequence
  Description of Artificial Sequence: Synthetic oligonucleotide
acgcgggatagtcaggttctt

SEQ ID NO: 44960 - DNA, 21 bp, Artificial Sequence
  Description of Artificial Sequence: Synthetic oligonucleotide
cccggcggcgtccccggcagc

SEQ ID NO: 44961 - DNA, 21 bp, Artificial Sequence
  Description of Artificial Sequence: Synthetic oligonucleotide
cattatggtgagactcggaat

SEQ ID NO: 44962 - DNA, 21 bp, Artificial Sequence
  Description of Artificial Sequence: Synthetic oligonucleotide
cacaaaagcggcctcgtcgac

SEQ ID NO: 44963 - DNA, 21 bp, Artificial Sequence
  Description of Artificial Sequence: Synthetic oligonucleotide
gctggtgtgacgactgttaat

SEQ ID NO: 44964 - DNA, 21 bp, Artificial Sequence
  Description of Artificial Sequence: Synthetic oligonucleotide
tacatcaacagccccagcaac

SEQ ID NO: 44965 - DNA, 21 bp, Artificial Sequence
  Description of Artificial Sequence: Synthetic oligonucleotide
tcgcgttctactgggacgctg

SEQ ID NO: 44966 - DNA, 21 bp, Artificial Sequence
  Description of Artificial Sequence: Synthetic oligonucleotide
gctctgaggaatcagagtcag

SEQ ID NO: 44967 - DNA, 21 bp, Artificial Sequence
  Description of Artificial Sequence: Synthetic oligonucleotide
ggggattctaagtctacgtgg

SEQ ID NO: 44968 - DNA, 21 bp, Artificial Sequence
  Description of Artificial Sequence: Synthetic oligonucleotide
gagcctcttcagggttcgcgt

SEQ ID NO: 44969 - DNA, 21 bp, Artificial Sequence
  Description of Artificial Sequence: Synthetic oligonucleotide
gcccacttcagcaccgaaaga

SEQ ID NO: 44970 - DNA, 21 bp, Artificial Sequence
  Description of Artificial Sequence: Synthetic oligonucleotide
ctcgtcagcaaaagcggcacc

SEQ ID NO: 44971 - DNA, 21 bp, Artificial Sequence
  Description of Artificial Sequence: Synthetic oligonucleotide
agcgccaccagcgtccccatc

SEQ ID NO: 44972 - DNA, 21 bp, Artificial Sequence
  Description of Artificial Sequence: Synthetic oligonucleotide
tcgagtccgactaatatggcg

SEQ ID NO: 44973 - DNA, 21 bp, Artificial Sequence
  Description of Artificial Sequence: Synthetic oligonucleotide
cagatttctgcgtcgactagg

SEQ ID NO: 44974 - DNA, 21 bp, Artificial Sequence
  Description of Artificial Sequence: Synthetic oligonucleotide
cgtgatccgaaggcgggtgtt

SEQ ID NO: 44975 - DNA, 21 bp, Artificial Sequence
  Description of Artificial Sequence: Synthetic oligonucleotide
gaaagagccaaaggcagcagc

SEQ ID NO: 44976 - DNA, 21 bp, Artificial Sequence
  Description of Artificial Sequence: Synthetic oligonucleotide
caagccaacaccatcggcaaa

SEQ ID NO: 44977 - DNA, 21 bp, Artificial Sequence
  Description of Artificial Sequence: Synthetic oligonucleotide
atggctctgcagccgaatagg

SEQ ID NO: 44978 - DNA, 21 bp, Artificial Sequence
  Description of Artificial Sequence: Synthetic oligonucleotide
ccttcgtctactccgaagctg

SEQ ID NO: 44979 - DNA, 21 bp, Artificial Sequence
  Description of Artificial Sequence: Synthetic oligonucleotide
tcgggttcgtctcctcctacg

SEQ ID NO: 44980 - DNA, 21 bp, Artificial Sequence
  Description of Artificial Sequence: Synthetic oligonucleotide
caggtgacgggtgcgagtcat

SEQ ID NO: 44981 - DNA, 21 bp, Artificial Sequence
  Description of Artificial Sequence: Synthetic oligonucleotide
agcctcggcagcggcttccaa

SEQ ID NO: 44982 - DNA, 21 bp, Artificial Sequence
  Description of Artificial Sequence: Synthetic oligonucleotide
gtgaatacgtctcatacgaat

SEQ ID NO: 44983 - DNA, 21 bp, Artificial Sequence
  Description of Artificial Sequence: Synthetic oligonucleotide
tatttgacgagtacgtctaat

SEQ ID NO: 44984 - DNA, 21 bp, Artificial Sequence
  Description of Artificial Sequence: Synthetic oligonucleotide
atgctgaatagtcgtacgtct

SEQ ID NO: 44985 - DNA, 21 bp, Artificial Sequence
  Description of Artificial Sequence: Synthetic oligonucleotide
ccttttggtgctggtcgtcct

SEQ ID NO: 44986 - DNA, 21 bp, Artificial Sequence
  Description of Artificial Sequence: Synthetic oligonucleotide
cccctccccaaaaacagcagc

SEQ ID NO: 44987 - DNA, 21 bp, Artificial Sequence
  Description of Artificial Sequence: Synthetic oligonucleotide
cacgccaaaagcagcagcatg

SEQ ID NO: 44988 - DNA, 21 bp, Artificial Sequence
  Description of Artificial Sequence: Synthetic oligonucleotide
accaacgccgccagagacagc

SEQ ID NO: 44989 - DNA, 21 bp, Artificial Sequence
  Description of Artificial Sequence: Synthetic oligonucleotide
ggtcttcagactccgcctcgt

SEQ ID NO: 44990 - DNA, 21 bp, Artificial Sequence
  Description of Artificial Sequence: Synthetic oligonucleotide
ggccacgacggccaaagcaga

SEQ ID NO: 44991 - DNA, 21 bp, Artificial Sequence
  Description of Artificial Sequence: Synthetic oligonucleotide
gccaccagccaactccccaga

SEQ ID NO: 44992 - DNA, 21 bp, Artificial Sequence
  Description of Artificial Sequence: Synthetic oligonucleotide
agcaccacccccggcctcaaa

SEQ ID NO: 44993 - DNA, 21 bp, Artificial Sequence
  Description of Artificial Sequence: Synthetic oligonucleotide
agggctactagtcgtgaggct

SEQ ID NO: 44994 - DNA, 21 bp, Artificial Sequence
  Description of Artificial Sequence: Synthetic oligonucleotide
ggccccgtcaacgcccacagc

SEQ ID NO: 44995 - DNA, 21 bp, Artificial Sequence
  Description of Artificial Sequence: Synthetic oligonucleotide
agtgcgaataataagtcgggg

SEQ ID NO: 44996 - DNA, 21 bp, Artificial Sequence
  Description of Artificial Sequence: Synthetic oligonucleotide
tcgcagcctggttctaatcat

SEQ ID NO: 44997 - DNA, 21 bp, Artificial Sequence
  Description of Artificial Sequence: Synthetic oligonucleotide
ggcagcatcagcaccgcccac

SEQ ID NO: 44998 - DNA, 21 bp, Artificial Sequence
  Description of Artificial Sequence: Synthetic oligonucleotide
gctggtacgaattctaggcag

SEQ ID NO: 44999 - DNA, 21 bp, Artificial Sequence
  Description of Artificial Sequence: Synthetic oligonucleotide
aatgcgcagggtactgctaag

SEQ ID NO: 45000 - DNA, 21 bp, Artificial Sequence
  Description of Artificial Sequence: Synthetic oligonucleotide
atgtcgacttcttcttctcgt

SEQ ID NO: 45001 - DNA, 21 bp, Artificial Sequence
  Description of Artificial Sequence: Synthetic oligonucleotide
accagaaccgccggcgtcgac

SEQ ID NO: 45002 - DNA, 21 bp, Artificial Sequence
  Description of Artificial Sequence: Synthetic oligonucleotide
ttcggccaacaagccggcatg

SEQ ID NO: 45003 - DNA, 21 bp, Artificial Sequence
  Description of Artificial Sequence: Synthetic oligonucleotide
gacagcagaaacaacatgacc

SEQ ID NO: 45004 - DNA, 21 bp, Artificial Sequence
  Description of Artificial Sequence: Synthetic oligonucleotide
caaaacctccccaaagccagc

SEQ ID NO: 45005 - DNA, 21 bp, Artificial Sequence
  Description of Artificial Sequence: Synthetic oligonucleotide
gctgctcattcgactatgaat

SEQ ID NO: 45006 - DNA, 21 bp, Artificial Sequence
  Description of Artificial Sequence: Synthetic oligonucleotide
gttccgcataatcattcgttg

SEQ ID NO: 45007 - DNA, 21 bp, Artificial Sequence
  Description of Artificial Sequence: Synthetic oligonucleotide
gggatgggtaatgatccgcgg

SEQ ID NO: 45008 - DNA, 21 bp, Artificial Sequence
  Description of Artificial Sequence: Synthetic oligonucleotide
agcagccccagcagaagcagc

SEQ ID NO: 45009 - DNA, 21 bp, Artificial Sequence
  Description of Artificial Sequence: Synthetic oligonucleotide
cccggcagcggcagcaacaac

SEQ ID NO: 45010 - DNA, 21 bp, Artificial Sequence
  Description of Artificial Sequence: Synthetic oligonucleotide
acgactttgccgtctagtaag

SEQ ID NO: 45011 - DNA, 21 bp, Artificial Sequence
  Description of Artificial Sequence: Synthetic oligonucleotide
gtcagagaaagcagaagcagc

SEQ ID NO: 45012 - DNA, 21 bp, Artificial Sequence
  Description of Artificial Sequence: Synthetic oligonucleotide
tcgtcgacggtgaagagtggt

SEQ ID NO: 45013 - DNA, 21 bp, Artificial Sequence
  Description of Artificial Sequence: Synthetic oligonucleotide
accagcagcggcaacctcagc

SEQ ID NO: 45014 - DNA, 21 bp, Artificial Sequence
  Description of Artificial Sequence: Synthetic oligonucleotide
accatgagcaccagacaaagc

SEQ ID NO: 45015 - DNA, 21 bp, Artificial Sequence
  Description of Artificial Sequence: Synthetic oligonucleotide
agcaccctcaacgccggcgcc

SEQ ID NO: 45016 - DNA, 21 bp, Artificial Sequence
  Description of Artificial Sequence: Synthetic oligonucleotide
cacctccacgccagccccgcc

SEQ ID NO: 45017 - DNA, 21 bp, Artificial Sequence
  Description of Artificial Sequence: Synthetic oligonucleotide
ggccccgccgtcaccaacaga

SEQ ID NO: 45018 - DNA, 21 bp, Artificial Sequence
  Description of Artificial Sequence: Synthetic oligonucleotide
gcgaatggtagtggtgttggg

SEQ ID NO: 45019 - DNA, 21 bp, Artificial Sequence
  Description of Artificial Sequence: Synthetic oligonucleotide
agcgccctcatgaacaacggc

SEQ ID NO: 45020 - DNA, 21 bp, Artificial Sequence
  Description of Artificial Sequence: Synthetic oligonucleotide
agccaagtcagcaaaccccaa

SEQ ID NO: 45021 - DNA, 21 bp, Artificial Sequence
  Description of Artificial Sequence: Synthetic oligonucleotide
ccttctactcagtcgagttct

SEQ ID NO: 45022 - DNA, 21 bp, Artificial Sequence
  Description of Artificial Sequence: Synthetic oligonucleotide
aacggcttcaacagcaacaac

SEQ ID NO: 45023 - DNA, 21 bp, Artificial Sequence
  Description of Artificial Sequence: Synthetic oligonucleotide
agcctcagcaaaagccaaagc

SEQ ID NO: 45024 - DNA, 21 bp, Artificial Sequence
  Description of Artificial Sequence: Synthetic oligonucleotide
agccaacaaagccccagcatg

SEQ ID NO: 45025 - DNA, 21 bp, Artificial Sequence
  Description of Artificial Sequence: Synthetic oligonucleotide
caggtgcatggtaagactcag

SEQ ID NO: 45026 - DNA, 21 bp, Artificial Sequence
  Description of Artificial Sequence: Synthetic oligonucleotide
ggtcaggcttctcatatgaag

SEQ ID NO: 45027 - DNA, 21 bp, Artificial Sequence
  Description of Artificial Sequence: Synthetic oligonucleotide
gccccccacagcgccgccaac

SEQ ID NO: 45028 - DNA, 21 bp, Artificial Sequence
  Description of Artificial Sequence: Synthetic oligonucleotide
cacgccaacaacaaactcatg

SEQ ID NO: 45029 - DNA, 21 bp, Artificial Sequence
  Description of Artificial Sequence: Synthetic oligonucleotide
agcgacatcaacagaagcacc

SEQ ID NO: 45030 - DNA, 21 bp, Artificial Sequence
  Description of Artificial Sequence: Synthetic oligonucleotide
ggccaaaacacccacctcacc

SEQ ID NO: 45031 - DNA, 21 bp, Artificial Sequence
  Description of Artificial Sequence: Synthetic oligonucleotide
agtgtttctactaagagtgct

SEQ ID NO: 45032 - DNA, 21 bp, Artificial Sequence
  Description of Artificial Sequence: Synthetic oligonucleotide
tcgaaggttactgcgcagtct

SEQ ID NO: 45033 - DNA, 21 bp, Artificial Sequence
  Description of Artificial Sequence: Synthetic oligonucleotide
agccacaacagcaaagacagc

SEQ ID NO: 45034 - DNA, 21 bp, Artificial Sequence
  Description of Artificial Sequence: Synthetic oligonucleotide
gtcagcagcaacgccagcatg

SEQ ID NO: 45035 - DNA, 21 bp, Artificial Sequence
  Description of Artificial Sequence: Synthetic oligonucleotide
attaagccgtcttcttcggct

SEQ ID NO: 45036 - DNA, 21 bp, Artificial Sequence
  Description of Artificial Sequence: Synthetic oligonucleotide
ctcgtccacaaaggccccgtc

SEQ ID NO: 45037 - DNA, 21 bp, Artificial Sequence
  Description of Artificial Sequence: Synthetic oligonucleotide
cctcctgtgacgactcgtcct

SEQ ID NO: 45038 - DNA, 21 bp, Artificial Sequence
  Description of Artificial Sequence: Synthetic oligonucleotide
agcacccaccaccccgccagc

SEQ ID NO: 45039 - DNA, 21 bp, Artificial Sequence
  Description of Artificial Sequence: Synthetic oligonucleotide
tcgtcgagtcctaatgttaag

SEQ ID NO: 45040 - DNA, 21 bp, Artificial Sequence
  Description of Artificial Sequence: Synthetic oligonucleotide
gcccaaaccaaaggcacccaa

SEQ ID NO: 45041 - DNA, 21 bp, Artificial Sequence
  Description of Artificial Sequence: Synthetic oligonucleotide
agtactactgggggggctagt

SEQ ID NO: 45042 - DNA, 21 bp, Artificial Sequence
  Description of Artificial Sequence: Synthetic oligonucleotide
gtcaacatgagaaacaccatg

SEQ ID NO: 45043 - DNA, 21 bp, Artificial Sequence
  Description of Artificial Sequence: Synthetic oligonucleotide
tgcggcagacccctccccgcc

SEQ ID NO: 45044 - DNA, 21 bp, Artificial Sequence
  Description of Artificial Sequence: Synthetic oligonucleotide
ggcaccggcaccaccttcaga

SEQ ID NO: 45045 - DNA, 21 bp, Artificial Sequence
  Description of Artificial Sequence: Synthetic oligonucleotide
aacaccacccccagcagaggc

SEQ ID NO: 45046 - DNA, 21 bp, Artificial Sequence
  Description of Artificial Sequence: Synthetic oligonucleotide
ggccacgtcaacgcccacgtc

SEQ ID NO: 45047 - DNA, 21 bp, Artificial Sequence
  Description of Artificial Sequence: Synthetic oligonucleotide
aacaccaacggcagccaaaga

SEQ ID NO: 45048 - DNA, 21 bp, Artificial Sequence
  Description of Artificial Sequence: Synthetic oligonucleotide
gcgtctcttcgggagtcgcgt

SEQ ID NO: 45049 - DNA, 21 bp, Artificial Sequence
  Description of Artificial Sequence: Synthetic oligonucleotide
ggcagcggcaacaaagtcaac

SEQ ID NO: 45050 - DNA, 21 bp, Artificial Sequence
  Description of Artificial Sequence: Synthetic oligonucleotide
atgcagactagtcagtcgact

SEQ ID NO: 45051 - DNA, 21 bp, Artificial Sequence
  Description of Artificial Sequence: Synthetic oligonucleotide
agtagttcggcgcctcgtctt

SEQ ID NO: 45052 - DNA, 21 bp, Artificial Sequence
  Description of Artificial Sequence: Synthetic oligonucleotide
atcccccacgccggcaccgcc

SEQ ID NO: 45053 - DNA, 21 bp, Artificial Sequence
  Description of Artificial Sequence: Synthetic oligonucleotide
agagccagccaaagcgtcggc

SEQ ID NO: 45054 - DNA, 21 bp, Artificial Sequence
  Description of Artificial Sequence: Synthetic oligonucleotide
gccaccaacaacggcagcaaa

SEQ ID NO: 45055 - DNA, 21 bp, Artificial Sequence
  Description of Artificial Sequence: Synthetic oligonucleotide
accgtcaccaacgccgccaga

SEQ ID NO: 45056 - DNA, 21 bp, Artificial Sequence
  Description of Artificial Sequence: Synthetic oligonucleotide
agcagcggcctcagcagcagc

SEQ ID NO: 45057 - DNA, 21 bp, Artificial Sequence
  Description of Artificial Sequence: Synthetic oligonucleotide
gaccccctcagacacagcgtc

SEQ ID NO: 45058 - DNA, 21 bp, Artificial Sequence
  Description of Artificial Sequence: Synthetic oligonucleotide
ggcgccatcagcaacgaacac

SEQ ID NO: 45059 - DNA, 21 bp, Artificial Sequence
  Description of Artificial Sequence: Synthetic oligonucleotide
aacagagtcgaacacacccaa

SEQ ID NO: 45060 - DNA, 21 bp, Artificial Sequence
  Description of Artificial Sequence: Synthetic oligonucleotide
gagcgtacgccgcctaggatt

SEQ ID NO: 45061 - DNA, 21 bp, Artificial Sequence
  Description of Artificial Sequence: Synthetic oligonucleotide
atgcccctcaaaccccacctc

SEQ ID NO: 45062 - DNA, 21 bp, Artificial Sequence
  Description of Artificial Sequence: Synthetic oligonucleotide
ggtgataagactcaggcgatg

SEQ ID NO: 45063 - DNA, 21 bp, Artificial Sequence
  Description of Artificial Sequence: Synthetic oligonucleotide
tcgactaatcctgcgaatcgg

SEQ ID NO: 45064 - DNA, 21 bp, Artificial Sequence
  Description of Artificial Sequence: Synthetic oligonucleotide
accccccaccaaagaagcagc

SEQ ID NO: 45065 - DNA, 21 bp, Artificial Sequence
  Description of Artificial Sequence: Synthetic oligonucleotide
gcgcaggttgataagcggagt

SEQ ID NO: 45066 - DNA, 21 bp, Artificial Sequence
  Description of Artificial Sequence: Synthetic oligonucleotide
cgttcttcggatcggagtgcg

SEQ ID NO: 45067 - DNA, 21 bp, Artificial Sequence
  Description of Artificial Sequence: Synthetic oligonucleotide
atgtcgcgtctgccgtctacg

SEQ ID NO: 45068 - DNA, 21 bp, Artificial Sequence
  Description of Artificial Sequence: Synthetic oligonucleotide
accaaatacgaaggctacacc

SEQ ID NO: 45069 - DNA, 21 bp, Artificial Sequence
  Description of Artificial Sequence: Synthetic oligonucleotide
cgggatggtgctcatcttagg

SEQ ID NO: 45070 - DNA, 21 bp, Artificial Sequence
  Description of Artificial Sequence: Synthetic oligonucleotide
tatggttcgcgtccgccttct

SEQ ID NO: 45071 - DNA, 21 bp, Artificial Sequence
  Description of Artificial Sequence: Synthetic oligonucleotide
aggaatgattctcgtccgccg

SEQ ID NO: 45072 - DNA, 21 bp, Artificial Sequence
  Description of Artificial Sequence: Synthetic oligonucleotide
ggcggcaaccccagcggcagc

SEQ ID NO: 45073 - DNA, 21 bp, Artificial Sequence
  Description of Artificial Sequence: Synthetic oligonucleotide
tctcttagtaagcaggcggcg

SEQ ID NO: 45074 - DNA, 21 bp, Artificial Sequence
  Description of Artificial Sequence: Synthetic oligonucleotide
gctactggtcgttcgccgaat

SEQ ID NO: 45075 - DNA, 21 bp, Artificial Sequence
  Description of Artificial Sequence: Synthetic oligonucleotide
gtgggtggtggtcgtgataat

SEQ ID NO: 45076 - DNA, 21 bp, Artificial Sequence
  Description of Artificial Sequence: Synthetic oligonucleotide
tcttcgcagcagaaggcttct

SEQ ID NO: 45077 - DNA, 21 bp, Artificial Sequence
  Description of Artificial Sequence: Synthetic oligonucleotide
aacagaagcaacaacagcgtc

SEQ ID NO: 45078 - DNA, 21 bp, Artificial Sequence
  Description of Artificial Sequence: Synthetic oligonucleotide
tcgaggggggatggtgtgacg

SEQ ID NO: 45079 - DNA, 21 bp, Artificial Sequence
  Description of Artificial Sequence: Synthetic oligonucleotide
gccctcgccaacccccaaacc

SEQ ID NO: 45080 - DNA, 21 bp, Artificial Sequence
  Description of Artificial Sequence: Synthetic oligonucleotide
attcctgggcatcctactgcg

SEQ ID NO: 45081 - DNA, 21 bp, Artificial Sequence
  Description of Artificial Sequence: Synthetic oligonucleotide
ggcttccccagcggcaccaga

SEQ ID NO: 45082 - DNA, 21 bp, Artificial Sequence
  Description of Artificial Sequence: Synthetic oligonucleotide
cccaccaccctcaaacacgac

SEQ ID NO: 45083 - DNA, 21 bp, Artificial Sequence
  Description of Artificial Sequence: Synthetic oligonucleotide
agcatccccagcaccgtcaga

SEQ ID NO: 45084 - DNA, 21 bp, Artificial Sequence
  Description of Artificial Sequence: Synthetic oligonucleotide
aacagactccccgccaccaaa

SEQ ID NO: 45085 - DNA, 21 bp, Artificial Sequence
  Description of Artificial Sequence: Synthetic oligonucleotide
agcgacaacaaaggcagcgtc

SEQ ID NO: 45086 - DNA, 21 bp, Artificial Sequence
  Description of Artificial Sequence: Synthetic oligonucleotide
atggctacgtcgacggttaag

SEQ ID NO: 45087 - DNA, 21 bp, Artificial Sequence
  Description of Artificial Sequence: Synthetic oligonucleotide
tacaacggcggcaacagaagc

SEQ ID NO: 45088 - DNA, 21 bp, Artificial Sequence
  Description of Artificial Sequence: Synthetic oligonucleotide
ggcaccagcctcaaaatgagc

SEQ ID NO: 45089 - DNA, 21 bp, Artificial Sequence
  Description of Artificial Sequence: Synthetic oligonucleotide
ctcctcaacagcaccggcatg

SEQ ID NO: 45090 - DNA, 21 bp, Artificial Sequence
  Description of Artificial Sequence: Synthetic oligonucleotide
tttatgggttcgccgacgacg

SEQ ID NO: 45091 - DNA, 21 bp, Artificial Sequence
  Description of Artificial Sequence: Synthetic oligonucleotide
agcggcagcgaacacctcaga

SEQ ID NO: 45092 - DNA, 21 bp, Artificial Sequence
  Description of Artificial Sequence: Synthetic oligonucleotide
ggcaacaccaaaaacggcatc

SEQ ID NO: 45093 - DNA, 21 bp, Artificial Sequence
  Description of Artificial Sequence: Synthetic oligonucleotide
attcgttcgacttctggtggg

SEQ ID NO: 45094 - DNA, 21 bp, Artificial Sequence
  Description of Artificial Sequence: Synthetic oligonucleotide
agtggtgtggtgaagtctagt

SEQ ID NO: 45095 - DNA, 21 bp, Artificial Sequence
  Description of Artificial Sequence: Synthetic oligonucleotide
tcgagtgcggggacttatact

SEQ ID NO: 45096 - DNA, 21 bp, Artificial Sequence
  Description of Artificial Sequence: Synthetic oligonucleotide
gcccaacaaagagcccaagcc

SEQ ID NO: 45097 - DNA, 21 bp, Artificial Sequence
  Description of Artificial Sequence: Synthetic oligonucleotide
tcttcgccgactcgtagtttg

SEQ ID NO: 45098 - DNA, 21 bp, Artificial Sequence
  Description of Artificial Sequence: Synthetic oligonucleotide
tggggtaatgagctgcgtcgg

SEQ ID NO: 45099 - DNA, 21 bp, Artificial Sequence
  Description of Artificial Sequence: Synthetic oligonucleotide
cccctcagcaaaagcgccctc

SEQ ID NO: 45100 - DNA, 21 bp, Artificial Sequence
  Description of Artificial Sequence: Synthetic oligonucleotide
ccgatttcgagtaagattcat

SEQ ID NO: 45101 - DNA, 21 bp, Artificial Sequence
  Description of Artificial Sequence: Synthetic oligonucleotide
accggcaacaaaggcggcgtc

SEQ ID NO: 45102 - DNA, 21 bp, Artificial Sequence
  Description of Artificial Sequence: Synthetic oligonucleotide
aggactgtgaatagtgctaat

SEQ ID NO: 45103 - DNA, 21 bp, Artificial Sequence
  Description of Artificial Sequence: Synthetic oligonucleotide
accggcatcgaaagacccatg

SEQ ID NO: 45104 - DNA, 21 bp, Artificial Sequence
  Description of Artificial Sequence: Synthetic oligonucleotide
cagcttagtggggcgcgtagt

SEQ ID NO: 45105 - DNA, 21 bp, Artificial Sequence
  Description of Artificial Sequence: Synthetic oligonucleotide
agaagccccagcaccaacccc

SEQ ID NO: 45106 - DNA, 21 bp, Artificial Sequence
  Description of Artificial Sequence: Synthetic oligonucleotide
cacgacagaggccaaaacggc

SEQ ID NO: 45107 - DNA, 21 bp, Artificial Sequence
  Description of Artificial Sequence: Synthetic oligonucleotide
gtgtctaattcgccttcgagg

SEQ ID NO: 45108 - DNA, 21 bp, Artificial Sequence
  Description of Artificial Sequence: Synthetic oligonucleotide
cacagcagcagacccctcgaa

SEQ ID NO: 45109 - DNA, 21 bp, Artificial Sequence
  Description of Artificial Sequence: Synthetic oligonucleotide
cgtaagccggggtctatgatg

SEQ ID NO: 45110 - DNA, 21 bp, Artificial Sequence
  Description of Artificial Sequence: Synthetic oligonucleotide
aattcggttggtcatagtagg

SEQ ID NO: 45111 - DNA, 21 bp, Artificial Sequence
  Description of Artificial Sequence: Synthetic oligonucleotide
cgtcagacggataagttgagt

SEQ ID NO: 45112 - DNA, 21 bp, Artificial Sequence
  Description of Artificial Sequence: Synthetic oligonucleotide
gcccccctccaaagcaacctc

SEQ ID NO: 45113 - DNA, 21 bp, Artificial Sequence
  Description of Artificial Sequence: Synthetic oligonucleotide
gctaggggtaagccggctctg

SEQ ID NO: 45114 - DNA, 21 bp, Artificial Sequence
  Description of Artificial Sequence: Synthetic oligonucleotide
cccggcagaccccaaaccgac

SEQ ID NO: 45115 - DNA, 21 bp, Artificial Sequence
  Description of Artificial Sequence: Synthetic oligonucleotide
accagacaaggcatgggcagc

SEQ ID NO: 45116 - DNA, 21 bp, Artificial Sequence
  Description of Artificial Sequence: Synthetic oligonucleotide
ggtgctgagcggacggttctt

SEQ ID NO: 45117 - DNA, 21 bp, Artificial Sequence
  Description of Artificial Sequence: Synthetic oligonucleotide
atgggccaagtcggcgtcaga

SEQ ID NO: 45118 - DNA, 21 bp, Artificial Sequence
  Description of Artificial Sequence: Synthetic oligonucleotide
aacaacggcagacccatcgcc

SEQ ID NO: 45119 - DNA, 21 bp, Artificial Sequence
  Description of Artificial Sequence: Synthetic oligonucleotide
tacagaaacgtcaacagcagc

SEQ ID NO: 45120 - DNA, 21 bp, Artificial Sequence
  Description of Artificial Sequence: Synthetic oligonucleotide
aacggcagcggccaacaccaa

SEQ ID NO: 45121 - DNA, 21 bp, Artificial Sequence
  Description of Artificial Sequence: Synthetic oligonucleotide
agcatccccatcagccacgtc

SEQ ID NO: 45122 - DNA, 21 bp, Artificial Sequence
  Description of Artificial Sequence: Synthetic oligonucleotide
agcaacggccaaggccccgcc

SEQ ID NO: 45123 - DNA, 21 bp, Artificial Sequence
  Description of Artificial Sequence: Synthetic oligonucleotide
ggcatgcacagcgtcgccaaa

SEQ ID NO: 45124 - DNA, 21 bp, Artificial Sequence
  Description of Artificial Sequence: Synthetic oligonucleotide
ggggcttcgactcctaggctt

SEQ ID NO: 45125 - DNA, 21 bp, Artificial Sequence
  Description of Artificial Sequence: Synthetic oligonucleotide
ggcctcaaaggcagcttcccc

SEQ ID NO: 45126 - DNA, 21 bp, Artificial Sequence
  Description of Artificial Sequence: Synthetic oligonucleotide
agtaatccgagtgggttttcg

SEQ ID NO: 45127 - DNA, 21 bp, Artificial Sequence
  Description of Artificial Sequence: Synthetic oligonucleotide
tctacggtgggtcatatgact

SEQ ID NO: 45128 - DNA, 21 bp, Artificial Sequence
  Description of Artificial Sequence: Synthetic oligonucleotide
gggccgtcttctcctcggctt

SEQ ID NO: 45129 - DNA, 21 bp, Artificial Sequence
  Description of Artificial Sequence: Synthetic oligonucleotide
ggccaagccgtcaacaccgcc

SEQ ID NO: 45130 - DNA, 21 bp, Artificial Sequence
  Description of Artificial Sequence: Synthetic oligonucleotide
ggcgccagcgtcaaccaaggc

SEQ ID NO: 45131 - DNA, 21 bp, Artificial Sequence
  Description of Artificial Sequence: Synthetic oligonucleotide
actactatgagtaagccttcg

SEQ ID NO: 45132 - DNA, 21 bp, Artificial Sequence
  Description of Artificial Sequence: Synthetic oligonucleotide
acgtcttctgcgcgtgttacg

SEQ ID NO: 45133 - DNA, 21 bp, Artificial Sequence
  Description of Artificial Sequence: Synthetic oligonucleotide
ggggataagaatcatggtagt

SEQ ID NO: 45134 - DNA, 21 bp, Artificial Sequence
  Description of Artificial Sequence: Synthetic oligonucleotide
cccaccctcggcaccaccaaa

SEQ ID NO: 45135 - DNA, 21 bp, Artificial Sequence
  Description of Artificial Sequence: Synthetic oligonucleotide
cacatgacccacaccaccgcc

SEQ ID NO: 45136 - DNA, 21 bp, Artificial Sequence
  Description of Artificial Sequence: Synthetic oligonucleotide
gttgcttcttcggctcatgtt

SEQ ID NO: 45137 - DNA, 21 bp, Artificial Sequence
  Description of Artificial Sequence: Synthetic oligonucleotide
tcgtatcctagtcagttgaat

SEQ ID NO: 45138 - DNA, 21 bp, Artificial Sequence
  Description of Artificial Sequence: Synthetic oligonucleotide
cccaccaaagccaacgtcacc

SEQ ID NO: 45139 - DNA, 21 bp, Artificial Sequence
  Description of Artificial Sequence: Synthetic oligonucleotide
ggtcggagtccgacggcttct

SEQ ID NO: 45140 - DNA, 21 bp, Artificial Sequence
  Description of Artificial Sequence: Synthetic oligonucleotide
gccaccggcagaaacaccgcc

SEQ ID NO: 45141 - DNA, 21 bp, Artificial Sequence
  Description of Artificial Sequence: Synthetic oligonucleotide
agcagcggcagcaacagaagc

SEQ ID NO: 45142 - DNA, 21 bp, Artificial Sequence
  Description of Artificial Sequence: Synthetic oligonucleotide
gctcctacttcgggtccgagt

SEQ ID NO: 45143 - DNA, 21 bp, Artificial Sequence
  Description of Artificial Sequence: Synthetic oligonucleotide
agccccaccagcgccagcctc

SEQ ID NO: 45144 - DNA, 21 bp, Artificial Sequence
  Description of Artificial Sequence: Synthetic oligonucleotide
gtccccagcagcagaagcaac

SEQ ID NO: 45145 - DNA, 21 bp, Artificial Sequence
  Description of Artificial Sequence: Synthetic oligonucleotide
acgtctacgcagaagggtcag

SEQ ID NO: 45146 - DNA, 21 bp, Artificial Sequence
  Description of Artificial Sequence: Synthetic oligonucleotide
aatcagattaatgctcctcgt

SEQ ID NO: 45147 - DNA, 21 bp, Artificial Sequence
  Description of Artificial Sequence: Synthetic oligonucleotide
agtgcgactgggtcgaggctg

SEQ ID NO: 45148 - DNA, 21 bp, Artificial Sequence
  Description of Artificial Sequence: Synthetic oligonucleotide
gtgtcttatgctcgtacggag

SEQ ID NO: 45149 - DNA, 21 bp, Artificial Sequence
  Description of Artificial Sequence: Synthetic oligonucleotide
gggcttgatcatcttcggacg

SEQ ID NO: 45150 - DNA, 21 bp, Artificial Sequence
  Description of Artificial Sequence: Synthetic oligonucleotide
ctgcctcatacttctcagtcg

SEQ ID NO: 45151 - DNA, 21 bp, Artificial Sequence
  Description of Artificial Sequence: Synthetic oligonucleotide
agccccaacaaaaccagcctc

SEQ ID NO: 45152 - DNA, 21 bp, Artificial Sequence
  Description of Artificial Sequence: Synthetic oligonucleotide
ggcctcgccaccctcagcggc

SEQ ID NO: 45153 - DNA, 21 bp, Artificial Sequence
  Description of Artificial Sequence: Synthetic oligonucleotide
agctacggcaaagaaagcagc

SEQ ID NO: 45154 - DNA, 21 bp, Artificial Sequence
  Description of Artificial Sequence: Synthetic oligonucleotide
cagggtcgtgcgaatgggtct

SEQ ID NO: 45155 - DNA, 21 bp, Artificial Sequence
  Description of Artificial Sequence: Synthetic oligonucleotide
cccggcggcaccaccaaaggc

SEQ ID NO: 45156 - DNA, 21 bp, Artificial Sequence
  Description of Artificial Sequence: Synthetic oligonucleotide
agccccatgagaagccaagtc

SEQ ID NO: 45157 - DNA, 21 bp, Artificial Sequence
  Description of Artificial Sequence: Synthetic oligonucleotide
gctcttggtggtaagcatgtt

SEQ ID NO: 45158 - DNA, 21 bp, Artificial Sequence
  Description of Artificial Sequence: Synthetic oligonucleotide
ttcgccaacaccgccaacaga

SEQ ID NO: 45159 - DNA, 21 bp, Artificial Sequence
  Description of Artificial Sequence: Synthetic oligonucleotide
tttggggatcatactcgtacg

SEQ ID NO: 45160 - DNA, 21 bp, Artificial Sequence
  Description of Artificial Sequence: Synthetic oligonucleotide
aatgtggttgggactggtgct

SEQ ID NO: 45161 - DNA, 21 bp, Artificial Sequence
  Description of Artificial Sequence: Synthetic oligonucleotide
tctaggtcgcctggtacgtcg

SEQ ID NO: 45162 - DNA, 21 bp, Artificial Sequence
  Description of Artificial Sequence: Synthetic oligonucleotide
cccgtcccctacagagccgac

SEQ ID NO: 45163 - DNA, 21 bp, Artificial Sequence
  Description of Artificial Sequence: Synthetic oligonucleotide
ccgacgaagggggctaatgcg

SEQ ID NO: 45164 - DNA, 21 bp, Artificial Sequence
  Description of Artificial Sequence: Synthetic oligonucleotide
actacgaatacggtgtctcgg

SEQ ID NO: 45165 - DNA, 21 bp, Artificial Sequence
  Description of Artificial Sequence: Synthetic oligonucleotide
aacggcagcgccagaatgacc

SEQ ID NO: 45166 - DNA, 21 bp, Artificial Sequence
  Description of Artificial Sequence: Synthetic oligonucleotide
caaaacagcaaaggctacgtc

SEQ ID NO: 45167 - DNA, 21 bp, Artificial Sequence
  Description of Artificial Sequence: Synthetic oligonucleotide
agtgggggtactcctgggcgt

SEQ ID NO: 45168 - DNA, 21 bp, Artificial Sequence
  Description of Artificial Sequence: Synthetic oligonucleotide
aattcgtctggtcattatcag

SEQ ID NO: 45169 - DNA, 21 bp, Artificial Sequence
  Description of Artificial Sequence: Synthetic oligonucleotide
aacgtccccagcatcagcaga

SEQ ID NO: 45170 - DNA, 21 bp, Artificial Sequence
  Description of Artificial Sequence: Synthetic oligonucleotide
gggcttgctggtagtttgcag

SEQ ID NO: 45171 - DNA, 21 bp, Artificial Sequence
  Description of Artificial Sequence: Synthetic oligonucleotide
catcagagtagttcgagttcg

SEQ ID NO: 45172 - DNA, 21 bp, Artificial Sequence
  Description of Artificial Sequence: Synthetic oligonucleotide
gatcgtgcggggaagcagagt

SEQ ID NO: 45173 - DNA, 21 bp, Artificial Sequence
  Description of Artificial Sequence: Synthetic oligonucleotide
aatgcgcttcctgtgactcag

SEQ ID NO: 45174 - DNA, 21 bp, Artificial Sequence
  Description of Artificial Sequence: Synthetic oligonucleotide
gaagtccacgccaaaaacaac

SEQ ID NO: 45175 - DNA, 21 bp, Artificial Sequence
  Description of Artificial Sequence: Synthetic oligonucleotide
ggcaccagcggcggcatcgtc

SEQ ID NO: 45176 - DNA, 21 bp, Artificial Sequence
  Description of Artificial Sequence: Synthetic oligonucleotide
tggggcggcagcgccgacaga

SEQ ID NO: 45177 - DNA, 21 bp, Artificial Sequence
  Description of Artificial Sequence: Synthetic oligonucleotide
aatcagtctgctaagtcgacg

SEQ ID NO: 45178 - DNA, 21 bp, Artificial Sequence
  Description of Artificial Sequence: Synthetic oligonucleotide
gcttcttctagtcgtcctagt

SEQ ID NO: 45179 - DNA, 21 bp, Artificial Sequence
  Description of Artificial Sequence: Synthetic oligonucleotide
gatcgtcttgatcattctagg

SEQ ID NO: 45180 - DNA, 21 bp, Artificial Sequence
  Description of Artificial Sequence: Synthetic oligonucleotide
tctattccgacgtctgctagg

SEQ ID NO: 45181 - DNA, 21 bp, Artificial Sequence
  Description of Artificial Sequence: Synthetic oligonucleotide
actaggaatggtcagggtgat

SEQ ID NO: 45182 - DNA, 21 bp, Artificial Sequence
  Description of Artificial Sequence: Synthetic oligonucleotide
ccctacagcagacccgcccaa

SEQ ID NO: 45183 - DNA, 21 bp, Artificial Sequence
  Description of Artificial Sequence: Synthetic oligonucleotide
gttggttctgggcgtgctaat

SEQ ID NO: 45184 - DNA, 21 bp, Artificial Sequence
  Description of Artificial Sequence: Synthetic oligonucleotide
aatcgggttggttcgatttct

SEQ ID NO: 45185 - DNA, 21 bp, Artificial Sequence
  Description of Artificial Sequence: Synthetic oligonucleotide
ggtacgaatcctgggacgttg

SEQ ID NO: 45186 - DNA, 21 bp, Artificial Sequence
  Description of Artificial Sequence: Synthetic oligonucleotide
aacggcaaccacggcctcatc

SEQ ID NO: 45187 - DNA, 21 bp, Artificial Sequence
  Description of Artificial Sequence: Synthetic oligonucleotide
cccggcatcaacaccaacagc

SEQ ID NO: 45188 - DNA, 21 bp, Artificial Sequence
  Description of Artificial Sequence: Synthetic oligonucleotide
agacccagcagcgtcaaagac

SEQ ID NO: 45189 - DNA, 21 bp, Artificial Sequence
  Description of Artificial Sequence: Synthetic oligonucleotide
tgtttgggttcgaataatttg

SEQ ID NO: 45190 - DNA, 21 bp, Artificial Sequence
  Description of Artificial Sequence: Synthetic oligonucleotide
gaccccgacaccagaaaaagc

SEQ ID NO: 45191 - DNA, 21 bp, Artificial Sequence
  Description of Artificial Sequence: Synthetic oligonucleotide
cagttgcagcctagggttgcg

SEQ ID NO: 45192 - DNA, 21 bp, Artificial Sequence
  Description of Artificial Sequence: Synthetic oligonucleotide
cgtcctgcttcgacgcatacg

SEQ ID NO: 45193 - DNA, 21 bp, Artificial Sequence
  Description of Artificial Sequence: Synthetic oligonucleotide
gcttcgtcgtctaagtctgtt

SEQ ID NO: 45194 - DNA, 21 bp, Artificial Sequence
  Description of Artificial Sequence: Synthetic oligonucleotide
cacaccagacccaacagcatg

SEQ ID NO: 45195 - DNA, 21 bp, Artificial Sequence
  Description of Artificial Sequence: Synthetic oligonucleotide
aacggcgtcccccaacccaaa

SEQ ID NO: 45196 - DNA, 21 bp, Artificial Sequence
  Description of Artificial Sequence: Synthetic oligonucleotide
tctcatgctagtagtactgcg

SEQ ID NO: 45197 - DNA, 21 bp, Artificial Sequence
  Description of Artificial Sequence: Synthetic oligonucleotide
accggcgaaagacaaagcagc

SEQ ID NO: 45198 - DNA, 21 bp, Artificial Sequence
  Description of Artificial Sequence: Synthetic oligonucleotide
ccgactcatgcttcgagtctt

SEQ ID NO: 45199 - DNA, 21 bp, Artificial Sequence
  Description of Artificial Sequence: Synthetic oligonucleotide
gttgcgtcttctccgcttcgt

SEQ ID NO: 45200 - DNA, 21 bp, Artificial Sequence
  Description of Artificial Sequence: Synthetic oligonucleotide
cgtcctggggggaaggatggg

SEQ ID NO: 45201 - DNA, 21 bp, Artificial Sequence
  Description of Artificial Sequence: Synthetic oligonucleotide
agggatacgaatcggtttggt

SEQ ID NO: 45202 - DNA, 21 bp, Artificial Sequence
  Description of Artificial Sequence: Synthetic oligonucleotide
gcgccttcttcgcagcttttg

SEQ ID NO: 45203 - DNA, 21 bp, Artificial Sequence
  Description of Artificial Sequence: Synthetic oligonucleotide
gttaatacgaatctggttggt

SEQ ID NO: 45204 - DNA, 21 bp, Artificial Sequence
  Description of Artificial Sequence: Synthetic oligonucleotide
agcagccccagccacatggcc

SEQ ID NO: 45205 - DNA, 21 bp, Artificial Sequence
  Description of Artificial Sequence: Synthetic oligonucleotide
agccacgccaccgccgccacc

SEQ ID NO: 45206 - DNA, 21 bp, Artificial Sequence
  Description of Artificial Sequence: Synthetic oligonucleotide
gatgctggttctcgttcttct

SEQ ID NO: 45207 - DNA, 21 bp, Artificial Sequence
  Description of Artificial Sequence: Synthetic oligonucleotide
cacggcaccacccccgccaga

SEQ ID NO: 45208 - DNA, 21 bp, Artificial Sequence
  Description of Artificial Sequence: Synthetic oligonucleotide
gaacccctcagcaaacaaagc

SEQ ID NO: 45209 - DNA, 21 bp, Artificial Sequence
  Description of Artificial Sequence: Synthetic oligonucleotide
cgtcatcaggggacgctgcag

SEQ ID NO: 45210 - DNA, 21 bp, Artificial Sequence
  Description of Artificial Sequence: Synthetic oligonucleotide
cccctcaccaccagacccagc

SEQ ID NO: 45211 - DNA, 21 bp, Artificial Sequence
  Description of Artificial Sequence: Synthetic oligonucleotide
agcagcagcacccacgccgtc

SEQ ID NO: 45212 - DNA, 21 bp, Artificial Sequence
  Description of Artificial Sequence: Synthetic oligonucleotide
cagacgcatgcgcctacgtcg

SEQ ID NO: 45213 - DNA, 21 bp, Artificial Sequence
  Description of Artificial Sequence: Synthetic oligonucleotide
aacggtactggacagaatcaa

SEQ ID NO: 45214 - DNA, 21 bp, Artificial Sequence
  Description of Artificial Sequence: Synthetic oligonucleotide
tcgtatggtcatcctggtgct

SEQ ID NO: 45215 - DNA, 21 bp, Artificial Sequence
  Description of Artificial Sequence: Synthetic oligonucleotide
cagtcggggtcgaagcctggg

SEQ ID NO: 45216 - DNA, 21 bp, Artificial Sequence
  Description of Artificial Sequence: Synthetic oligonucleotide
tcgtttgctaagtctgcgtcg

SEQ ID NO: 45217 - DNA, 21 bp, Artificial Sequence
  Description of Artificial Sequence: Synthetic oligonucleotide
aggccggtggggggtctggcg

SEQ ID NO: 45218 - DNA, 21 bp, Artificial Sequence
  Description of Artificial Sequence: Synthetic oligonucleotide
ctcgtcagccacacccacggc

SEQ ID NO: 45219 - DNA, 21 bp, Artificial Sequence
  Description of Artificial Sequence: Synthetic oligonucleotide
ttgacgccttctagtacggtt

SEQ ID NO: 45220 - DNA, 21 bp, Artificial Sequence
  Description of Artificial Sequence: Synthetic oligonucleotide
agcatccacagcaccaaagcc

SEQ ID NO: 45221 - DNA, 21 bp, Artificial Sequence
  Description of Artificial Sequence: Synthetic oligonucleotide
ggcgtcatcaacaacgaaaga

SEQ ID NO: 45222 - DNA, 21 bp, Artificial Sequence
  Description of Artificial Sequence: Synthetic oligonucleotide
gatcctctgaggaatagtaat

SEQ ID NO: 45223 - DNA, 21 bp, Artificial Sequence
  Description of Artificial Sequence: Synthetic oligonucleotide
aatgctaatcagaatcagatg

SEQ ID NO: 45224 - DNA, 21 bp, Artificial Sequence
  Description of Artificial Sequence: Synthetic oligonucleotide
agccaagtcagccacagcgtc

SEQ ID NO: 45225 - DNA, 21 bp, Artificial Sequence
  Description of Artificial Sequence: Synthetic oligonucleotide
gggcatagtactgtgggtagt

SEQ ID NO: 45226 - DNA, 21 bp, Artificial Sequence
  Description of Artificial Sequence: Synthetic oligonucleotide
agattcagcgacagcaacacc

SEQ ID NO: 45227 - DNA, 21 bp, Artificial Sequence
  Description of Artificial Sequence: Synthetic oligonucleotide
acggggacggctactcttcgt

SEQ ID NO: 45228 - DNA, 21 bp, Artificial Sequence
  Description of Artificial Sequence: Synthetic oligonucleotide
ggccaaggcgtcagagccatg

SEQ ID NO: 45229 - DNA, 21 bp, Artificial Sequence
  Description of Artificial Sequence: Synthetic oligonucleotide
gccggcagccacaaaggcgtc

SEQ ID NO: 45230 - DNA, 21 bp, Artificial Sequence
  Description of Artificial Sequence: Synthetic oligonucleotide
tctgggaatagtcataatggg

SEQ ID NO: 45231 - DNA, 21 bp, Artificial Sequence
  Description of Artificial Sequence: Synthetic oligonucleotide
tcgggtgcgactacgcctagg

SEQ ID NO: 45232 - DNA, 21 bp, Artificial Sequence
  Description of Artificial Sequence: Synthetic oligonucleotide
actggtatgcgtcctcctggg

SEQ ID NO: 45233 - DNA, 21 bp, Artificial Sequence
  Description of Artificial Sequence: Synthetic oligonucleotide
aaacaaacccacagcggcagc

SEQ ID NO: 45234 - DNA, 21 bp, Artificial Sequence
  Description of Artificial Sequence: Synthetic oligonucleotide
caaggccaaaccgccatgaga

SEQ ID NO: 45235 - DNA, 21 bp, Artificial Sequence
  Description of Artificial Sequence: Synthetic oligonucleotide
ggccaagtcaaccacaccacc

SEQ ID NO: 45236 - DNA, 21 bp, Artificial Sequence
  Description of Artificial Sequence: Synthetic oligonucleotide
ggcaacagcaccagactcctc

SEQ ID NO: 45237 - DNA, 21 bp, Artificial Sequence
  Description of Artificial Sequence: Synthetic oligonucleotide
catgtgcatgatgggaggact

SEQ ID NO: 45238 - DNA, 21 bp, Artificial Sequence
  Description of Artificial Sequence: Synthetic oligonucleotide
ccgttgggtaatcgtccttct

SEQ ID NO: 45239 - DNA, 21 bp, Artificial Sequence
  Description of Artificial Sequence: Synthetic oligonucleotide
gagcctgttacttctaagtct

SEQ ID NO: 45240 - DNA, 21 bp, Artificial Sequence
  Description of Artificial Sequence: Synthetic oligonucleotide
cataagactacgtctatggct

SEQ ID NO: 45241 - DNA, 21 bp, Artificial Sequence
  Description of Artificial Sequence: Synthetic oligonucleotide
accaccgccggcagcagatgc

SEQ ID NO: 45242 - DNA, 21 bp, Artificial Sequence
  Description of Artificial Sequence: Synthetic oligonucleotide
gatattccttctagggctgcg

SEQ ID NO: 45243 - DNA, 21 bp, Artificial Sequence
  Description of Artificial Sequence: Synthetic oligonucleotide
agggaggatactaagatgcat

SEQ ID NO: 45244 - DNA, 21 bp, Artificial Sequence
  Description of Artificial Sequence: Synthetic oligonucleotide
aggctgaatgatcgtcctggg

SEQ ID NO: 45245 - DNA, 21 bp, Artificial Sequence
  Description of Artificial Sequence: Synthetic oligonucleotide
cgtacgggtcattatcaggat

SEQ ID NO: 45246 - DNA, 21 bp, Artificial Sequence
  Description of Artificial Sequence: Synthetic oligonucleotide
aactgttctggacagaatcaa

SEQ ID NO: 45247 - DNA, 21 bp, Artificial Sequence
  Description of Artificial Sequence: Synthetic oligonucleotide
aacgtttctggacagaatcaa

SEQ ID NO: 45248 - DNA, 21 bp, Artificial Sequence
  Description of Artificial Sequence: Synthetic oligonucleotide
agcagaaccaacgccaccgcc

SEQ ID NO: 45249 - DNA, 21 bp, Artificial Sequence
  Description of Artificial Sequence: Synthetic oligonucleotide
agcagcaccaacagacccacc

SEQ ID NO: 45250 - DNA, 21 bp, Artificial Sequence
  Description of Artificial Sequence: Synthetic oligonucleotide
gtcggcctccaaagccccgaa

SEQ ID NO: 45251 - DNA, 21 bp, Artificial Sequence
  Description of Artificial Sequence: Synthetic oligonucleotide
gggattgggtcggctgcggtt

SEQ ID NO: 45252 - DNA, 21 bp, Artificial Sequence
  Description of Artificial Sequence: Synthetic oligonucleotide
tcgagtccgtctaagatggcg

SEQ ID NO: 45253 - DNA, 21 bp, Artificial Sequence
  Description of Artificial Sequence: Synthetic oligonucleotide
cgggctgagacgaatgctatt

SEQ ID NO: 45254 - DNA, 21 bp, Artificial Sequence
  Description of Artificial Sequence: Synthetic oligonucleotide
tgccccggcagcagcgcctac

SEQ ID NO: 45255 - DNA, 21 bp, Artificial Sequence
  Description of Artificial Sequence: Synthetic oligonucleotide
gagaatattagtaggtctcat

SEQ ID NO: 45256 - DNA, 21 bp, Artificial Sequence
  Description of Artificial Sequence: Synthetic oligonucleotide
agcagcagcagccaccccctc

SEQ ID NO: 45257 - DNA, 21 bp, Artificial Sequence
  Description of Artificial Sequence: Synthetic oligonucleotide
gagccgacgcatccgcggggt

SEQ ID NO: 45258 - DNA, 21 bp, Artificial Sequence
  Description of Artificial Sequence: Synthetic oligonucleotide
catgcgcatagtaatgttggt

SEQ ID NO: 45259 - DNA, 21 bp, Artificial Sequence
  Description of Artificial Sequence: Synthetic oligonucleotide
ggcaaccccagccccctcgtc

SEQ ID NO: 45260 - DNA, 21 bp, Artificial Sequence
  Description of Artificial Sequence: Synthetic oligonucleotide
caaagcaacaccagccccacc

SEQ ID NO: 45261 - DNA, 21 bp, Artificial Sequence
  Description of Artificial Sequence: Synthetic oligonucleotide
ggcatccaaaaccccacctgc

SEQ ID NO: 45262 - DNA, 21 bp, Artificial Sequence
  Description of Artificial Sequence: Synthetic oligonucleotide
caaagcgaccacagaagcctc

SEQ ID NO: 45263 - DNA, 21 bp, Artificial Sequence
  Description of Artificial Sequence: Synthetic oligonucleotide
caagaaaccagaggcaacagc

SEQ ID NO: 45264 - DNA, 21 bp, Artificial Sequence
  Description of Artificial Sequence: Synthetic oligonucleotide
tctatggctcctgctggtctg

SEQ ID NO: 45265 - DNA, 21 bp, Artificial Sequence
  Description of Artificial Sequence: Synthetic oligonucleotide
accggcaccggcagcttccac

SEQ ID NO: 45266 - DNA, 21 bp, Artificial Sequence
  Description of Artificial Sequence: Synthetic oligonucleotide
aagtcttgtaagggtatggtt

SEQ ID NO: 45267 - DNA, 21 bp, Artificial Sequence
  Description of Artificial Sequence: Synthetic oligonucleotide
gggggtgataataagcttacg

SEQ ID NO: 45268 - DNA, 21 bp, Artificial Sequence
  Description of Artificial Sequence: Synthetic oligonucleotide
gatcgggctgatgcgaattct

SEQ ID NO: 45269 - DNA, 21 bp, Artificial Sequence
  Description of Artificial Sequence: Synthetic oligonucleotide
gcccccagcgccagacccagc

SEQ ID NO: 45270 - DNA, 21 bp, Artificial Sequence
  Description of Artificial Sequence: Synthetic oligonucleotide
ggttatgggtctaaggttagt

SEQ ID NO: 45271 - DNA, 21 bp, Artificial Sequence
  Description of Artificial Sequence: Synthetic oligonucleotide
agttctgctaagagttcgctt

SEQ ID NO: 45272 - DNA, 21 bp, Artificial Sequence
  Description of Artificial Sequence: Synthetic oligonucleotide
tttgtttcggctcgtagtggt

SEQ ID NO: 45273 - DNA, 21 bp, Artificial Sequence
  Description of Artificial Sequence: Synthetic oligonucleotide
cccaacggcagccccctcagc

SEQ ID NO: 45274 - DNA, 21 bp, Artificial Sequence
  Description of Artificial Sequence: Synthetic oligonucleotide
aagaatagtagtggtagtacg

SEQ ID NO: 45275 - DNA, 21 bp, Artificial Sequence
  Description of Artificial Sequence: Synthetic oligonucleotide
aatatgcgtgctagtacggag

SEQ ID NO: 45276 - DNA, 21 bp, Artificial Sequence
  Description of Artificial Sequence: Synthetic oligonucleotide
gacggttctggacagaatcaa

SEQ ID NO: 45277 - DNA, 21 bp, Artificial Sequence
  Description of Artificial Sequence: Synthetic oligonucleotide
tgcatcaccaaaaacctcgcc

SEQ ID NO: 45278 - DNA, 21 bp, Artificial Sequence
  Description of Artificial Sequence: Synthetic oligonucleotide
ggggctctgaatagtcgtggg

SEQ ID NO: 45279 - DNA, 21 bp, Artificial Sequence
  Description of Artificial Sequence: Synthetic oligonucleotide
taccaagtccccctcgccaaa

SEQ ID NO: 45280 - DNA, 21 bp, Artificial Sequence
  Description of Artificial Sequence: Synthetic oligonucleotide
acgccgacgctgtctcatact

SEQ ID NO: 45281 - DNA, 21 bp, Artificial Sequence
  Description of Artificial Sequence: Synthetic oligonucleotide
aacggttgtggacagaatcaa

SEQ ID NO: 45282 - DNA, 21 bp, Artificial Sequence
  Description of Artificial Sequence: Synthetic oligonucleotide
catattacgtcgaatcatgcg

SEQ ID NO: 45283 - DNA, 21 bp, Artificial Sequence
  Description of Artificial Sequence: Synthetic oligonucleotide
aggggtaaggaggagagggat

SEQ ID NO: 45284 - DNA, 21 bp, Artificial Sequence
  Description of Artificial Sequence: Synthetic oligonucleotide
aacggttctggagagaatcaa

SEQ ID NO: 45285 - DNA, 21 bp, Artificial Sequence
  Description of Artificial Sequence: Synthetic oligonucleotide
ccggcggctatgtctagtgtt

SEQ ID NO: 45286 - DNA, 21 bp, Artificial Sequence
  Description of Artificial Sequence: Synthetic oligonucleotide
agtgttggtacgtcggggctt

SEQ ID NO: 45287 - DNA, 21 bp, Artificial Sequence
  Description of Artificial Sequence: Synthetic oligonucleotide
acgcagcggtcgcagactgcg

SEQ ID NO: 45288 - DNA, 21 bp, Artificial Sequence
  Description of Artificial Sequence: Synthetic oligonucleotide
aatctgggtcagaatctgtct

SEQ ID NO: 45289 - DNA, 21 bp, Artificial Sequence
  Description of Artificial Sequence: Synthetic oligonucleotide
tgccccagcaccaaaagctgc

SEQ ID NO: 45290 - DNA, 21 bp, Artificial Sequence
  Description of Artificial Sequence: Synthetic oligonucleotide
tctccgacgagtcctatgaat

SEQ ID NO: 45291 - DNA, 21 bp, Artificial Sequence
  Description of Artificial Sequence: Synthetic oligonucleotide
aataagacgatgtcttctacg

SEQ ID NO: 45292 - DNA, 21 bp, Artificial Sequence
  Description of Artificial Sequence: Synthetic oligonucleotide
tcgtattctagtaaggagacg

SEQ ID NO: 45293 - DNA, 21 bp, Artificial Sequence
  Description of Artificial Sequence: Synthetic oligonucleotide
cctgtgcagcattcgagtaat

SEQ ID NO: 45294 - DNA, 21 bp, Artificial Sequence
  Description of Artificial Sequence: Synthetic oligonucleotide
ctcggcatcgccaaaatcggc

SEQ ID NO: 45295 - DNA, 21 bp, Artificial Sequence
  Description of Artificial Sequence: Synthetic oligonucleotide
aataggtcgaaggagtctgcg

SEQ ID NO: 45296 - DNA, 21 bp, Artificial Sequence
  Description of Artificial Sequence: Synthetic oligonucleotide
ccgcctcatgatgggcagcgt

SEQ ID NO: 45297 - DNA, 21 bp, Artificial Sequence
  Description of Artificial Sequence: Synthetic oligonucleotide
cacggcgtcaacaaaaccgaa

SEQ ID NO: 45298 - DNA, 21 bp, Artificial Sequence
  Description of Artificial Sequence: Synthetic oligonucleotide
gaccaagtcagccacaaactc

SEQ ID NO: 45299 - DNA, 21 bp, Artificial Sequence
  Description of Artificial Sequence: Synthetic oligonucleotide
aatagtgcgaataagactccg

SEQ ID NO: 45300 - DNA, 21 bp, Artificial Sequence
  Description of Artificial Sequence: Synthetic oligonucleotide
atgccccaccccagcagcaaa

SEQ ID NO: 45301 - DNA, 21 bp, Artificial Sequence
  Description of Artificial Sequence: Synthetic oligonucleotide
tctcatggtcctcagattact

SEQ ID NO: 45302 - DNA, 21 bp, Artificial Sequence
  Description of Artificial Sequence: Synthetic oligonucleotide
gaaggcggcaccagaaactgc

SEQ ID NO: 45303 - DNA, 21 bp, Artificial Sequence
  Description of Artificial Sequence: Synthetic oligonucleotide
gagacgaggccggcgatttgt

SEQ ID NO: 45304 - DNA, 21 bp, Artificial Sequence
  Description of Artificial Sequence: Synthetic oligonucleotide
aggcctcatgataatgataat

SEQ ID NO: 45305 - DNA, 21 bp, Artificial Sequence
  Description of Artificial Sequence: Synthetic oligonucleotide
cggacgtctgagcatgatagg

SEQ ID NO: 45306 - DNA, 21 bp, Artificial Sequence
  Description of Artificial Sequence: Synthetic oligonucleotide
accggcagcagcagcagccaa

SEQ ID NO: 45307 - DNA, 21 bp, Artificial Sequence
  Description of Artificial Sequence: Synthetic oligonucleotide
ttcgccagcagacccgtccaa

SEQ ID NO: 45308 - DNA, 21 bp, Artificial Sequence
  Description of Artificial Sequence: Synthetic oligonucleotide
ggggctcttcatacgagggat

SEQ ID NO: 45309 - DNA, 21 bp, Artificial Sequence
  Description of Artificial Sequence: Synthetic oligonucleotide
atgccgagtcagagggatggt

SEQ ID NO: 45310 - DNA, 21 bp, Artificial Sequence
  Description of Artificial Sequence: Synthetic oligonucleotide
gctatggggtcgagtctgtct

SEQ ID NO: 45311 - DNA, 21 bp, Artificial Sequence
  Description of Artificial Sequence: Synthetic oligonucleotide
gctatgtctgcttctcggaat

SEQ ID NO: 45312 - DNA, 21 bp, Artificial Sequence
  Description of Artificial Sequence: Synthetic oligonucleotide
gttagtacgactcctgctttg

SEQ ID NO: 45313 - DNA, 21 bp, Artificial Sequence
  Description of Artificial Sequence: Synthetic oligonucleotide
ggcaacaccggcagctaccaa

SEQ ID NO: 45314 - DNA, 21 bp, Artificial Sequence
  Description of Artificial Sequence: Synthetic oligonucleotide
aacagaaaacacaccagcacc

SEQ ID NO: 45315 - DNA, 21 bp, Artificial Sequence
  Description of Artificial Sequence: Synthetic oligonucleotide
ggcaacatcagcaccagcagc

SEQ ID NO: 45316 - DNA, 21 bp, Artificial Sequence
  Description of Artificial Sequence: Synthetic oligonucleotide
agcatccaaagcgccgccgcc

SEQ ID NO: 45317 - DNA, 21 bp, Artificial Sequence
  Description of Artificial Sequence: Synthetic oligonucleotide
aacgattctggacagaatcaa

SEQ ID NO: 45318 - DNA, 21 bp, Artificial Sequence
  Description of Artificial Sequence: Synthetic oligonucleotide
aatacttctacgaatggtatt

SEQ ID NO: 45319 - DNA, 21 bp, Artificial Sequence
  Description of Artificial Sequence: Synthetic oligonucleotide
atgagcacccacagcagcggc

SEQ ID NO: 45320 - DNA, 21 bp, Artificial Sequence
  Description of Artificial Sequence: Synthetic oligonucleotide
aacggttctggacagaagcaa

SEQ ID NO: 45321 - DNA, 21 bp, Artificial Sequence
  Description of Artificial Sequence: Synthetic oligonucleotide
tcgtttacgggtaatacggtg

SEQ ID NO: 45322 - DNA, 21 bp, Artificial Sequence
  Description of Artificial Sequence: Synthetic oligonucleotide
gaactcgccgcccccagcaaa

SEQ ID NO: 45323 - DNA, 21 bp, Artificial Sequence
  Description of Artificial Sequence: Synthetic oligonucleotide
ttcagcaacaacggcagccac

SEQ ID NO: 45324 - DNA, 21 bp, Artificial Sequence
  Description of Artificial Sequence: Synthetic oligonucleotide
ctcaccgccgtcagccccaaa

SEQ ID NO: 45325 - DNA, 21 bp, Artificial Sequence
  Description of Artificial Sequence: Synthetic oligonucleotide
aacgccagcaccgccaacatg

SEQ ID NO: 45326 - DNA, 21 bp, Artificial Sequence
  Description of Artificial Sequence: Synthetic oligonucleotide
cacaccgacaccagcgccgtc

SEQ ID NO: 45327 - DNA, 21 bp, Artificial Sequence
  Description of Artificial Sequence: Synthetic oligonucleotide
agcggcacccaaacctggagc

SEQ ID NO: 45328 - DNA, 21 bp, Artificial Sequence
  Description of Artificial Sequence: Synthetic oligonucleotide
aacggttctggacagaatgaa

SEQ ID NO: 45329 - DNA, 21 bp, Artificial Sequence
  Description of Artificial Sequence: Synthetic oligonucleotide
agttatccgcagcagagtgcg

SEQ ID NO: 45330 - DNA, 21 bp, Artificial Sequence
  Description of Artificial Sequence: Synthetic oligonucleotide
ccgatgggtactgggaggggc

SEQ ID NO: 45331 - DNA, 21 bp, Artificial Sequence
  Description of Artificial Sequence: Synthetic oligonucleotide
ggcggcgtccccagcagactc

SEQ ID NO: 45332 - DNA, 21 bp, Artificial Sequence
  Description of Artificial Sequence: Synthetic oligonucleotide
ggcgtcaacaccggcacccaa

SEQ ID NO: 45333 - DNA, 21 bp, Artificial Sequence
  Description of Artificial Sequence: Synthetic oligonucleotide
ctcaaccaacacagcagcctc

SEQ ID NO: 45334 - DNA, 21 bp, Artificial Sequence
  Description of Artificial Sequence: Synthetic oligonucleotide
tcgcgtgagtcgagtccgctt

SEQ ID NO: 45335 - DNA, 21 bp, Artificial Sequence
  Description of Artificial Sequence: Synthetic oligonucleotide
aacggttctggacagaatcca

SEQ ID NO: 45336 - DNA, 21 bp, Artificial Sequence
  Description of Artificial Sequence: Synthetic oligonucleotide
agcgacgtcagactcagcggc

SEQ ID NO: 45337 - DNA, 21 bp, Artificial Sequence
  Description of Artificial Sequence: Synthetic oligonucleotide
cagggttcgagtaagacgact

SEQ ID NO: 45338 - DNA, 21 bp, Artificial Sequence
  Description of Artificial Sequence: Synthetic oligonucleotide
aacggttctggacagaataaa

SEQ ID NO: 45339 - DNA, 21 bp, Artificial Sequence
  Description of Artificial Sequence: Synthetic oligonucleotide
accagcagcaccaccagcctc

SEQ ID NO: 45340 - DNA, 21 bp, Artificial Sequence
  Description of Artificial Sequence: Synthetic oligonucleotide
ggcacccaaaaacaaaccagc

SEQ ID NO: 45341 - DNA, 21 bp, Artificial Sequence
  Description of Artificial Sequence: Synthetic oligonucleotide
aacggttctgtacagaatcaa

SEQ ID NO: 45342 - DNA, 21 bp, Artificial Sequence
  Description of Artificial Sequence: Synthetic oligonucleotide
acttctcggcagtcttttgtg

SEQ ID NO: 45343 - DNA, 21 bp, Artificial Sequence
  Description of Artificial Sequence: Synthetic oligonucleotide
aactggtctggacagaatcaa

SEQ ID NO: 45344 - DNA, 21 bp, Artificial Sequence
  Description of Artificial Sequence: Synthetic oligonucleotide
aacggttctggacagagtcaa

SEQ ID NO: 45345 - DNA, 21 bp, Artificial Sequence
  Description of Artificial Sequence: Synthetic oligonucleotide
atgactactcagttgaatagt

SEQ ID NO: 45346 - DNA, 21 bp, Artificial Sequence
  Description of Artificial Sequence: Synthetic oligonucleotide
ccgattcatccgtcgagtggg

SEQ ID NO: 45347 - DNA, 21 bp, Artificial Sequence
  Description of Artificial Sequence: Synthetic oligonucleotide
gagtctcctaatcttcattcg

SEQ ID NO: 45348 - DNA, 21 bp, Artificial Sequence
  Description of Artificial Sequence: Synthetic oligonucleotide
ttttctcagcattcttctaat

SEQ ID NO: 45349 - DNA, 21 bp, Artificial Sequence
  Description of Artificial Sequence: Synthetic oligonucleotide
gttcattatagtactactaat

SEQ ID NO: 45350 - DNA, 21 bp, Artificial Sequence
  Description of Artificial Sequence: Synthetic oligonucleotide
tgtgcgacgtcttcgaggaag

SEQ ID NO: 45351 - DNA, 21 bp, Artificial Sequence
  Description of Artificial Sequence: Synthetic oligonucleotide
cccgtcagagaaggcagcatc

SEQ ID NO: 45352 - DNA, 21 bp, Artificial Sequence
  Description of Artificial Sequence: Synthetic oligonucleotide
aacggttctggaccgaatcaa

SEQ ID NO: 45353 - DNA, 21 bp, Artificial Sequence
  Description of Artificial Sequence: Synthetic oligonucleotide
tcgagtccggctaatatggcg

SEQ ID NO: 45354 - DNA, 21 bp, Artificial Sequence
  Description of Artificial Sequence: Synthetic oligonucleotide
gaaggcctcaacaccagcaga

SEQ ID NO: 45355 - DNA, 21 bp, Artificial Sequence
  Description of Artificial Sequence: Synthetic oligonucleotide
caagtcaccgtcagacccgtc

SEQ ID NO: 45356 - DNA, 21 bp, Artificial Sequence
  Description of Artificial Sequence: Synthetic oligonucleotide
tatgggagtgagtcgaataag

SEQ ID NO: 45357 - DNA, 21 bp, Artificial Sequence
  Description of Artificial Sequence: Synthetic oligonucleotide
aatagtgaggcgaggcttagt

SEQ ID NO: 45358 - DNA, 21 bp, Artificial Sequence
  Description of Artificial Sequence: Synthetic oligonucleotide
ggccccagccaacacgtcatc

SEQ ID NO: 45359 - DNA, 21 bp, Artificial Sequence
  Description of Artificial Sequence: Synthetic oligonucleotide
tacggttctggacagaatcaa

SEQ ID NO: 45360 - DNA, 21 bp, Artificial Sequence
  Description of Artificial Sequence: Synthetic oligonucleotide
actcagggtgcgagtaatttg

SEQ ID NO: 45361 - DNA, 21 bp, Artificial Sequence
  Description of Artificial Sequence: Synthetic oligonucleotide
atgaccctcagcggccaaacc

SEQ ID NO: 45362 - DNA, 21 bp, Artificial Sequence
  Description of Artificial Sequence: Synthetic oligonucleotide
gacagacacaacaccaccagc

SEQ ID NO: 45363 - DNA, 21 bp, Artificial Sequence
  Description of Artificial Sequence: Synthetic oligonucleotide
atcatcggcagcagacacacc

SEQ ID NO: 45364 - DNA, 21 bp, Artificial Sequence
  Description of Artificial Sequence: Synthetic oligonucleotide
agagacagaagcgtcgccagc

SEQ ID NO: 45365 - DNA, 21 bp, Artificial Sequence
  Description of Artificial Sequence: Synthetic oligonucleotide
gccggcaacatgccccacagc

SEQ ID NO: 45366 - DNA, 21 bp, Artificial Sequence
  Description of Artificial Sequence: Synthetic oligonucleotide
ggcggcagcgccaccgccgtc

SEQ ID NO: 45367 - DNA, 21 bp, Artificial Sequence
  Description of Artificial Sequence: Synthetic oligonucleotide
accagcagcggcggcctcacc

SEQ ID NO: 45368 - DNA, 21 bp, Artificial Sequence
  Description of Artificial Sequence: Synthetic oligonucleotide
ggcaccagccccagcaccatg

SEQ ID NO: 45369 - DNA, 21 bp, Artificial Sequence
  Description of Artificial Sequence: Synthetic oligonucleotide
gccaacggcaccaaaagcagc

SEQ ID NO: 45370 - DNA, 21 bp, Artificial Sequence
  Description of Artificial Sequence: Synthetic oligonucleotide
agcagcctcaaacccaccctc

SEQ ID NO: 45371 - DNA, 21 bp, Artificial Sequence
  Description of Artificial Sequence: Synthetic oligonucleotide
gttggttcggatagttctacg

SEQ ID NO: 45372 - DNA, 21 bp, Artificial Sequence
  Description of Artificial Sequence: Synthetic oligonucleotide
aacggttatggacagaatcaa

SEQ ID NO: 45373 - DNA, 21 bp, Artificial Sequence
  Description of Artificial Sequence: Synthetic oligonucleotide
agagacgccaccagcatcggc

SEQ ID NO: 45374 - DNA, 21 bp, Artificial Sequence
  Description of Artificial Sequence: Synthetic oligonucleotide
accggttctggacagaatcaa

SEQ ID NO: 45375 - DNA, 21 bp, Artificial Sequence
  Description of Artificial Sequence: Synthetic oligonucleotide
aacggttttggacagaatcaa

SEQ ID NO: 45376 - DNA, 21 bp, Artificial Sequence
  Description of Artificial Sequence: Synthetic oligonucleotide
acgcagtcttctactcggtcg

SEQ ID NO: 45377 - DNA, 21 bp, Artificial Sequence
  Description of Artificial Sequence: Synthetic oligonucleotide
aatacgacgggtcatgctggg

SEQ ID NO: 45378 - DNA, 21 bp, Artificial Sequence
  Description of Artificial Sequence: Synthetic oligonucleotide
ttggggactagtactattttg

SEQ ID NO: 45379 - DNA, 21 bp, Artificial Sequence
  Description of Artificial Sequence: Synthetic oligonucleotide
cccagcacccccaccatcaaa

SEQ ID NO: 45380 - DNA, 21 bp, Artificial Sequence
  Description of Artificial Sequence: Synthetic oligonucleotide
cacctcgcctacgacaacaac

SEQ ID NO: 45381 - DNA, 21 bp, Artificial Sequence
  Description of Artificial Sequence: Synthetic oligonucleotide
gaaaacgaccacaacgtcaga

SEQ ID NO: 45382 - DNA, 21 bp, Artificial Sequence
  Description of Artificial Sequence: Synthetic oligonucleotide
gccaccggcagccccagcaaa

SEQ ID NO: 45383 - DNA, 21 bp, Artificial Sequence
  Description of Artificial Sequence: Synthetic oligonucleotide
aattctagtcataattcgcct

SEQ ID NO: 45384 - DNA, 21 bp, Artificial Sequence
  Description of Artificial Sequence: Synthetic oligonucleotide
ggctggaaccacgaaaacgtc

SEQ ID NO: 45385 - DNA, 21 bp, Artificial Sequence
  Description of Artificial Sequence: Synthetic oligonucleotide
gtcagcagccccagaatgagc

SEQ ID NO: 45386 - DNA, 21 bp, Artificial Sequence
  Description of Artificial Sequence: Synthetic oligonucleotide
aacggtgctggacagaatcaa

SEQ ID NO: 45387 - DNA, 21 bp, Artificial Sequence
  Description of Artificial Sequence: Synthetic oligonucleotide
cccagccacaaccccaccaac

SEQ ID NO: 45388 - DNA, 21 bp, Artificial Sequence
  Description of Artificial Sequence: Synthetic oligonucleotide
ggcagccaccaccccagcggc

SEQ ID NO: 45389 - DNA, 21 bp, Artificial Sequence
  Description of Artificial Sequence: Synthetic oligonucleotide
aacggcagaggcagcgacgtc

SEQ ID NO: 45390 - DNA, 21 bp, Artificial Sequence
  Description of Artificial Sequence: Synthetic oligonucleotide
gccggcagcaacagccaaggc

SEQ ID NO: 45391 - DNA, 21 bp, Artificial Sequence
  Description of Artificial Sequence: Synthetic oligonucleotide
aacggttctggacagattcaa

SEQ ID NO: 45392 - DNA, 21 bp, Artificial Sequence
  Description of Artificial Sequence: Synthetic oligonucleotide
ggtggtcttgatcatcatgct

SEQ ID NO: 45393 - DNA, 21 bp, Artificial Sequence
  Description of Artificial Sequence: Synthetic oligonucleotide
ttcagcagcaaaaccagcccc

SEQ ID NO: 45394 - DNA, 21 bp, Artificial Sequence
  Description of Artificial Sequence: Synthetic oligonucleotide
aacggttctagacagaatcaa

SEQ ID NO: 45395 - DNA, 21 bp, Artificial Sequence
  Description of Artificial Sequence: Synthetic oligonucleotide
actattaagtctgttactaat

SEQ ID NO: 45396 - DNA, 21 bp, Artificial Sequence
  Description of Artificial Sequence: Synthetic oligonucleotide
cacagcacccccagcaccatg

SEQ ID NO: 45397 - DNA, 21 bp, Artificial Sequence
  Description of Artificial Sequence: Synthetic oligonucleotide
aacagttctggacagaatcaa

SEQ ID NO: 45398 - DNA, 21 bp, Artificial Sequence
  Description of Artificial Sequence: Synthetic oligonucleotide
aacggttctggaacgaatcaa

SEQ ID NO: 45399 - DNA, 21 bp, Artificial Sequence
  Description of Artificial Sequence: Synthetic oligonucleotide
aagaatcatacggcggttcag

SEQ ID NO: 45400 - DNA, 21 bp, Artificial Sequence
  Description of Artificial Sequence: Synthetic oligonucleotide
caccacgacgccagccccaac

SEQ ID NO: 45401 - DNA, 21 bp, Artificial Sequence
  Description of Artificial Sequence: Synthetic oligonucleotide
ggggggtcgaattctaggctg

SEQ ID NO: 45402 - DNA, 21 bp, Artificial Sequence
  Description of Artificial Sequence: Synthetic oligonucleotide
cacagagaagccagactcctc

SEQ ID NO: 45403 - DNA, 21 bp, Artificial Sequence
  Description of Artificial Sequence: Synthetic oligonucleotide
agtgcgagtggtaataggtgt

SEQ ID NO: 45404 - DNA, 21 bp, Artificial Sequence
  Description of Artificial Sequence: Synthetic oligonucleotide
ggtccgaatcagtcgggtcgg

SEQ ID NO: 45405 - DNA, 21 bp, Artificial Sequence
  Description of Artificial Sequence: Synthetic oligonucleotide
gatgcgactaagaatcattcg

SEQ ID NO: 45406 - DNA, 21 bp, Artificial Sequence
  Description of Artificial Sequence: Synthetic oligonucleotide
gacagcaccctcggccaaagc

SEQ ID NO: 45407 - DNA, 21 bp, Artificial Sequence
  Description of Artificial Sequence: Synthetic oligonucleotide
ggtacggggactcctaggact

SEQ ID NO: 45408 - DNA, 21 bp, Artificial Sequence
  Description of Artificial Sequence: Synthetic oligonucleotide
aacggttctggacataatcaa

SEQ ID NO: 45409 - DNA, 21 bp, Artificial Sequence
  Description of Artificial Sequence: Synthetic oligonucleotide
aacggttctggacagaatcga

SEQ ID NO: 45410 - DNA, 21 bp, Artificial Sequence
  Description of Artificial Sequence: Synthetic oligonucleotide
aattcgagttcgtctaatcat

SEQ ID NO: 45411 - DNA, 21 bp, Artificial Sequence
  Description of Artificial Sequence: Synthetic oligonucleotide
aacggttctggacagtatcaa

SEQ ID NO: 45412 - DNA, 21 bp, Artificial Sequence
  Description of Artificial Sequence: Synthetic oligonucleotide
gaaagaagcaccagaatgcaa

SEQ ID NO: 45413 - DNA, 21 bp, Artificial Sequence
  Description of Artificial Sequence: Synthetic oligonucleotide
cagttgccggctttgcagggt

SEQ ID NO: 45414 - DNA, 21 bp, Artificial Sequence
  Description of Artificial Sequence: Synthetic oligonucleotide
atggctcatgatggttatcgg

SEQ ID NO: 45415 - DNA, 21 bp, Artificial Sequence
  Description of Artificial Sequence: Synthetic oligonucleotide
tacagcaaacaaaacctcacc

SEQ ID NO: 45416 - DNA, 21 bp, Artificial Sequence
  Description of Artificial Sequence: Synthetic oligonucleotide
agtgcttctaatgttagtagg

SEQ ID NO: 45417 - DNA, 21 bp, Artificial Sequence
  Description of Artificial Sequence: Synthetic oligonucleotide
aacggttctgaacagaatcaa

SEQ ID NO: 45418 - DNA, 21 bp, Artificial Sequence
  Description of Artificial Sequence: Synthetic oligonucleotide
gctacggtgggtcatatgact

SEQ ID NO: 45419 - DNA, 21 bp, Artificial Sequence
  Description of Artificial Sequence: Synthetic oligonucleotide
agtacttctagttcggctagt

SEQ ID NO: 45420 - DNA, 21 bp, Artificial Sequence
  Description of Artificial Sequence: Synthetic oligonucleotide
gccagcagagacagcagcgtc

SEQ ID NO: 45421 - DNA, 21 bp, Artificial Sequence
  Description of Artificial Sequence: Synthetic oligonucleotide
tctgagcatcagcctctttcg

SEQ ID NO: 45422 - DNA, 21 bp, Artificial Sequence
  Description of Artificial Sequence: Synthetic oligonucleotide
atccaacaaggcagcagaacc

SEQ ID NO: 45423 - DNA, 21 bp, Artificial Sequence
  Description of Artificial Sequence: Synthetic oligonucleotide
atgctccccagcgtcagcggc

SEQ ID NO: 45424 - DNA, 21 bp, Artificial Sequence
  Description of Artificial Sequence: Synthetic oligonucleotide
tcttctacgagtagtccgtat

SEQ ID NO: 45425 - DNA, 21 bp, Artificial Sequence
  Description of Artificial Sequence: Synthetic oligonucleotide
atgaggcaggatacgagtaag

SEQ ID NO: 45426 - DNA, 21 bp, Artificial Sequence
  Description of Artificial Sequence: Synthetic oligonucleotide
tctaatgtgtcgaagccgcag

SEQ ID NO: 45427 - DNA, 21 bp, Artificial Sequence
  Description of Artificial Sequence: Synthetic oligonucleotide
accagaggcagccccctcatg

SEQ ID NO: 45428 - DNA, 21 bp, Artificial Sequence
  Description of Artificial Sequence: Synthetic oligonucleotide
caccccaccagccccgccatg

SEQ ID NO: 45429 - DNA, 21 bp, Artificial Sequence
  Description of Artificial Sequence: Synthetic oligonucleotide
aacggttctggactgaatcaa

SEQ ID NO: 45430 - DNA, 21 bp, Artificial Sequence
  Description of Artificial Sequence: Synthetic oligonucleotide
aaaagagacgcccacaccgcc

SEQ ID NO: 45431 - DNA, 21 bp, Artificial Sequence
  Description of Artificial Sequence: Synthetic oligonucleotide
cttcttggggatacgaagccg

SEQ ID NO: 45432 - DNA, 21 bp, Artificial Sequence
  Description of Artificial Sequence: Synthetic oligonucleotide
tacagcagagtccaaagcgaa

SEQ ID NO: 45433 - DNA, 21 bp, Artificial Sequence
  Description of Artificial Sequence: Synthetic oligonucleotide
gacgtcctcagcaaaagacaa

SEQ ID NO: 45434 - DNA, 21 bp, Artificial Sequence
  Description of Artificial Sequence: Synthetic oligonucleotide
agagacggcaccccccccacc

SEQ ID NO: 45435 - DNA, 21 bp, Artificial Sequence
  Description of Artificial Sequence: Synthetic oligonucleotide
agccaccccagcagcttcggc

SEQ ID NO: 45436 - DNA, 21 bp, Artificial Sequence
  Description of Artificial Sequence: Synthetic oligonucleotide
agcggcgccagcagcaacagc

SEQ ID NO: 45437 - DNA, 21 bp, Artificial Sequence
  Description of Artificial Sequence: Synthetic oligonucleotide
tctgcttctcgttctgcgtat

SEQ ID NO: 45438 - DNA, 21 bp, Artificial Sequence
  Description of Artificial Sequence: Synthetic oligonucleotide
agcaccagcaacggcaccctc

SEQ ID NO: 45439 - DNA, 21 bp, Artificial Sequence
  Description of Artificial Sequence: Synthetic oligonucleotide
agccacacccccaaactcgtc

SEQ ID NO: 45440 - DNA, 21 bp, Artificial Sequence
  Description of Artificial Sequence: Synthetic oligonucleotide
ggccaagtcagccaaatgaaa

SEQ ID NO: 45441 - DNA, 21 bp, Artificial Sequence
  Description of Artificial Sequence: Synthetic oligonucleotide
agcagccacagcgacaccaga

SEQ ID NO: 45442 - DNA, 21 bp, Artificial Sequence
  Description of Artificial Sequence: Synthetic oligonucleotide
caaagcgtcaaaacccccgaa

SEQ ID NO: 45443 - DNA, 21 bp, Artificial Sequence
  Description of Artificial Sequence: Synthetic oligonucleotide
gacagaaaccacgccgccgaa

SEQ ID NO: 45444 - DNA, 21 bp, Artificial Sequence
  Description of Artificial Sequence: Synthetic oligonucleotide
cctttgaatactcatcagtcg

SEQ ID NO: 45445 - DNA, 21 bp, Artificial Sequence
  Description of Artificial Sequence: Synthetic oligonucleotide
agcagcagcgcccacagactc

SEQ ID NO: 45446 - DNA, 21 bp, Artificial Sequence
  Description of Artificial Sequence: Synthetic oligonucleotide
aacgacagaggccaaaacggc

SEQ ID NO: 45447 - DNA, 21 bp, Artificial Sequence
  Description of Artificial Sequence: Synthetic oligonucleotide
ggtcagacgatgtctacgatg

SEQ ID NO: 45448 - DNA, 21 bp, Artificial Sequence
  Description of Artificial Sequence: Synthetic oligonucleotide
actaggcatatgcagcttagt

SEQ ID NO: 45449 - DNA, 21 bp, Artificial Sequence
  Description of Artificial Sequence: Synthetic oligonucleotide
accggttctgaacagaatcaa

SEQ ID NO: 45450 - DNA, 21 bp, Artificial Sequence
  Description of Artificial Sequence: Synthetic oligonucleotide
aacggttctggacataagcaa

SEQ ID NO: 45451 - DNA, 21 bp, Artificial Sequence
  Description of Artificial Sequence: Synthetic oligonucleotide
attttgggtaataagtctagt

SEQ ID NO: 45452 - DNA, 21 bp, Artificial Sequence
  Description of Artificial Sequence: Synthetic oligonucleotide
accggcgcccaaagcaccatg

SEQ ID NO: 45453 - DNA, 21 bp, Artificial Sequence
  Description of Artificial Sequence: Synthetic oligonucleotide
gtccccgtcaccggcctcagc

SEQ ID NO: 45454 - DNA, 21 bp, Artificial Sequence
  Description of Artificial Sequence: Synthetic oligonucleotide
gttcaggggagtcttccgtcg

SEQ ID NO: 45455 - DNA, 21 bp, Artificial Sequence
  Description of Artificial Sequence: Synthetic oligonucleotide
tctgattctcggtcgggtatg

SEQ ID NO: 45456 - DNA, 21 bp, Artificial Sequence
  Description of Artificial Sequence: Synthetic oligonucleotide
cacgaaagaggccaaaacggc

SEQ ID NO: 45457 - DNA, 21 bp, Artificial Sequence
  Description of Artificial Sequence: Synthetic oligonucleotide
ttgaatggtagtgctactgct

SEQ ID NO: 45458 - DNA, 21 bp, Artificial Sequence
  Description of Artificial Sequence: Synthetic oligonucleotide
agaatggccagacccgccgtc

SEQ ID NO: 45459 - DNA, 21 bp, Artificial Sequence
  Description of Artificial Sequence: Synthetic oligonucleotide
aggagtatttctagtgcggtg

SEQ ID NO: 45460 - DNA, 21 bp, Artificial Sequence
  Description of Artificial Sequence: Synthetic oligonucleotide
aatgagcaggctaagttgacg

SEQ ID NO: 45461 - DNA, 21 bp, Artificial Sequence
  Description of Artificial Sequence: Synthetic oligonucleotide
agcagcggcggcaacatgagc

SEQ ID NO: 45462 - DNA, 21 bp, Artificial Sequence
  Description of Artificial Sequence: Synthetic oligonucleotide
aacgccaccagccccagaaaa

SEQ ID NO: 45463 - DNA, 21 bp, Artificial Sequence
  Description of Artificial Sequence: Synthetic oligonucleotide
tcgggtgcggggtcggctggg

SEQ ID NO: 45464 - DNA, 21 bp, Artificial Sequence
  Description of Artificial Sequence: Synthetic oligonucleotide
atcggttctggacagaatcaa

SEQ ID NO: 45465 - DNA, 21 bp, Artificial Sequence
  Description of Artificial Sequence: Synthetic oligonucleotide
aataatggggcttcggttgtg

SEQ ID NO: 45466 - DNA, 21 bp, Artificial Sequence
  Description of Artificial Sequence: Synthetic oligonucleotide
tctgggtctgggattatgatg

SEQ ID NO: 45467 - DNA, 21 bp, Artificial Sequence
  Description of Artificial Sequence: Synthetic oligonucleotide
cccacccacagcagcagagac

SEQ ID NO: 45468 - DNA, 21 bp, Artificial Sequence
  Description of Artificial Sequence: Synthetic oligonucleotide
aacaggtctggacagaatcaa

SEQ ID NO: 45469 - DNA, 21 bp, Artificial Sequence
  Description of Artificial Sequence: Synthetic oligonucleotide
agcaacagcgacagagccaac

SEQ ID NO: 45470 - DNA, 21 bp, Artificial Sequence
  Description of Artificial Sequence: Synthetic oligonucleotide
gttaatgagaatcgggtttcg

SEQ ID NO: 45471 - DNA, 21 bp, Artificial Sequence
  Description of Artificial Sequence: Synthetic oligonucleotide
gggcgggagagtaatctgagt

SEQ ID NO: 45472 - DNA, 21 bp, Artificial Sequence
  Description of Artificial Sequence: Synthetic oligonucleotide
cagggtcctaagaatgctgat

SEQ ID NO: 45473 - DNA, 21 bp, Artificial Sequence
  Description of Artificial Sequence: Synthetic oligonucleotide
agtaataatggtactcagaag

SEQ ID NO: 45474 - DNA, 21 bp, Artificial Sequence
  Description of Artificial Sequence: Synthetic oligonucleotide
gatgcgcgtactatggcggct

SEQ ID NO: 45475 - protein, 7 aa, Artificial Sequence
  Description of Artificial Sequence: Synthetic peptide
SINTKTN

SEQ ID NO: 45476 - protein, 7 aa, Artificial Sequence
  Description of Artificial Sequence: Synthetic peptide
KGPGQMG

SEQ ID NO: 45477 - protein, 7 aa, Artificial Sequence
  Description of Artificial Sequence: Synthetic peptide
TLAVPFK

SEQ ID NO: 45478 - protein, 7 aa, Artificial Sequence
  Description of Artificial Sequence: Synthetic peptide
NLAGRYA

SEQ ID NO: 45479 - protein, 7 aa, Artificial Sequence
  Description of Artificial Sequence: Synthetic peptide
ILGTGTS

SEQ ID NO: 45480 - protein, 7 aa, Artificial Sequence
  Description of Artificial Sequence: Synthetic peptide
QSSQTPR

SEQ ID NO: 45481 - protein, 7 aa, Artificial Sequence
  Description of Artificial Sequence: Synthetic peptide
  MOD_RES (1)..(1): Any amino acid other than T, S, or N
XLAVPFK

SEQ ID NO: 45482 - protein, 7 aa, Artificial Sequence
  Description of Artificial Sequence: Synthetic peptide
  MOD_RES (1)..(1): Any amino acid
  MOD_RES (2)..(2): Any amino acid other than L or V
XXAVPFK

SEQ ID NO: 45483 - protein, 7 aa, Artificial Sequence
  Description of Artificial Sequence: Synthetic peptide
  MOD_RES (1)..(2): Any amino acid
  MOD_RES (3)..(3): Any amino acid other than A, S, Q, P, and T
XXXVPFK

SEQ ID NO: 45484 - protein, 7 aa, Artificial Sequence
  Description of Artificial Sequence: Synthetic peptide
  MOD_RES (1)..(3): Any amino acid
  MOD_RES (4)..(4): Any amino acid other than V, T, Q, N, L, and M
XXXXPFK

SEQ ID NO: 45485 - protein, 7 aa, Artificial Sequence
  Description of Artificial Sequence: Synthetic peptide
  MOD_RES (4)..(4): Any amino acid other than V, T, Q, N, L, and M
TLAXPFK

SEQ ID NO: 45486 - protein, 7 aa, Artificial Sequence
  Description of Artificial Sequence: Synthetic peptide
PKKKRKV

SEQ ID NO: 45487 - DNA, 28 bp, Artificial Sequence
  Description of Artificial Sequence: Synthetic oligonucleotide
cttccagttcagctacgagtttgagaac

SEQ ID NO: 45488 - DNA, 32 bp, Artificial Sequence
  Description of Artificial Sequence: Synthetic oligonucleotide
caagtaaaacctctacaaatgtggtaaaatcg

SEQ ID NO: 45489 - DNA, 44 bp, Artificial Sequence
  Description of Artificial Sequence: Synthetic oligonucleotide
acgctcttccgatctaatacttgtactatctctctagaactatt

SEQ ID NO: 45490 - DNA, 37 bp, Artificial Sequence
  Description of Artificial Sequence: Synthetic oligonucleotide
tgtgctcttccgatctcacactgaattttagcgtttg

SEQ ID NO: 45491 - protein, 7 aa, Artificial Sequence
  Description of Artificial Sequence: Synthetic peptide
QAVRTSL

SEQ ID NO: 45492 - DNA, 10 bp, Artificial Sequence
  Description of Artificial Sequence: Synthetic oligonucleotide
  modified_base (5)..(6): a, c, t, g, unknown or other
  modified_base (8)..(9): a, c, t, g, unknown or other
tattnnknnk

SEQ ID NO: 45493 - DNA, 10 bp, Artificial Sequence
  Description of Artificial Sequence: Synthetic oligonucleotide
  modified_base (1)..(2): a, c, t, g, unknown or other
  modified_base (4)..(5): a, c, t, g, unknown or other
nnknnkcaac

SEQ ID NO: 45494 - DNA, 10 bp, Artificial Sequence
  Description of Artificial Sequence: Synthetic oligonucleotide
tattaacggt

SEQ ID NO: 45495 - DNA, 10 bp, Artificial Sequence
  Description of Artificial Sequence: Synthetic oligonucleotide
aatcaacaac

SEQ ID NO: 45496 - protein, 11 aa, Artificial Sequence
  Description of Artificial Sequence: Synthetic peptide
TINGSGQNQQT

SEQ ID NO: 45497 - protein, 11 aa, Artificial Sequence
  Description of Artificial Sequence: Synthetic peptide
TINGSGQNQQT

SEQ ID NO: 45498 - protein, 11 aa, Artificial Sequence
  Description of Artificial Sequence: Synthetic peptide
TILQTSSPGQT

SEQ ID NO: 45499 - protein, 11 aa, Artificial Sequence
  Description of Artificial Sequence: Synthetic peptide
TIQQGKQSVQT

SEQ ID NO: 45500 - protein, 11 aa, Artificial Sequence
  Description of Artificial Sequence: Synthetic peptide
TISINTKTNQT

SEQ ID NO: 45501 - protein, 11 aa, Artificial Sequence
  Description of Artificial Sequence: Synthetic peptide
TISNGTKQTQT

SEQ ID NO: 45502 - protein, 11 aa, Artificial Sequence
  Description of Artificial Sequence: Synthetic peptide
TIGSGKTAAQT

SEQ ID NO: 45503 - protein, 11 aa, Artificial Sequence
  Description of Artificial Sequence: Synthetic peptide
TIMGDKPTRQT

SEQ ID NO: 45504 - protein, 11 aa, Artificial Sequence
  Description of Artificial Sequence: Synthetic peptide
TIDGAATKNQT

SEQ ID NO: 45505 - protein, 11 aa, Artificial Sequence
  Description of Artificial Sequence: Synthetic peptide
TIQPSGGNTQT

SEQ ID NO: 45506 - protein, 11 aa, Artificial Sequence
  Description of Artificial Sequence: Synthetic peptide
TIERGANTKQT

SEQ ID NO: 45507 - protein, 11 aa, Artificial Sequence
  Description of Artificial Sequence: Synthetic peptide
TITTGGHSSQT

SEQ ID NO: 45508 - protein, 11 aa, Artificial Sequence
  Description of Artificial Sequence: Synthetic peptide
TIGTTKTSEQT

SEQ ID NO: 45509 - protein, 11 aa, Artificial Sequence
  Description of Artificial Sequence: Synthetic peptide
TIGTGTSVLQT

SEQ ID NO: 45510 - protein, 11 aa, Artificial Sequence
  Description of Artificial Sequence: Synthetic peptide
TINQSGTKGQT

SEQ ID NO: 45511 - protein, 11 aa, Artificial Sequence
  Description of Artificial Sequence: Synthetic peptide
TIDGQSSKSQT

SEQ ID NO: 45512 - protein, 11 aa, Artificial Sequence
  Description of Artificial Sequence: Synthetic peptide
TIKGPGQMGQT

SEQ ID NO: 45513 - protein, 11 aa, Artificial Sequence
  Description of Artificial Sequence: Synthetic peptide
TIGTPSKAGQT

SEQ ID NO: 45514-46363 - skipped (850 entries)

SEQ ID NO: 46364 - DNA, 21 bp, Artificial Sequence
  Description of Artificial Sequence: Synthetic oligonucleotide
gacggcgccgccaccaaaaac

SEQ ID NO: 46365 - DNA, 21 bp, Artificial Sequence
  Description of Artificial Sequence: Synthetic oligonucleotide
gacggccaaagcagcaaaagc

SEQ ID NO: 46366 - DNA, 21 bp, Artificial Sequence
  Description of Artificial Sequence: Synthetic oligonucleotide
ctccaaaccagcagccccggc

SEQ ID NO: 46367 - DNA, 21 bp, Artificial Sequence
  Description of Artificial Sequence: Synthetic oligonucleotide
cagcagggtaagcagtcggtt

SEQ ID NO: 46368 - DNA, 21 bp, Artificial Sequence
  Description of Artificial Sequence: Synthetic oligonucleotide
tctattaatactaagacgaat

SEQ ID NO: 46369 - DNA, 21 bp, Artificial Sequence
  Description of Artificial Sequence: Synthetic oligonucleotide
tctaatgggactaagcagact

SEQ ID NO: 46370 - DNA, 21 bp, Artificial Sequence
  Description of Artificial Sequence: Synthetic oligonucleotide
gggtcgggtaagactgctgcg

SEQ ID NO: 46371 - DNA, 21 bp, Artificial Sequence
  Description of Artificial Sequence: Synthetic oligonucleotide
atgggggataagccgacgagg

SEQ ID NO: 46372 - DNA, 21 bp, Artificial Sequence
  Description of Artificial Sequence: Synthetic oligonucleotide
cagcctagtgggggtaatact

SEQ ID NO: 46373 - DNA, 21 bp, Artificial Sequence
  Description of Artificial Sequence: Synthetic oligonucleotide
gaaagaggcgccaacaccaaa

SEQ ID NO: 46374 - DNA, 21 bp, Artificial Sequence
  Description of Artificial Sequence: Synthetic oligonucleotide
accaccggcggccacagcagc

SEQ ID NO: 46375 - DNA, 21 bp, Artificial Sequence
  Description of Artificial Sequence: Synthetic oligonucleotide
ggtacgacgaagactagtgag

SEQ ID NO: 46376 - DNA, 21 bp, Artificial Sequence
  Description of Artificial Sequence: Synthetic oligonucleotide
ggtactgggactagtgttctt

SEQ ID NO: 46377 - DNA, 21 bp, Artificial Sequence
  Description of Artificial Sequence: Synthetic oligonucleotide
aatcagagtgggactaagggt

SEQ ID NO: 46378 - DNA, 21 bp, Artificial Sequence
  Description of Artificial Sequence: Synthetic oligonucleotide
aagggtcctggtcagatgggt

SEQ ID NO: 46379 - DNA, 21 bp, Artificial Sequence
  Description of Artificial Sequence: Synthetic oligonucleotide
ggcacccccagcaaagccggc

SEQ ID NO: 46380 - DNA, 21 bp, Artificial Sequence
  Description of Artificial Sequence: Synthetic oligonucleotide
aaggataatactcctgggagg

SEQ ID NO: 46381 - DNA, 21 bp, Artificial Sequence
  Description of Artificial Sequence: Synthetic oligonucleotide
aacaacctccccagaaacctc

SEQ ID NO: 46382 - DNA, 21 bp, Artificial Sequence
  Description of Artificial Sequence: Synthetic oligonucleotide
agagaaagcagccccagcctc

SEQ ID NO: 46383 - DNA, 21 bp, Artificial Sequence
  Description of Artificial Sequence: Synthetic oligonucleotide
cgtgttcctctttcgactatt

SEQ ID NO: 46384 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIDGAATKNQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46385 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIDGQSSKSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46386 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTILQTSSPGQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46387 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIQQGKQSVQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46388 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTISINTKTNQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46389 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTISNGTKQTQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46390 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIGSGKTAAQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46391 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIMGDKPTRQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46392 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIQPSGGNTQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46393 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIERGANTKQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46394 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTITTGGHSSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46395 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIGTTKTSEQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 46396 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTIGTGTSVLQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL
